United States Patent 11,001,841 (CCCTC-BINDING FACTOR (CTCF) RNA INTERACTOME) - sequence listing, part 3

SEQ ID NO: 5097 - DNA, 1068 bp, Homo sapiens
tgagccaagtaatgctgcctttgttttgttttttgtttttgagatagagtctcactctgtcgcccaggctggagtgcagtggtgccatctcggggctcactgcaagctccacctcccggattcactccattctcctgcctcagcctcccgagtagctgggactacaggtgcccaccaccacgcccggctaattttttgtatttttcgtagagacgaggtttcaccgtgttagccaggatggtctcgatttcctgacctcgtgatcctcctgcgtcagcctcccaaagtgctgggattacaggtgtgagccactgtgcccagcctggtttttttttttttttttttttttaggcagagtttgattcttgttgctcaggctagagtgcaatggcgcgatctcagctcactgcaacctctgcctcgagggttcaagtgattctcctgcctctgcctcccgagtagctgagattacaggcatgtgccaccacgcccaggtacttttgtatttctagtagagacggggtttctccatgctggtctcgaactgccgacctcaggtgatctgcccaccttggcctcccaaagtgttgggattataggcgtgagccaccgtgcccggcacctttgttttaatgtgtggatttttctggtggaacacatggtgttttgtcagtcttgctgggacttttaatcgctattctatggttttataccagtatctcacgagaattagaaataacattacattttcggccgggtgtggtagcttttgcctgtaatcccagcactttgggaggccgaggcgggtggatcacaaggtcaggagatcgagaccaccctggctaacacggtgaaacctcatctgtactaaaaataaaaaaataaaaaaattagctgggcgtggtggcaggcgcctatagtcccagctacttgggaggctgaggcaggagaatcacttgaaccctcaaggcggagcttgcagtgagccaagatttcgtccctgccctccagcctgggcaacagagcaagactccatctcaaaaaaataaataaataaaggaaagaaca

SEQ ID NO: 5098 - DNA, 1051 bp, Homo sapiens
tggttcattagttacatcacccccttttcttttttttttttgaaacagagtctcgctctgtcgcccaggctggagtgcagtggcgcgatctcagttcactgcaagctccacctcgcgggttcatgccattctcctgcctcagcctcccgagtagctgggactgcaggcacctgccaccacacccagctaattttttgtatttttagtagagacggggtttcaccgtgttagccaggatggtctcgatctcctgacctcgtgatccacccgcctcagcctcccaaagtgctgggattacaggcgtgagccaccgcacccggcctatatcaccccattttgtaatgcattagccatctcccaatttcatacattttgatgtatactgtatatgtaaaccctttgtacatctttaattcattaaaatgttgaacacaaaagatgaagatagagacttttgacaccctcaaattcgctgtaagagatagagcttttaatgattttgattttgattaactagttctgagtctgcaaaagtatacacttttccccgagaagaggcttgatcaaatacttagttataatttatgttacactatatcctcagtaacccccaattcccaacaaggaaatgaaattaaattcagcatgtcctgcattatccctgcattcttatagaaaatctttcggatgatccagtggttttaacttcacaaaaactgaggtttacgaataggaagcaattcaggaagcaccaatggtaaactaaaagtaggatgtcctggatatgattccaggcctatgtggaaattatcccttccctactcccactgtggcattccctcccctctttctcttttactgcttcagatctatagtagcagaggaattctaactgatgcaaactggcttcagatcccacaaggttaccacttactggctgcggtacatgggcctcatatgtaaaatggagacaataagcaataatatcttctttctcatggggttattgtgaggattcaatgaaatcctttaaaaacacttagaacattag

SEQ ID NO: 5099 - DNA, 1038 bp, Homo sapiens
tggcactgggaatctctggaatgaaatgttataagggtataggtgtggatacagttaggtatctacagctgcaaaagtagatacctaagtgaataaagaacaatcctcttttaggattatagaattttttttatccaaaaattactgaatttttaagaccaaaaatgtcaggtgatttcagcgtaagatcatactgctctctttagcagtacaggtattaaaacttgggtttatttcccagtttaactcatttaagcataacatgaaattagtattatcagatacacaagccatccgaaaatgaaaaggattagctatagcatattgccattacatatcttaaacatagaaatgtatgtgcgtgcttctttcctactggactctaattcttggtttccatcagttctacttctgccctttatattcgatgccttttcagtgctcttccaccccacttctgtttttctctggtcaccttatcatctcttctatctttatgtataaatgaattatttccctttaatatcactagttaggactgttttcttctaagttccatgctttaaagcactgggcttgcctttgcccagttaatcttatctgctttcaaatagagacctattttgggttgtttcgcaaaccaaggagatgtaggcttcagtgtaaaacgaatttgtattcccagagaccgttttgatgttggcttggcttcttagcatatgagaactctgtagaagtaatctagttggcttgatatgttttattatttgttttatttatgtaaaaatagtttccctataaaaattcaaatattatgaaatgatttaatgagtcaaactgtagttctttataatgccttctccataaatagtattaagttagcatatgttataaatatgtttatttatatgtttaccatatggatttctttttctgtgcatatactaaaaattattttcatgcaaaatggaattaaattatgatatattggcttatcttttaaaatgattgtattgtaccataatttaaacaacttcc

SEQ ID NO: 5100 - DNA, 1030 bp, Homo sapiens
acaggagactggcgtgaacctgggaggcggagcttgcagtgagccgagttcgtgccactgcactccggcctgggtgacagagcaagacactgtctcaaaaaaaaaaaaaaaaaaaaaaaaaaaaaaaaaactcatttggccgtgatcttaaattcttttatacatcattggattcaatttgctaatattttattgaggatttttgcatctgtgtttatgaaagatactgatctatagtttttttcttttcatgtttggacaggggatctatgttgcccaggctaggcgcagactcctgggttcaagtgatcctcccacttcagcctcccagtagctaggactatgagtacattccattgtgcctggcttatagttttctttcactgtgtctttgtcagattttggtattaaggtaatgctaaccttggagaagagttaggaagtatttcctctgcttctatcctctaaaacataacagaggttgggtataatttcttcctcaaatgtttagtagaattccttagtgaacccatctgggcctggtgctatctgttttggaaggttaattattgactcaatttatttagtagatataagcctattcagagccttccatttttttcttgtgcaaatttagaaatttcaaggagtttatctttttaaagtccataggatctgtagtgatgcccctttttcatttctgaaattaataatttgtgtcctctctcttttttcttagcctagctagaggcttatcagtatcattgatctttttaaacaaccagcttttggttttgttgatttttttctattttctgttttcaattttattgatttctgctctagtttatattattctgattactttgtatttaatttcctattttttttttttagtttcctaaggtggaagcttaaattactgattttaagtcttctttactaatatatgcattcgatactacaagtttcccactaagcactgctttggctgcatcacacaaattttgacaagttgtctttttatttt

SEQ ID NO: 5101 - DNA, 1031 bp, Homo sapiens
aatactttttatatttgtaagtggttgaaaaaaatcaaaagaataatgatatgttgtgacttatggaaattatatcaagttcacagggcctccttaaggagtaaacatgctctaaataagttcataactgaaacagaccagcccctacaaaatataaaagcaagtgtgatgggatcgaaaagatctgccagtaattttttttgtctacaagaaaaaaattcaacaccctgtgtagcatacaataaaaaaattgctgtacttgtggggaaaaaaagactattccataagtcaataaaaaagccatcaatagagatagactctgagatgactcagatgttgggattagcagacagtgacttcaaaatagctatcataagacatgttcgtgaacttaaatgtaaatataaatataatgaacagagaaaatctgagtgaataaatggacattttttcagataaagaaaatgaatttagaactgaaaagtataatatttgaaaagaaaaacttctgaatgaacttaaaagcaaattggaaacactaaaagactgggtcggtgaacttgagaatgttatcagtagaaattatccaagtatgaaaacaggtaggaaaaaaatgaaaaaaaaaaatagaccctcagatccctctgagacaatattaagcaagataacatatgtgtaattgtagtccccgtaaaaacaggagagaggggacattattttatgtgccgatgcacataaaaaatattagatgaaacaaaagctgaaatttttccaaaaatatagatctaagatactctgaaccccaagcaggatacccacatatacacaaaacccatcattagacacaatacagaaaatcttcagagaaactcttaaaagcagtcacagaaaaacagcatattatgtaagaggagcactgatatggatggcagccaacttcatatcagaaaaaatgctagaagtaatgccaaaaaagttcttcagactgaaaggaacttttttacattacatgatatcttatgtaaactgga

SEQ ID NO: 5102 - DNA, 1045 bp, Homo sapiens
tttttttgtttgtttgtttgttttttggttttttttttttttttagtagagacggggtttcaccatgttagccaggatggtctggatttcctgacctcgatatctacccgcctcggcctcccaaagtgctgggattacaggcgtgagccaccgcgcccggcctttcttttttttttttgagacggagttttactctgtcacccaggctggagtgaagtggctcaatcttggcccactgcagcctctgccctctgggttcaagcgattcccctgcctcagcctcctgagtagctgggattataggcgcctgccaccacgcctgtctaatttttgcatttttagtacagacgggattttgccatgttggccaggttagtctcgaactcctgacctcaggtcatccacccgccgtggcctcccatactgctaggattacaggcatgagccaccacgcccggccagaaacaatctaagaacctatttttgaatacagtatacttaatgagaagaaaaaaaggagtggtgagatgaatagattttaaggtttttttgtttttgtttttgttttttttaagatggagtctcactcttgtcgcccaggctggagtgcagtggcgcaatctcagctcactgcaacctccgcctcccagattcaagcgattctcctgcctcagccccctgagtagctgggattacaggcgcctgccaccacgcctggctaatttttgtagttttagtagagacgtggtttggccatgttggccaggctggtctctaactcctgacctcaattgatctgtccgcctcagcctcccaaagtgctgggataacaggcgtgagccaccacgtccggctgattttaagtttttaatctcagcacttgagtccaggaggtggagcccagaatcgcttgagccggagatggaggttgcagtgagccaagattgtgccactgcactccagcctggatgacagagccagactctatctcaaaaaaagaaaaaaaaaagattttaagtttttatatggggtagttatcagtttg

SEQ ID NO: 5103 - DNA, 1053 bp, Homo sapiens
tcccatatatactgcttgaatcaatattcaacaagttcagaaatcatacaaaaaaatcattattatcagctaagctctttctgtgtatttccagtccttattcatcattgcttacaacaattcactttatacagtgctggtctttatatccttttttctcattgtttttatttagtttttgagacaaatgacaatagagctcataatgtacctttgaaagtgaaagccataacatggcatgaaagtgatgtttaaatactttgcttcatcctgggatttgaaaacggaaggaagataggctctagaaataagagggaattcagcatttatacttttaaggcaaaaattatgattaaaagtttacatagtaggaagtctcatctttaactgctatattggtgtgtttactgggtcacagagaaaatatcatgttcttttgggtagaatattgaaatggaacttggtccctatgagatctagattccaggcacaatttcatcaaaggatggtgaaaaaattattttgctttgtaggaaggaataacctgcaaaatctttgagtcttggaaggtcctgttttttaaaaaatgaaaggtaatttactgtgaaaagaaacagttcctttttctttccttccttttttttttttttttttcagactgggtcttgctctgttgcccaggctggagtggtgcaatctcggctcactacaacttctgtctcccaggctcaaacaatcctcccgcctcagcctcccgactagctgggactacaggctcattccgccacacccagcttttttttttttttttttttgtatttttggcagaaatgaggtttcaccatgttgcccaggctggtctcaaactcctgagctcaggcagtccatccgcctcagcctcccaaagtgctgagattacaagtatgagccactttgcccagctcttttttttgggtgggtggggaacagtctccctctgttgtgcaggctggagtgcagtggtacaatcacagcttagctcattgcagcctcaacttcctgggctcaaatgat

SEQ ID NO: 5104 - DNA, 1195 bp, Homo sapiens
ttaagagccataaaggtacctttatgcatggatgtgaccaacacagcgtacgtgtaccctgcctgacacccaccctagggcattgcctcccctaaccatgtttactcaccctgacatctaagacatgtatgctcacttgtgttgagtaagtaaaagcaccaattccatagtttaagggcaatggaacttaattttgtaatttacaatattgcataaattatatgaaaagacaaatatgttatttaattacaaaaaaaagtcctgaatccactttcactattcagtttatacatatttgtgaaaggctcaattactattgaatcttatctatgcacaaggcaaatggacttaaaaatgaggactcaacatactaccgattccattttctttgtgaggtcatgtgttcttagtaagttataaagttaaaaattcaagttgccaagctggtgaaaagtcgtattaaaagtgtttgtgttttaaatttgatagagagcagcactaagtccccaaggaactttgtccatgatagaactgttctcttttgtgatgtccagtagggcagccaagctactagccatatgtagccatggaacatttcaaatgtggctagagtgatggaggaactgaattttgaattttatttaattttaacttgcatagtcacatgtagctagtagtcactgtattgggtagggcacagctattgaccagtcatgagctgtactgtttatttgtagaatacaattgattgtgatttattttatttatttatttattttgagatggagtttcactcattgcccaggctggggtgcaatggtactatctcggctcattgcaacctctgcctcccaggttcaagcgattctcctacctcagcctcccgaatagctggggttacaggcatgtgccaccacgcctgcctaatttttttgtatttttagtagagatgggggtttctccatgttggtcaggctggtctcgaactcccgacctcaggtgatccacccgcctcggcctcccaaagtgctgggattacaggcgtgagccaccgcagctggtcttgattgtgacttagaatgctcccaaatgagtgtggacctactaagcacagtgtacttgtcatccgaaaatgtttttcatcatccttggtatctttatcataaacatgtcttatcacctcttggatgtcaca

SEQ ID NO: 5105 - DNA, 1038 bp, Homo sapiens
ccagccccggggagatgaggcaacccagccccatgaagaggccttagagtgactttcaggctggcactgagcgtcctgccagcctgggggagatgaggcacatgtacataccctctgttgtatggctgttggctccttaacaagcttcccctcaggtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctctatttgtgtattgcgtgtctggtctcattctgac

SEQ ID NO: 5106 - DNA, 1774 bp, Homo sapiens
cagcaaggatcccatcgatgtcaactatgagaagctcaaaactgacattaaggtaacagggtcaggccttcctcaagcatcttaacctctcatcctgagagcagcggtcccaaacttccatgtgtgttaggatctcctggaaagcttgttaaaacacaggtggctggcgcccaataattcacttttctaacaagttcccggacattgctgctggtggtcctttgagaacctttgggcgtttcacgtgtagataatgcaccttgtttgcaaggcagccttccaagccagcacctcagcttggcgtacaaatttatttttgagggtcttaccaaaagttcttttttgtttgtttgtttgtttgtttcctctccttaatctagagaggagctctgtttttctaaacccttgtagcgtgaacttttagaagacttattaccggtgtccatttcagaagtggaaatgcttgatggcacctgtaataaaaacacaatgcttgcgttcatttttctctggtgctgaagtggactgtgttggcacacacagtctctgaacaccccgcttagaccaactagaggagggatttttgcctcagcttctagatggcccggtccttgagcctatctccacactcatgtgccccattgtcctcagcccattccctgcagtgttgcaggggtttgggtgggcgagagtatgttgagtctggtaccaggtgtttacatcgctaaagaaagagccttggcttctttcctaggacaaagtatagacctatgggtccaagcagggtaagacaccacatgtcatttgttttgcccctagagcaccttcctgatgggaaaactgtaggtgtggttcttcgtgaagggattcttattctctttttacaattctgaagccttttaattaaaagacagggaggtagaccagcattctaggttttctgaagtttgaatataaatatgaaaataaaacataactagtctcctccgtaatactcaggcttactgagcatagattacatcagctatttgacagatgcttgttaggcctgtgctctgagccagggataattttcattgcacatcatagctgtgacttcctctggcccattgtgttttaactcatgctgagctggactctcttccaggagccaattgcttgttctggagatgccctgttcactgacagtgaatcccacattctagcttccctgatatcccaaaacatagaattttaagacaaaaaggaaccctgagattctctagcagcccaagtagatgaagaggtggaggcttaggtaagtggagccactggcccaggatctgcccagcccacaggcctgggacacaggctctcggtcatgcccggcttcctttgaggagtgtggtgttgagctatgcattgactgagcctgagcattcctcctctgtagctctcctgggtctcttttgtgctaatcccaagattctgtttatccaggtggttgacagagattctgaagaagccgagatcatcaggaagtatgttaagaacactcatgcaaccacacacaatgcgtatgacttggaagtcatcgatgtaagaatcccttcttcccccacttccttctgtgtcctgccagctcttccctgcccactcctccaacctgggcctgggtagaaaagagcagtttatttactttaaataacccaaagaagtgactcatttgttcagcagaaaaattagtagttttttttttgtttgtttgttttttgtttttttttttgacatggag

SEQ ID NO: 5107 - DNA, 1034 bp, Homo sapiens
tattggcaaagccccagagacgatgtctcaggatacagagtgtggggcccattggtacacaggtgtctccacgcaggggctgagccaaataggcagggctgctcgcaaaagggagtgagtgccttttaaggaaggtggccccacttaacaaatggaaaatgaaggctgcagatctcatgcttcttccactgcagcttctcttgatggcaggcagttcccaagatatgagcagtagcaatatttgttggaggtgactgatctgaaagggacagcattgatttgaatgtaagtccataagttcaggagtgtgtcctttttaaaaatagtgttcaacacttgaaaactcttggttcttttccaggtgggaacccaggggtgcacttaactaactgccttggctctgggaccccagggaaggccgctgggtggggtggtcagcatgatttatgagccctcatctgcacatcagaattggatgggaattatgctatatcttcgtccagacgtgctggactgtttgaaactgggcataggggcagaggagacatggttggctaagcccagccgtaaaggaagtgagcaagaatcttcagacacactgccatccctcatggtggggtggggctacagactctggatttgggtcactggtgtcctcaggaaatcccagcaggctcctgactgctcctgttgggggcctgagggtgggctgcccggtccagctctcctgcgatcacactgcacagtgcccagctttcagagcgaaatcccctgtctcctcagatcgaccttcagaagatgcccttggggaagctgagcaaaaggcagatccaggccgcatactccatcctcagtgaggtccagcaggtaagcacagggctaccaggggcctcctggaaccctcctctggccgacttagggggtgagacctgggggtggcaggggtaacatttactcaaggttaagaaactggaagtactgaactgcacttcacgagggtttcgatttttttcagttcaataaatgacaagtgc

SEQ ID NO: 5108 - DNA, 1412 bp, Homo sapiens
agtaagtgaggaagagtcgaacacagcgctgaaaaactggatcttaacatcatcatcgctgtggttctttatgaagggaaaccagtatttgctctcagtgttgctgctttgtactgtagattcacatgcattgcgtgttctcaactaaagacggtaagctactataggttgagtctccctagtcccgaagcccaaacaaattgcctcaaaattcaacactttttgagtgacaacatgatgctcaaaggaaatgttcattggagcatttcagatttcagagttttggattagatgctcagtcagtaaatatgaagcaagtattttaaggtctgaaaggtttctggtctcaagcatctcggataagggaagctgctcaacctgtattctcatcacttcgcactgctctgtaagatgtgcatagatatctgccaaaacagaagttcaaggttcaagtatgtttggaaaaggtagggtaaaacaaagctaaacaggtttctgtgtgggtttattatgctgattaccactgtaggtcttcaggaaccagagaaatagaatacaggatttcccatacatatttgacatcagggtgttttttctttggagtgtttgttaacatcgtgctgtagaatggtttggagaaggctgccctggctcatcataccttagaaaagggggaatgttgctgataaaaacactcttgggagcattagacttggaagcaaaggagagctgtgaatgctgagggtttggaagtacacactaaatataactgtagtaatttgaagtttcagttttgttttaaacttgtattttggttttttttcctttcaatttgaacagaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtgagggccccaagctgccccctccagggccaaaagccagggacattggtggccaggttgttgtccacggaacctctccctttgtgtccctgacatggcctgttgagtgctgcagagcaggacacagaatggcaggcgctttggggtggcgggagtagtgtgtatatagatgccgagttgacagatgatgggaatgagaacaactcatttgccttctaccttccccttactttttagttacatttaacttcatgtttacatttttctgttctcctccaaggtatcaacaaatctgaaaagagaatgaaattaactcttaaaggaggagc

SEQ ID NO: 5109 - DNA, 1059 bp, Homo sapiens
aagatagaaaaggtaagatcttgggggcccagatccctgaactttatggattgcttgcaatgatgttattggctatctcaagagaaaagaagaaatgggggctttagggtgctagctcaacgtaagtgattaaaaataaagtgaagacattagtattgaccagatacgtcagtgacttccagacaggtctggtcctccttatcacggtccagttctcatgtatgtatgcatctgctcttggaaaatgttaacaaaaggagtctcttttggacccagcagtggctggggagagactgtttgtctgtgttttatggtagaattaggtataaggagtgtgtttaccctgttatgagcctccagccttctgtttaatcaaaggaacttcattaaccaggctttcccaccagttctagcccttgaaggctgacagccagtcagagaaaatggatggacacacaggtagaagggaaggcttgtgccccgcagccttctcacccttctctaatgtgacatgcacatattaattgattcatttaaggcattaattgaaagtctctgcctcccggaggtattgtacagaaaactgaggtgagccaatgggtatttagaaaagaaaaacatggaattgctgtatcttctccagctaccttcaaccaccaaaaatttaaggcaaacattaagatcctctttacctcaaggggaatgccggatggtatgtgctgctgggttactggttttatgtaatgccaggaacccctcctgctgcattctctggattgagcctcccaggcctggaactctcctgggaatatcaggcctggggactggggacctgggcaggctggcaggactggattcttgcctgtgggtttattactccttagggggtgtcatctgtaaagagactaaggaggccataggagggtgggagtggacagaaagtccctgctagtacaaaagtgctgcattgggggctgggcacggtggggtggtaggctgaggcaggagtattgcttgagtccaggagttctggaccagcccgggcaacatagtgagacc

SEQ ID NO: 5110 - DNA, 1029 bp, Homo sapiens
gagatcatgccactgcactccagcctggcaacagagcgaaactccatctcaaaaaaaaaaaaaaaaaaagattcctccatgtcttgtcgtattgatagctcatttctttttattactgaataatattccattgtctggattaccacagtttgtttattcattgacctgctgaaggacatcttgattgcttccaagttttggtgattatgaacaaagctgctagaaacacccaccatgtgcaggtttttatggggacataagttttcaactcctttgggtaatcaaggagtacaattgctggatcatgtggtaagagtatatttagttttgtaagaaactgccaagctgtctttcaaaaagctgaatcattttccattcccaccagcaatagatgagagttcgtatcattatacatctttgccagcatttggtgttatcattgttttggattttggccattccaatagatatatagtattttattattgttttaatttgcatttccctaatactgtaattatcttgaacatcttctcatacgtttatttaccatctgtatatctttggtgaaatgtcttttgcctgcccctacccccactttttttttttttttttaagactgtcttgctccgtcgcccaggctagagtgcagtggtgtgatcacagttcgctgcagccttgacctctgtctcccacctcagcctcttgagtagctgggactacaggtgcgcaccaccatgcctggctaatttttttaaattttttgtagagacagggccccaccttgttgcccagactggtctcaaactcctggttttgctctttttaaaatcacattgtttgttttcttactgttgagtcctaagagttcttggtatattttggataacagccctttgtcatatgtcttttgaaaatattttttctcagtgtgtggctggtcttccgcagagcagaagttcttaattttgtgaagtctagttaatcagttacttctttagtggattgggcttttggtgtttgtaaaaa

SEQ ID NO: 5111 - DNA, 1028 bp, Homo sapiens
tgccaccatgcccagctaattttttgtactttgtttattggcttattcatctcccccattgagaggtgtcttgtatcatgcacaaaatctctgtattttggggtccttttaaaaatttctgttccattgtctgtttaacctttttttatatgtaaacttttttcgttgttgttggagacggattctcgctctgtcacccaagctggggtgcagtggtgtgatctcggctcaccgtaagctccgcctcccaggttcatgacattcttctgtatgtagactttttttcttatagcagttttaggttcacagcaaaattgagtaaagtacagagtttccatatacccgctagccctacccaccccacacatacacagacttttgtccacaatcaacatcgccaccagagtggtccatggttatagctgatgagctacattgacacatcgttatcggagtggtccatggttataactgatgagccacattgacacatcgttatccctcgaggtctgtagtttacatgagggctcactctttgcattgtacattctgtcagttttaacaaacatacattgacatgcatgtacctttatggtagcctccagagtcctttcactgcctgggaaatctctgtgctttgcctagtcattcctccctcccctctaacctccagtaaccactgatctttttgctttctccatagtttttccttttccagaatataatatagttggaatcatacagaaggtagccttttcagattggcttctctcactagcaatgtgctcttaagattcctccatgtcgagccgggcacggtggctcacatctgtaatcccagcactttgggaggccgagcccagcagattacgaggtcaggagttcgagaccagcctggccaatatggtgaaaccctgtctctattaaaaatacaaaaattagccggtgtggtggtgtgcacctgtagtcccagctactcgggaggccgagacaggagaattggttgtactgggaggcggaggttgcag

SEQ ID NO: 5112 - DNA, 1032 bp, Homo sapiens
tcacaggaggttagagaactaaggaggaaggggagaaggctttaacccacccctctgctgtctctctctggaggaaacctcaggcagctctgtgtacttccccctctgcacacacacctcttcctgccttctctaccctgacaccaaggtctctccccagccctggtggcatcgtgcctgggttgctaataatagagaagggtgaatctgccaggcagtgaatcagaaggctgtcccagctctgttcttctgccctgatcctggcaaattcttgtgggctgattcggtaaatatccttgtgagcagaataagtctttgtgtgttctggaaactcctgctgtccctgggggtaacaccctcttggaaggatgatggggatgcctttggcctcaagatcttaggacggcgtttcaaattgctccaggcttccaagctagcctgggctctgggaggagggtttgcaggtttggagaaggagctgcttcccaggtgctcaggggatggaagtgagaatagggagggtgtggagggtacaaagagactgtttagttcttgcgtaaaagacaacacaatatggtccttccagttctttttagagctcaaaaggtgaaataagaataaagaacagcgatctgcagttttcctattatccaaaagcctactacccaattcagtggattgttttggcaacttgcttggataaacttatttagaaattatttcagaattcctccaggcagttaccctacgtcctttttaagtcaaggtgtggtataagtccattaacgaattaaaatacttccagatttctgtgttattctcaaggcacttttgctagataacaatacctcacacttggacggtgttttgtggtttgcaaagcactttcacatctgttttctcacttggttgccataataaccctgggagccgggaagggcatgtcttgttattatccctattttgcagatgaggaagccaaggtttttagaaggttgggtggcctagtcaaggtcacaccggtaggggaat

SEQ ID NO: 5113 - DNA, 1021 bp, Homo sapiens
aagtgctgcagtttccctacgaccattggattttgtttgtagtttgatattgtcttactgtcccttgaagttgtaatttgtaattctttagttttcaagagggactctacatgtttccttgtgatgatggccttgagttactcatgtgtacactgcctatttatccccattgagcccccactgcccgaacatgttgatggcattttatatagtaagctgtcagttacttaatgtacaaatattcttccattccatgtttttctcttaaaattttactttattggccaggcgcagtggctcacatctgtaatcccagcactttaggaggccaaggcgggcggatcacctgaggtcaagagattgagaccagcctggccaacatggtgaaaccccgtctctactaaaaaatacaaaaattagccaggtgtagtggtgggcacctgtaatcccagctacttgggaggctgaggcaggagaattgcttgaacctgagaggcggaggttgcggtgagccgagatagcaccactgcactccagcctgggcgaaagagctaaactccatctcaaaaataaataaataaataaaaaataaaaaaagattgtactttatttggcaataatgtttttattctgaattattctactaggtccctttatttccttgtgaaattgttcttaattgcgctggcctggaaatagagcccatatggtactggagggtgatggtttttcataatttttcttatgcaaccacccttagtgatgagtccctagaggattgaactgtgcctcattctgtggactggactttttggaaacccctttttgagcccccaggaagaaatttggctgagagctgatgcctggatgctagccagctggctgctggccatatccagccaccccagtcccctggccatctgtgcacctcggcaacagagtggcgactgacacacccaggcccagaaagccagacagactggcggctggaaacttcatggaatccttgtaattagaaatg

SEQ ID NO: 5114 - DNA, 1024 bp, Homo sapiens
tagtggatctaaaacgggatgacaccggaaacctgtggggaggacgccgtccttgtcgccccttgacagagggggcacagaggccttagagaaacaaaaataaaaatagcaattgtttgccacttccctccctaataaagtgttctctccaaacctggtttccactctatttctgaactgtttcgccccatggtgtgtaggaagccagggtaaatgtgggagtgggaggaaggggacacaggcagcaactcaaaggaaggcagaattagtagccgtctgggaaccgggggcgggggcattctagaaatgcgaagaggtcgaatagccagctgggtccggagtctcctcacctctggtgtcttagcggagcatgagtgtgtatgtatgtgtgtgtatatgtgtgtatatttatttgcgcatatgcacgtgtgtatgtgtgtgtgcatgcatgtgtgtatatgggtaagtgtgcagtgtgtgtttacgtgcatgcatgcatgtatgggtgtagatatgtgggtgtgtagataagtgtgggtgggcacatgcgtacacccactggaggggtgcgatggaagttgtgtgcagctgcgtgagcgttactgaccatcctgtggtttgctgatagctgcttaatctgggttgtgtgtttcctccctccccaagcagacactcagggtgctccgtgatgcaccgggacgctaatattttcacacctgcaatctgtattgttcttttctccttcggagagcaatattgcccttctgggtgcttaagcaggaaacacaggaccagataatttaagaggagccttaatgctcagggccagaacagacagacgggcctgaacaaggtcacaggccgtccagggagtgcagggctagggcaatgccagcccacttccttccagccgagcgctcccttcacggtgaccaccttcccttcaacgtctttgtttcccggctgtaaaatgggcatgttgcatacagctatgtaggaagtgtttgcaagtgcccaggctctg

SEQ ID NO: 5115 - DNA, 1043 bp, Homo sapiens
gttctggatccagaggctcacggaggctggaatgaaagagggcacccctgccccagtacttgatttggagcgttggattctgcacaaattgatgctcagcagttgcacggtgcagagcccagtcagctgcactgttgctatgctctcgggaggaccccgattgaccagaaggacatggtcaggagagctcggcaggggtttttctgcttagtacacgttatagagtcttagctatggaagagctctagggggaggggaagaaccctgaggtgtagtcctgggttgagtctaaactctgttacttcctatctgtgtgaccctagagaaaactttctgctcctcagttgcatcatctgtgaaatgtgactgataatacccaccttaaggctgtgagccttaaacaaggtaatgtgggaaatgcctagcacagcgtctggacatactaaatgctcgatacaatagcatggacctcagaggcagctgtggtgtcatttgttagtattttatgccgaacctgcgacctccaccattctctttgattgggtgagagtgaataagggtgtctgaggcagtgttgctgacttcttcccttggaagaggagaagtcatggggtctgggagctctttgacattgaggtttgtaggaagtgtgtgctgggggaggcttgctctgctgagcacagaagcaagatggtctgctggggagtgtggagcccgagccagccagacctgaacccacaccctcactctgtcctagaccttggcgtgggctgaacatctctgagtctcagtgtcctcatctctaacatgaggataatgagcctctctcagggggtgctgtgaagatgaaaggagataatgcagctcaagtaccgggtgcagaacaggggtggaatagaggacacccctccaccagttgtgaagagcgtttttaagtggatgccctaatcgccttcaccaattggctcgagtcacgttgtcccaagtacagctaattgtcgaagatgatgacaaaacaggcagcaggatttatttttccaggg

SEQ ID NO: 5116 - DNA, 1034 bp, Homo sapiens
[399 bp omitted]aatctctcttggtatgctgctgagttggtgggacctgggcaattacaagggaggtcactgcacccccaggcagttcccagcaagtgttttttccaatttcactgacattctttccgggctcaactcaatttgttttcaacttctctatggcaattgatgactgactgtgtaattcagcaggatctcctgtgaagtgcttcttccccagttgaataggagctggtgtttgtctaagcctctgcttatgcatgaggtataatgctttttatatgttatataatgctcttacgcgttagctatctgaatgatagatttaataaaatatacctcataatattatggggaaaggatgacgactgttatagagaggaacttgggagtatcacttctgtaatccttatctaacctgaatctgctagcaggaaactgaaaaggcctgtgtatgacaatgagataaacaattttaatctcttagcaatgtcaagtggaaaatctaactacctgccagtagtttaagaaatggctaagagattttgttgggcacaaataatcctgagacccagattgctgagccaagggtaggaaaattggttttgctatgtgttacagctgggaagtgagaaggtcactgtttg

SEQ ID NO: 5117 - DNA, 1048 bp, Homo sapiens
ttacactgtaaatataggaataaatgtagtctttataaataaagcctaaaatcggcctccaggatttttttgggttttgttgttgttttgttttttgttttggttttgcgtttttgttttttgttttttgtttttgttttttttgagacagagtctcactctgttggccaagctcgagtgcagtggcacgatcttggctcactgaaacctctgcctcccaggttcaagcaattctcctgcctcagcctcccgagtagctgggactacaggtgggtgccatcacacccagccaatttctgtatttttagtagagacggggtttcaccatgttggccaggctgctcttgaactcccgacctcaggtaatctgcccgcctcagcctcccaaagtgctgggattacaggcgtgacccaccgcgcccagcccagttcacattaggttttgtcatcacatgaatttgcatcaagcttgtgaaaaaacttttggttttcagcacttttggatttgtggaattgcagataaagataggccctaaactgcaaagatttaaagagccaagacagcccatctccttagaagtgctgaagtgaggctcccatatcactgctgatggcatgcaaacgacagactggagctggcctggcgttcttgtcaaggcccttaacgcattcattgagtttggccttttttatgtccctggttaccagctgcttgtccagtaaagatataagaggaaagaccctctcgggaatgccaaggggcatctggtgtttagagtgcctcctgctggcttcaagactagcccagctcatataaaatgtttccagaaggacagccagccaagagaggaacaggccaactatgttcagtctctacagcaagaagcacaggatcttccacagccagactcaacgatttcatgatgcaaagtcagattgaaacagcggtgctcaccatgcttccttccctccttcctagttcacctgaggaatgagacccgctcctgtcagcagtaggggctcactgggagcctcccagaccctcctg

SEQ ID NO: 5118 - DNA, 1052 bp, Homo sapiens
ggatcatgttttctggaaacataactgttcttcaagaactgaatcttgaaaattcccattagagaaggtgactggctactgagtgatagttcctgcgtaatcggaagtagttcttttatctctaaaaatagtccttggattcaaaagcttttttctatatctttgatattacattatttcatttttaaaaaatatacctgaacattgaagggaagatttttaccttgttaagaaaacaaacatgttctttttgggtgtctaaatggagataagcttgggctgcttaaaggtaaaccaataattagtatattccatggttaactgttataaggaaataaaatcagtaaaaacaaacacattatcagggaatgcttttacatggttttagatttctaaagaaacagtttcataacacgtctatttagaagctgttgtaggttcacttgttcatgttcttgcttgtttcttgctttttctatccttaatgtttttgatagatttttgccatattttgattgtgttattacataagaaaatactgaactaaactctgaaagtcttgtatctctgaaagtccaatttctccttacttattttaattaaagaataattttataaaaaagaatgatcttttgcaaatcaactatttaagtaactggcaagagtattacaaaatttaactttctaagacctaaaagtatttcattaaggattcagctctgatatcagatactattccatttgttctgtgtgcatgttttgtgaaatgtgaatccattttcatcaccttattgccttttttcatctttcttttgtttttgatagccaggtttcccttatccatcccctcatcatcactccggtctgatctcctctccgatcaactttgaacacatctatcacatgactgttaattctgctgaaaaatttctctctcctgattccataaaccctgaatattccccgtctctgcgctctgtccctggtacaccaagctttatgactctgagggtatgaacagctgagtcaggtgttaactttcactaaccatg

SEQ ID NO: 5119 - DNA, 1061 bp, Homo sapiens
tcagcaatttatccagaagacatagccaagataattgatgaaggtggctacactgaacaatacgaaattcagtttagctaaaacagacttctgtaggaagaagatgtcatctaggactttcatagctagagagaagtcaatgtctggcttcaaaggacaggctgactcttgttaggaattaatgcagcttgtggctttacgttgaagccagtactcatttaccatttgaaaaaatcctaggcccttaagagttacagtaactcggttgggcatggtggctcacacctgtaatcccagcactttgggaggctgaggcaggcagatcacctgaggtcaggagttcgagaccagcctggccaacatggagaaactctgtctctattaaaaatacaaaattagccagctgtggtggcacatgcctgtaatcccagctacttgggaggctgaggcaggagaatcgcttgaacctgggaggtggaggttgcggtgagctgagattgtgcagttgcactccagcctgggcaacaagggcgaaactccatctcaaaaaaaaaaaagaattatggtaactctactctgcctgtattttataagcagaacaacaaagtctggatggcaacacatctgtttacaggatgtcactgaaaattttaagcccactgttgagatctactgctcagaaaagtaatacttctttcaaaatattactgctcattgacaatgcacctaagtcacccaaaatctctgatggagatgtacaaggagattgatgatattttcacgtctgctaacacagcatccattctgtagcccatggataaaggagtaattttgactttcaagtctgatcatttaagaaacacatttcataaggccatagctgccacagatagttattcctctgatgaatctgggcaaaatagattgaaaaccttctgaaaaggattcaccattctagatgccattaagaacgtatgtgattcatgggaggaggtcaaaataccatcattcacaggagtttggaagaagcagattccagccctcatagatgacttttagag

SEQ ID NO: 5120 - DNA, 1007 bp, Homo sapiens
gcgagaacctgtctctataaaaaattttctttaattagccaggtgtagtggttgcatgcctgttgtcccaactacccaagaggctgaggtaggaggatcacttgagctatgatcatgccattgcactccagcctaggcaatacagtgagaccttatctctaaaaacacaaacccacacacactctcatactcatcagtggaataaatgctgtcttgtaactgaatcagataataattatgattattctaatgtagagtcagagttggaatgtctgacttttttgtgtagctctttcaataattccctttgtaaccttagtttaagtaaaccattgaatctttctttgcttgtgtcaccatttgttgatattcattctttcaacaagtgtatattgagcatctaccctattcatgtaactgtgctacagtgctttattatacattcttaacagggactagaacacttacctgaagatttctctgctttctaagtttgattcactgtcaataacttaactacttttaggaatcaaatagttcaaatataatgaaattcctttatagaactcatgttgggcaaagaaatagtatacccctggtgtttacagaatccgtctatattataacggctatataatctgaatcatggtataccagttcctcatttacgatatatgttctgtttgcttcaaaaatgttttgatttggctactatatgatagccccataggatttgggtgggattccactctacagttatttagtgtagacctttcaaaatatttggggtttaatagttaaaagtaatccgcaagctgcccccccttcccttctcccaggttacaatgcaccatatctctcggtgtacagtgaaaatgcagttgatatctttgatgtgaactccatggaatggattcagactcttcctctcaaaaaggtaatttaacattaaaatgtgggctaagccaactgagtataagtgaaaacactaaattactacatagtaa

SEQ ID NO: 5121 - DNA, 1035 bp, Homo sapiens
gcctgtgttcacagctactctagaggctgaggtaggaggatcagttcggctcaagaattcaaggctgtagtgacccgtgattgtgccactgccctacatcccagggcaagagagaaagaccttgtctcaaaaaaaaaaaagaaaagaaaagaaaagaaactgggactttttaacttacagtttatgtttaccaataacaaacaacttgttagatgcaagctagtttttagtaggttgaccatatataatccatatcacatcttggtgttttttactttgaagcaaggtttcttatgagaggggttgttacttgtgcaaatctgtaattatttaggcagtagaaaaggcctgttgatacatattcaagatgagtggttttagttatttttattatttataggaaaaccatgctgtccataatttgaggaattcttgataagtgggtcatctaaaaaccagttctgtgatcctgggcggcggggggacctttttaaatgtactactgtaaaaatacatttgaggatcttttagtagaaaaatcctaacagcttcagggaccattatgaacattttgcattaaaatgttttgcagtatggacagtaccactaatattcagcttttcctctttttttttttaacagagcattaagtaaaatgatactgaaatatagtagatgtttctaatgactgttcgtcagagtaacaccttaaagtatgtttacttaggaaaagaaaattagctaacaaaaaaaaattgcatttacttaaagatatttcttatattgaatttataatatctctgctacttatgtatgtttattagcttttgctgcattattatacttaatgctatagtattttagcacataaaaaatgacaaaaagaatattttaacttccatggctaaaatattaataatgattatgtttgtttttaaggttttaaaatactttgtaataaaataactaatggtattaatcagttgctttgctgctatactatatcagagtcattgccaattcataattaaactg

SEQ ID NO: 5122 - DNA, 1034 bp, Homo sapiens
attattaaaagatttaacagaagagaaaggtgacagcttcattttggacaagttaagtttgagattcctaagggacatccagttggagatgtccagcagacagtcagatatttaatatatgcgtcaggagtttaaggaagaggagtggactggcaacagagatttggaaataatcagagttgaaagtggatgagattccccaaggggcagattgtagcagtgagccaaggacagaaacctggaatctccattgaagaaagggtgaaggaataggactccacaaaagctaagaaagcaatcgttgagaagtatgtggttacttaggaaagtacctgtcagaaaaactagaagagcagataattttaaggaggggaatggtcagtgtgatggtatggcagaggtggttggtcagataggacaaaccagaaatactgacctgagtatcagatcaaagcagaatctgaattgcactgtattagaagttaattgggagtttagaaaatacagacggcatttgtataccatttttcagaaatctggctgaggaagttttgaatcctggctctaccacttaatagttttataaccttaggcaagttgatccatcttctacatctttaaaatgaggatcataattcctaccttatagggtttctgtgagaattaaaataattcatatatgtaaagcactttggaaaacgatctgcatatactctgcacataataaatgttattatgattattaaggaagaagggagatagatgatagctagaggaagagttggagttgatttgtttattgtttggttgtttggttttgggggcaagaaggaatgagagaggttcttcccattaataactgaggaaaagtaactaggtttgaacctgagactttagcctccataatggaaaaacttctttagaactctccgggccttctaatcctggtttactattaactctgcaggacacagtgttcaagttatcttccattccatttcctatggaaagaaagaatatttctggccaggcgc

SEQ ID NO: 5123 - DNA, 1077 bp, Homo sapiens
gttgaagacctaaagtttgaattgcagctggaacttgtacgtatagaagggaataagactagtattgactagaattgcaggaatcaagtcctttggtatcaacatattatcattcttctccctctgtctctgggaacccagtgttctcatgctgccctctgatttgttggagctttaccaccagtgcctctcctcctccaaagttaccttctttactcctacttttacccttccacacaggcctctaagtgtagttactttatttaaaacagtacggttttaagttaaaatgttcccatccctattttttcctccacatgttttgcctgttaactcaaaattcaaatgaatgctggaatttttggcacaatgggaagatgttcggagcaacatgctttcctttttaagtcacattgtttggccaatacttgtatgtgtaagagtagctttgaagagaagaaatatatgtaataccagtcattcccttccctctgggaaaatgaaaggaggcaaccaggcagagcagagcatattctcaacactctctgcttctctaacttgggggaatgtaggcatttgggcttttctacatgtagaatcatagagttttgaaggagaaaaccttagaaagtatttaatccagttgttttaaccattacagcactcttctgttattaagagtggataggttactctcccatttttaagagtgacttttttaaagttctcaatctttggggattaggacagtgtggtgatacattgttatgtaaaatattctttaggacagataaagaagggtttgagttaatttatttatttatttatttatttattttgagatggagtctcgctctctcacacaggctggagtgcagtggcgcgatctcagctcactgcaagctccgcctcccgggttcacgccattctcctgcctcagcctcccgagtagctgggaccacaggtgcccaccaccacgcccggctaattttttgtatttttagtagagatggggtttcaccgtgttagccaggatggtcttgatctcctgacttcgtgatctgcccacctcggcct

SEQ ID NO: 5124 - DNA, 2055 bp, Homo sapiens
gaaagcttagtcagagtgcttcatagctgtattacatgaacttcttaaactttccttaatgtggatgttaagaaagtgaagatttaataaaaagaaattcagatatttttaaaataaagggatatcttatatacatttatttgaaattgattttcctgacaaaggccatcactgaatactgaactcgttaatgggctttttattaggtctaagtgctttcctatcatttctcagccatgcaacacagtgagataaaactggtggagtctctgcatctgcatgtaaaatgatagagaacagagagtaatcacataaagaagctaacaagaaaaagcctttacaaatagtcgatgctcaataaattcttgtggattgaatttcttaattaacaacaaaaggaaggagcccagaaaaagtgaatagtaattcagattaggagcacaagccatcatgccaaaatgaaaatcaagctaggttttaattaatggaaatttgaaagaagatacattatttagtgaggaaaagaaaaagaattcgtaagacatggacaactcgtggccctaatggcaaataggagagagactagtgcagaatatgacttgcacgccagatgacattgattgcatcatttttagaatagacctaaacttgaaagagacttaagtttatcactgaaggcatgtttaccacagctttttaatttggattttgaatattgcagaacaaaattttattgtataacataatgtatactactacttcagtaatataatgtgatatttacagtatgagggcaaggatgtttttaatgcttcatttactattatttccccaagtctctaggacagtgtctggcacactctcaatatttgaatgaatttctgaacatactgccttacctgataactgtgttatattattagatagtaatatgaaaaacacaaatcagctgatgtcaattcctaaggatatggaagtgaaaaatgtgggattggctgttttctggtttttttctacctagtatttttatttgtatgttgtaagaattacttgggaaattgtgcatttaaagttaatgccatagtcaagagatatgtatgaatttttaaaaattcatctgagaaaaactggggtttggagtcttcatcctgtcaataaaaaaatacctgaaatcagattggcagtttttttgtaattaagtgtatttgtttcatcactgcattaatttcttataaaggattattcttattagtgcatactctgtgctttgataagagtatttcaaaacataagcctgtttggtgttgaattagcttagaaaaatcagatataaacagactcctatttttaaattctctcaagcctaccaaaagatttaatgtggttttttattatttactatacacaaaaagaaagaaactcagtaacataaataagcatttcatggaaactgatgtaattgaactattaagtgatattctaggaaacactagtgtattttagttttgtttaaatgtagagttaattatagtgatcaactttgaaatacagtagtttgtgaactgcttttagtagattcagacagggaaggttatccattaaaatcaattttaattgttgtagccttaaaaaaagttgctgctgtcttctaggtatagagcaccaagactcacagcattctttcttggcatttttgaatacgcctaccgatgctctggatcaatttgaagtaagtattaaacatgtcacatatcctctggggtcaatttaaaattcactttgtaatttaaagttcacttataataaaaccattttattgcttcccacatcagaggacctagaatcttaaataaacaaaaacatattagcagaggaatatgttctgcattcttatggagactataatcccacctctgtttaacaaaacatctaagaaagatttaatcatgagagtcattataagatttaaaagcaatttcatctcccttaagaaacattaagagcagaacaaatcccaacttttgaaataatttgacaatttttttattctccaaa

SEQ ID NO: 5125 - DNA, 1050 bp, Homo sapiens
tactaaatataatttgaaaactttctgtctaaaattataattgtatcgttagctagatagccttaagacagtaagtagaaattaggttttggtagactttaatcttccctctttgttattttattgatcatttcagaaaacagaagagcttaattacaatataaccctgatttttgcagaatatcctacattaaactttctaaatttaatatacacttcagttttaagaatggtatgttgtttttatgatataaaatggcagaatccaattgagaaatcttattatttagaaaacctcacacatttgtgcatctgtgttaattgttagatttaaagagtgttaattctgtgtttcaagggtgaagttttaataatgtatcagctatgagtaacttggacttttgtaaacatcacctgctctaccatgtacataaaagaacagttccataaacctcttcccagttgttgacaggtagtatactatggtagaccttttcaaagaaattatttaagactatctttgaatttcctaccacttatttctttaggaagctttaaaataacatatattgcactgaagcttttttgttttacttttgtactttgtctttatatattctagggtcagcgatgaaaaggatgcacgagggtatcttcaggccttagcttctaaaatgactgaagaattggaggcattaagaaattccagcttgggtacacgagcaacagtaagcttctatgattttgcatggaggcttatcatattagaaaaaagagatttaaaaaacactataataaatccaattacttatatcagtttgtttagactttgagcctactaaagagttttttatgagaaaactattagtttgggtcttttccagtttagaaaaacataacacacagctggttaactataataatttaaatgttaaaaataggatggaactaaaaacacagtcattatttcataggatatgccctggaaaatgcgtcgttttgcgaaactggatatgtcagctagactggagttgcagtcggctctggatg

SEQ ID NO: 5126 - DNA, 1087 bp, Homo sapiens
tatcatctgacagacataccaggcatttcatttatcacacggtgatgttccctgctaggacaaaaaggagctaagtagattcattggcagagtacaccaagaattccatcttcatatctgcacatatccagagacccagaaagtggaaagattcatttagtttcatacatctttcatttaatgggagattaaaacctctccctgaagccccctagtggacttcttctcaaggtaccatttaagttctaactaggtcacatacctaattcttgaccaacacttgcaatgtagaatggaattattatgattaacttaaaccagccagttttgactgggcccaccttacatgtgcacactgtagcctgataattgaatttggttcacaagacagaagagatgaatagatgtcgggtaaaaacaagcagtatctgccgtaggggatttatgtgcctcagaagtcagtgttagatggattatctattttgatgttaaagttactaagaataataagaagagtagtaatggaaagaacagcagagaacaacatgtaaaatccttatttaaaaaagagtaagatagggaagacaagtggataaccacataagcaggaaatggtcatttcagtagacctaggaattttgaggaaagaggtggcaataatgagcgaggatgcctgccccaccttcatacctgtggtaggtggggtacaggaggaaaagtagctcctattaatgtccatttggtattctttggtcttttgtttgtttgtttttttttgagacagagtctcgatctatcacccaggctgggtgtagtggcatgatctcagctcactgcaacctctgcctcccaggttcaagcgtttctcctgcctcagcctcccgagtagctggtattacaggcatgcaccaccatgcgtggctaatttttgtatttttagtagagacggggtttcaccatgttggccaggctgatctcaaactcccaacctcaggtgattcatctgccttggcctcccaaagcgctgggattacaggcatgagccaccgcacctacacctcccctgcattgggtatttttatgtctc

SEQ ID NO: 5127 - DNA, 1058 bp, Homo sapiens
tgaagcagtaattagaagagtttcacgctgttgaatattctctagatgtcaagcaggagaactttcaacccattaattctaccatcctttcactgaccctcacttcacttatattccctatttcccccttaccctgtttaaattccattgagaatgattataatcactccttgtatgccatttcagttcctttgactgtctctcattctgttatatttgttttgctaagtgaacattaactattacaattttattctctacctgtacagttccaaatgactagaaaaaatagctgactattcttactggtctactttaaattcatgattaccaacctcaagtcccccttgtctgacaaatgtactgtattaccctagtatattcactcttccactcacctagtaactattttttactttctttttttttaagagatggggtcttgttctgggcagcagaagggctggaatgcagtggtgcagtcctagctcactatagcctcagactcctgggcacaaatgatccccctgcctcagcctcctgagtagctgggacaataggcacaagccaccatgcccagctaatttttaaaacgatttagaaatggagtcttgctgtgctgtctaggctggagtgcagtggcacagtcatagataactacagcctcctactcctcaagccgtcctctggccttaacctcccctgttgctgggattacagatgtgagccactgcatctggcctatttctttctacttgagtttgaaacctctgtcatcctcactttcagcttgcatctcctttcactgaaaggattgaggcaaaccgcagacaacttccacaagctccagttaccatatttaccgcctacttactgttagacccaaattctctgttcttttcatggatgaactgtgcaagcctctagtaaggccagtatcttccatcccttcctggctagtctagtgcatgttttgctttcatgtcatgaatttttttcttcttgtgtcatctgcatcatcagatcatttctatcagcttacaaatgtcagttctcca

SEQ ID NO: 5128 - DNA, 1039 bp, Homo sapiens
cacacatttatgtttggaaacatacacatatgtttggaaacacatatgtttggaaacatacacgtttggaaacatacacatgtttggaaacatgtttggaaacatacacacgtttggaaacatatatgtttggaaacacacacatatgtttggaaacacacacatatacacacacatatatgtttggaaacacacacacacacacacatatatatttattttattttatttttttcttttggagacagtttctcattccatcacccaggctggagtgtagtgacacagtcacggctcactgcagccttgacctcccaggctcaggtgatcttctcacttcagcctcccaaatagctgggatcgcaagcatgtgccatcctgcccagctaatttttcatttttattttttgtagagaaggggtctcactgtgttgcacaggctgttcttaaactcctgggctcaagtaatcctccctcctcggcctcctttggcctcccaaagtgctgggattataggcatgaactatcacacccagctgatgaagcataatatttgaataaaccaagttgcaaaaggcaatgcacagtttggtgtcatttataaagacattttaaaaagtacatagttttatgatgttgtatataggcataatagtgtaaaatatgcatggatacagtaaacaccaaatttaggatagtagctatgtctgggtagtggagggagaggatgagatcaggaatggtaatagaatacttatgtttttcagtactatctgtaatgtcttgttaatttttagtattttctattttatttatatagtattatgaataaaatatattcacataatatgctttatgtatatgtatatagtttataattactatctataaaataagcaaagatattattgatgcatataaatcctgtctttgcagttcctttaatctcctttacaatctaagaagtactataccagtagaagtaattcgtagtgactgtatagcttaatttttaagataaagaataaaatattttttc

SEQ ID NO: 5129 - DNA, 1030 bp, Homo sapiens
gtgttcacaatatatgaaaaaataggaaatctcagcacagaactagaaacaaatcaaatggaaattctagaaatgaaaaatacaaaatctgaaatgaaaattttcactgcaaaaaattaacagcctagtggagatgacaaagtaaagacttgaagttaaataagccagaagttattgaaggtaacagagaggaaaagattaaaataatagtagtccaaggacctgttagaaaatatcacaaggttttatgtacatgtactttgagatcaagaaggagaggaaagagaatgggccagaaaaaatacctgaagaaataatggcctcaaatttgatgaaagatataattttatgtatttgagatgctcaagaaacaccagggggccgagtgcagtggctcacgcctgtaatcctagcactttgggaggccgaggcggatggatcacgaggtcaggagatcgagaccatcctggctaacacggtgaaaccccttctctactaaaaatacaaaaaaaattagccggacgtggtggcaggcgcctgtagtcccagctactcgggaggctgaggcaggagaatggcgtgaacccaggaggcggagcttgcagcgagcggagatcgcaccattgcactccagcctgggtgacagagcgagactctgcctcaaaaaaaaaaaaaaaacaccagggaagataaatatgaaaaaggccatgtcaaggttcattatagtgaaactattgaaatccaaagacagagagcaaattttggaagcagcaaggaaaaaatgacaagttacatttgggggaactacaattccattaagagatgaattctcattagaaaataaagaagctaaaagagagacttaagaattctatatatccagtgaaaatatccttcaaaaataaatgtgatatgatatttttaagtaaaagaagaacaaaaagaacaagaagccaggggtgatggctcatgcctataatccctgcactttgggacactgaggcaggcggatcacttgaggttaggagtt

SEQ ID NO: 5130 - DNA, 1027 bp, Homo sapiens
actttatatttaaaaattttaaaaataccagcatgaatttggaaggacacacaaaaaataagaaataaattaaggatatattggatgatttaaaaggtaccctcacattttaagaggaaagtaggaaacagcagaacgttgttggtgaattaatcattcaaatgagagtatctttggatggtgcaaaatgtgagaaagagaaagatgctgaggagaagtacgtaaagggatactgccaagttagaaataaactaaaccattttctaagagtgattttcaaactttggcatgcatctgaatcctatggaggaagggtggttgaaacccagattgttgagtcagctgcagaagtgctgattcagtgggttgggtcgggctggggaattgccatctctaacaagttgccaggtggtgatgctgctgctggtgtagtgaccacactcagaactatgctctaagacagcagtgactgtttcttttaagttttgggtggtgagagtgatctctgagaagaacatgaatgtggcaaggagtagaatgtttctgtttcagtgtttgctttttaagatgtgggtgtcttaattgctgtttcatttaattagtattgaagttctaagacattattaaaggaagactactttaattaaacaatttgtattttatcagatctctgtttggcttttgcctattcgtgtgcttttctctgtgggtatctgattgtcacagtttttattgaaaataaagatatggaaatgctttgaaaattgtacaatgcagttttttttttttaatttaaatttttgtagagatgggggtctcactgtgttgctcaggctggtcttgaactcctggactcaagtgatcctgccacctcagcctcccaaagtgttgggattacaggcatagctaccacttcttgccacagtgcagccttaaagatggtattgtggtctcaagagtcagttatagaatgagaaacgaaagtgctattttgtggcttaaacagtaatccaaaatcctagctgag

SEQ ID NO: 5131 - DNA, 1672 bp, Homo sapiens
ttgaacccaggaggcaggggttgcagtgaaccaagattgcgccactgcactccagcctggcgacagagcaagactctgtctcaaaacaaacaaacaaacaaaaacgttgggcctagtaaatacagcaagtaggccaaagacacaggattttaaatatattctgcttccctaattttcaaggctttaaatatgcgaaattagtttctttggtttaacacacatttcctatgtttgtaattttaacatatagtaataaaaggaatttgaattttttcaagactctttaaatcttaatgtcaactcagtaatatccctgaaacaatatcttcattctgtaataaaaccttaatttcaaggcattcatgtgtcttgtactcactagccttcatgctaagtgctacattatcattattgtagttaggtagatgagaaaatgaaatgtcacagagattaatttttcaacatccacttacaacatggagtcagtatttgaatacaggtttctctgactacaaaacccatttttccactatgtctagttttctccctcacttaaaaataatatataatgtacacacaaatacacatgtatatgtaatacatgcttataaagcaatgtagaacataaagttataacatcagctgtaatctaacaacctacagaatctcagtgaacagtttgatgtactcttctcatcgtttctttacaccacatacatacccataaggatccatatctaaaattagttggcttctgtttattatatacacctgagaaaagcccattctgatatttttacagtattagaaatgggaagagacacatatggtgataattactatattctacgtagtagtggtttctaaatgctgatctataggctgatgctggttctaataaagttcttactgatccaaggtgaaataaggaaaacataatgataatatgaatttctttcaatgtagggactatcctgtattccaagttttttctttcattgtttttttgggggagggggtggattcaaatgttcattcttctaaaatcttggaaagctgtgttccattgttgtaggtgaagatgataataatgatgatattagctctttgcaaaatacaacaatggtaaccctgtgttgttctctgccccagtctttaaaaattttgttttactgctgtatgaaatttagaagttttgtaatgactgctgatcatcatcttacacagtttcttgttaattagcagcatatgtaattaactgcataaatatttgacccagtcctgttgaccttgggatacagtatattgatttttcacccttattagtttactgagtacattttatttttttcattcacagtacctggttatggattattatgttggtggggatttgcttactctactcagcaaatttgaagatagattgcctgaagatatggctagattttacttggctgagatggtgatagcaattgactcagttcatcagctacattatgtacacaggtaaaacagtccttcattgtacctggctgtgagttaccatgtaatatctagcaacagaggcctatttcttgccagatttattaattatggtcttggatacatttatcgtcaaccaaaaaaaattattttgagatgattttggttgttttgctttgttgttgtt

SEQ ID NO: 5132 - DNA, 1042 bp, Homo sapiens
aactagaatgtttataaaatttcggattgctattatagtgagatgaagccaggagaaagtagtcttctaggctctgacagtctttacaaactctctaaaatgttagcagtaaaccataacctcaggttggttaaatcataaaacaggacttggtagtaagtatgtaaagtgctttctgttttccccttaaaaagaaccagagcggccgggtgtggtggctcacgcctgtaatcccagctctttgggaggccaaggtgggcggatcacgaggtcaggagatcgagaccatcctggctaacgcagtgaaaccccatctctactaaaaatacaaaaaattagctgggcctggtggcactcacctgtagtcccagctactcaggaggctaaggcaggagaattgctcacacccggaggcagaggttgcagtgagctgagatcacgccactgcactccagcctgggcgacagagcgagaaaaaagaaccaaagcatagtgttgtatagattttagtaatttaattgttttgtggatcatggctgttgaattttccttgtgggaaataataatcacttattatatatagcatactgtgtgataatgtttttagtgtatctggaatatggtgtagccattaagaaaaaattaggtagatttctgtgtactgatacggaaggatgttcaaattcattgttacttgaaaaaaaaaaaaaacttacagagcactataatctcatttgtataaagaccaaaaaatataggggaggtgggataccatgtgaatatataatctgtgtgtgtgtgtgtatgtgtgtgcacgtgcacatgcatgcttatatagacacagattttctgagaggattttgaccaaagagttaataatggtaacctctgcacacaacaattgggcaatgaaactatgggaacatgactcagggagacttttactttcttagagttatctttgaagtttctgtcatagtgttatttttgtttctttttagttaatgtattacaaaattatgatacataaaattgattttta

SEQ ID NO: 5133 - DNA, 1031 bp, Homo sapiens
ttagatatcaaatattctgtttttaaaggggggagatattgtttagttttttttaaaaaaggtaatgaagtagatgttactaaagcctttaagcatgttgaatccacagagcacctttatgaatatatatatacccagggtatatgtgcatcatgatttggttaatattgatctagaacagggcttctcaacagggacttcattgacaactggggccagataatgctttgttggaggggttgtcgtgtgcattgtagaatatttagcagtatccctggcctctacccactaaatgccggtagaacccatcctttcccaattgtgacaagcaactgagagcagtgtgatatgttgaagcaaaaacgtagcctgtgctttatatctagactcaggattcaaggcattgataggaatcatttaatagctagatatttatggataaaatcatatgctgtctggggtttgcttaaaaatatgtatatgctcctgtgtgtgtggtgctaggggatggtagtaagtaggtgagggtctaaatgaaataagattgaccaagaaaataattgttgaagttgagttcattagtaggagggggtttttatactagtttctctacccttgtatacgtttgaaattttgtatcataaagagtttatattgtttattttcttattttaattaatgtttttgaagagacagtcttgctctgtggcccaggttagagtgcgatggtgtgatcatagctcacttcagcctcaaactcctaggctcatgtgatctttctgcctcagccttccaagtagctaggactacagaggtgcatgccaccagcctggctgatttttttttttttttttttgcctgtagagacagggtcttgctatgtcaggcaggctggtttcaaacttcaggcctcaagcgatcctctcacctcacttcccaaagcgtgggactgcagatatgagccactactcctggcctattatttttatttttaaaaaataatttttttagttaaacagattagcatagat

SEQ ID NO: 5134 - DNA, 1030 bp, Homo sapiens
tataaaattccatagagctcattaaatattacttggtaacattttgtctgtggtgacattttttaaggcataaaagacaaattcaacacaattgtgatataattatgataaaggttacaatccataatgctaatttaatattagtggaatactaaatggaaacccttgtaatggggggcttatgcagctatatttaaaggatgtctgcaaactactttcttctatagaaagacattttgtaatggttgatttctaacgtgacgtaacttgtttatattattctgtatttatctgtattctgctacaagcaaaagtcagcaggagttttgaacatgccctctagaaattctgtttaatgctgattatgcagtcactttgtattttgttttatattacaggagttgtagtaaaatctagtaatggaagaactgcctgcatttttatgtagatttgagggaaggattgactggagtgatgttaaaaatatccagcagctggtatggcctggtcagaactgctgtcacacatagatttggagtggacttctggggggtccgctgctgtgctgtatcatggtgaagggttgaatgggataggcattctggggcttcagggaagcagaacttaactggtgtagaattctgtcagtattttaactggtaaaaggtgatactgacgagcaggctgagtaatagccctggaagttagtaagattagtaagaaaataatgacaaattcgcctttagaaatctttatctgtcagtacttgtagcaacccaaagatgaacaaacatacagggaaaagcaaaaagtgtttccatgatgacagatatggtggcagtgaaagtaaatacttcattatttatttatttggagaaatttgaaaacacaaagaagaaactaataatcacttttgttctgttacccagaactaataacattttggccaagtttttgcttttagtttttttttttaaactaaaaaaaacaaacaaacaaaaaccctcagaagtgaagcacaaatatattc

SEQ ID NO: 5135 - DNA, 1027 bp, Homo sapiens
gggccacatgcggcctgtgggccacgggttgggcaagcctgctgtgataaccattgctgtagtgcttgtcatctttgtaggaaggcgtgtagtgaggcttacaaattttgaacttgggaatgtctgtctgcctccgtcacatgggagctgagagccatattgaaatggtgctcacgtggtggatagaatagggtcttcaggctacgtgggagtcatagaggctacctgagagagaacaggcttttcttggttcagaaattctaggtttgagaaggaaagcctacatacagccatctccacactgcacaatagatgagcagttttcagcagacatctccacattggtgttcttattggtctaaatgtacacctggtcagaaatggttttcatggccccagatgttcaggaagagctacatgaactctgttgatgatgtctttttaattgttagacattttggccactgttcctggatcagcattttttgggcagacccattttcttaacaaactgtactctctgaggcagcttggatctatccaggaaagtttccactagttaatttgcatagctcatgttggcattatggagactcaacagtttatctgcagggtgtgaaattggggtattagtcagcaccgtaaggcagaaaaggtggccagacccactctttgggctctggatcctggatttactgaaaccgcagataccctgagcctgaagatgccatgtccagtcctaatacctggttcctggaacccacctccaccactgttgccacttgaacaacataaaaaaatattttaaggacatgttatcttgctgaacctaaaagataaatagagaattctacatgctgcagagactacacattcttttctagcttatttatgtatttatttatttaaaattgagacagagtctcgtcctgtcacccaggcaggagtgcagcagtgtgatctcggctaactgcaacttccacctcctaggttcaagtgattctcctgcctcagcctcctgagtagc

SEQ ID NO: 5136 - DNA, 1030 bp, Homo sapiens
ttgatataaattaactttctctggagttacacacaaataacgaagatttaagagaaccttggctgaaataaatttccagttgtttggaggctaataaataccatgcaggtgtaaccattaaaaaaattattatataaactactatattatgtaaactacaatattttagcttttctgtgtgagaaagtgatttttgtttgtttgtttgtttgagacagagtcttgctctgtcacccaggctggagtgcagtggcacgatcttggctttctgcagcctcagctcccgggttccagtgattctcttgcctcagcctcccaagtagctgggattacaggcgtgtgccaccatgcctggctaatttttgtatttttagtagagacgagatttcaccatgttagccaggctggtcttgaactactgacctcaagtgatctgcccacctctacctcacagggtgctaggattacaggcatgagccactgcacccagccaaaaatgatttcataaaaattgttaaaaatctgtagctgctttgttaccttcattaactctttgtgattaaagttgcaagtttattgcagtaatgggaatgtgttagattaatgtttaggtgagttatattttaaaatctgtgtagtatatttatagttcacccagtaattagaacaccgtatcttaattccttattgttcctctagtgtgtcacaggaggtagagtttattgatgctgggattgcggatgtgaaaataacattctcagggtatcttatgacttaaaaggccgattttttaaccagtgatattttctgtgattgtctataatttggtttaaatttatacttaataagggccagaatacatggctatattcttagtatcctttagaacattatttcttagtcaaagtttatgaggcatctagcaacattttacatgatatataaaattggaggtaaatgtgctttttcttgggaggaattcatagccttaaactattcttggaggagtgtatgattctctctctgtact

SEQ ID NO: 5137 - DNA, 1030 bp, Homo sapiens
tttcatttaacagtatgcattagagatgtttctattaattcatgtgggtctacttcattttatttgctgcatatgtttcattgtatggatatatgtgggtatagtgttttgtggcatggatatcccgtaatttatataccatttcggtatttcctaggtagtttccagtttttcattctaacatacagtatttcagggcttatacatatactcagaagtggagtttttgggcaaaaggaatgtacatttaaaatatttagttactgcaatataatatttcttccacttcaaaggataccagtttaaacttctaacattgggatatgagagtccttgtttcctaggaacagagtattatcagtcttttttgcctatcccatggtcagtaattgatacttgttacattagtataaaaatctctgatttacttccagatgttagacattttccatatggttttcttttgttttgaattgccagtgcctatttttctaatattaatatttctcttagtgatttgtaaaatctgtatgttctatgtgttaattttttgttacgtaaatatttgttacaaatatatttttccaatgttgttttatttttcttaaactttgttcgtgttatcttttaccttacaggagacttaagttttcatatagataaatcttctttttattattaatacttctggctataaggctctgtgttgctaaaacagctttttccatttcaatgttatgtgaatatgctccattatattttcctagtattactgtagattttaaaaaattgtttctctaattatggcattattttttgagtcgtgtgagctatggattaaagtttttttccaaatagttcatctttctcccactcatttaaaatacctatatctgagcccatttctgcttcattgttctattggttcaggggtcagcagactgacacacaagacaaatctggcctactgccttgtttttgtaaatacagatttattggaacatagccccacctatttgtttacatactg

SEQ ID NO: 5138 - DNA, 1046 bp, Homo sapiens
tccagtaagctttatgaagaaatgccaagaaaatgtttagttcaaatttactcttctttcatagaatgactttcactttaactgtttcacttgatttctatttatgctactctacagctgtccatttgtgaaagttaccagcctctagaatgtaaagagctatatatgattctattctagcatattgaggtgaagttatagatgagcagtgtgttttgttcagcttagttttgattaattttccttttttatggatattgaattatctttataattcagtgaaaaggcagtgtttgagatatttcatgtgctttcttctctgtaaagttctcagtttttgtcactgaaacctataagccactgagcggctgctgtctgtatctgcttatgccagatagtccttggctttcatttgccagaatgcagcaagctttttgttatatagcttcaaatggcttttttccttaaaagaagcatgtttttgctggagaagtatgaatctatattaacagttgattataaaggacaaaactctgggacagccaaatggaagtgatgcgtagggcaaggtttagggtaagggagtagagggggaggatttccatgccctccttaattttcttctgagtttttaggttatagcaccaacatactaatgacactagcttgtttatatacatgtttagccaaattatgaaaagtaaaagaaactatttacctgaggatattattacaaaaaaaatgcctcaagttgagtaagggcaattataatagtggttgaatttctggtactattttgtcataatttcacttgttattttttatgtgtttgtgtatatttcttggatgtgctttaactgttgcttgtcttcagtaccttggcaatatatatgaatttggaattgtggcacgactctggggagggaggtattctggaaaatgccatatgtgtgaaatttttacctactacactgagaaagagagattttttttgagacagataaaaaaaaacattgtatatagtcacactgctttttctcagtctg

SEQ ID NO: 5139 - DNA, 2458 bp, Homo sapiens
caggttcatcttgaactcctgaactcaggcaatccaccgggctaggtctcccaaagtgctgggattttaggcatgagccaccatgcccgtcctcccattttgctttttaaaattttgataaaggaataattaaaatgccatttattggtaaataataactgaaatgcatagctatactaatataaggatgtaaataactattttactattaacatacatttgtatcttactgatagtattttattatattgggattgaagatgccaatatttctgtgtgactatgcaaaaaaatcttacaggataagctttttgcattggaacattttgttgttatataattattcttcagtaagtatcaagttaatgctcattcatccaccaacaacaacaaatatgagatgactaattacattttatttttatatttatatatctccaatctgcacatcagtggtagagttctggacctcaacgcagagggttaaaatcatcatgaaaaattattgatgtgttgttcatttaggactttttatgtattgaagattatgcagcacccgtaaatgtatttgtgacctgacagtacgacacaaacgtgtggtgtggtatgtagaaacttaatgtacactagtgtttcctaaattatatttctagagatataaatgaatattctgaaaattaagagttcagtggctgtgtaagattggaaaatagtgctttttgtatgcctctttggatattacaaagcacattatcatagaaaaagtttcaaaaagtttgctgtagaaaccatttaaactttgttttacctagaatttgcctgagtaatttaacattggaactccttatgaagaacagctgacagagtttgggaaatgctggtatatacttaaccgtaggtagtgtgagagcctttaaactggttgtgtgacagaaagtggttaataaagtcttctaacacataaattgtcacaatttatatcaatttccaaacaaaggcaaaggtttgaaggtttgcctttatcctttccatattttttagcgtatctgtttatgtcatctaagcaatattaagttggtgtggagttttgcatggggtgtatatatctttacaaagaaaggacagtgagacttgatacatgacttcgaggagtttatatgtgcacttcttggtttgcaaagatgcacctgctaagctagtgattttgtttttttccagtaaagctttattatgttctaatccagttacctctctaaccattggtacagaatttgggatcgatattgtcatggctgtgaaatagaacaatgctaattagattttatgaaagttttgtaaaagcagtatagttatcttgctacagcaagaatcccatccttaagtatcatcgtttacttagagtggctaatgcaatgccccaagttgactcagatactattaaaagcactcaagcatctacttagaagtggtatgccctgagatttaaaaaatacttgtttgaaaagattaggaaaagcccccgcaatgaaacagtgactaaagcccctttttgagattgtattgctagctacctgtgatctggccctgagctaaaagcataactaacaaacatttaacaacagactaagttcgggtatgtagtgaagctgacatatgatatcataaagcttttccatactctctacttatagagattctcctagagtttatggttaaaactacaataatattttcaggtctactgtagtatctgtttctgcctttttgttgcatgcgttcgtaatgtgttacccatttctgactaatacatgctaagttgacagtttcttctaagagtcctttgctgtgttatgttgcttgaggctgtgattaagtgtgatcatcatatttgtctcttttgcctatgtacctctggtaatcccagttaagtgtagtagctcatgagttctggttttattcaacctctgtgtgcatctggctcagttgacttctctgtattaaacatgtacaaatgggttacgttcctggatcttactgatcttattaatcatgtttgtttttccattaaatactaagcaataacaacttccttattacatgtacctctaacttgaaaatactgtgaattctacacatccaagacctttgtagaaggaagcaaaaaaaaaaaaaaaaaaccacttagaacatgatcctttgatcatgtcaacatcctgcttaatatacttcagtgactactgaaagctttcagaatgacatttgaactcctctttagcatgccatacagaatttttaatatgatcctgtttacttctctttttcttcactttatttatttatttagttttttgagatggagtctcgctctgtcacccaggctggagtgcaatggcacgatcttggctcactgcagcctccgccttctgggttcaagtgattctcccgcctcagcctcccg

SEQ ID NO: 5140 - DNA, 1048 bp, Homo sapiens
gaaaacgaggaggtctgagaagttcccaggtatgtgcagttatctcttcacgtcacctcatgggtcccatgtgcaaactgagggggagttagtatgaaacatgcatcgaaattcaggccatgaagtcaacaagctcattctgtggaaattccggctggccatattggttccaattggtttcaggcagttttttcttttttaagagacagcctccctccatgttgcccaggctggggcacagtggcctggaactcctgggctcaagcgacccacccacctcagcctccctaacagctgggaccacagcatgcccgaccacgctagacttatttttactttttgtagggacagtgtctccctgtttttttctccctcaattttttttcttgatatcataacatgggggagtttcagggtttcagcaagttgtttattttcttatgtgccatcctgcaagctcaagaatttctgctagtcattggtctttggtgtgaggttttgagactatgttttctgaagaggccatatatgcaaagtgactcccaaacacagaaggaactgagaaaccaaagaatgaggcagacaaatccagtttgtcacttggaggtgattttttggggaactcacagaagcatggtcttgggcagccacaagacgggtagatctctgcactgttaccccctagactcagggcttatatatttttggggaaaaagtatatgtgtcctggaaggaatgtgcaggcaactgaaatagtgctatgggcatcacagtttatgatgtatgctgtagcatcgagggttgttttggaggaatggcgagacttacggtagataggtgtttctacatagagtacgacttcaactagacatcttggaggcactcccagactcatgcttagttaggcatcagtgtggcagattagaatctaagaggagtgactcttgtccccatactaaagatggaacatttttcaaaaaagtacaagaagacagaatccagcaacatatagaaataattatcttccatgccaaagttggattcctcc

SEQ ID NO: 5141 - DNA, 1075 bp, Homo sapiens
aggcttttaggctgcatggctcagactcccttggtcaccgcgcagcttctcagtgcctctgtcttaatggtcccttcttcgtccttggggactgggcgcatgtcgggtcctttgcagcttggactgtgtccatggtgttagctcactggcctcttccctctgcccaggtcatcatgaggtcctgctcgggcatcaactttgaagagttttaccacttcctcaaggtcatcgctgagaagaggctcctggtcctgagggaggcagccgctgaggacggtgctgggttgggtttcgaacaggcagcctttgatgttgggcgcatcacagaggtgctggcctccttggttgcgcaccccgacttccagagagtggacaccagcgcgttctcaccacagcccaaagagctgctgcagcagctgagagaggctgttgatgctgctgcggccccatagcacctgtcgtgaggatagaaggacgggtggaagagaggcagcctcctgctccggggcccttccagaaataaagaccgccctccctgtgacctggggcccacccctgtcgaggcttgtggcctggctgttcatggccactgcctgggtgcctgttttcaggtgaggcccaatgaggtcagggacccaagatgggatgtggcccttctgacctgcagcaggcctgctgggagctcggagatggtgccaggacctggctcttttgggggccctgcctccttaggccaggacgcctgagctgacaggagtctgtgtctggtgtgccttctctggtggctcctcttaataggccagccctgtcccctcgtctcaggccattggaccacccctggctctgccctgtgggttcagggaggggttggagcagtgctgggcaagctcaccagggcctccaggcagggctggggttggcctccatcacctccaggtgatgggctgtggaaccagcggcctgcgccttcctctgggtacccagagtggagggctgggttgggctggcctttgccacctccctgcctttgcagggcctgtggacagctggagaggccacagatggggtggaatcc

SEQ ID NO: 5142 - DNA, 1638 bp, Homo sapiens
gtgctgagctggatggaccgcgagacgcgcgccctcgccgacagccacttccgaggcctgggggtcgatgtccccggcgtcggccaggctccgggccgggtagccttcgtctcggagccgggcgccttctcctacgccgactttgtgcggggcttcttgctgcccaacctgccctgcgtgttttccagcgccttcacgcagggctggggcagccggcggcgctgggtgacgcccgcggggaggcccgacttcgaccacctgctacggacctacggtggggcggcggccgcagaccccgggcggggaggaaaggccggcgggacccaggcccgggaggcccccgcctagagaggggcaccagggagggtgagggaggccaggcgcgtggcccctggagagttcctctgcagacggtttggagtgaggacggggcccagggagatggcatggaccgtgcctttcatttcaggagacgtggttgtaccagttgcaaactgtggggtccaggaatacaactcgaaccccaaagagcacatgactctcagagactacatcacctactggaaagagtacatacaggcgggctactcctctcccaggggctgtctctacctcaaagactggcacttgtgcaggtaatggggcttgggacgcaccgaggcgctgccttccctagcgctgcgtgaacccagaggcctttctgatgaaggtggcccctgggtgcacaacggagctatttttccccgtgaggcactttaatcagtttaaaagaaactggattgtcttccgcatggctgcaagtgttgttctttgggaggtcaatatggttttttttcctttttttttgagagagatctcctcagcctccctagtacctgggattacaggaaggcgtctccactcccggctttttttttttttttttttttttttaaagagactaggtttcaccatgttgcccaggctggtcttgaactcctgagctcaggtgatgcatccacctcagcatctcaaagcactgggattataggcatgatcagtactttctaataagcagaaccattgtagtcagactgccccgccccctcccccgccagcagcgtctggctcagaggagggtctggggctctttgggggctgcagccatctggaagctccactggagccgattggtctcagttgccccactcgtgctgccctagtctcctcgtgcctcacgtgctgtcggtggtgcccttgcgccctcctcacagggactttccggtggaggacgttttcaccctgcctgtgtacttctcgtccgactggctgaatgagttctgggatgcactggatgtggatgactaccgctttgtctacgcggggcctgcgggcagctggtgaggccacggatgtgggagtggaacccgaaggggcctggtgacagaacggactgggaggcccagggtggcaggaggggggctgcttggcacaggcctcacagtgggtgccatcccttgagaccaaggggccacccctccttcagttggaccaggcctctggggtgccaagcaaagcccataccagcccctacaggcatgaaccaggcgctcttgctgccgcaggtccccgttccatgctgacatcttccgctccttc

SEQ ID NO: 5143 - DNA, 1035 bp, Homo sapiens
gatgacagcacatttgttcccagcctggtttactaaatattttatgcccactgtggagacccactgctcagaaaaaaagattcctgcaaagtattattgctcattggcagtgtcccgttcacccaagagctctggtggagatgtgccaggagatgtatgttgtttccatgcctgctaacacaatgtgcattaattctccagctcatagatcaaggagtcatttcaactttcaagtcttactatttaagacatttcataaggctacagctgccatagacagtgattcctctgatggatctaggaaaagtctattgaaaacctgctggaaaggattcaccattctagatgccttaaaaacattcatgattcgtgggaggaggtcaaaacagcaacatgaacaggagtttggaaaatgttgattccagccctcagggatgactctgagggatcccagacttcaggggaggaagtcactgcagatgtggtggaagcagcaagagaatgagaattggaagtagagcctggaaatgggaccgaattgctgcagtctcatgataaaatgtgaatggatgacaagttgcttcttatggataaacaaagaaagtggtttcttgagatggaatctacttctggtgaagatgctgtgcacattgttgaaatgacaacaaaggatttagaattgatatcaatttagttgataaagcagtggcagggtttgagaagagtgactctaattgtgaaagcagttccactgtgggtaaaatgctagcaagcagcatcacctgctatagagaagtctttcatgaaagggagagtccattgatgtggcaaacttcatagttgtcttgctttaagaaatttccggctgggcgtgatggctcacgcctgtaatcccagcactttgggagtccaaggcaggcggatcaagaggtcaggagttccagaccagcctggccaacatggtgaaaccctgtctctactaaagatacaaaaaaaaaaaaaagacatttccacagccaccccaaacttcagcag

SEQ ID NO: 5144 - DNA, 1064 bp, Homo sapiens
ggcttgtgggaaagtgtccctgcagcacagtgccctgggtattgtggaggtcgggaatcaacctgatttgtgcaggccgaggcccgggggcagggcctgaggggtgggatcactgggcctggcccaggcctcctgcgcccctttgctgcccccatcacctacgttgcttgccccttgggcagggcgtcctcactgcctctggaggctgcgatgggcagatctctcccccagggctgcacctgcgggggctacgaaggtccccaaaagcggtgaccctcctgcccccaaatttagtccctttttctgcctggggctcccttccgaaatctcacctctgtgaagctgtggcagggttgtctgtttaggggaaggacgtctcccaccctacaggcatctcagatactcttggaaagccccagggagggttgtggatgcctgtggaaccttctggttgtgctgcctctccctgctcagccagagcggggccatgtgcggacatttcacgggggttacatgtggttatggcctctttagggctgaagggacctggctttggttctctgctggcagagcgtggccaggggtggctccagggtcactgagcggggattgtgtgggaaccagagcctgcctccccttcctttaaaatactttttatttatttatttatttttgagatggagtcttgctctgtcgcccatactggagtgcagtgacacaatcttggctcactgcaatctccgcctcccgggttcaagcaattctcctgcctcagcctcccaagtagctgggattacaggcgcctgcccctatgcccagctaatttttgtatttttagtggagacagggtttcaccatgttggccatggctggtctcgaactcctgacctcaggtgatccacccgcctcggcctcccaaggtgctgggattacaagtgtgagccaccgtgcctggcccctttaaaatatatattttttaatgtgaaaaaatgcagacaggaaagagtgtatgtcagatacatgcacagtttaaaaagtaataaaatggattcctgtatagccag

SEQ ID NO: 5145 - DNA, 1102 bp, Homo sapiens
ggcgtgctgtggagatggggatattgcatctgtttctaacccacgtagccactggccacgtgactacgtaactgaggagtggaatttgtagtttgatttaactgatttaaagacgcacttgtgggtggtggcttcatctggatggggcctgcttgtgttcactctcttggcttgcaagactagggtctgaggcacaccttgtatcctccttgtagttgtgagagccacaggaaaagcaagaaggagaagaagaaaaagaaaaagaggaaacacaagaaagagaagaagaagaaagacaaagagcacaggcggccagctgaggccacctcctctcccacatctcctgagaggtatgccctggtccatatctgcctcttgggggtgggggcctggttgactccttccgagtgactgactgccattggtctccccaggcccaggcaccaccaccatgactccgactccaactccccctgctgtaagaggaggaagcggggacacagtggggacaggaggagcccgtctcgcaggtggcatgacagaggctctgaggcctgatggctggaccctgctcactgctgttgtgggaccctgaaccctcccttcaccttgcttgcctcctgcctcggaagctccttgggtgtgggtgaagcccgaggctgctcctgtggaagtggctctgggcaccagcctgtggggctaaagacttgacagctagctctggagcagccggcttcctggaaaacctccaggtttcgcataccagggatggcccctggcttggcctgcgaaggtgaacctgcccagatttatcagtagaggctggactccctctgtgtcctgcccatggttgcagcagccatgggcctatgagcggtctaactgtggccaagtatggtgacctctatttttctttatattgactctttgtatttcaataaatatattttaaaaggaaggtatatcaaattggaaggtcagtatcaggggttaatgagatcccactggaacgtcggagctggggtctgtctcccaggagtctgagacctggtgattttttttttttttgagtttcacttttgttgcccaggccggagtgcaa

SEQ ID NO: 5146 - DNA, 1024 bp, Homo sapiens
aggggacagggggctgcacctgtgataagcccttgtccccatgcagtctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggtgagtggcgtggtgattacatgtgtcttggaagcatcctgggctgggatttgataagaaaccattaggtggaagaaccttccttttaaaaaagatctcttcattctctgcctagcaggttgcacgccagggcctgtactgaccacctccacgtgccactggggctgtaaggaggaatggcggccgtgggcagcctgcttgggtaagcatggacttttaggtccctggggattactgtcaggggccaccccagggaacccctctcttcagcaggaaaccgccattctaatcctccctagtccttgctattgtccactgtcccctgtgctggaagctttgtgcccttgctcagcctggcagcctcttcctggctagggggccagaacgcctctg

SEQ ID NO: 5147 - DNA, 1033 bp, Homo sapiens
tgcaggggccctgaggtcaccctcgggtggaggggggagactgccccgcccacctagcaacccccagacaggttggaggactcacatgatgaaggctgtcacaccgatggcccagatgtctgtctgtggaacagccccctggccctccaggagctctggagctgggaggggcacatgtggttgggctcaggtggagggacacaggtggtgggcatgagtgagtggtcccaggtgggataggtggggcacaggtgtgtgggccaggtgtgtggctgagtgggtggcagtggagctgggagagaggacagcactggaggagagggggcttcttcctgccccccgccccaggtgaggtccccccaactgtccacacacgcacccatggtctctaggtagtccttgaacttgtctgagggcagcaccttctcctggctgaggctctgtgcattgcccaggtccacgaccttgagcaggttgtattcggtgatgatcatgttctcggacctcaggtccaggtgcaggatgtgctggttgtgcaggtactgggtggcactcaacatctgccacaggtagtccttcacctcggattctgagtaggaggccctggggggcagaagctgctcagcccaggctccggggtgggggccaccagggccagggctgagactactccccgtggactgggaggggcactggctgtgcagaggggcctggtcctccagccccaccccagaggcctgggtccatcagtccatcagtccgtccatcagctcaaccacaccaccccaggccaccctcacctctcggccaggcaggggagcagctcgggcccagagcacagctccaagatgagcaccaggtgccgggggctgaggtaggctgcgtgcagctgggccaggtgcgggtggcgcaggcccttgagggcctcgtattcgcgcagcactgctgtcttgtccttggggtggtaggggatgatcttggcggccagcgcccgcccgctggccttctcccagcattgccgcaccacgctgaa

SEQ ID NO: 5148 - DNA, 1603 bp, Homo sapiens
gaaggtggaaggtggtggagtgggggcaaggaaaatgtggccataccctggccagcaaggagctggaatcagaggaaagtgggagaacctcagaggtggccgatcctagatggactccctgcagggactgtgttagcaggtcagtacttaagtcctgggaaagccccagactgggcaggatgagggggacacagtcgtttcctctctaacctcccctccagggctgccctgcatttctgggtggggtactgggagccatctctgccatctgagatgccagggctcagcctgccttttctccccttgtcttgctgcttaaaacccaaataaaacccgagctgaagggcctggggcacacgttccctggcctgcgctccctcccgctgtcctctttcctcgctgacctgctgcaggtgtgctcctgggagcctacgtgtggggcagatggcagcatctttggagctttcttgattgcactttgtgtgttgcatcatggtcacttgtgtgtgccagatgagcagttaaggcagtgttagaatcagtactgagcttgatctgtccctatcacagagcaaacttctgggatactagaataaatctgaatctgtccccttctgctttggattttagcagaaaggtggtttagagccatatccgtgggcttgttcagacacagattcatttgggttttcttttctttgcccatgcaggaatgtctacacctgaaacatgttagcccagcagaattacccttgtgacaccaattaccccaatgggtgcagagagtgcccaatagctctatagagttgactcgatatagtttcatgggatagcacttaaccctttcttttgcaggtgaagaaaaaaatttccctctaccctgttaggttcagtggctcagggctgcaaattaaactggcacaagacaaattaacaggaaaaaaaatcatacaatttgattaatattttaagtttcacatgcacaagaacttcatagaaaagcgtatttcagcaaaggtttgtgaattgtggagaagtgactggacacagaaatgggattgggcgtctaggactgataaattgtgggaaagtgactaggaaatagatgggaagaattaacacaagataatggtcattgtagtaaggtctgtttaggcagaatcatctcccaggattagagtgccctcctcttcctggtagagagagggtgcctttctcatggggaatgaataccctacttttaggcagataggagtacagagagctcttcctgcatctgcttttactcagaataattcttgtaccacagcggtatatttggggatgacatcctgttcttcactgccttagagcctaggttatgttaaccacagcaaactgcttttacctgcccccatgggcctagaaagctcagtcccacctatggggctgtgtgtccacttgccagagctggggcccattagctccatgacaggttcactccttgcctggccctgacctggggtcatgacagctgaacaagccccaggctgggttgccccgaggtggtaaacagggaagtcccagtaagctccagttccaggaagcagcaccatgggagaga

SEQ ID NO: 5149 - DNA, 1050 bp, Homo sapiens
cgggtgtgtctgtgtgtgggggagtggatttgctcctggtggcggtggggtgtgtctgggtttctctcaggccctctcacccgagatcaggccgccgcctctagtgccagcccggggcaaaacagggccaccccccgacccgctacaccccacgccctcttgcccccccggccgggtcttggtcgggacaagcgaccgtggtgggggcgttgtgagagaaaggccccgcgcggctgggccggctgttcgccttcggccagccctgacggctctgggtgggtggggcaagagggggcctcgcaggagcccctgtgcggcgagggatccaaaacgctgcctccgcgacagggcggaggaccggagggcgtcccaggatcgtgggccctgggccctgacacctctgaactcctgagtagctgggaccccaagtaggatgtccccggctgccgctggggtataggtgtgctataaagggagagcagagtcagagaaggttcggaagcatggcgactgcagggggaagggaggcagcgggaaacccaaaaaagcctacagcaggccgggcgggcgcggtggctcccgcctgtaatcccagcactctgggaggccgaggcgggtggatcacgaggtcaggagatcgagaccatcccggctaacagggtgaaaccccgtctctaggaaaaatagaacaaattagccgggcgtggtggcgggcgcctgtaggcccagcttctcgggagcctgaggccggagtatggcgtgaacccgggaggcggaacttgcagtgagccgagatggcgcgtctgcactccagcctgggtcacagagcgagactctgtctggaagaaaagtaaagaaaaagccattaaaaaaaaaaaaaaaaaaaagcctccagcacctggtattctcaggcggtctcccatccaagtactaaccaggctcgtccctgcttagcttccgagatcagtcgcgttcagggtggtatggtcgtaggcgccagaagaggagcctggctcccccaagtgcccggccagccttgccggccggatt

SEQ ID NO: 5150 - DNA, 1030 bp, Homo sapiens
gggcaaaacagggccaccccccgacccgctacaccccacgccctcttgcccccccggccgggtcttggtcgggacaagcgaccgtggtgggggcgttgtgagagaaaggccccgcgcggctgggccggctgttcgccttcggccagccctgacggctctgggtgggtggggcaagagggggcctcgcaggagcccctgtgcggcgagggatccaaaacgctgcctccgcgacagggcggaggaccggagggcgtcccaggatcgtgggccctgggccctgacgcctcggagcactccctgctccgagcgggcccgatgtggtggaagctcgggagcgcgggagccgggggaaggccgcgggccagcggctcgggggtccccgatccgagccccgcggccccgggctggcggtgtcggctgcaatccggcgggcacggccgggccgggctgggctcttggggcagccaggcgcctccttcagcgtctacggccataccaccctgaacgcgcccgatctcgtctgatctcggaagctaagcagggtcgggcctggttagtacttggacgggagaccgcctgggaataccgggtgctgtaggctttttctttggctttttgctgtttctttccttttcttccagacggagtctcgccctgtcgcccaggctggagtgcagtggcgccatctcggctcactgcaagctccgcctcccgggttcacgccattccccggcctcagcctcccgagtagctgggcctacaggcgcccgccaccacgcccggctactttgttctatttttcctagagacgggctttcaccctgttagccgggatggtctggagctcctgacctcgtgatccacccgcctcggcctcccagagtgctgggattacaggcgcgagccaccgcgcccgcccggcctgctgtaggcttttgtggcttcccggctgcctcccttccccccacagtcgccatgctacccaacctcccctgactctgctccccctttaccgcccacctacaccccc

SEQ ID NO: 5151 - DNA, 1261 bp, Homo sapiens
gcaattcaattcactcatccggcgcagtcgcaaccttataaaccgggggaaggggcgggcaggggcagcgggtaccacagacgccagccaagatctccgctccagaacgcatggactgctttacccgggaggaaggacattgcttcgccaaccaccaggaaaacagtccctgtgcacccggattcctattgccccgcacttcgtgtcaactccagtaccgaggacacgccagagacccaggcctccggacgcgcccggtaccacggctcccgccaaaagggcgggcgcactctgcaaatctcggggcccactgcaccgcaccaagagcacagtgaggtaccaagagcacagtgaggtgccaagaaagaatggagcctacgaaacccacctccaaagcaagcaattcatccaagaaaaaacccgtctcagcgctccgttggtcctctcgcacgggccgcctggccgccctgctcaggcacagctcaaacccctccaccctattccggactgctcaaaagggggctgcctaccgaagtagggtgcttcctctctaaggctcaaacgttctcgctctctagctccctcctcctcactcttctgggtttccccctggacctcgcgttatttctctagccttccctctgtacctctgtacttctccctttctctgtccctcttagcctctctctctttacctctccacctctccggtctctctcgatcgctgtctctctccctccctcggtttctatctctccatccatcttctccttgctctccttcaagccgtgtgtgtctgtgtttcaccgtgtgtgtgtgtgcgtgcgtctgcgcacccgtgctcgcgtgcgggttccggaacgagaacgaacgggtgtgtctgtgtgtgggggagtggatttgctcctggtggcggtggggtgtgtctgggtttctctcaggccctctcacccgagatcaggccgccgcctctagtgccagcccggggcaaaacagggccaccccccgacccgctacaccccacgccctcttgcccccccggccgggtcttggtcgggacaagcgaccgtggtgggggcgttgtgagagaaaggccccgcgcggctgggccggctgttcgccttcggccagccctgacggctctgggtgggtggggcaagagggggcctcgcaggagcccctgtgcggcgagggatccaaaacgctgcctccgcgacagggcggaggaccggagggcgtcccaggatcgtgggccctgggc

SEQ ID NO: 5152 - DNA, 1032 bp, Homo sapiens
tattaccttagtatttttctctgggtctttggaaaaccatagtcaatttttagaacatattgctttcattccccataaactcttcacacatgataactgtttaagctttgaaaacacatactgaagtattgtgagcttaaaaaaactttttaaatatttgcatagttttgaggtgaatttgtttccttacagatctctcctaatcattgagatgtatatttcaaaagaggaaattttacatgttgtccaaaacagccttgctagtaactggtgaattttggtattaactattattaaagtctttaaacgacacaggtacctaaagatcaccttaatgtggcaatttgtgatggtgtagctagctgattgtgaaaactgttcctttaaagtcgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccagacttttctcttgtttagaaaacaaacttatatttaatgtacttactacttaaaactccagacagagatataatgtagaaggcaaatattggccaattttttcctctttttaagtggaagacaaatgaacgggatttttaaagtgcttttaaagtgcatgaatggttaataaatcagtatgaattgtaagccttcatcttacatccaagtccttagttggttagggtttcttttctttcttttttaaagagtgtcaattaccttttgaacctgtgaaaatttgatagttgttaacagtctgatggtcctaattctttcttttcattctagaaatgaatgtggttgtaatcatgttcctaattcttgggacaacctgcaagacagtgagacagtttaaaaattacctttcatgttgaaaaagtctgaaacagagaacccaatgatatttaaaataaatgctacataaaactctttttaaaattttgattttaactta

SEQ ID NO: 5153 - DNA, 1063 bp, Homo sapiens
acctggctatttttttatttttaatttttattagagatgaggtcttgctatgttgcctagctggtcttaaactcctgagctcaagcaatcctcccgccttgtcctcccaaagtgctgggatgatagacgtgagccaccacatctggctcatgtgattctttctagggctcagcttctgtcctggaggcctttcccctctggcagttaggattcatcctactcagttctgtgaggccatttttacctcttcagttgcttttcttttcctccaaattttattgatgccttttgcctgatgtcatcacctcccttgctctctgtccttgtggctttatacctttttttccttcctttagtaggatttggagaggaagagactataagctttaaggaactataaggcacaggtttttagtgcatatttaacctgaaccctccaatttgctatatttttttaactgatttttatttttactttcttctctgtttcttgatcagacttgccagaggtttgtgaatttgtttagtttttccccacattaaagatttgtggtttctctttattgtatattttcattaatttattattttttccttactttaattttctttgggtttattttgcttttttctaactttttgagatggatgcttatcattgatttttttgccccctgcctttcttttttgatatgttcatttcaggctataaatttccctctgataactgctttagctgcatcacgcatgttttgccatgtaacatttttattcaaactcattttcaaattttcattatgattttttaaaatagtcacaaaaatcataaaatttaacatttatgtatagtatccacgtaaggaaatatttattttttaaagaaaacatatattccagcctggtcaacatggcaaaaccccatctctactaaaaatacaaaaattaggtgggtgtggtggcgtgcgcctgtaatcccagctatttgggtggctgaggcacaagaaccacctgaacccaggaggtggaggtcacagtgagctgagatcgtgccattgcactccag

SEQ ID NO: 5154 - DNA, 1032 bp, Homo sapiens
aaaagcacatcagccctatgccatacataacaccctggtttttcctttggtatttatttctgtatctccaagtaacatggcttttattgacatgtgattgttttttttcagtttttaacattatctattgactttaattcttttttactgctctcctcacccacacacacacggcccatctccacacctgcacaatacagtcctcatagagtttgttggattcataattagtatgtaccgtattgtgcccatggaaaaagttactcaaagctgacccatactatttcccatgattcccttttttctttcacaatacaaccaacacatcaggttcactatcactcttgtcatcttaagatgcctctcccagggcccctgacctacttctgtctgggctggctgctgctcctgtgggctgctgcctggctggcatcttgggagggcccttggccatcctcctaggacctttcttggcttctctcttgggtttgagtctctgtcgtgtgcctttcatgtcattttctttcttggtttaccccttcttggtggagcacatcttctagtagattcccaagaaaggatggttcagaggttagctttctttgaatgccaagagatagctttattctacccttacaatttggtgagtgtggctgggcatggaattctaggttggaacagttgtccgtagaaactctgggggcattcctccttatgtgttatgactgctgatgttacagcctgcctcgttatgattcttgatcttgatcttttgtaggtaatgtgttgccctcaggaagctttcacggtcttctctttggcctttatgttctgacatttttccttgatctagatctgttttcctttgctttgctgggcacttggcaggtctttatagacaaactcatgtttttaattcccggaagttttctggaattattttcttatttctgttttttttttttttcccatttcttttttttctgaagtccttagttggatattagactttatcattttatcctctaattt

SEQ ID NO: 5155 - DNA, 1029 bp, Homo sapiens
gagctgggattatagacatgagccactgtgccgtgcctaaaatatgcattttttaaaaagacagtttattttaaggtggatgcaatacagtttccaaatatgagactgtttttactataaaaatacaactggccaggtgcagtggctcacgcctaaaatcccagctctttggatggccaaggcaggcggatcacttgaagtcaggagtttgagaccagcctggccaacagggtgaaatcttctctactaaaaatacaaaaattagccaggtgtggtgatggattcctgtaatcccagctactcaggaggctgaggcaggagaatcacttgaacctgggaggcagaagtttcagtgagctgagatcgtgccactgcaatccagcctgggtgacagagcaagactttgtctcaaaaaaaacaaacaaacaaacaaacaaaaaacaaactacaacttccttacaagacataatgacttcttttctccataaatgtctctagtattagttacatgattgtataatcttctaccttattttaacttgtcatagctatatatctgtgaagaaaatagaagagctaatgaatatgatttcaagaaagctttggacttgttggaatatattgatgaggtaagtaaaattgcttgagatgatctcaggcaactgaatacatatataaaaagagggagatccctcttttagtcaatcatgaaaatgaattaagcaaaaaagactgtatctgtggttcaactacctttaatccttagaatgtaaacaactcttcagaaaagctgtcaaggtcaagagactcccttttgtgataattctcacacattcctgggtatctttttttgtgcacagataaatactgcttttcaaagtcctgaaatatttttttgtctttcatttattaagtcattagtttctgaaggtaatatacgactttatcagtttattctggctgggtgcagtggctcacgcctgtaatcccagcactttgggaggccgaggcagacagatcacctgaggt

SEQ ID NO: 5156 - DNA, 1028 bp, Homo sapiens
cctcggcctccaaagtgctgggattatagacatgagccaccacacccagcctggaatttttcaaaataaaaattggagcggggaatctcagctatgtggtttggatcaagtatatgcagatatggatatctggttatgtggcttatccacagagtccagcctaagatctgggtttaaattatactgctgtcatttttttccttttgagggagtggatatagtagaaagaattgggatttcaatattttctccagaacttactagctttgtgaccttggatagttaatttatgctccttcgcctcagtttgttcatctataacaagggtagttgtaaggattgaggacactgtcttgggaaaaatggcttgcatatattaagtactcaataaattataggtattagccccttttattaaaattattttttactgtttgggataatcttccttcaatctttttattttttgcactagtagcgcctgttctaaaaaaagtgtgtttatattctataggactggctgatagtctaagaggggaagccatattttagcctggccaccagaggtagatcatgttaatcaaagcattttaaccaaggctttcctgtttcttctttctccctgctttgcatttgatcacttcttagcttttatttcttaacgcgatgggaacatttgcaggtctcagtgattctacagactgttagcacaatgtgtctaatcggaggggatagactttttaaaaataactcttctggtagttaaataattcctcatggaaaatgtgtaaattatagaaaaaattcaataggaaaaataagttgtctgtagtcctacctccccggagatagccactggtactgttttgtgggtttcctcccagtctgattttctaggtacagaaatggacaaaagtgttccatttaatttttccaaaaccaggatcacggggaatgctgccagtatttgagcgaaagtatctgtgttttggtcactgttttgctgtgaatgctgtgtttatgaggct

SEQ ID NO: 5157 - DNA, 1015 bp, Homo sapiens
ggtttgcatattttattgtaggctcatgcaacacttctgggtttggcaaatatggaaactcgttactttgcaaagaagaaaacccttcttggcttgagtaaattggctgcattagcttcagacttttcagaggatatgctacaagaaaaaattgaaggtgaaagaatttgagcaaaaggatttacaaattggtcatgccatcaattaactcatgatgtgttcctgtcatcagttagcaggatctatctcttagaaacaggacctgtctctaagaggaatgcatttagttaatgtccatgtgtagttactcaattatatacttggaatttttttagagaaaagtagtttgtattttaaataagaattcctaaagaatagactcaaatgattttgattggagaggtctgattatgtacctttagtgataaatattccaagggcaaaaagaactacaaagcaatcttgacctttacacagtgggtttgttgtaggtagtgtggtataggtgcaataattctgaactattttgtgtatattgtagatgaaaacgattacatatagtacagttggcccttcatattcttggattccacatctgcagattcgaccaaacatcaaaaatatttggggaaaaaagaattaaaaatattcaacaacaattaaaattacaacaagagaattaacaaaaaaattaaaacaacaaaaataatgcaaaattaaaacaaaataatgcaaattttaaaaaaccaatacagtataacagctatttacttagcatttacgttgtatgaggtattataatctagaggtgatttaaggtatatgggaggatgtatgtgggttatgtgcaagtaactaccgtttttatataagggagttgagctttttggtattcctatgggtcctagaaccagttgtcagcagatactgaggcatgatgctattattttttagaaccaaggagagaggagtacaaatatagaaagacagtgaagaaaaactctgtattattgaa

SEQ ID NO: 5158 - DNA, 1033 bp, Homo sapiens
gaagaagaaccaagcagatacttagctgaaggggttgggcagaggacagagtgcaggtaggcaacagcatggaacccaggttttctagtcccagcacaagaaccttgacagagggtgggtaggatgttactaaggtgccaggtaggcttagaccttttttttttttttttttttccagtccccattgactgatgtggtaagttaaagtcagaattaagagaactccacaggattgaaaaagctcttcttctgagttttgcagaaggaataattttcttttttggcttactagactgactgctgtctggcaaggctagtttttattgtccttaaagctgaaagacacagagcctgcttcttcagatagcaaccggttcttagcatttgattctgggatgtaaaggatgagttcgaagtaggactaatgttgtaaaggaaaaaatgtgcttaatatatcatcaagatgattttctgcttagggtggtagcttttacatagcattttgttgttattgttagatgtatttgactctgttttcctttcttttaggagatagtgttttaggtgctggtgcctgtggtggtgttcctatcattttttctagaaacagtggactggtgtctattacttcaagggaaaatgtgtctatattggcagaagacttggaagggtctttagcatcttcagttgctggaccaaacagtgaggtaatgtgattcgataagaatttgaagtttttatgttatttattttttagagatagtgtctcacgctgtcacccaggctagagtgcagtggcacagtcgtagttcattgcagccccaaactcctggcctcaagcaatcctcctgcctcagacttcccagtaggtgcctggctaattttttgttttttggtttggtttggtttttgagacagagtctcactctgttgcccaggctagagtgcagtggcataatcatagctcactgcagcctcacctcaacctcccgggatcaagcagtcctcccctcttaacttcctaaatagctgg

SEQ ID NO: 5159 - DNA, 1007 bp, Homo sapiens
gtaagttctttagtggtgatttctgaaattttagtgcacctgtcacctgagcagtgtacactgtatccaatatgtagtcttttataccttaccctcctcccacccttccccttcaggtccccaaaatccattatcattcttatgtctttgtgtcctcatagcttagctcccacttataggtgagaacatatgatatttggttttccattcctgagttacttcacttagaataacgtggaccaatattcttgaattcctttcaagagtccaagcagaagtgataaagtttggggagctgggggaagagaaccgtgaagaaggaaaatgagccgtgctaggattccttgctttgaagtgtcatgtcatttagttacatgcttggtttcttatttttagttgtcagtagagggtgctttgccacccttttaatctttttgagacttgaatgaaagttgctagtaataggaccgggcgcagtggctcgtgcctgtaatcccagcactttgggaggctgaggtgggcggatcacctgaggtcaggactttgagaccagcctgaccaacatggaaaaaccccatctctactaaaaatacaaaaattagccaggtgtggtggcgcatgcctgtaatcccagccactcgggaggctgaggcaggagaattgcttgaacccaggaggcggaggttgcagtgagccgagatcacgccccggcactgcagcctgggcaacaagagtgaaactccgcctcaaaaaaaaaaaaaaaatgttgctagtagtagtattagatgttttagaagagctaaaataggaaccatttaatttattgggagcaacaagtttgctagacttaaggaacaaataagctttaagatgcaaaatggtttgtttttacatatatagcagtttgaaatttctataaccaatggctaaaaagcattttaaatatatatgtttgtttttaaacattagagacagggttgccctgtttggtcttgaactactgggct

SEQ ID NO: 5160 - DNA, 2121 bp, Homo sapiens
tcttttttttttttttttttttttgagatggagtctggctctgttgcccatgctggagtgcagtggcacgatctcggctcactggaacctccacctcccaggttcaagcgattctcttgcctcagcctcccaagtagctgggactacaggcacgtgccaccacactcagctaattttttgtagttttagtagagttggagtttcaccatgttagccaggatggtctcgatctcctgacctcgtgatcctcccacctcggcctcccaaagtgctgggattacaggcgttagatatatttctaaagttggttatcagagttaatagatctattgtttttggtgttgataattttggaatattcaaaagtatttgttgtgaggtagtcgtttctgagtgtgccaattacttttttttgataaagcgtgtggtaataaagatttatactataagattaatcacccacctcattttttcctttagtcgatgaccagctgaccattaacatagatgaaggtggatgggcttgtctggtgtgcaaagagaagctcattatttggaagattgctctgtcacctattactaaggtaatggctctttagagagctggaacaagatagaggagaggaatgccaattgacttttcatttttaccctaatttttttacagttggaggatagtcaataggaaactacttaggcattaagagtttgcattttcatagtgatgtgaaataatgagcatgcatacacatttgtgtattgggaaaaaagtttcccccttttgaagatctgtgttgtttacatttaataaaattagagtcattgatatttccaatgaatataatgctaatccgtctgcctaatgaagtatcagactaaatgctatccacataagcaaatgaactttgagtttgcgtatttctgagaagacagaactatgttttgttgaacctactgaatgatgcttaataaaataagaaaatatgataccagttgctagttaaacttttcacttgtccacttccaacagtgggttatcatttgcatgtctagtaacgtatcctcagcaacctttttctgtttgttacagcttagatacactactctcttctaccagtcattacttccttggccatgttccgttggaactcagggctcctgcttacctcaattcttcacttctgctgaactctgtgttactgctgcctagaaaagggtgtatgtggttaggagtaataggtgagggtgaattcctgggggacatactgagttagctgcgggatcctgatatttggctgagagtctaagaaattgtttcctaggtaacttggtataattactctttggtcatgctaattttaaatgtcagatgaacaaatcaagagtaaattgggaaagttccataggaagcctaagcactcatcttaaccttacttagtcttctcttaactggacttttctagcccaggaagaggttaggatagttgttcttcagagtttggtctacctttaagttttcatgattcaatactcttaagatactttgttttaaaattactgaaagcctgattaaaaggagatgtgagaagaaagaatatttgtagaatggtgtttccagcagtgagtcagaatctaaaatatgcagagaagggaaatcagatgcatcttcaaaatactggatttgatgtgaaagattttctgtttgggtttgttctacagttatccgtttgcaaagaacttcagctgccacctagtgatttccactggagtgccgacttagtggctctttcttactcttctccctcaggtgaagcacattctactcaggtaggtgacttaaaagcttatttaaataaactttttacaacaaggacatcctaaagttagaggaatcatcctctttgattttgagatataactataaacctatagaaatcaagatattgtggtattggcaaagagagctacacacataggtcagtgtaacagaatagagaatacagttatagatccacataaaggcacccatttggtctttgatgaaggtgcaaaagcaattcagaaaggatggtttttgacgatgatttttctctgtatcaatgcatagtgtaggaacatttg

SEQ ID NO: 5161 - DNA, 1055 bp, Homo sapiens
aaggtctgtgtataaatcttatcatgttttaagaaagtttacaaacttgtgttggaccgcattcaaagctgtcctgggccacacgtgtccctgggccatgggttggacaagcttggggtatacagtatggatatgctgcacaaagggttgattcacaacctttaggcaggacagtatgagattttatcactttacccagaacagcatgcaatttacaacttaggaattgttcatttgaattttccatttaatattttcagactacgattgaccacaggtatttgaaactgcagataaaagggggaaatactgtatatgcaaaattcagtcctgtttacagagttgatcaggtttatgaagtttcccgtgaaaccccaaaactggcacctcatgttattgggtttaataatacagtaaaatcaagtcctacctccatttctggatcctatgtagcatcccagaggctgtgtgcacaaatttatgacgttaccattgtcgtggtgtacctttagaagcgtctgttggtggagaattagtgtggaattttgacagatacaatcaacacaagcttagaaaggcaactttaaagatgagcagttggatgacactggaagagcaaagttcagagcagccttaatatctgctgaagtcatttttattaaggcttgaattctagatctttgtgatttttctggaacagtatttttcaaattgtaggggtgaccaaaatttagcggttcttgaccagcatttaaaaaaagaagaaatagaatgcatctcatatgtttagtaaattttgttcgttttacttaaattgtatatgggtgtatcgtgatgtaaaatgtattatactgtgaataactctatttactgtataacttaataacagtaaaaaaaaaatgctgaaattactctgttttagaagaaggaatatatctcatcaactggaacttggcacatcttgcctgtaggtccttgggagctttagggatagttgttttcagacaactactaacctttctatacattgttctgttttaaataaataaatgtat

SEQ ID NO: 5162 - DNA, 1052 bp, Homo sapiens
gtgcagttttcaacattttggcacatgaaagcctgacaagtttttaaaagggcagaagctttattttttgaacaggaaaacatgttttttaaattcacatgtttgtatgagtacttttgcgaagcaaggcatgaactgctaggtattattaagaatgaatgatttttgcatttaagttgtttgaaggcatgtattttgaaaaatatctgttacaaatttataatttcaagacaaattgaatcttattttataatacttttggaatttcattaataaggctaaaatttgaggaatataactaattttcagccttaagacatttaagtttggaagtccttgctattcaacagaataacaagaaaacttcagaatgtatcactctcctgaaaagaagatattaataagcccttttatttatggttatagttttatttatagtctcaaaattcctaaagcaatgctacaaccattgaatttgccatattttgtatcagtgctgttaatttgctgttgcctcaagaaaaagtgctttttctccatggatgaggctagaccctaagaagtaattaagtcaatgtaaatcaaatggaagttttcccatgaactaagcatttattagttccctgattagactggaagaagaaaccactatttcatgaaaagcatggaatattatattttattgttcataattaatgaataaaattgatatgaatgaatatagtgttctttgaattagtaaacagtacatctgtgacaatcatttttaacaagctctacttgtgttctttataaagtgtgattttcagaaagcaaacaacacaattacaaggttgaatctgaggaaaataatccttgtgccatagaagtatttacgaaattgcatttcattgttatgttttattttctgatacatgatgttcaattttatctttaggtaatattttatatcatagattaaaatttatagtgaactttatctgtgtctgtcactttttttttttttatgacccaggaaccaaagatgcagtctgtcatttcttataaaactt

SEQ ID NO: 5163 - DNA, 1035 bp, Homo sapiens
ccaggtgtgttggtgcacacctgtagtctcagctacttgggaggctgaggtgggaggatcacttgagcccaggagattgaggctgcaatgagccgtgatcatgccactgcactccagcatgggtgacagagtgaggccctgtctcaaaaacagaaagaaaagaaaatacttggtatataggaagtcatcaatacattttggctatgataataattattaattttgggattgatatattttaaacctatattttaaaataggtttctggtctatctgtgtcagctatgactaactagaagaagcttgccttcaaattgctatatggtttatcataaaagcctattactaagattttttgttgaggccttctttttttaaatgttgtctttgtcaggtgggcagaaacagcggattgcgattgcccgtgctctgctaaaggtaagcctgaagcgacttggatgttttttaaattagggattatttttattagggaccttgtaatttgtaatttactatttgtcttcttccttttcctgttttttgtttttttttttttcttggagtgggagggtgacagttctggtgaaaggtaagttagtgtagtatattgtccaaatttaacaagtatttcttaggtatcatgagctcagtactgtgctaaggttgttggaggtagaagaatttaacacatggaccctccatcaagaagcatacagtctagccagtgaaacagtgattattaatgcaaaatataaaacagcgtaagtatgcatatttgtacaatctgtaatcagctgctaaagtgaatagtacagacttgaagtacttagacaagattcctagaaggaaagggaagagccattttagctgaaaggcgggcattctctttttaaggaagcaatagccttccctttgttatacaactgttcttctcaggcttataggtgattaaaaaaaaaaagcagctttactgaagcagaatttacatatataaaattcatttattttaaatgtactttccagtgacttttagta

SEQ ID NO: 5164 - DNA, 1130 bp, Homo sapiens
tccgggtaggtaagataaactctggagctacacagaggcagtggcatagagagaaggccatcggatttgaaaccagactaacaagggtggatcttaactccactacttgttagcttaagcaggttgttgtctgtggtcttcaatgtcctcatcagcaaaattggaattataatttctacctctcagggttgtaaggatcaagtaagaccgtctacgtatatagtaccttggacatagtaggtgcagagttggcacgtggtaagcatttagcctaggtttgcttctgacttgccctttaagagctcatataccaggattagctgtggtggagtcacccatccatagccagatgagtaggagaaccgagttcagcttttgagtttaattttttgctgtaagtaattaatattccattttatgtttcagagggggtcatcttaaatgagaaaagcttccagggtgctttggagtttaagaacgtgcattttgcctatccagctcgcccagaggtgcccatatttcaggatttcagcctttccattccgtcaggatctgtcacggcactggttggcccaagtggttctggcaaatcaacagtgctttcactcctgctgaggttgtacgaccctgcttctggtaagcagttcaccacactgtagcaccgagggactctcccgagctctgctcccacttttgcgccctaggagatgctcaaaccatgcaaataccttattttgtagagtaccttcttttctaagtgccagtggaaagaaatccctcaaacagaaggtgtcatttgcaggggcatgacagctcatacagaggcctttagagctttttgtgtgtaatgtgtcctacctcttcaagcccagagtgacttccccagatctacctcctcatctcccatgcgggtatctcctctggacatgccctctactgggagcaggtggacgaggctgtgctcagcagccaggacagagtgcctggggtgctccagcagcaccctggagaaccaccgtgtgccagtgcgcgtgctgggcgcaggagtgatagggagctcctggagaacctctgcctctgcctgtgagccattgaatgcttattgtgcacacagttaacttggccatcag

SEQ ID NO: 5165 - DNA, 1846 bp, Homo sapiens
tatcataggcagtgaggtttatccgaggcgtgattattgccaattgaaaacttttctcgatacccttctgtgatgacttgcaatgtagtcagcattggcaaggttttttttttttttttttttttttttttttaaagggagtctcattctgttgcccaggctggagtgcagtggcatcatctcagctcactgcaacctccacctcccgggctcaagcaattcttgtgcctcagcctcccaaagagctgggattacaggcatccgccaccatgcttggcctttttttttttttttttttttgagatggagtcttgctctgtcacccaggctggagtgcagtggcgcggtcttggctcactgcaacctccacccccccaggttcaagcgattctccagcctcagcctcccgagtagctgggactacgggtgcgtgccactgcgtccagctattttttttgtatttttagtagagacggggtttcaccatgttggccaggctgatcttgaactcctgacctcaggtgatccacctgcctcggcctcccaaagtcctgggattacaggcatgagccatccacgcctggcctaatttttgtatttttttttttagtagagacagggtttcaccctgttggccaggctggtcttgaactcctggcctcaagtgatctgcccaccttggcctcccaaagtgctgggattacaggtgtgagccaccgcacccggccagcattggcaatttttgacatctctatggtgaccgaatgaatttttttcttacaaaaaaaattttagttttgtaagaaactcccaaactgccttccaaaatgtgtgtcccatttgcatccccactagcaaggaatgagagttcttgttgctccacatccaccccagcatttagtggcgtcagtgttctagcttttagccattctgatagatgcatggtatttcattgttgttttagttggcatttccctgatgacatatgatgttgagcgtctgttcatatgcttatttgctctctgtatattttctctggtgagttgtctgttcaggacttttgaccatttttaagtaagtcttcatgtttccgtattgttgagttttaagagttcttcgtatattttgggtagcaatcctttattggataggtcttttacagatattttcttccagtttgtggctggtcctcttcttttcacattgtcttttgcaaagcatacatttttaattttaatgaagtccagcttctttctttcatggattgtacctttggtattgtatctaaaaagtcatcaccaaattcaaggtcatctacacttgctcctaggttgccttctaggagtttattgttttgtgttttacattaggtctgtaattcactctacattagtttttgggaaaggtgtaaggtctgtgtctagattccttctttgcatgtggatattcagttgttctagaaccatttgttaaaaagataatatgtatattgccgttgcatctccattgtattgcgtttgcttctgtgtcaaaaatcagttgactgtttatgggggtctatttttgccaaatgcatttttaattcagcctaaaaattttagtccattgtatcttgcataaatattcatactgtagaatatttgaattgtattttttcagcatcctcactgagggaaaatgttacaaatgtatgtcctcacatttgatgtagaccattgcatttggggtttaagttgttaaatggttcaggctaggcatggtggcttacacctataatcccagcactttgggaggctgaggtgggtacatcacttgaggttgggagttggagaccagcctggccaac

SEQ ID NO: 5166 - DNA, 1097 bp, Homo sapiens
caaaatagcttcattctgaggccttttctcttggctggtaggcagctgccatcttgccatgtgctcacatagtggagagagagtgtgctctagtgtctcttataaggacactaatcctattggatcatggccccacacttaacgacctcatttaaccttagttactttcttagaggccccatctccaaatacagccatggtggggattaaggcttcaacatgtgaatttcagggggaatttccattcagtctgtaaaagggcctcaggaagtggcttcacctaggatctgatctttggctctaggggatcagaaatgtgactttgtttctcctgcacaaactcatggacctgacataggggaagtccagttatgagaacctgatattgtgtatggcatactgccaatttattaatttacatagtgggcctacccaccattaagttgtgtttctgctattcctttttttttttttttttttttttttgagagaaggtctcaccctgttgcctaggctgtagtgcagtggtgtcatcttggctcactgcaacctctgcctcccgagctcgagtgatcctcccacgtcagcctcctgagtagctggaaccacaggcgtgcgccaccatgcccggctaatttttgtattttttatagagacagtgtctcaccatgttgcccagcccactggttttgaactcctgggctcaagcgatccgcctgcctcagcctcccgaaatgctaggattacagacgtgagccactatgcctagcccatttctgctattcaaaacacttcattatggtgccagcaccctgtattagtcatcagaaggtttttcattaagtgtggaaccagagtgaagggaggggggtggttctggacagttctaggagaatcttgatggactgtgcctgccctacacagaggacacctgtccagttggttcattttgacatcagttgtgttcaggccccagaagtgttagacctgccctgttggtctcatgtcctgatggtgaccatcagagatatgattatgttccccaagactcaccccaggtgtcctgatggacttgtcttctcagggtgggacattcc

SEQ ID NO: 5167 - DNA, 1758 bp, Homo sapiens
atcacacccacctgcatccgtggaaatgtgtcccagactccagcaaaccaaacatgtctaaaaaccaaagttacctttctccgcaaagcatctttcctcttctgtctcttggttcagtgagagagactgcagtgcgaacctcttggccttggccagagacatgggttgttcttataatggtagtaataaagataatagttaatatttcttgtgtactcagccctgggcattgtaccagatgctttgaatatgtgtgtagtttactcataattctgtgagggagggattgtttctattgccattttacaaatgaggaaactgggcacagagagatggagtgacttatgcaaggtcaaacagctagatggcagagcttaaaaggagaacttaagataacgaatgcctaacctaggagggccggttctgaggttgagttcgtcagggttccgacccaatgctgaccaactcaacctcaaaacggccctcctaggttaggcattcctcatcctaaatcctccctttaaccctcatcttatcctcatttttcagagaggaaaaatgctcacatccaaccagtcatcacgtcctagttcttaaaaatatctgtagtcctatactctgccctttatccctctgtccccagcctacttcgccctaagtttgcttctcacctagggcactagaacagtgctctgtccgctgctcctttcgctctgtagccagagtggatcatttaaaaatgcaaatctggctgggtgcggtggctcacgcctgtaatcccagtactttgggaggctgaggcgggcggatcacctgaggtcggcagttcaagaccagcctgaccaacatggagaaacctcatctctactaaaaatacaaaattagccaggcatagtggcgcatgcctgtaatcccagccactcgggaggctgaggcgggagaatcgcttgaacctgggaggtggaggttgcagtgagctgagattgcgccattgcactgggcaacaagagggaaactctatctcaaaaaaaaaaagcaaatctggctggatcattccccagtgtaaagcccttttaggccgaccttgccacaaaatccttctgttctataatctagaggcttcatttcatttctcagttctccttcctgtgcacccatgaggtctctgcccctgctccatcctgccaggctttctgctcccttccctgattccaaggtgaggcctgtgcttcctcttcctctgcttgggatgtgggaagatgccaaagacaggctttgtcgcagaatgtggttctgtgatgtgtaaattgggagaccttgcgtaggctccctctctctgtgttcgagattcctctctgaaaaacgaggataagatgagggtgaaagggaggatttaagatgatggatgccagatccttcagataatggtgaggactctgaagtgctgcctttgagtccttgaatgacagtggggattgctgtacctgcctgatataaccagatgggtgccctgttcagcagtgggcaggtggtaggcacagtgtacagcttcctccaaccacccccaacctcttctatccagcgctgttgtccagcaatctgcaattcagattttccttcccctttcttttgaaggatatttgtttccatctttgctgcaattcagtagaatgaggtaacaaagatacttgaaggtatctgtcaagaaatagataatgggagaagttgctggggccgcatcaggcaagggtgggggca

SEQ ID NO: 5168 - DNA, 1088 bp, Homo sapiens
tgtgcctggcagatagatgaggctctgacctgagtgagttaggggcagggttttaggagcaaatgtgggcccctacagtactgtgagattagggcaaagctgcctcctggaggttttttgtgtggggggcttcggcggggtgggcagcatgccttcattaaactgtggactgcacacatgtatcccctccgctggggcatgttcagttggtgcctgtgtggaggactcaggagggctcctctcactgcagttactgataaggggctggtgtgtggtttgagggcaggactgctctgagaacctgaagcctgctggcagcttttgctgagtttgtagttgcattttatgaagatgggccgtgagtgaccacagtgaatatagtgacaaaagcagtgggtatggtgggcaaggaggccagagtagctacttcctgaagcccagtgaggatggagatcccgcagggacagtgccctgtgggggctgggatggatgaacctttgaaatcggaactgcccccgaaagccagggatgtgcgtgtgctacagaaatacattgtttcagcgaaactgagcattctgtagctgtgctgtcacatcagattccagaaggacagtagagaaaaaatgtaaaatatcttactaattttttatgttgatcatgtgtggataatattttggatatattgggtcaagtaaaatgttattaaaattaattttacgtattcctttttataatgtggcaactagagaagtttaaattacctaggtggctcccatcgtatgtctgttagagtccatggcgaaccctcctgtggttcatgggacaggtacccctaactgttttattttaattttgtctttgggatactcctaactctagagcatgctaatagcatggacagagacagtctgatcttgcaccagacacatgggggctcagatctttcttctccagatttccagaacctggagtccctggcttcttcctctactcccttctcatctgtcagccgctcatgtcctcactcattctctacccagcgcagatgccgagtctcttcactcagcctccatctcccccacaccctc

SEQ ID NO: 5169 - DNA, 1030 bp, Homo sapiens
gatgcaagggccttgtaagatctaaaattttttcgatttctctaaatcttcactccttctataaacatctgttgagccctcattctggactgggccctgggtttacagtggcatgcacaaggaaacatggtcctcacttctgctggggcttctaggttagtggggagaagcatctatgaaatattcgtatgtatagaggtaaacctgcacctgtgggctgtggaagggggcctgtggggcctgtgaggttgtcaggtgcaacaccagaaaagcattctttgctgcaaatccattgctttagaaaggaccctcctgggtagtgatttgggatttagagtaggtttgcacagtggaggagagcagttagggtggcgacttttcatctaccagttgctatgaaagcttagggggctgttgatatcactcgggtgtaaagagaattatttcattgttcagttggttgagtgtagattttgttgtaaaatatctttttctctttcctctttttaaaaacattggagactaggagctctcactggactttgagctgcttgagacggggactgtgcgattcatctttctgtctctagttcttagcatgtgcacggcacagagcaggcgctcagagtgccttcagtgaaggaataaatgaccataccaccaggcacagagtgaggcctttagaaaccctgagcatcatcgggtgcgcccaccacttctgtatgtgactcaaagtaagtgtaaggaaatccagttctgttttgtttctgaaatactagatgtcaggaagggtgtttaggtgtcaggctttggtggcctacacgtgcccagtcctcttatgccatgaccattgttcctgtgacccctcactctgtccccagatatcctgccatgctagtatgttttggtgacagccttaaacaagacgagactgcctccttttttctttcttcttttgtttttctgggataggggtctcactgtgttgctgagacttgtgttgaactcctcagctcaagcagctctgcct

SEQ ID NO: 5170 - DNA, 1046 bp, Homo sapiens
gcacagtgtattgggagaaagggaaatttcgggtgacagattgatcaccctggctgacatgtttctggaagtgggtgggtgggtttgattgagaacactttgggctcctgcagtgatggtgggaaagaaaaattctttccaaagctgcacttctcttaataattctctcccctcaaaagaaagattatgataaagaataatttggagtaataagtaacaagatagaattagaaaaatgttgaatttctgaatgaccattcagaggtgtggctttttccacgtctttttctcctgcaatgaactgctcccacgtcctgcactgcaataccagtctaatgaacactttgtgaaacaaatcgtaagtatgtacgcacgcatatcaaactatgctctgaggataaagcaagttctaatttgtggaaaaaggattaaatatttctgttttctgaaaagagttattttgtattttgttttctattaaaatgtatttagtttcaaaaaaaaaagtgttggcatctcatttcatctctgaggacaggcgggtgagtgttctgtcctgggatggtgtgtctctctcacctctcatcagggcaataacccgtcggttacctaggccacactgtccccaacgaaggtgcatttttatctgttcttgggttctgtttagcttactttgaatcatgattcccttagtattcacttggattattgatggcatttaatgctgtttgtacatccaagattgatagttgctgactggagaccacatatatttcaccatctagagtcatttgatgagatcctactttgcacttccttcaaagaccccactataaaatctccaaggggcataagaactggactgttcaataaactcaaactatgtattgaacaattccagataaaggactcgttcaaagtaaagtgaacttcaaaacataattttctcagccgggtgtagtggctcactcttgtaatcccagcactttgggaggccaaggcaggcagattacccaaggtcaggagtttaagaccagcctggccaa

SEQ ID NO: 5171 - DNA, 1048 bp, Homo sapiens
catccctgcaccctcaccacactggatggatggtattggctttctgaggccagtgcatatcctgtggctccatgtaccccggggtgttcccagaccccacttggagaagtaacacaggaagtagagttgccagctcccctccccccgtcagtcagtgttcaatcttgtttggcttgtaaccgtttaggacagtcattgaaaagggcaggcgcagcttgggtttcaggtcaccaaaaatcactaccttagaaaaaatgtgggccaaggaagatagaaattaaacttcacagcattaacttttctttagagtggtcctgaaaaagctgtgggccaaagtatttttgtcttatcaccactgaaattcaggtagctctgcctcacattactttggatggaaaattctttacacaatgttgaataattaaggagcaaaaaaatcactctaattaaattacagttaatgataaggatgtcaagaatattgggtgccctaaattaaaccattgttttcctgttcctgttttctgagtccacttccagttaggatggcctttgaatttttgattcttgcaaccgagacagtataattgaaggatttccttgtgatgagtgaagagtctagattcccatgtagaagctttaatttctagaattttatagtactctccaaaatattttttattacatttgtatttgaattttcaaacatctcttttccttggagacagttccctttttgggagttcttctgataaaactgaggaatactgcctgcatttgctttcgattttctgtaaatacaaaaaaaaattacactgaccttattagctttgatgatacagagtttggagattattctgtgcattaaaaattaatattaaagaagatagcattatgacatctgataacagtagaccaaaataaaacattttaagactctggccactactggtaactagctctgtggcttgtcctatgtttatttccgggtatcagaagtgtatctgaagactcagaagtgaggaaccgcatgcggaattccaggaac

SEQ ID NO: 5172 - DNA, 1048 bp, Homo sapiens
gttaaatttttctgcaagttgcttaaagcctcagaaaccaatgccaatgataaaaaatatctctaagttcttacctctcaatgaaagaaacccttattataaattcggtttttctttttttatccttagtggaaattgatcactgcactgaaatatttaagatttatatgatatgcagaattaatggaacttcctttttttcaaacataatagagtcattttactaaagccttaattttcatgatttttcgtttttgtaactattaaacagactattctctacttatgaattctgtcacccaacaaccatgaaactgataagataaccccactagagggttttattttgtaacccttatttcctgtaatattttgaccattttctccaactgtagactatagtaaatatagattctttgctttaaaataccattatgggggccaggtaaaactaggataattctatgcgtgtgtaaggccaggtgtattattttggtttatatattgattactgtatactcgtcgtttaccattaaaaattattaccacaaggattgtttggccagaactttacatttcaaaagattatagtctatcaaccatttcctttaagttcttactttatttctgaactgagaaagttgtctgttattttgtctgtaatttgattctttaatcctttggtttaaaggatcattattttaaaggggttaatatatattgatcactttggactgctgctcctggaatatttttctctaccctcaggtctctgaagagcagttaaccaaatcaaatgaatagttatttcctgatcaccaagataaagtgtaagatatactcattaatctattttagaagcagtcctagcataaaaacactataggtaaaagtttttacataaaatttgaatatcacagaagcactttcacagaccagcatgagatcaattgctgaatcatataggaattgcattcagaatgaaaggagaaagtgatttggttggcggtagtcagagaaggctttactgagcaggaggtaggcttta

SEQ ID NO: 5173 - DNA, 1050 bp, Homo sapiens
cgtcttatcccttattttgagaacaggacatcctatttctgtctgcagtggtgtttgcaaatagagcatttgtgaaagttttctttatgtagtcaagcatagtaagtaatgtaaagagccattctgtagattgtgccacactcttccatgttaataagattttgtatagaaaagcagtttttctgtgctgtaaaacagtattaaagtagaaattcaaaaagatcacgagcttaaaataaactctcaagaattccaagaagctagatagcactcacgttatttttatgatgagtttcaaagataaggcctgtcctcagggaactctccatctgtttaggggaactgaggaagagtgatggcaagaggggacaacctgcatgagggttggggtgatttaggcttggttgtaacatcattagatttgtcatgtactttggctgcttttcaaagggccatatgaggagggcctaaaggtggaagaatattggaatagtccagttgagaagtgatttgtagagtcgggcatagtggcatacacctgtaatcctagctacctgggaggctgagctgggaggatcatgagcccagaggatggagaccagcctgggcaatatagccagaccacttctctaaagagagcgagaagcaatttgtgctgtcaaatagcaaacagtcaagatggggtagcagaaatggttgagttgcactagccgcaattttttttttttaagttgagagagaattcccatttagaataggagttggtggcctctttgaagtaagggagagagagaacagaattttatcatgactggctttttggttgttttgttttcttttgttttgtttttgctttaatggtggatagtggcaccattaagccggctaagaaaaccgggagaaggaagaggtattgcaggtggaaatgtctgttaattgactgagttgaggaaggtggtctgactgtaagtcttgcatggtggtgtggtgaagccgggaatgtgaagaagcagtggcagacagtaatgggagggcagagccacaagagag

SEQ ID NO: 5174 - DNA, 1035 bp, Homo sapiens
ctatcccgggccatcgatatggttcccaaagagctgagtgtgctgctcctgtggttctgaggaggggatgcctcttggctcagagaattaggaggatgggaaaagaatcttctagctggaagaaaatatttagatatggaatttggatttttttcaagagaaggttaggtaagagataaaaaagatctccttgcctatttttagaagcatctaaactgagctcttcacccagggcgtcatcatgtacctcctctgccgtgactgagggtagtgtcctccagcatgtccacagggagggtcactggtggctgcaccgtgcctcctcaggacacagattgcattggtctgggccactgtccccccaccctgggggattctcaggcagccaaggttgaggagaagaatcagagctgagagtctggttgtccctcctagggccacacagaccattgtcaaaagccagaaaggacattcctagaataatttctgtgtttataaagggatagattcatggaaacttgagtgctgctggaatgttctttccctcttacgaacatgcagcttctctttggctggtggtgtagattgagccccagatgggtgattttggacatccttaccctggttcatgtcatcctcctccctgtttctaagaacagattctcctttttacatctctagatgagagtagcttgagtggtcacgtgcggttgctaggaatggagctgcgagcagcagctccctcctcttttcagcagcgagactcaaaagcacctccgggtgcatcttccttcccacctgccacaaggaaaggaattcggaagaggaaaagattcattcaactgtccttcttccagtgcagggtgggatgcggggatgaggaaagcagatgcatgggatatgggatgtgttcaggtgaccgatggcactgtcggtcctccgggagctgagcagagagtaaaggctgagactgctcccagggtctctgcgtcccctccaggctgctggggagcagctgagtgcttgtggcccctg

SEQ ID NO: 5175 - DNA, 1050 bp, Homo sapiens
tcattctgataaatactttttatacagaaatagccgcttgagtgtatagtcaacatatatttataaacacacacatatacacacacttgcactgttttataatctggctacttacaaggatattgtgaacattttctatgttattaaacactttttctacatgatgattttttaaagtatatcacattccattatacctacatatataattttaaccagtctgctcttcatgtaaggtagttaggtcattgttaatttttttaccattataaaaaaccctgaaatggacatggtattttatatataaatccttttaacacatttctgattgttaccttggattgaattcctaaaagtgaaactcatgagtaaaatagcatgaatatttttaaggtttttacaaaatttattttttaattgacaaataaaaatagtatatttttattgtgtacaacatattttgaaatatgtagacactgaaatggccaaatcgagccaactgacatatgcattacatcacatagttatcattttttgtggtgagaacacttaaaatcgaccgtcttggcaatttccaagaatatattgttattaactttagtcaccatgtggtaccatagatctcttgaacttattcctcctatctaacagattttgaattctttgaccaatacctccccactcccacttccatcccccagccccgtaaccaccattccactctctcctattagttcaacttgaagttcacatgcaagtgggatcatacagtgtttctcttcctgtgctcggcttatttcacttcgcttaatgtcctccaggtccatgttgttgcagatggcaagacttcctcctttttaaaggctgaatagtatttcatcttgtgtatatgccacatttcctttatccacttatccactgatggacacttgtgtttccatatcttggcgattgtgaataatgcagcagtgaacgtgggagtgcaggtatctcttagagatcctgatttcagttcctttgggtgtgtactcagaagtaagattactggat

SEQ ID NO: 5176 - DNA, 1021 bp, Homo sapiens
aggaaaagtgaaaagcttggcaaccaccaaatggtacattttcctgctctagagatacttgtcaagcagtcttgtagctcagaagtgtctataactggctgcattttgcccagtgataggaagtcacctatgtctacacacgttggtggaaccatattagtatgatagtgctttctctagatatgtctagggagatatctgactttttgaaaagcagaccaggaagtagtcacacatctaagtgaatggtatttccttccgtgtcgtgtctggggagctcttgtagaaagtacccaacccagtgtctgaatacatgtgtgggttcccagtgattctgctgtttctcagattactggcaggattccttaggattgtcttttaaacctggacgagatcattagcatagcttgtatagcttaagcatttgtagcaacagagcatggataggataagacttcactggaggttgctcatccagctaagggaaacaagttactacctttgaccactgacgttattctgtcaaagcaaaccaggaccagtcaggtaccggacctgcctggccatcagaccaagcagtacctcttagactgggccttttcctggccagattttgactgccttgccaacagtttttcctaaatcatgccctcaactgagactttcaaggttacctcttttttgtatttatttaaatgaaggtcctattttatattcacttttagaaactcattattttatagcaatgagtgccacacatttgggactctctttggactctcattggtgccacttcttggctgcatccttcttccagatttcctaataagaaatctttgaccttcggctcagtgcctgtctcctctggctcagtgcctttagctcagtgcctgtccccttctcctgtgacatcccagttgagcgtccacttcttcagaagaggctggctggagtctggaaaaatggcagttttcagaggtgcatgtgtggacacgaggctgagtaatttcaaggcagtcct

SEQ ID NO: 5177 - DNA, 1056 bp, Homo sapiens
cactatccttgaataattgacggctgcacccaccggaggctgcaaggctgtgctgaaataaaatgattttcattaggagtaggtgtggagcttcaggctacacctgcggaatcggccctcattcatcctggcctcatcgtcatgccagccagggcctcttcctccaagacctgtttggtgcccaaaaaatggttggtgaaagtgatgtatgtggtgccactttaccctccaggctactgttgcttctgtaaaatgcagatagttagagtcttccttggaaagccctcggcctggctgtcaatgaatttctgttgatgatatcttggtaaaagttaccaagcctcaggaacctcccttagggccaggcaccaggtgaggtgcattattcacatgatctcatttatttcacgctgcatgacaacctttcaaagtaggtattcctgtgtccatttttacaagaaaactagagctaggagggattaagaaattcctctaagactgtgcagttagctagaagtaaatttggggtgtcagagccccatccatcactctgattctaaaacttgggctgtctcatacacattatctctcttaatttttctgcagaaacttgtttttcagaaactgtctaaatcagtaataaaggaaggttggagagagtgatgattaaaatctgaagaatgagaacaacttttgttagcaatcgatacacaggccgggcgcggtggctcacacctgtaatcccagcactttgggaggccaaggcgggccaatctcttgaggtcagaagttggagaccagcctgggcagagataggcaaaaccccgtctctactaaaaatacaaaaattagccaggcgtggtggcgggcatctgtaatgccagctactcaggaggctgaggcaggagaattgcttgaacctgggaggtggaggtttcagtgagctgagattgcaccagtgcactctagcctgggtgacagagactccatctcaaaaaaaaaaagaaaagaaaaatcaatatacagatgcaatagaagcaaattttgtctcttaca

SEQ ID NO: 5178 - DNA, 1050 bp, Homo sapiens
gataggaatatttttgtggtgttgcagcacattctggttatatttttgtacctgtttgatttagcctggagataaatgattccatcctcttaagcccttcatttaaaatattaattgattctatctatatcacaaaacggctgacagtttgcaccaaaaaatatcagcatatgcaaaattcccttttcactgacccctgcaaaaccagtgcttgaggctctaaaaggctgcagtttagaaggcacataaagccactttttttttttttgagatggagtctcgctctgtcacccaggctggagtgcagtggtgcaatcttggctcactgcagcctccgcctcccaggttcaagcacctctcctcccttggccttccgagtagctgggactacaggcgcccgccaccacacccagctaatttttgtatttttagtagagacgggatttcaccatattggccaggctggtctcgaactcctgacctcaggtgatctgcctgcctcggcctcctaaagtactgggattacaggcatgagccaccatgcctggccaaagccatccttttcttcctgatggggcaagggtggggattagtcccacctgtggggcgcttagctggcctccagatctgaatgaaggcagagagcaggagcggcccccaggacctgcatcgctaaggcccagagctgccttcttgcctgtgtgtgcgaggtcatgtgatcttcttacccgctgtggggtggtggttcccacttgatcaataaagaaactgagatgcagagaggttgtgtgtcctgaattctcaggccatctctcacctgggactcagtaggcccacccccacttgatttcctagatggcgtgggcatcctcagggatgtgaccgagaggtgtgcccactgtactttcaccactcgtcccacccacccactcaggcctccccatatgcacaggtgtccctggctgacctaaccttgtcaccaggcattagcacagggactgttgccatagagacccaatgcttcccactgaacacagaaaagatgctcct

SEQ ID NO: 5179 - DNA, 1041 bp, Homo sapiens
gcagcttcgagaggtgaacaccaaaggggctcttggctttccgtgccatttccatagagttctctttcagctcttagccatgtgcgttgaggctgtgagggcattggaacagcacagtctcccagtaagaccacagtgtggtggtcaagggcagagactccagagctggaccatctgggctatttctagttctaccacttactagttctgtgacctcattagaggctaagagttaaggcacatcccttaacctctctgactcagtttcctctttggataaatgggtgttaagaatagtgcagatctcatagatttgtcatcaaagaataagtgaatcaagtgatgtgcaaagcagacagaacacaagcctgcacataaacacgtacagccatatgcatgttggttctacaaaataaatacacatgatttgcttctatttattgataaataggatgtttcccttggcaacacttctggagctgggctctggaagcgtgaccttgagaaaggggaggggacagtgggacctgaagggcagagtccccacggctcacgaaccgcagcgctgacctttcccttgtttccatggggaatgtgaagaggatggtgccaacagcctggaggccacgatgggaccagcagtgtcagggcaaggcaggtagcgccctgccctgtcttgactgcagtggctggaggggaacgcagagcatctttcctgctcccctgcagctccatccccgtcctttccctctggtctccttttccgtgttacgttctgcatctgcagaggctcccgtctctgtcatcaacgtaactctccttgtgagatgaggaagctgagccctgtgcccttgtcacttatttgcccctgggcggacagtggctggggtgcattatttctctcctttccatcatcgtgatatctgtgtctccatcctagctacccttttccttatctcttccttttctctcattctttctctctctcatcctggcgtgggtgggtatgcagggaattctagggatataattagtagccag

SEQ ID NO: 5180 - DNA, 1025 bp, Homo sapiens
tcactgcttagaggtattctttgaatatttttaggagtaaatttcagatgttgccccgattataatttttacttgtgatatttctgcatgcagttgtttcctctcataatcgcttgaggaaaaactaggagtgtgtcaatggagcaatatgtctatctttcaagataaaatcatttttgaacttctgtctgcatctcagatttttttttctatgaacattagttttgatgtcttccctgaggagacaatagatatcatgtaaggaacacttacgctctcatgacacatcagtttgattacccagaattccctgggacagccagccagaaagggagggagaaacatggctgatttcctcattaatccagcaagcaggctgtcagactcaaaggcctggatgtgtttgcacagccaaatgtctgctgtacaagatacagaaggagcacattaattcagggaacagtttttttttccgtaatatggtttccaggaggaacttaataatcaggattcatagcttgggcaaatctcagcaattcttcatcttctaactactgaaaatgataatttgttcatgataatcattttaacagccattttgagtgtcgctttagtcttcatagacttaaaactacaaggagttgtctgaagacattcttaagaggtctattattgaaaacagacatttttctgtaactcttttcttcaagctctgaatattcttttttagtcctagattgaaagtgacgtattctggactggacatggtggttcacgcctgtaatcccagcattttgggaggccaaggcaggcggatcacctgaggtcaggggttcaagaccagcctggccaacgtggcgaaaccccgtctctactaaaaatacaaaaattatctgggtgtggtggtgcacgcctgtaattccagctactaaggaggctgaggcagaattgcatttgaacgtgggcggtggaggttgcagtgagcgaagattgcgccattgcactccagcctgggcaacaagagt

SEQ ID NO: 5181 - DNA, 1071 bp, Homo sapiens
tgtcacctaatgaaaaattagtttgtaatctttatagtatttatgagtctgtatcttttttttctaggaggctgatgctgtctgcaacttaatcttatccttagtttattacttttataatttaatgccactctctcgaggatccaggtaagtaatatcctgtcattaaaattattttaaattgagaaatgtgttcttttttgcttatccttcctgttatggatataggtacagagtacacaaagaaatggtaaggagctccctatttttttccaaaatctgcacaaaaaaatatttccttagtctatcacatcagcaaaagaattatagaagacagttctaatatagtgtgcttacgtttaataggatagggattcatccattcaacacaagttcatggaaagtttactgtgtatcatgtgccgtgctcagtgtgttttaattttttgtatctgccagcctcttactgaacctcttcctcctcctcttccttttccattttgggctgtcaggtgacccataatcctcatgttttatacttttgggccaacagtcactctgtactatttttattattttggataaattcttgctacttgtatatcaggagttttttaggtatcattaaaacaagagctatgactgtagagttttcatttcattctccttttcccagcactgtgtgcagtaaattatgtaaatggccttttgccattactggcacatagttgaacttaagatgttttggctaaaaataatacacttgaatgtctttatctttgattaatggcttagaaagtaaaactcccctaagtgtggtagtaaatttggttatagaatttaagactcattgaaacaaaatagaaacataaatgttgtcttatcagcataatattgctagttgtgtccactgaataagggatgtgaggcctgtgcacatcaccgcttgtgggccccactgtactcaacagccagcatccgtcctttgtcctcacagcagctctgctggctcacgtgtgacattgaaggacgtgcagctctgattgtcctcaactctgcctcatccctaca

SEQ ID NO: 5182 - DNA, 1296 bp, Homo sapiens
ttcaaggttgctgcctactaagatggacatgagaaaacattcaaagggagctcttagaagtgagcagtgccccttgttgacgaagagaacctgtgagcttttggtgctgaggttctctgctggcctctggtaggagctgtggggagcgtaacctgggctctgttggggcctgaagacaggcagagatgtccttggccaccaggccaccatctcttgtatcagatgacctccttggccctttttaaaaacatgtaaggtagagccagcactacagagttgcagttggggtttacagtgaatgaaacactagtaacgtgaattttctttttccctgaaagcagtttaatactaaaacgaaggatgggttcaccgtgaacacaaaagttcccagccttaaagaccaagggaaggaatatgatggattcacaatcacgattacaggagacaagtatgtgcgcttcttaatgtgggtgtaaactagagacgaggcaggaagggtgcctgtgcttattgtcactatagagttttgtggtgttgaacttttgctccatcctgaaatgaaaagtatcaaggtccagtgagcagttataaccagttatttaaaaaaatgtgacatctaaagtattacaccagcagatacattttctgactgtctaaatctaaggactttctagatactatgtatgatgtagtttgtgggagacattcttctgggttcttgaagttccttgggggggcgagggaggcttttactaataaaatgaaaaaagatgagcagttggcggattgaagtccattgtagatttaaatatatatgtataaaagccaatctatatatatatagagagagagagagagagagaaaacagctttaataattaatgagtagtataatcttattgtagaaaatttagaatatacagataagcaaaattaacaaaataaaaatcaagttattttctttaaaaactgaggttagactgttctactatttacccttaccattacattatcacaatcatttccccagtcatattcttaaaagtatttttagtaactgcataatattccattgtatagatgtagaatttctctgactgatctttttgttattgaccacttagggtatttctcattgttttgctttataaatagcactgcagtaaacatttttattaactctagttttatttacatctgaaatccaagctttgtctgtcagcctccatattccttgaattgtgggtggaattgccttgagctgtgcacacacacacacacacatacacacacacc

SEQ ID NO: 5183 - DNA, 1030 bp, Homo sapiens
aagttagttattttcaggcactggctaattacaataatgtgaatcccactgtcaccccagctttctactgtggtatttattagaccactgcacggtaatgtggagcccaagcagagtacagtggtcttgctaagctaaggaggtagagagtggagtttggttctgccaaagtggctggaatttgcagagcagagtataggagagaaggaggccatgtaggctggggagtgctcaggggttaatgtgagcactccttttcatccttgactaagaccttggtcatgaacatgcaataaaagaccatgagaggctcagcagagagtggctactgtgggaacgaaagctgagcagaggtatcagaggtgtatgtgctgagagacattggagtttcggccttgccaatgtggatggatcctgtgaacaccttgggcgtttagttaagaccccagaaaggacacagtttaaaagtaagaccatactttacagtaaggcccacaacctaggactaagaacaatttctaaatagactgccctaacaaagaataaaactaagtctaaaggattaagtggatctgctagtgatttgactacctgtcaaaactcattaccctttaaagaaaggcaaaataacctatactctttaattactagagaagtaaatgccatcgtttgaatgtgttcccctcaaaatgaatgtgttggaaatggaatcctcagtgcacatatgttgggaggtggagcctaacaggaagtgtttaatggcagagccctcatgaatggattcatgccgttataaaaagggctttggggagtggcctctcttgcccttccagcttccgtcatgtgaggcagcagtcagaaggctcacatcagacgctggcaccttgatctcagacttcccagcctccaaaataaatttctgttctttttttttttttgagacagggtcttgctctcttgcctacactgggtgatgagtgagaccccatctcctaaaaacaaacaaacaaacaaacaaaaagctagatac

SEQ ID NO: 5184 - DNA, 1954 bp, Homo sapiens
gaatggtcttggtttgagctctcgctccaagctccatgggcaatcagtttctccttccatgtctataaagtggaaacaattctactttctgcctcttggagtgatcgtgaggattcaataaaatactctatgtgaaaagtactttgtaagctttaaacaggaatcaaatattaattattatagattattttatctgtgaaaatttaaagttttacagattctaaaagaaaactcccatcccactaaaaaccaaaccaaaaggaattttgcagattctatttcataaacctcacattccttttggaagtatgtggaggatactcctaataaagacctctctctcccctcaggattcagactggcagccgcaggctttgagaacaatttcttaaaacatgctttgagcagctgccagatagacttgtccagtttattttgtatctgccctctgttcctctcatcttctctgacagtcaccttaaattttaaaaactcagaacttcggtactctactcaaattatatcccttggatatctcatggaggagaaaaagattacaaatacaaaaaataccaacctatttgtattaagaggttgaaaatatttttaaaagtaaacaaatgcaaacggtttcacttttaacattgttactgtaaagccaggtttaggaacatggatggggctctttggggtatttgaaaatgagaatttttcagaaaagagaaactaactacaaattgcacaagaactgaaattcagtttgatttgctttagatctgcatgataagaacctagaaacagtgctttcattttgagcattaaaagcccctcagcaaactagtcctaccaagttatttggtactctgtccttttcaccatgctcataagcacagcatcagcaagtataatagatgggaactcttgctttgcatttttatagatccactgtctgaggaggttagagtagttacttactgactccttcatcccaacggcatctccatgaggtatagaaggagtggagggtgtccctgttacacagattggaaaactgagtcggtagtgaaacggctgaattaataaatgaactttgtctaggtttttctgtttctcttgttaaccgcagagacaagtattaaatggaccagtgagtttgagctatctttatatcctaaaggtggtctctcttggccaacagcaatttagaaattaattgagtgggtgattgcttatttactatatgatgtaatacgttagaagtatattaggcaatattacattacaaattttacaactatctaatccaggggttatatcaggcattttggatcttcccagggaaacaacaaaaacttttctattgaattccattgttttatctatgttgtaaggatatttcacaaaccatgcgtcccaagcaccatcagtcttcactttgagagttttctgagagtgttctcttagttacaaggaacagccctagggtggtggttgcctgtcaactagtaagaaagatggggactgaaaatggtgggatggcatttgccaagcaaattaattcagagccagttcatatgcttagagattgattcattcaaacgtagtttctttgttcccaacgccttaaaatcttgattctactatgtcccctctttggcagaatgaggtagagagctgtgcagtgattagacaggaaccccgaaaccaaagactcttaaaagctgaagagaaatcagactttgaagaactgtggcgtccaagcatgctgtaagtggagtgggcagccccctgggcgtctccacctagctgtccacaagcactccagacttaacacgccccgatgggctcgttattccctcctgccccaccccatccccacctgcagctgccctttctcctgtacttccttacttggttaatgttcttgccacccacccaagctcttcagcttaaa

SEQ ID NO: 5185 - DNA, 1825 bp, Homo sapiens
aggttgtcttttatcatcagagtggcatttatgattgccacaattatttctgtggcttatagtactttaaataacaattttctgtgccaaagaaaatatattaaaagagtctcagcataacacattttaatgttaatctgtggcataattattctgggaatatccagtatgataaaatgctagtaccagaaatttctctaacagattattaccataatactatttgagataaatttttttgtagttgagacagagtgcttaaattaaacctttgtttttctcacaatcgcttttcttaaaaaactcccaactgtttgaatgagtagtataagcacttaaccaatatatagtgtcatgaaatgtttcctttaaagccaaaaagggcagaggatgaattgagattttttttctctaccagccaaaaattaggaaatgttcacatatctaatgaatactattttatttttccccccactctcctttttgtaggactatgcaacagcccatgaagactttcagcagtccttagaactgaacaaaaaccagcctatagctatgctatacaaaggtttaactttctttcacagaggacttctgaaggtgaaagtgttgtgcatatgtgtaccatatgatgactctgcttctcttttgtgggtgggaggaatttcgtttgattgatggctggtatttattatttattgagctcctactctttgatgggttcttggagggagatacagaaagggaaaggatcaaaggttaataagtggaagaaatgatactttacctttatagaggatacagtttgcaaagctttttccacatataatttatcatatggtaaacatactcaagaatgtaatataaacaaagtgctttgaaaatgtagataagaaagattcattggaactgcagagttagagaaagttccaaagaacaggtggactttgtcctggagctggaagactgagtaggattagggggtggaggtgggagaagaaaagcccttcaggcagagaggagagcgtgggtgatgacttggggagatggaaatatgggcagttcacagagtgggaagtagttgggtatggtttaagggagatgaagctggaaggtcggtggagggcaggtccttatcctggagtactgtgctaagcattttgacttaaatttgcagaccagaggatctataaattctaggttgccaaaatgcatagattccagcactgagaccaaatctgtaatttaggaagtagattctgacagtgtggtggctgaggagatgagggacagaaggactgactaggtgacattggttgggtctaggtcagtgggcatgaaacttgacccagctccttgagagaccacaggaacaggttgggagacccttctttgattgactgtattagtattgcttgagaactgcctgactgctgggcagaggaggtagagggaaacaggaaagctatctgaactgactgaaagtatgggcagaaacgtggcctccagcctggcccttcctcctgcctgggcactcgattccatgttccgagtctgtgcggggaacccactgtgagaaggcttgtgacaggagccgggggcctggaacctgacggggagctgcctctctcacctgggcctccttagtgccgctcaaggcctggcacacagtaggtgctctcacacaggacatatccaagctacctgatggaagacagacgggcctgagaacgaaacagaggcagcctgcacagccaaaaagcaattcattctgacaggagccccagaaggtggtacttaacaagaactttgaaggctgtgaaga

SEQ ID NO: 5186 - DNA, 1027 bp, Homo sapiens
aagaacaaaaggtttttttaggcatgtaaaatttatctttatttgttatattttatactttttgcatatggcgtaatatctttgtagctgtaatcaaattattccccttatttctctgaggaaggctggagaaggactataataatcatattttacacaaacaaaggtactatggtataaaaatgaagactcctgaaattatatagtaaatcacgaaatggtgtaagttcagctttccaaatttttagtctaggacattatatgcaaactttttctattgtcttattgtatactaaaaatatttgtgtgaaattgtgctttgagagaaatgccacttttgcaacttttacattaaaatattaaaaatgtttaacatttttattttattacaatttataaaatattacaattaatattatactaaccttgtgctggcctattggagaaactttgtgtatttgtatactttgagacatagaggactgagaatgaatttagaattgggaatgatggaagtgcttaggaaggaaatgatattttactcagagcatcaatgaatgaccaggttgaagttgcagtagtaaagttcagagctgcctcttcctaattctcatcttttaaaattatatatcttgagattaaatttgcatgtatatttaataaaaagttgcacatgcatttttaatgtaaaaataatgtgcaaatgttaaagagaatgtacctaaacttcttaaggtatagatttataggcttatgtttttgatagacactgtcttgacccatttctgttcccctgttgccacaggtcagcctcatttcatgtgctggtatccacatactcatccattgagattcgttgattccatgtttaagtagattaagtttagataatatcctgccatctgtggaatttgtgataggtagccgggtctaacatgttattgttgagtaagtaggtagacttgagtgagttaaataattataatatcatgactgatttgacatggcacatctcttacatagaagt

SEQ ID NO: 5187 - DNA, 2194 bp, Homo sapiens
aggtggaacttgcagtgagccaagatcgcgccactgcagtccagcctgggcgacagcgagacttcgtctcaaaaataaaaaataaaaaaaaaaggaaagaataaattgaatagagaaaacctaaatactttacagataagcacagtaatcaattcagtgctgtagtaatgatgagaccatggggtgacttgaggggaggcccgtgcgagggcctctgtgtggggcacacatccaatcctgcagtcaagatgatgatggctacctttaggaagttgtcagtgttcggatatttcagctgttgcaaatttttgaatggctgttttttttttttaatttaaaatttttattactataaaaatgttccagctgcaagagctggagggccaccatacgtcattcactgtggcacatctgtcatagagctttgccttcctgttaccctggatcgggctcttgttttccattgacctgcaccccactattattagccatgttgtcctgcttgcttccctttgggaagaataggcttagcagagctgactttgatctgataggcaaatctttgtcttctgtgttggtttttgcttgctattcctagtatgtggcaagaatagcatgactttgcatggtattcctagcacatggaacctgagatagctaacagtaggccctgagtaaataattgtggaatgaatggctgacatccatacagtgaacagtgggaataaaggagaaggagcatatttattttccaggggcgtctggaaggaatccaaaggtggtgtttgaactgagacttaagggatcaaaggaatttcttggggaccgaggcaatgggtgagtgtttcagacagaggggatagcatttgcaaatgcactgcatttgggaaagcatcttgtatgtagggaattattaaatgattctgatttctagggtatgaagtgaagctgggtgtggtggctcacgcctgtaaccccagcactttgggaggttgaagcaggaggattgcttgaacccaggagcttgagaccagcctgggcaataaagtgagacccccatctcaacaaaaaaattttaaaattagcctggtgtgatcgtgcactcctatagcctcaggtacttgaaaggctgaggtgggagtttgagcccaggagtttgaggctgtagtgagctaggcttgcaccactgtactctagcatgggtgacagagtgagaccctgtctttatgaaaagaaaaaaaaaaaagaggaaggagatgaggctgaacagtaagcaggaaaatgattaatattttctgcagagccatttagatgttaccttttttttttttttttgtattgtgagttgctaccctttagtgggtcctgaaattaattggcaagtcaagattagcacttttttttttaagtgaaatatgctggactagaaaatatcagattccattgtgtataggaagtcctaggtataacctactgaaactgttttctgatacatgtgtgtatatattgtgcacatgtgtatgtgtgtactggattgtaatgtaaaatgtatttcagtgatttggagtttaaaaagtttgaatgtcactgtattaggtgttggggagtcactgaataatttcagttagggaaatgatatgatgagactttagtgttagaaagataactcttggtgtatatctggagaatagataggaagaaatgggaacaggtaaggtgatcacagtatcctaggtgagagaggaaggcttagaatagggcagtggctgatggagtgggtgggaggatgctgatctgttcaggaggtgagatggccaggatttggtgaggggtgtgtgacctggagagcaggaggatgccagagcaccagccccggccacgggtgtgcggggatgccagttgtatttgtagaataactgcttatttacatctttttctgattcacctcttggtcatctggagtaaacttttttctgttaggagaaaagcagcttggataatatattttgaaccataacaaatctgagcataggtttggttcttcctggagatgtatgttatcctaaagcaagcttgtccaacccatgggccacatgcagcccaggatggctttgaatgtggctcaacacagctttgtaaagtttcttaaaacattatgatatttttttttttttagctcattagttatcattag

SEQ ID NO: 5188 - DNA, 1005 bp, Homo sapiens
acaaatcataatttgcataaattattctctttaaattatgtatcacacacatgattattctctaaatctaattactcttttcttttttgtttgtttttttcttttgttggcaagtgtagtgataaaatttcttgcagtatgaaatacatttttatctcaataatactttttcatatccagtatttcagcatagtgatgaagcttttcttcaagcctacacagatgttgctctactacttttcattcttcacgttgcacctgagctaaatatcacttgagaaccatttttctctgtatatgctaataagtttttacctgttccttgcaggaccttctagatatgcaaaaatgcagtatttttaagccagtaaatgtcctttgacaaatctacaaagtggtagctattcatgtacagaatttttggttttcttgagttcattaactcttggcaatcttttttttttttttagacagctcatgagctccagtatgaagcagcagagcatggaatattattctgtttatagaagcaggcaacaaatggggactcaggggcttggattttattagaatcactgttttgataagctcatttaatatgattttcaaatctacatataaagggtattttaactccagaatgactttttgatataaagctcttatacctttcctgttgtcttggtttcaccatcaggttacaaacctgggaaatatttccataatcctcggtgtttcaaagtgtttattggaatgtttattccctgtggtttgattttcctttacagaagtatcaaggtttctaactgagcacaatgacagggtttaatagatgttggtctgcattggaaactcttgatttttaaagcttataagttagtgttgcttctatgccaatgccctgaagtcatttccatgtgtgtcagtgcatcagtaatagtgttcttgagttgaaaagtagaactttttcctgatttctgtgctgctttggtcctcatgcaggga

SEQ ID NO: 5189 - DNA, 1071 bp, Homo sapiens
tttttttgcaataatctatcaaggtgaaatgttttaatataaaattaaccattttagagcaaacagttcagtggcattcaccatgtgcaaccaccccaagttgttttcaacactccaaaataaaaccccttactcattaagcagtttctccctagtccctccttcccctatccccggcaatcaccaatctgcattttgtctctatggattcacctattctggacatttcatatagatggagtcatatgataagtgaccctttgtgtctggcttcttccatttagcataatgttttggaagttcttccacgttgcagtgtgtatcagtagttcatttttttatggtcgaatagtattctactctgtatacaccaaaatttgtttattcattcatctgttgatggacacttggaccatttctcccttttggctactgtgattagcgctactatgaacatgtatatacaatacttgtttgagtcccttttcaattttgggggtatatacctaggagaagaattgctgcatcatatggaaattctgattcgctttttaaggaactattttccataactggtgtaccattttacactcccaccagcaatgcacaagggttccaatttttctacattcttgctactgcttgttgttttctgctttttggttatagccatcctagtgtgtgtgtgtgaagaggtaccttattgtggtttgatttacatttccctaagtagtaattagtaatgatgttgagcaacttttcatgtgctcaatgcctatacaggtcctttgcctgtttttaaaattgtgttgttttagttgggttgtaagagctatttatatattttgcatactggactcatagtgtgtatcatttttttttttttgagtcagagttttgctcttgttgcccaggctggagtgcaatggcacagtctcggctcacggcaacctctgcctcccgggttcaagcgattctcctgcctcagcctcccaagtagctgggattacaggcacctgccaccacgcctggctaatttttgtattttagtagacacagggttttgccatg

SEQ ID NO: 5190 - DNA, 1095 bp, Homo sapiens
tacaagttgataccacacagccacctggccttcaggtagttctttcagccacaagaattctgtcttctcttcgcaggtttaccctatacctggggttaggattgtcaataaatatctggcactctacttttaagttgtagctcatccaagggaaaagcccagtcatccttattttcaagtagctcagtgtgctgtctgttataactaggtggtcgagtgataagtgctacccagcagctgttgatttccttataaattggccatgggtttgccacttataagctttcagtcagttttctcacacacatggatgtgtgagaaatacatgctactgccaatgccaccttctctccttccttggaggtgacgactgtcatcttatttgactaagaagcagtgagaaaacaacttccttgctccccaccaccccagctactggcctgcccgcagatggactggtagattttgccttctgtcctgttgtggtggatgagtggccggtgcctctgcctagttcagctctctgttcactggctctcatttcctcttgtcttccgtcagcatacagatggtcttaataaaactaccatcctgaaaatacaagcaactaagatgaccacacacccctccagccactgccccatccctctgcctccttttacagcagaattcctcaaaggagatgttcatatggactgcctccaccactccactctctcttggaccttctatggttagcttttgtcctcgtcaatgtgctgaaactgctcttcttaaggtcagttgtgtgtgaggtttaggaggagaggaaagaagtttcaagacactgctatacctaaactgttcattactaggacccagcattggcagaaggagttgtgacaaatgtaccatgttcttcattgctgtggcaagacccggctgtgctatgtctttgttttgtgaccttaaacatgttcattaacattgagtttatttccccatgtgtacagtgggcacagtgtgccttgtatctaccttggaggatggagaatcaaaagaaatgaggtttatgaaggtatttggaagctgggaagtactgtgaaggccaagata

SEQ ID NO: 5191 - DNA, 1045 bp, Homo sapiens
gctttgactttgtataaaataatcgtattggtttggagaggagtgcagtggtttggaaggtcctccttttggggtttgaggtaagatatcccaagtcttttcctatttgagagtttcccttcctcatgaggcagtgtcactggcacgttgtcaccctgcctgactatgctggctgtcttctgagcgaaggtgaccatctggttccttctcatgtaccacctcagtgctggattgggagaggagcgggaggaacacagtgggatggggcgcttctgttttcagagcctggctgtacctgctgctccttcctgaggtgagtctgcccactagcagagtggaaaagaaaccatggaaatactaacaatgagaatagaggctattgattttttttttttttttttaggagctgagcaatttatccacagtttctcagctggtgagtggcggagccaagatctgaacccaggcagggaggtaggcaggttccagagcctgcacttttaattctgtgctcttctgcttggctggcctgaaattccaggcttacaggataataaatataagtggcccaggaaaatcagaaagatatttgtgtcaagatcactggttctttgctggaactgagcatcagcatcatctgggtactttttgtattatttatttattttttcaatagaaaattcctaaactgactgacttttctttccctccttctctcccttccttcctttcttccttctttctttccctgtctctcctttttttaatagaaaattcccaaactatggataatttttaaaacacaaatgccagatatgctgtttccctccctcttgacagacacacatcctttcgaactctaatcaagaaaaagagcaagcagtggtgtctgccttagggtgtggtggcctgggcatctcttaagttgcccattgcttgcctattcaaggtatgcttttgagatgccattgaataaagtttgctcctgagtacagtactggaaactgtctgtctttcgcttgcagttcatttaggacagagaagc

SEQ ID NO: 5192 - DNA, 1022 bp, Homo sapiens
agcctgaagaacagtcagaccagatggtggagtgctgcctacggatcttccacctccctctagaaaatgttaagtgtcgctgtttaaacagccacagctgaggaagaggggcccgggctaggaagtctggtttactgtgcagtgacttaccttatgtcctccgagctgatttagaggatttctggtaaatcaggaagtttagtctggtgcctgaagacagtggcattgagaggctgggaggtgtgtaggcgtgtgtgtgcgtgtgcatatgtatgtgtgtgcgtctaatccttgttaaatccgtctgaacttttgccatgtgtcgggttgtgtaataggtgtgtgcggggctgcgctgtattcctaggcggtcaggattcctttctaggccagtgttccacctgacgacaaggcagctttgtgagtcatctgggtgctacagtgcagaagtgtccagggagagatcctctttgctttcgactccctgccgggtgcatcacctcggtgggcctgggaataccttggaaatggcactgtcaggagaaaagcctggagccacgtgtctggctggaatggggtcatggggagtcagagcctttgaaacctagaagcgttcaggctcctgtgtttacctgggccgacctcaaaccatcccaggaaggagaaaagcagacctgctctgataccagggtgcccactgctacttaggtgtttttccattattcattcctggggtaagaaatcgagtcttgggtttacccaccctactggtgtcagagggactcagcaggagagtagatctaggattccagatgatcttcttccatggtttttgagcacatactatgtgaccccgagagagtgtggctttctcgattaaagttattatttcttttatgaaatcctagcaaagatagggacgtcagagctggccgagtcagactcctgggggcatgttgatggcatccagatgcaattctgcagaggaatcctggaaaacaggagtaagtctagaggaaagg

SEQ ID NO: 5193 - DNA, 1030 bp, Homo sapiens
tggtatggtcagtagatccattaggaataagagcgttgggtaagccttgctgttttttggaccctgtgccacacacttatcacactttatccagttatatcgtaataacccccctgtgaattaagtgcagagttcctcatcatctgaagagtcatttcatagggagtcagaagccatcatctatgaaaacatgcagtgactgactgtctgaacccacacaccttaaatacagtggtgggggctggggtgggggatgaggaaccaggctaagcagaagcacagctcccgtttggagaaggagagagcaagtggactccattgtggctgcctcatggactgtgtagttgcagggtggactaccaccattggtggtcaatggcacatggtgccgttgtgataggcacctcttggcaggtagggcaggagatagggtgatataaagagtcacatattttgggggcatttgcagcaacatcattttctgttaggaattataaaccaaatctctgccatgctaggaatctgatatttctgaaagaactgtttagcccattacactagtggccagatgggagggaagaaagaaataattacttgaatatagcagttttaccctctaaattttacatctaaaattcctgctcacagccatccttttctaaaccttcccagcaagcagaattttctgtgtgtgatgtgtgagattcaggcagtgctctcttaccagcttttctttttttctcagtttctcatcattacttttataagctttgagaccctaaaaagtattgtctccatttttcttctgttagttgttctttaggattttgagcaacatgcttgtattacttttgacagttggccatctgggccagtttcaaggtttctttctgttttccatttttttaattgtggtaaaatatacatgaatgtaaaattgaccattttagccatttttaagtgtgcagttcagtggtgttaagctcattcatggtgttgtgccaccctcattaccatccatcttcagaac

SEQ ID NO: 5194 - DNA, 1181 bp, Homo sapiens
tttacagattttctttgactaatttttttcacataactttaggattttcgaaagttgtaaccataactggatatcttagctgagcaaaggcggttataatttgtctttttaagatcactggaaattgataaaattttgtgataattatgattattctgtgccatttacagtttctaatactatactgtatgaaatatgtataaatatatgatgctgagtctgtggaatgatacttctgaaatcaaaattcctcataaggcatgaagttgtaaaaacttgaatgtgtatagttagatatttaaatggttgcttcttcatagaattgtctgctttttaaaactggaagtacaggattttcttcaggtaaaatctgtgtgttccaattacagttgtagctgaaggaagtatgctttggtgagtcaattagtatgggaacttgactaaagacccccagtgttgtaacgtacctttgtacccagacaaaacaattatgttacattcctcaaagtggcatgggctttcttctctaattcttctgttttattagacccaagacaagttctaaaaattgaatgcaatgagagattgtccagaaatgtaatatatactaaaatataccacttaagcattgattgccttttcttgtttgcttcaagaatataaaacttgttacttgagcttggaatcatgggcttgattgaattaattactcttggggaaaaaagacaccttgtggcattaagtcttgctttggttaaagccttatttcacataattgctaaaaactcatttttgtttaatatactacctatagtttaattatcggcacttgtattttgtaacttgatatcttacctaggattgggaatttgggacatgacatgtactataaaagtcagtctatgtacatactgcttattgatgtgctgtgatatgagggaatctgaaatgtttcataaaaataaagcttaaaaattgtcttacactggataaaagtgatattaagatattatatctattgctcttctttagttggtattcaatatttttatattcttgttactgaaatattctttgaagaccctagttttttgttttatttatgtggggaggatacttaggaagctgtttgctaaattaagtaagtgttctgcttaccgtcagaattgtgaataaatcag

SEQ ID NO: 5195 - DNA, 1054 bp, Homo sapiens
ggttaggagtttgagaccagtctggccaacaaggtgaaacccccatctctactaaaaatacaaaaattagccaggtgtggtggcgctcgcctttaatcccagctacttgggaggctgaggcaggagaattgcttgaaccccggaggcggaggttgcagtgagccgagattgtgccactgcactccagcctgggccacagagcaagattccatctcaaaaaacaaaacaaaaacccaaaacccaccgttttataaaaacagaatctagaccccatgtccccacagcagggggatagcatttaaggattgagccagaattaccagctctgcttctaagttgggaagttggctttaaaagggaaaatctaaacagaaacaaaactatgtctctattatgaatgacatatttgggggaatatcagaatttttagggtgcaaattttctcaagtgtttaacagatgtagtaaggcttatttcaaattgagttccattttctcaactatttccatcattccctagaacctgaaaccaactcctgactttactacctgtttctcaaaaaattgtctcttcctctccctccctgccactacccttccccctcttatctatgctgtccccagaaaaatccattggaaacacttctcaacatgtcctcgactggcttataagcctttccaagccccaccttaattaagagatgcttattagcaggtatcacacaaaccagacataaagtgaggaacatgagatccctggcctcaaacttgtactacttagctagatctgtcctatctgccatctctcctttggccattttgcccctcacattttactctattcacttggaatagcattcagttccctcggaacatgactttgtgttccttcttccctttgaaaggttcttccccacccttctttaaccaggctaactcgactcactctacatgattcaactttggatgttgtctcctccaagaaacatcccccgaagtcctgggcagagctaatttttcttcctacagtttacccacagcacccagcaaaaacc

SEQ ID NO: 5196 - DNA, 1030 bp, Homo sapiens
tgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccatt

SEQ ID NO: 5197 - DNA, 1194 bp, Homo sapiens
acctgaagatcctttaattatgccagttccccttctcttccacttatggactgcctctccaagagcagggggtctgtttcccatctgatggaccacttaccttcttttctttaactctactttctatctccaaaaatccactgagtattcacattactgattagctgtgttttccagagccattgctaatcgcacgtcgaccttacataaaaatggaatattcatgcattttctatgtatttttaaagccattatttgtggcacaagctcagtgtgctttcagagacactgaacactctgttgaagaaactcaaatggcttttaaaataaaaagacaaaatcattatctctgtgtagaggatggttttatccttgaaggtttactatttgaaacctcatcacaatagaatgctgagggaagtttttggaagtacaagcgtgatagttctcagatgatgtttgcaaagttgaaatattgtccatactcttaggaattcagtggaatgcagtagcagaagctctctggtgcttagtgaatgaatgaaaattttttttttttttaccttgcaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaag

SEQ ID NO: 5198 - DNA, 1081 bp, Homo sapiens
aataattacactgtttgtgccaaaataacttaaggaatttaaatcgtaactcttctagaccctggaattgaaacagatgttttacttttaatctctgtatcctcatgcctagtgcagtacctgctcagtgagcctcaagaagtgccagaatgtatgtttgtaatgtcaagcagctaagtgttttgttctgtttgtatttttgtttttaatgccgaattgcagactcttccaacgaattatattaataatatagcaagtttgccatagctgtcagaatatctgtcttaacagtgatacttccttgcatgggctagaatgaggttgtataattccctgggtggggatcaagctgagacctgctcaggatccccagtctccttgtggagagaggttgctctgtcttcctcatgaagtttgcagtgggagtggtgtgtgtgatataaatacagagccctgcttgggaatctaagaaagagttgtgcagtgctggtaagattatagctgaggttaacaaattgtagatctctgttctgacagcagagctagacagctcaaaatataatgtgtttcaccagatgaatttcttatttgtaaagcataactttatcaattcttcactaaaagggaaatgaaagctcagagagtactaaggcatcatgacatatctctagattatactgtcgggagcatcatacttaagttgatttttaagtgtatatttaagtttttttaatcatgggctagaattagagcctaataaggaaagtagtttggtgttagattattaaacaattcataattcttgggccacttggagagtgatttggatcaatgctatttcttcttcaataatctttcattgtttttctgtatttttcatatttctatgaacatgggaagaatcttggatttttaaaaactttacattgataattaatataattatattctgccttcctgtaccgataataaaaactttgtattaacatactcttccacacaagcagagtaaaaaggttgaaattgttgttgtgtcatatgacagcggttaacaaccaaagagctcttaaaaatcagtagg

SEQ ID NO: 5199 - DNA, 1050 bp, Homo sapiens
tctttgtttagtctttgtaataatagtttcaaaatcttatctagtatttctataaacgcttttttataaaaagctaatagtgtgtttttaaggcttgtattttcaaaataatttattctgaggttgtcctgtttacttattcaaattggttattcacaaaaataaaaagatagtctcatgtgctcttatttttaagatgcgtattttaagcattaaaaccatatgttttgtaacagagtttgagtttttagactaataaaagttaccgagtaccattttattttggttttcatgatttggggctctgcggtgccaattatatttttttaatcctgtctgaaatgtctgatctgtgtcgtcataaaggaagcagtgcaggattggaaatcaggagacccctttttgtcctttgggattcccctctctaaagagtttgggccagacctttatgatcttttccacttttaaaattctagtgtttttattttaaatctctgctagatcagaagcactgccttatggatgtatagtcttagagctagattggaagatagcatagtccaggttccttattttaaagatataccagctgggcatggtggctcacacctgtaatcccaggacttggggaggccaagatgggaggatcacttgagcccatgagtttgagaccagcctgggcaacagaatgagttccctgtctcacacacacacacacacacacacacacacacacacacacacaaaaaaaaaacagaatgagttccctgtctcacacacacacgcgtcggtcgtggtgaatcagttcctgtctacacgcacactagccgggcatggtggcttgcgtctgtagtcccagctactcaggagactggggcaggagtattgcttgagctcaggagtttgacgttgcggtgagctatgatcacgccactgatctccagcctgggggacagagaccttgtctcttaaaaaaaaaaaaaattaataatagtaaagataatccaggcccaaatgatagcgtctaagatctcaccatcatttagaagt

SEQ ID NO: 5200 - DNA, 1024 bp, Homo sapiens
atgagtctttcccttattgaagtaatttcagaaatgcaccattggaatgttgtttaatttcaacaggtacaaactcacactcaaggaaaaacccagccattcactcaaaggaacattattttgatagtattcagatatcgtatacaaatcttttgagcaggttagttttttcatgtaaatcataacatatggtattggtcaagtagtaaagttcatattaaccttaaacatttactaagatactgttttcaagtaactcaggcaatgtatgcagagggtgtcatagtttctgtaagtatataagttttggatcaagatcacattaatgccagggccccactacagatcttctgaatcagagattctgaatctgaggtgaagactcatagctccttaaaattccatggagaaaatatatatatacctactattttcccacgaaaataaaaaatttaaagacaatttcctggagattctaattcacatttgggtctgagaattcttgtgtagggcatactctccattgttaaaggatactaaaaagttacatcctatatctcagatacccaaaggacatttattaagtcttatatacacctctcacaacctataagcttgcaaagcaaaaaggccttctaataccccaaattggtttatattttcttgatagttttaaccctatagattaatattctcttacctttttccccaaggcttctaaaagtagatgatactatctgtctttatgtgatagttgcttgtttgttaacttctttatgacatgtgccttcaagtgatgttctaaaactaaacttttgaaagttgttattccccttgtaaaagggtctgcccttttccctctcctgtgtttttctccttaaccatttcgtagtgcccacaggtagcgtggtatatattggtcaagaatgtaggatgcaaaggggggttgcctagatttaaaacccagctctgccattggctggttgtatgatgctagcaagttatctgccttctcatatttatt

SEQ ID NO: 5201 - DNA, 1024 bp, Homo sapiens
gtctataacttaataggtagcagtaaaaacaaaataataaaagttatttattttcctcctaaaataatggggggtatttatggcttatttacccttaataatgtcttttaagtggccattataaaatatgtagaattactttggtgtctgtgctgtcaaatttggctcatgtagtaattgtgctcgtagtaaaaagtgtattttaagcagcctgtgttgtccttaagaaatttcatgtaggttccacacttttttctaaaattaattattcttaacatttttaacagtcaaaacttgaaaccattaagatgtgaactgctgtatgtattataatagggagtagcttttttagtgttgacattgtataaaattagttatttacaaagatagtaaagcttattgtttgaaaataaggaattgaggaaatgaagttaaacaacatgtattcatacctatgtttttcttatagaaatatataatatctaggtatgtagaaatgtaaacactttgaattatacaatactttgaataatttaataacaatatagcttaaatacttgtagtgttatcttttcagtttgggaattgcatatatattttaactgtaaaaatctttttttttttttttttttttttttgagatggagtctggctctgttgaccatgctggagtgcagtggctcactgcaacctccacctcttcccaggttcaagcgattctcctgcctcagcctcccaagtagctgagtgccaagtacaggcacgcaccactgggcctggctaatttttgtatttttagtagagacagggtttcgccatgttagccaggctggtcttgaactcccaacctcaggtgatccacctcccttggcctctgaaagttctgggatagcaagcatgagccactgcacccagcctgtaaaaatcttacatgtcatgggaaagaggctgctgctttgtttatgactttatatagtttctgattataaaaataatacagtgctccaaagtagatgaagcaaaa

SEQ ID NO: 5202 - DNA, 1044 bp, Homo sapiens
atagtgacttgaatgaagtgggaaattagttatgtggatatgtggaagaggagcattttcaggaatggtattaaatagcaaatacagaggccctaacttgaaatgtgtttggtgtgttcagaaaacagcaagcacggcactttgggaggtcgaggtgggcggatcacttgaggtcaggagttcgagaccagcctggccaacatggtgaaacctcacctctactaaaaatacaaaaattagccaggcgtgatgacatccgcctgtagtcccagctactctggaggctgaggcaggagaattacttgaacccaggaggtggagcttgcagtgagccaagatgatgccaccgcactccaacctgggcagcagcgtgagactctgtctcaaaaaaagaaacagaaaacagcaaggaaaccactgtggttttagtggaaggagtaaaggatatgtgattgatgtagtaggataggaaatgagatcagtttgtgtaggatatattctggatatattttgaaagtagaatcaaatgagatttgctgatacattagatgtggggtatgaaagaatggaagagtcatgaatgacttaaagggttttggcttgagcgattggaaggaaattattgttttattttgacctaagtcttctgcttttcttctcttgcccccactttttcagtgttgccatttatgatagcttgctgacacttacttcccagccaagcaacaagaaaaaagttatatgttctatattttcacattccttcaaattggctgtgctagctactactactgttgaccttctagccccatcctttcttctctagaggttttaaggtttctctgtgcagtatgcttgtatcagctctaccagtggaaccgccttcaggaattattgcaggaaaccttgcaacacttttagtgttgtctataagtatgtctgtgcttccttgcatgaaccactcattcaagatggcttgtgaatccacgtaaaaagaaatatacgaagtttgaactttaggggaacattagagaaaattgaatg

SEQ ID NO: 5203 - DNA, 1028 bp, Homo sapiens
tcagagtatttttttttttttttttggagacagggtcttgctttgttgccctggctggagtacaagggtgtaagcatggcccactgcagcttccacctcctggactcaagctatcctgccatctcagcttccgagtagctgggactgtaggcacacaccaccatacttggccaaatgaaaaaaaattttttttgtagagtcagggtcttgctgatcatttgatctcgaactcctcggctcaggggatcctcctgccttgtcctcccaaagtactgtggttacagacttgaaccacctcacctggccacaataatcttaattctgtgaagtgagtagtgttattcctaatttacatttgagggattttcagctcagacttggcagaggtctaccacttactataaccctggctggtgttcaaacttaagtcattcagatatcaaacccatgctcttttttaactacgctagttataggtagaacattaaatgagatgtagattatttagcacactgctggaactgcaatttgatacatatattttgttgaaagtgggtgaatagcactagctttatatgtgagtaatcatactctatggttgggctgtgtaaaactttttattaggtgactgtacaatgtttatttcagatagtggcttaaaagccacttttgtatttatccacctgaattatgcgcctgtcagtatactgttaacagatgtcagaatatggtttttttatgtgattgcagagggagacttcaattcagaattttatccttcataacattatagtgattttaaaagttatatgcagcaaatgtgtagtatttttctcatttcaactttcacagcagtaggcaggtggttgtatccctttttttatagattagaaaagtgggactcaggaaaagttagttcacttgttggaaattctgcagcatattaggacttaaattcaggttttctgactaagaatctgatgttcttttttatttacatcatgtatattgcatgctctttatgtcag

SEQ ID NO: 5204 - DNA, 1050 bp, Homo sapiens
ggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacg

SEQ ID NO: 5205 - DNA, 1052 bp, Homo sapiens
acaaagaaaaggaatgaagtaagttgtaaaaaaaaaagcaactggcaattgaaattacactgcaatttataaataaaactaacaacctgagtttttctttgaatattgataaaccaatagcaaatttgatccaaaatataaaaaagtacaaatgaaccatgttagaaaggaggttaagttaacatgagaagaagacagtgggaccaaaatgacctgtgcagaactgtgccatctccctgcagaggacagtgggttctgccttacccctcaaaccccagatacctctaggataggaatgttattacctctccctggcttggattatggagacctcgtgatcttttggggtcttgcactccccaccataatgcaaaccaggccagcctgaaccataaaatctggtcaagacgagaccctgtccttactaaagaacttggtttcctgtaaatctaaatatgtaaatgtacagtattagctgtagaggcagaaggaaacctgtcaaagggcaatctagagatgcaagctcagaacaccctccttaattcactgtagcacatacacactgcctgcccagcttggctgatcccagttgtggggctctttatttacccagaaaatttcttttctgtctttaatggtataagatgatgcacttgatcacttaattttctgcaaaccttggcaggctacttggctggttccttctgcacaaaatactggtataccaccctaacccctagcttctggccccaagtggatctcagtcctctatattttctaattaatatgttctctgggtgacattttaaaaaagagacatagagatttttttaattactaaggaacgtcaagtagctatataggaatacatttggtggataaggtacttagattatttcttgcaagaaaacgttgcagggagcataagaaacggtcaaaggcccaggtgtggaaggcattgaaaaagtcacccaggaatatccccaaataccaaatatattacctgaaaataataagtttacagttaattgttttcagagtttcaaagagta

SEQ ID NO: 5206 - DNA, 1026 bp, Homo sapiens
aatggctatcatccggctgctttttctgaccctctggttaaaccagatcccacaatttcagatgcttttagcttctctggcggggctgagctgacaatttgcattttcatttgccagaaaaccagctcctggatagggctttccctcgcatagcctacttggaagccagcactcccgtgtgcatgctggcaggtggcacggttgagaaaggacaggctcaactctgtgttcttttcaggtgccagtcccctctactgctcgaacaccagggctcaggccctttggaatgtgacggagccagggagagggaagacaccatggaagcaagcaggcacccgggtaataaggaactcctggaaattgacctcccttgctccccctttccccctctctgccccctcctctcccatcacttcattttattcattcactcattcaacctatgtgcaccaagttgaggtgatcagctgggtctccagatgcaggagggggtgtggtcatggttggttgtggttgtggcacctgcagaaagtgaacactttatggtggtggttctgtatacttttgtgacatatccattggtaagaccagaaagtcccagaaccacaagcctgttcatgtttaccaaaccacttgtctgactcctggttttctttactcttttggtaatactggaaattggaaattcaactcctctctttttatgtgacagaaaccaaatggcatggcccaccttccaaagtcctgggttcctataaagaaagagctctgcagaaagatggaagttgcaaagattcccccaataagctttctcacgtaagtcctttgttcataagcccttcactggcctagccaggactgatctgtctcagcacacagtggtacagcctgattcctggggatgctcaagagcacattacctcacagggctcttagaggtgaggttaaaaaaggaaactatcttcctgatttataaaggacctcaaagaaaggttgcacagcaaattagtggcaaagccaaaatta

SEQ ID NO: 5207 - DNA, 1034 bp, Homo sapiens
tagaagtaaacaaagcaaaatctagttcacaagagtagttgctgtaaaagtgtcacataataacaaaattagtttgattttaaaataaaaccattcttttgagaatagctaatttttattagggcaaaagaatgccagttcttagtattttaaaagacctttcctatatgactttctgcacaaggttggagataaaataattccacccagattctctcttcaacttaatggattgcacagatttttgccagcattctctcaaaatatgagtcatgattatgcatttatattacatgtttctttccaagcctcaagctaaattatagtgtcttataaagactacagtctatgggcatgaattaagtaggccacactactcagccatctgtcttctctttcttttttcctcttaaaaaccataccaaacaaacttgaaggccaaacaagcactggaaatgcaaagatgtctttgggttcacaagattcaaggttcacgttcctttcattcaacatataactccaggatctgtaacttcaatggtagtcagttacagttcctgatgtgcactactcaggcagctggaacctgtgagacaccaaagcctggtgttcacctgaacatccagtgacgcttagagcatcgatttgagtggaagacaaaagtaggttttcttcatgttttattatctactgtcatatctgacccttgatttctgattaggtctttggctatggggatgaatcagtagccctagggatgtggtatcttaataaacagaaaacacttggaagcaatataaatccatgaacaaaacttatagagccttggcattttataagaaaatgatgcaacccaatgtaatttgcatttactcagtttgaccaataatgtaactgttaaactcagtaaatccagagtaacttaaactaaataagagaggtgaattttactttcaggaagggaaacagagttaaaataaaggataagaactaacctttactgatgcacagagaaatcactacctcatgttcta

SEQ ID NO: 5208 - DNA, 1028 bp, Homo sapiens
tcccataaaagtatttatgttcaacctaaagccacctgtgttttgaagtcccatttgccagcctaagggaggtgacagtctagcttgtccctcagcgtgaagggaagtcagagccatttttagttttccttgtggagttgcagggaacactgagcagggagaatcccccttgagggacacttattaactgatctcgtgctgggattggatcctggagtgaattcatatacattgggaatgagtggcaagaagcagtttgggaatagtactcttcaaatggaaatgaggtttgaaaggggaaccagggtgtttctcaagcagacagtctctgtggcaaagatgaagagttgctggggccagaaatgcttaattaagatctgtcttgtttttgcaagggataatttacagccaccggtatggccctggcctctggccttcaaaggtgactgacattctatcagtgtcatttgaaggaaagcatatcaacctaaaaggcggatataaaggaagtaacaactcatcagaattatgcatgagttgttatataatgtgagtgaatttagtaaatatgtccaataaaaatggaaatgaaattccttgctgcagtgcatctgtttttttgtgatttttttcatactttgttgacatactatccaaggcatttttctatataatgcaaaacagtggaaattttctcatgttatcatgagtctaaattattattctctcatcattctataaaaattaaaactttatgttctcatctcctgttttgctgtctgttgcctggtcattcaactccctgaagtatgcagagaggagagtatggaaatagaaggaaaactcaattttgtcagtttaacagtttttatttttagatgtatatctacacacatacatatataaaataaatggtgggctgaaatctggactcaagtgagccttctttttttaaaaattttttccatgctttatcccatttattattcattacaaagcagacttttttttcttcccagcttttaggt

SEQ ID NO: 5209 - DNA, 1056 bp, Homo sapiens
tggcctggggcaactcacacactctctctaagtctcacttactctctgtaagatgggattattatatcgcctacctcctatgatttcaatgaagatgaaataaagtaacacatgtaaagcacttagaaccttctagcataattgccccacacatttaatttagaaaaataaaactttaggggctgggcgctatggctcacacctgtaatcccagcactttgggaggtcgaggtgggcagatcgcttgagcccaggagtttgagagcagcctggacaacatggcaaaaccccatctcttcaaaaaatacaaaaattagccaggtgcagtagtgtgcacctgtagtcccagctactcagaaggggaaggtaggaggatcccttgagcctgggaggtcgaggctgcactgagctgagatcgtgcctctgtacgccagcatgggtggcagagtgagactgcatctcaaataataataataaataaaactttagcatattcattttaatttctttcatatgaaaaaataaattctgattatccaaagatagtaggattgttgggtctactttctggacttactaacctaggtcatactctctcctttctctgtttcctttcttcctcctttaagccagcactctccattagcactttctacagtgatctgtgtctgtaccgttcagagcagtagccacaaaccacatgtggctattacgtacatgaactgtagtgcaacttaggaaacgaatttttccttttaattaatttacatttaattggccacgtgttgctagtggctgccatattggatagatcagctaaaccatgatctccttttaggaaaaaaagccacttacactgtcttcctctatggttaatgtgcaaaatcttgcaaaaatctttctctattagttatcttagcatttgcctccagcctcactttctgtggccttgtttcctgtatttgcccagtgtgtttataaaataaggatttaagaaactaagttttctctgtagagtatcagtcccgtgttaagatgtttcttattgccttgcct

SEQ ID NO: 5210 - DNA, 1044 bp, Homo sapiens
gacaggcctagtggaggagaggcagcccataagcacagagggtctgtctgctgcctgccagagcaccatcctacacacttgccttgtgaacagatggccaaggagtctggctggcctgcccccaccatggatctgagtggtcctcaccactcaggcaagcataggcagttgtctgtcctcaagagaaggaccctaggggacagaacactccacagtatgtccctagggctggtgcgtagagaacatttagagttttcctaaagctctgactttctgccactgcccttcctgaacctcagagtgggctcttaagcgttagctttcaagtgctttggggtgtttttctttgcttgggatgaataaattgtctcatggtttttagtgcttgctggttgaaacttgtaatggtccacaaagtctttacaggttttccattgcaaaaatccatctagaacgatgggatttatatgcttaaaagtcaagtcaatttacctaataaaggaaaaacgggaattatctgagcccatctgaagctctcaagctctgggtcagtgacatctaagaaagcaggacacctgtatcaagaacagatatgacttagaatgaagaatgaaaccattgctttgcttctgttattttctttgcacttgatgcaaatgttaattgtgatcagctctgaacttaaatgtgtccttgtcctgtcacttggacagtttgaggaaaaggcagagagagacaggctgggctgcgagggcccaagggagagggctggcatggaggcccatacgtgcacctttggcagagccccatggcagcttgggcaggaagggcatctctaacagtctccttcccccttagatagtgacgagaggctgcgagactgtggaaatgaccctgaggaggaacgggctgggccagcttggcttccatgtgaattttgaaggaattgtcgcagatgtggaaccttttggctttgcctggaaggctggccttcgccaagggagccgcctcgtggagatctgcaaagtagccgtggccactctg

SEQ ID NO: 5211 - DNA, 1075 bp, Homo sapiens
agttttatgtacctgacttcatttcactgaaactagccttgaaaaaattgtatgcgcaaaaatcaggacagcaaagcagtgaaaatgtagatgcaactgggggatagaggaggatgtgtgtgtgttaaacttccccaactggaaagtaaaagaaaagtccctgtaagttgaggctatacattccaaactcgagaaagctgggatttgtatctgttttgttccctgaagtgtccctgtgtgcccagaacagtatccagaacatggtaagaagtcaacaaacatttgttgaatgaataatgaatgaatgagtgaacctttcttaggagatagagaattaggcaaattaatgcatgtaaagcacttaaaatagttccaggcatggaactaagttttagttgttactgttttataattcattagatatagagccagtcatattttggatgacctaatttgcattttattttcctgtctccagtcctaaagatctattatgaaaaactaagactctgaatggttaagaaagtgagagactaaatttatcaattatttcagaaaattattttttgacatttaatattttgcaatcacaggttgtcatcagaatgttctgtttgtggataaataatgccacttgcaatctggggacatgtgttttccaaatttgttaatgagttgtattgactccatttctctcaccctcaccatccatgcccacaaattatgttaataccaaaggtagaaatgtctgaaatgaccagctgggttcatgagtgcaatttgaagccacaggacttagcaaagttaactggcccctacatgaattgtgcctgtaaccttggcttcttacactacagttggtgaccatttaactggtccagactcgtccacatcagatctaatttcttgtgttccttcttgtaataaatcaagctggatgccaattccaagatgtattaaaagtcttcagagagtttaccacagttgcaaaagagctttaatctttggaatggtctctgactcttgcgtagaaaaactcaccagaccaaaagaatgataagaaaccctgctcttg

SEQ ID NO: 5212 - DNA, 1885 bp, Homo sapiens
agccaagagaattaaaatggaatgttactttctaagaagtcctttgaaaataacatatatgtgtttaataaatagttaaaaggaatttttttttggcggggctgatttatatataactttttggatgaatattctctccatctgtaaattaatttattggtaactatatgtaaacactaagtattcgccttattcatgaaaatgccttttatgaatgtcttttggagcatctaagaactctataggatattttttctaaagagttttcaggtctgtttctgaattggatatgaatattagaaagacatactacagggttcagaaagaatataataagtccgtgaaggttgaatgttttcgtgtttttaaagtaaaaatttagatttttagattaaaaaaagattaacttaaaatgactacttagaggtttccccaacaaacacaatggaataaatgatgttaacaacactgtttcttgttgcttaaaaagtagagaaataagactgtatagatcaagaattgacaaagaaattgaattccatttacattttcctttttgtatatctttttgtcttcattatccatgtgcaaaaagtcattcagaactttactccaaaattacttaactattttatagtcagcaggttagtttcaatgtgtgaaactcaatctgagatactcttattgataatacagatggagtttgaatttacaaagaatcattctccttttcaaaagatgaacagttttatgattaataggggttcaaatgtcatagttttttaacatatatgtcactggataatattctgtaagtgatcacattcattctccatattcttcattcatgggatgtatcaatgtacttcctgttgaaagaaaaaaattaattacattcagggaaagacatattcaaaataacattttttgttctcatttccatattcaatcaatcctatttcatttttctgggttctggaagatcaagtgccaagaataactaagaattaactgtaaaaacacacacacacacacacacacacacacacacacacacgcacacacacacacagatgcggccaggccatctgccagtttgtcacgcccttcagataattgcacccagacctggaccagcttctcttctccactgctcacctgtgcacttggtggcaaaaacacttcgctttcagtggatcacctaaatccacactgtgagggcaagaacagagaagaaaagcgaggaaactaaaggtgcagtagaaagcggtggggaaggaaaggagcctctcagtccacagtcctggagcgggagtggtagaaacagtgcttgatgaaagctggatgggcagcatccagatactggttgggtagagcttggtgttttttgttttttgtttttgcaacagtaaccttttaaatatcgaagcactaattttgtagcagcttaccttgcttctgtaattcatctttgttttcagctgattccacgggcacgcactctctctataccacatacaaagactacgaactcatgttccacgtgtcaaccctgcttccctacatgcccaacaacagacaacaggtatgtcctccccagcctggagctttttacgctgagtatgaaatctgaggtgggcccactgatgatattgatgcatgtagaacttgcaaagaatcagtgagggtttttcttgaatagcattaatcatctttgactctttgatcatttggaagtatttgggctttaaagggcgtattgttgcacttttttcgtataaaacttagaaactcttctgcactcagatctattgcttgctaagcaaaatcttttctcaggagaaacttgtctcaactatatgttaattacgaaaaggccaaccgt

SEQ ID NO: 5213 - DNA, 1074 bp, Homo sapiens
taaaaatctcttatggcccttttcctgaaccaacatttattcttgtctactatgtggaaggcatcatgctgacagatgggtgtgaacagcaagcgttaggaagattgaagctgactaagacctagtccctggcctatgaggacagtaagactaagagcagaaaggcctctccaaggcagaatctggtaagagatcttggagaggtgtaaatgtagtgagtaccttggggaaagaagaaataacatctggctgggcaactctcctgaagaggtggcattttaactaggcctttggacttggatagaattctaagagggagacatgagtagttgctgttttaggaactatgactagtttctttacaaagagaagagaggtggtgaggtggggtggggtaggggaagtaagacgagactagaacaaatgagacctggtatgctaggccaaggagattgcccttgattcaggaggcagtggggagccattgaaggttttccattaggatgtgacgtgatcagagctgtattttaggaagattattctggtagaagggaattgtacaggccgccgaagatagagactgatggctatgtggagatcaattatgtgattattgacattgtccaggagagagttaatgatgaacaggattgagatggtggttcagaatatggaaaaaaggtctttaagtttcaggtgcaaaataactcatagaggaaactgagcagtacatgctcaagtgcatgcaacttattttaaaccagtggatttgtttgtaaagccatgattttaaaaagacagtgacaatgtatatttttagaatttcccaagtaggattcttctgcatgttttagagggaatatgaggtatttcttggttgaccaaataatactgtggttaaagttgaatatttggcaccgcagatggctagaattctaaaagtgatgaaactaattggtctaacaagttaacactgcattattagcaaaaagaagcagatattgtaacactcagaatgaataatcttgagatctgtctcaggaatgaaagctgacatattaaaaaaaaaaaacc

SEQ ID NO: 5214 - DNA, 1033 bp, Homo sapiens
gaacatgtgtacccctgttcatcttatctagtacgtaggtgtcccagtgacctaggctctattctaggtataagtgagataaagcccctctcctaaagtgacatattttaagttatagacctatgctgttcagttcagtagtcactagccacaggtggctacttaaattaaatttaaatacttaatttaatttaaatgttaaatttaaaataactgaacaaaattagaaatccttttccttagtgacattagtgatttcgagtgtttaatagttgatgtggctaggggctcctgtattagtatagatagagaacattgtcctcgttgcagatagttctgttgtccagtgttatggaacattatgcaaacgttaggtatccttatgactgccatcaccccagctcctggtgttagtagtctaaggactcttaccagagtcagagagaggttggattagaaccagttctcttgatttatggttctggggttttctctctcatcatattagatcttaggcacgtgctccaaatattcattgcatgtttctgtggtgaatttgaggacatctaaaaagtcatgagacaaaatttagtggcaattttctcagccctgaatcaccctgcccatggataccactggctgctgctcccctgttcagcctcgggaatggtcattatggaaaattaaatgtaagataagaaagggagtggaagaaaagaagatggagagatgggagaaagggaggatggaagaagggtgatcatggtcaggtccaggatcatcatgtctggtttcctctctgtgtgaaccttctcatgtgggttcagagttgtaggaatgtcctaattttcatagcattgctctgccttgcttcttctcattcttaggcatacatctgctcatttccattccgcctggcttgttcctgatctttgtatactgttactgtttaaagactccttgagtgttgattttgtttccttaaatggaacactgtcgcccctttcactacactcagaaagagccttgcttc

SEQ ID NO: 5215 - DNA, 1522 bp, Homo sapiens
ccttgtctctgacctagcagccaaatctcttctcaccagattccttggcaggtcctcagtatgccttcccaggcagtgtgtgccctttgctctgtcaaccactggaatccaagtttcagagaattctcacctgttttagctacagaacatatccctaaggagaaagtcacttgagactctaacatttctaactttgatggaacattaaatctcttttatgagcagtctgcctcacttatatttctgttttaatatgtaaaaaatcagtaggcctaataaaaatgactaatgccaattttttgttgcttttcaacattcataatacatacctcacaaagtaacttgttaaaagacatcaatgatagagtacagaattccttactgtgaggcacggtgcatttgatgtgaactgaatgtctggcattcagttgcatttggacataggctcatggtatatattcatattcaagttaaatgtaatttctttagatgtgtagcaattaatattaataatgacttggcagattattcttttagaacctgggatagcatttgtaactgaaaacttttctagagaattttacttttctttttgcttaatttctagacatttggcttgagaaaactgcgattttggttttgtagtgaaaccattttgccaatgaagaacattaaaattccggcttctgtttgtgtcatatttcagactaaagacattttacaatcaaaccaggaacatgtgaaaatagagatttataatggaaatgttgattcaatttgagctgaagccagacattcatgaaggaaaattagattaaacagtagatgtttagagagactttaaattatgacagctttaaaaaaaaacatatgttgtggatgtttcttaggcatacgcgtactttctctggcagactgggaacctagctccttgatgtttcagccgtttattaaattcccttttatctttctttggactagtggactcagaacttacacagcttagagtctggtgattgggaattgtatcttgtacattactgtaggatcaaaacctgatgttgtcagtggaagtaattctgtcctgtcatagcgtattacatttatgagtagaaattgccattttagattgtgagtataaagctaccagttacaactgatttattccatttgtcaaagcctaacagatactccatgcaaataatttattttcatatactgttcagatagcgagggaagtgcttgaaattgtgaagaactgggatctgtgtcaggggagcagtgttaacgggaggattcatgaggctggatgtagatgctggaatgatgagtctccccagaggtccagcaccaaaggactcacccttgctagagtcagcaagaccccgccatggtggtgatatcccagcctcaggcaggcatttggggccagtgggacacagtgtgctgctgacactcctgcttatcagatacatggtttacaaatatgttctcccattccatgggctgccttttcactttg

SEQ ID NO: 5216 - DNA, 1043 bp, Homo sapiens
attacaaacattaagagaattatatgcgaattagaaaactagaaggctgtgtatatcaaacggttaataatggttgagaaaagtgttttccttctctagactgtttgaatttttaaaaaacaattatgtttatcagagtaaaaagctatgaatttttcagcttgttagtaggaaaaacagcccaagaacaagaggttagaagaaatagacaaaacttgtagcttctgtaagggtggtagtattacgtgtgattacatatttattcttcagtcctatagttttgtaatgtaagtagattactttcataattaaaaacaaaccaagccaaccatggttcttctagagcacttaggcgcccacacggagcctcatagatacatgagtcaagtgcttgaattcaaagttttaagccagatatgaaaaacaagtaatgtgtataatagaaagttagaaatcatatagtcagtaagtgtagcttgtttgtggccaggtttaagtccatgtgaaggctgtgctttttccgtgctatgctacagggaaccttgtagaagagtttacgcttacggcattgctgagtagtctggtaaaaattaaggcattaaagttgctatcagatttttttaattttaaaaaatattcttacaaattgaaatatcttattttagtatgaggttggctcctctggtacttctgtaaccatccaccgctttgcctggttttttcctcaggaagaaaaggcatgaaaatgagcagacagttgtgtcactgggcctgtcccgtttacaggtgtataattcctgttaacgcctttaaaaagaattcatatgctggattcagagtgtggtagtctttgtgcccatatacagtgaccccctgctttagagaagaggggatctgctttcggagcttttttgattgtgatataacaatgataaagttttaggcacctggtgcttatctgtctttttgtgcaagaagacttggctgtgttgtgcgttaggtatcttttatttgctagtaaaataggtggctgcagggcaggg

SEQ ID NO: 5217 - DNA, 1389 bp, Homo sapiens
gatgtgttgtggggttaagatagtgaatgatttgcatagaaagaaacacacaaggagtttttttgtaacctttgaccaaagttaaacacctacccctgctgtatgtggcttccactattgaaaagcgcctgaactctcaagagtccgttatggcttatcttaatagagagactgataaccacattatggggtgccttaggtagaagcgaatgccagaaatggagcccaacccctggcaggcgttcactgtatgttatatcttcctatttgtcctgtacgcctgctgaatttgtgatagcaatgagaccggatccacaaacattgtcaccataacctactgtggattacacaggcgctgtgcagtgtcagcctctcacctcctatcagtattttattgagctgccttcatgagtttttgttaatcctcttttgctcacgggacacaggtaaaaatttacttttgttgggtgtgggatttcttccacatggcttctctctccattcttgactgttgtcccagagctggcctgtgtctcctggtccaacggattgcctccatcctgaaaatctcaaagactgcaaaatccttgagattttgatatctgaatctaaaaaatagagggaaattaaatgagctttccaagaagtgtgctttaacttttcctgggtaaattgtcttatctttttgcagacttcagtctgaccccagtgttcactaccttggagctcttccattttttttttttttaactgtttgtatgagaggataagatccctagttttacaaagcaaagttcaaagattctcaagtgtgattgataacagctcccgaagacacataatttcttttggttttatcttgtttctgtctctgtttgtttttcccggatgacacacttatctgtctggtttctccatatctgaacggggtttatgtgccattgatagctgccttttgaattgcgtggattttgtttccatccttgtctgtgcagcatcagagcacatttgtagaattatcagctggtgtgttaaactgcactatggccataccttatcgctaaagggagagaagaagttttgggttcactttttcttttaaaaatgtaattgagataattatttggttatctttaacttaagcaacagcagcagcagcaacaacagaaaacctgacatgccaacagatgagatagatgttgggtaaatttgaggggcaggggctgccagcaaaacccttgatgagagaagcttagttgagttcagttcattcctctgtaagttttgtaacagacagaaaggtaagcttttatcacagtgtacacattaaacttctttaaacagcttagtggatcctgagttcttgctacagatacttcagaatgtgtg

SEQ ID NO: 5218 - DNA, 1026 bp, Homo sapiens
ttctgggatacaagcacagaacgtgccggtttattacataggtatacatgtgccatggtggtttgctacacctatcaacccgtcatctaggttttaagccccgcatgcattagctatttgtcctgatgctctccctcctctcatcccccaccctgagacaggcctcagtgtgtgtcattcccctccctatgtccatgtgttctcgttgttcaggtcccacttatgagagagaacatgtgtacacttattatttattacttctcccatctatattaatatgtattaatttattaatacttctgggagaagagtaatacttctgccatcctgtccccacaataaaaacccagagtaagaatctcttttcagataaatatattgaaaaaaggaaaagtaaacgctaaattaaaattggggtttgaggagtgttaacatgtagcttttaactttgtactttcttatgatctcatctgatggtttcttgtagctgcctattgtggcctgattttcattctgtccaggagtgctctctagaagggtggcactcctggcctcttggtggcccatcccttgcaggcaggcttcatgcttgatagtgaccccctccctcctggtttttgttttctgcctctgtggcctgagcagtcgacctgatggggtctaaaaaacctttcttggccaggagcagtggctgatgcctgtaagaagttgcagcgagccaagatcgcaccattgcactccagcctgggcaacaagagcaaaactccatcatacacacacacacacacacacacacacacacacacacacacacacacgaaaaaaaaaaaaacctttgtcgttcagtctggccaacatgatgaaacacacacacacacacacacacacacacacacacacacacgaaaaaaaaaaaaaacaaccttcgtcgttcagtctggccaacatgatgaaaccttccttggccaggagcagtggctgatgcctgtaagaagttgcagcgagccaagatcacaccattgcact

SEQ ID NO: 5219 - DNA, 1039 bp, Homo sapiens
agagaattagcctgtcctttaaagctttgaatccaggcattgacttcccctctctagctgtgaaagccctataggacgtcttctaatagaaggctgtttgatttacatagaacatttgctgtttagtgtagctctccttgtacctcacaaaccagcctctgctacctgcagacttttcttctgcagcctcctcacctctctcagccttcattgaattgaagagtattagggcctttctctgaactaggctttggcttaaggaaatgtggctggtttcatcttctatccagaacactcaaactttccccgtatcagcaacgagattgttttgctttcttatcatttgtgtgttcactgaagtaccacttttaatttccttcaagaacttttcctttgtattcgcgacttggctgtttggcgcaagaggcttagctttcggcctgttttggcttttgacatgtcttccccattgagcttaattgcttctggttttttatttaaagtgagttgtttgactcttacttgaatacggagaggctgttgtatggttattaattggcctacgttcaatattgttgtgtctcagggaatcgggaggtctgaggagagagagagaaatgggggaggctggtcggtggagccatcagaacacaatatttatggattaaatacactgttttatatgaatgtggctcatgccaccctagaacagttacactagttccatccaagatcgctgatcacaggtcaccataacaaacataaaagtaatgacgaagttcgaagtattgtgagaatcacagtgtgacacagaaacaccaaatgagcacttaaaaaatggtgccgatagacttgctccatgcagggttgccacaaacctccagtctataaaagacacagtgtctgcaaagcactgtaacatgaggttcaccttatacctagtactgtgtctgagtccctgacggtactagacgtccactgatgttacgtagattgagactgttgtgcaaccatcaccatcatccattttcagacctct

SEQ ID NO: 5220 - DNA, 1024 bp, Homo sapiens
agactgggcagtttacaaaagaaagaggtttaatggacccacagtaccacatggctggggaggcctcacaatcatggtggaaggtgaaaggcacgtctcacatggcggcagataagagaagagtgagagccaagtggaagggatttccccttctaaaaccatcagatcttgtgagacttattcactgccacaagaacagtatgggggaaaccgccaccatggtttagttatctcgcactgggtccctcccacaacacgagggaattatgggagctacagttcgagatgagatttgggtggggacacagccaaatcatatcatccatcaaggacaataagtgaggtgactgatctcttcatttattttaactgcagttatgtggtaagatgacagctagtaagtacagtgtggggccactgccttgctgtgtagtaaggtacacacatttttacatgctgttgctcttgtactgttgatgctgtacaaaaaggcaaataacagctttagaattctagtttgacctcacagatccagttgaagagccttggggatcctaaggggcccgtggttcatactttttgagaaccacgactttaagacatacaggaaaggtgctaaatgagacagaactagacttgactcgttatgaacttagtattacagaaatgggtcagatacctcatacgtgtggtgatagacgtgtggggccatgtgggagggatgtgtaagagagttcctggagtgtggcactttgactggggctgttgactcctgtgtcctgaacatctaaatctgtacctggtgtatcagttcatactttatgtagcagtttgaataattagggcaagtgtaatggctgcataaattcattagtttttaaaaagtcaaatgggttttgtgttcataataaagattagtcaaggtaatctttttgtagtataaaagtaataaagttgtgaaatatagctgcacagcccctcccatcccaccttcctgtgataccgtcatcctcagtctccctac

SEQ ID NO: 5221 - DNA, 1049 bp, Homo sapiens
cttaaattccaaatattcctaaaaccctaaaaagggtttcattttcgaatgagcattggaagaaaatggtcatttgtagcacagactctacctaaacatagtccaccattccctccctattgaaagttagacagttcatatgaaagtcaggaatctgaaatcctctttggttgggggagcacaaaagatgacttttgcagacccagagcagagtttgagtcgggtggaatgagattagtgtgctggggggaacgtccggacccctggccttctctcctttgtgaggaatgtgacagctgaaaggagtcagaagccgcccggtgcagcagtgacagcccagcagtgacagcccagcacaaagggtggtgtgctttccgacctctggccgccctttgctagaccttcaattgtagtttggggcccagactttgcatttttctcttttatggcttaatttaattttatttcaaccagtttattagagtgaaggccttctttgttgccccgaggctttgtgcccattggactggaaattagatgagctgggggtaagtattctttgtatgcatgagagagttggtgactgggaagacactgagggccagacctcactagccagtggaccaatgatttcaacctagcaacatcacttattactaagggaaggggcagttgaaaagtggtaagcaaggtaagtcatcactagcagctagccacggttgtgtagctgttcctgttcctccgaatgggcaccttggctgtgtttcttttgtgccctctcaaacttggctccatattggaatcactgggagcattgacaacaacaacaaaaacagatgcctgggcccctgcagagcttctggtttaattggaatgggtgcagcctgggtgtgggcgctgcagatcttcaggtgatggtacagtgtagccgcagtggaacaccactggcctgcctgagacctgaggtgcttgggcattacctgcaggctttataaaaaagttaaatggtgttagaatatttcaggggaggttctgattagatctaagaa

SEQ ID NO: 5222 - DNA, 1029 bp, Homo sapiens
ctcaaactcctcagcttaatcagcaatccttccactttgtcttcccaagtagcagggactacaggtgcgcaccagcacacccggctgattttttttttttttttttaacagacagggtttcactatgttgcccaggctagtctcaaactcctgggctcaagcaatcctcctgtcttggcctcccaaagtgtcaggattacaggcatgagccacagagcctggcctacaggctgtctttaaaaggaacattgactaagcagagcaagcttctctttgggagccagataatgaaaattaagagatcatggccaggctgaggatgaggacacaattattggcaagcttttgttagtttcacattcagtcttggctcacatgcaggtgtgccttcctttaagaaaatgtggagaacaggttttaaaagtgaggtgtgtatttcactttcgaagtgttctttcgggtgcctcagactcagcctgtctaaaaggaattcctgtgtggggttctgattccacctctgaaattgctcaggtctccactgtcactacagggccaagatcagcctctcttgcctggatcacagtaggggcctgagtgattcttctgagtccagatcaaatcttgttacttttttttttttttttttttttttttgagacagagtttcgctctgtcgcccaggctggagtgcagtggcgcaaactcggctcactgcaacctctgcctcctgggttcatgccattctcctgcctcagcctcctgagtagctgggactacagacgcccgccatcacgcccggctaatttttttttttttttttggtattttttagtagagacggggtttcaccgtgttagccaggatggtctcgatctcctgaccttgtgatccgcccaccttggcctcccaaagtgctgggattacaggtgtgagccaccgcgcccggccaaatcttgttacttctttaggttgatgttcaggcccctgagtcccaccatagaggctgctgtcacctggcctctaccagtt

SEQ ID NO: 5223 - DNA, 1029 bp, Homo sapiens
ctcacctctcatccaggttggctttgctgcttctctgcctgtgcacaagctcttcttgttgcttggaatgcccacctccttgtcttcagtcttgcctgcactttctctctggtagtgacttcccctccttgccttgtagcatttgtttactaggccaccttctccatgcgagggcttttctcaagggcatggtcttcaaaggtttttgtctttgcaccctctgaaataatttttaaaaaacatatactccttcacatgcttgtaaggtgacatcccatattttaaatcataaataatagtatgtttttgttaatagcaagtaggaattgttaaacatattatgagatgaaaataatatgaagattgacttagtttgatataccttttacaatagaatttgagataattgattttatctacctggttgaaaaatgtactgtaaagaatacaagtaaaattgttacctttgacatttctgtaacttggcttgaacattttggcgtttggtgtgttgggggtgtggaatttcagaaacatttaagagcatctatgccattaaacctgtatgtcttcagtttttctgaatccagaacatccccaaatgggccaaatttcacccataacagaaatgtgttgaagacacataaaaactggaagccatatggattcaagggaccatgggctataattaatcatcaaagaagacatcttgatgatcagtgttttgagttatcctttgtttggtgccctgaggtgttttaaactttggaagaatgccccatagtaagatttcagggagagtggagctgttgcaaagacaggaatgcccgtctgttttcagaaagagttacatagggaaggtgagggtctcaaaattgattctgtaggaggattgcttgggcccaggagattgagactagcctgggcaacataggtgttagctattagctctccttgaactgggcacataggctttttgagtccctaaagttgaatgtctctgttggactactgcaactgtaggatgag

SEQ ID NO: 5224 - DNA, 1060 bp, Homo sapiens
tataaaacatcactgttttaacaccatcctaatgatcttaattagtcatgtgactcaccatacaagttcaacaacatccaaactggtttatggctagttcgatgtgggtgattatcccaaattaccttttagagagacaaaattaaattgtggaaaacaaactattagaaaagaggttactttttttttttcttttttcacagctaattcttttctaaaggaggggatgtcggttaatattagatacgtgtttgactttaagaagaccggcctattgtgagtaagtagctagattgtgaaccctttggaagatttattttggggctgtgagttgaagatggagtaatggaatcttacagtcccaggtaggtgaacctgcctggcacttgcttggccactgtatgtggtttcctctgtggtgtatttctcgcccatgtgcctctaccttagttggagtgcttatcagtcttctactgtgcatggatctcctcgtgtttgtaatatatgcagagatatgggtgtgcagcacgcagagaaacatctttagtaactcgagtaacttggcaacaccaaaatgctaaaataattttttattttaatgagagaggaggaccatgttaatgtctgagcttgtactcagagggtagaggaagagacagcattgaaaagagggcaccaacctcttgattccaacccattaatttgttttctattatttgagagttgttactgcatttgcaggtggtctttcctctgcagcagtccctcactggatatttgaacccttgtgagaagctatccctaaaagattatctgcccattcctctcaagaggtgaaatatggggttgggtgcagtggctcatgcctgtgatcccagtactttgggaggttgaggcgggcagatcacttgaagtcaggagttcgagaccagcctgaccaccatggtgaaaccctgtctctactaaaaatacaaaaaaattagtggggtgtggtgatgtatgcctgtatttccagctactcaggaggctgaggcatgagagtcgcttaagtctggaggtg

SEQ ID NO: 5225 - DNA, 1035 bp, Homo sapiens
atttcggctcatcatctgcaagagagagccgaggcttctcggaaagagagaacaacttggcattacccctgtgggagatatttgtcatcattaacctgcttgagttaaattaattcagcccaagatgactctggcctgagtattggaaaaaatcaagtgcattggttacggaattgtgctcaccaaaacatgattttggtcaaaacaaaattgtagacattttggattttggttagattgagactgggttttgacaaggatggcttttttttaaaaaaaacaaggaaaaaaaccctcaaagaatcttggtgattctcatgtctttgcccagtaagttcaaaatagtcgcacagatttttcttttctttgcctcttttgtctgcagtctccattctaaacgttaacactagatggctttcttatgacagacatttagtaaactgcccatttgagtcgcgtttgtgtgcagcctaggttgtaatttttctagtgttacaattagtaattgaagaaaaaagatctcccaaactgttgctttttattgctttcctagaaaacctacacataccgatatttttgcggatattgagaggtggcctattatttttggcattcccaaagttgaatttcaagagacaacttggttactgtatttagttacatcatttaagaatgcttgtttcatgtttggacttatttaaagaattcagagttctgttagttttgtcattctgtttagacaatatttccagttaaaagatgtttaccgcttgattgaatttcactgcttgattcagagttataagagagtattattcatgagaaaaatgcagtctttcttaagttttgggtataaatcacattgattcttcctaaaagattccattgatccattttgggaagagatgcagttaaagtatctgcatgattcataccagggattgtgttagggacatctccccagaggatgtttgattttttcatttctaagcacaagcccttttatgacaagcacaatagcccgtagtttcagca

SEQ ID NO: 5226 - DNA, 1035 bp, Homo sapiens
cagacttttgcctgaacatcaggcatttccatacctcctctgaaatctaagcagaggttcccaaagttccactcttgtcttctgcacactcttaggcccaacaccacatggaagcagcaaaggcttggagtttgcaccctctgaagcaatggcccaagctgtactttggccccttttagccacattggagttggagtggttgggatgcagggcaccaaatccagaggctgcacagaatagtggggtccgtggcccagcccatgaaaccatttttccctcctaggcctccaggcctgtgatgggaggggcttccgtgaagatctctgaaatgccctggagacattttccccattgtcttggctactaacattctgctccttgttacttatgcaaatttctgcagcgagcttgaattcctccccagaaaatgggcttttcttttctactccatcgtcaggctgcaaattttccaaacctttatactctgcttcctttttaaacataagttgtacttccaaaccatctcttcatgaacaaatatgactgaacactttcagaataagccaggtcaccttgtgaatgctttgctgcttagacatttcttccaacagataccctaaatcatctctctcaagttcgaagttccacagatctctaggatgggataaaatgccgccagtctctttgttaaagcacagcaagagtgatctttgttctagttcccaaaaagtttctcatcttcatctgagacctcctcagcctggactttattgtccatattactatcagcattttggtcaaaaccattcggcaagtctctaggaagttccaaactttcactcatctgcctgtcttcttctgagccctccaaactgttccaatctctgcctattacccagttccaaagttgcttccacattttcaggtatctttatagtaataccccactctgctggtaccaattctccatattagtccattttcacactgctataaagatacaacctgagactgggtaatttataaagaaaggtt

SEQ ID NO: 5227 - DNA, 1045 bp, Homo sapiens
aggagctgagaaagttccccgccatgacgtggaagctgcaggagaagtttgtggggcagggagggagggtggtgagaatcccactgtgaccttcttgaaaatgacaatcattcaaaaactttttaaagtctttttttgacattatttcatttggtcacaaagcagcccttgatgtaaccagttggcaagaggcaatacaaatttagaattctagctttaagaaaaatgttatgggggccctcctcctgttaatatctctaccactatacatgcaggaggatatcagaaggggctaccaaggaagctcgctggggctgagccctgtctcacacatcttgtgttcccagcctgtaatgcgcactctgggctgtggaagtaaactgctcagagctcagaaatggccatatctgatggtctcctttttgtagccctgatcaattcaggaataaccttatgtgaccacagaaggaaatacattttctaataatccaacatatgtatcccaacgtttgtgcctataagtcccatctgcagtttgaaaagcacaggctaagctctatctatgtctaagaatgtccactttgtgagtgagagcgtgattgtgctttatgggtgggtggtttgagctttgtcccttctctaacatcccccttggtcacctcagtgctaggtatatgcagaacgccagctcagtgcctggcatgctgcaatggctaatgaaggcaatgatccttttaaaactcagctaaaatatatattcagcatagttttaaacatttacaatgttttaaatgtaatcatattgatgaaattttggatttttttatgaatccagttagattcctttttgtagaatccaatttgattattgggaacaaaaactgcggtttgtttctcaaagtactcatatcagttactagaagggaaattgaaggaccaagaagcccaatcttgaaaatgtgttgtgcgtttcgactttaatggcaatgttctcaatggaaggttataaatcatcccaaccttttctttcagagcagcttttctg

SEQ ID NO: 5228 - DNA, 1919 bp, Homo sapiens
gttttctctccccttttctttgtcagtctggttagagatttttcgatgttattgattgatattctcaaagaaccagctctttggctctttgattttctcatttatttttcaatttcactgatttttgctctttatttcatttcttatgcttgctttgggttttctttgctcttctttttctagattttttgggtgggaccatagactatgaatttgatacctttttaatgtgtatatttagtggtgtgaatttgtctttcaacacttctttagctatgttcgacaaatcttgatatctttatttccattttctttcagttcaatgtatttctatttcttcttttttcttttttttgtgtgtgtttccatttctattgaaactttatctttgacccatggtttatttagaattgtgctgttcagtttccaaatgtttggatattttcctgttttctttgtgttatgtatttctagtttaagtccattatggttggagaacaaactctgtatgatttcattttttaagaatttgtggagatcattttatgtcccagaaaaatggtctatcttggtacactctctgtggccactataaaagaatgtgtagtctaccattgttgggtggagtgtgcagtaaatgttgaataggtaatgatggttgatagtgttactgagttcttctatattatcgttgattttctgtctggccttcttatcagtttgttaagacatgggtgtttaagtctccatctataattgtggatttgtctgctttttcagttctatcaggtttgggttcacgtatgtttcagttgagttgtttgacttatgcatatttaggactgatgtgttttctttgtggatcaaccgtcctatcatacaatgttcgtttctgtctttggtaaacttctttgttacggagtctactttatctgatattaacagccatttttgcttttctttgattaatgtttgcatagtatatatttttcattttttattttcagttgggctatgttactatatttgaagtagtaacaatatttgaatttcttgtaagtaagaatatttgaatttcttgtaggcagcgtaggtcatagtttttcatctacttgctaatttgttctggtgtatttatgtttggtgtaattattgacatattagggcttatatctgttactaattttttgttttgtttgctctgtttgtaattttcatttgttttttcctgattcttgtatgtttcttgaacatttttcagaattctattttgatttattaaataaataatatatttttgagtgtatcttttagtgtttgctctaggtattagcattatatataaataattgttcaaaatctactggtactgtcattttacctgttcaaatgaagtgtagaagtcttttcatgtccatttagcttcccctgcttgtaccatgatgtcatgaatattttctgtatatacacttagaactatattgacaactatataatttttgattcagacattaagcataatttagaagacacatgaggagaaggacgtctattgtatttacccatacttttgcttactgtgttttttcttccttcctgatgttttaagtttcattcttttctttctttctcttcttttcttttcttagaggacattatttacctattatttcagggtagaacatctgttgacacattctcttagtttttcttcctttgatacattctgttagtttttcttcctttgagaatgccttggaatgaaattttcttcattccaaaaggatatcttcactgtatataggaatctaggctgacaattattttctttcagcacttaaaaacatattgtgctatttcttcctgacctctatggtttctaataagaaatctgcaataattcagaatttttccttttt

SEQ ID NO: 5229 - DNA, 1032 bp, Homo sapiens
caaataatttaataaatcataaatcaaatgaaaaaccagaaatcatgtttgttgacttacagctgcagacttgttcttgggcactccccttcccctcaccttgtcattagtgcagtgtttccaagccaaattattttacatggggtaccatatcataaaaatgcaaacatgagatgtcaaacttgcatataataaatttcttcatttataagtttagtcaaggtgtaaatgatttgacaaggtgtctcaagatgattgtagaataagaagtgtaattttagttggatttgatttggtaatagattttaagatttaaagtgagcgaagtacagtgttacacttttaggagtgaaggaaatagcaaaggaaaagtgaggtccgtctgagcaagaaacgttgctgtgtgattttattaacgccaaatccctcaactagaaaactgcaccgggtataatgggcattgtgttcagagaatgtgtcttctcaagttgctgcctctcccgagacaagtggctacaaaaactgaaggtcctgacttaactcatcacagctgagtgtgtcactgcacaaattactgcagttccattgctaaagatcatagtttctttttgctatatggggaaatgcatgtcaaaagcccggttcatcttgatccaaatcctgtatacaccacaggtaacttatgaatgaaataaacatgtcttcatccccaggagaagtttcactcacaactctaaataaaacactcaaataaatggcattggacctccccttttaccagaagaatgtaacagccagaagtcgaaaccttaaatcagtcaaattaaacttgggggaaaactcagcagtactctgataatttaatctttatgaatcacttaaaactgtctgcctcttcatttattcaatttcccagttggctgactttttgcccaacagcaagcaacttggattttttattactatttttattagttgcatttgcagaaagagaagaaacacttttcaccccctaaatatttatgactttcc

SEQ ID NO: 5230 - DNA, 3393 bp, Homo sapiens
agctctgcctggtgtctttattttaattccaggcaacaatagcaaatgcagtgtataatagtgctttgtgtttatacatccccgtaatgtcagagcattttagaaagctttagaaatacattctgatattatgatttatcatcctgctctttgtatataaacagtcactaaataaccaaactttgtcattaacatgaaacaaatgtttaggccagaaattacatgatacatgtgcccagttatctcagcaaacatctttgttctaaaggagttgactattttcagctttctaaaataatgaaaactcccattaacagagattttgttttgatatgtcagaaaccctctataaaatgtaaaatacattagacctacagcgctagatgaaagggaaataaagctttcatgatggttacatatctagaattctatccagattggttttaaaatgttacattgttctgggtgctatcctttatggcaaatgtgtattaagcatcatctatgcgagtgtactgtgctaggctttacctagcaggaatcactctgtgtgactggtctgcaaaagtatcaactctgcatctgtatccttggacctgcctttctcagcaagaaataattggttctacttaatcctcatctcttactgaggcagcggtagaacatcagaaagcacaggctttgtgctttgtggttggtcaaaccacaattaaaatcccagcacatacgctcggttaggtgtttgggacgttactttgtctgtgagcctcagttaactcatctgtaaaatgagatgatcactcctcagaagtcatacgcaccaaaagagacatggtttgctgtggtaaatgtgtaagtcatttctatgtacaacataccttatccttattcctgaccccatttcattttcctttcctaaatttctatcttttcttattcagcttttaatctagttgtaactaaacatatattatgtatccctgcaatctacctgaagtcctttctgaaaccgcagaaggccatcaaatcaacaggggaaatgacacatcatatagatcgtgtaccatcacatccatagccagcctgctgtgaggtgccctataaatattatttttcccttcaggcaccgtgtttattttgatacctgggccagtcactgagctccagttctgttcttcgagcatcacagctgcctttatggaataataggctctctaagtcccacggttttatggtttatctaacaacaaaataaatgataaaaatattgtaactagtcttagtgagctctcgtgaatctcactgtgttgttttccagcgccttgttggtttgtaatatagacataagtatagcacggacccttaggaattacggtagcccctctgtgctctggaccatccagcctcttctcgctgctggtggagcggatcttgtgccttgctcggcagcccctgtgagtgctgttacagctgtgagctcttcattgagttgaatcggctccttgtgatatcacctggatacccctgctgacacagcatcaagacgctgagtcctacacctgctgctctttaccagtttggaggcagctctccttcctttgccaccctctttttcaggccaaatggtacaaactgttccttgtgtgaaatggtctagaccttggaaatcctagtcggcctcatctagatgttcagtggattgcccctaaccctccccaccttcaccttgctccagaggtcatctaattggttctcagtagaaggacctattctgcaaatcaggtgtcctgctatcattcatgcctcttaaaatctaaaatgtctcattattttacaaaatatttgctgagctgacccttcttcatcctgatcttatgcgtgagtgtggtttactgaaaagaggaagtttacgtttccgctctcaactctcctcttactggttttaactcaatattccagcccatagaggtcagtttcattcatgtcatctttcacgcctccagccccctcagtttggcagcagatgggattacctgtcaccatctggagtttcattcatgatttgtattaacaaatacctggcttgatcaggcaatcaaagaaagaagttctcaacttcacagtttattttttaactttttccaaatgaatattgctgaatgcttcctacccactaagctgttttaagggtgacttgtaagatctttgcaaagcattgagcttctcaaaaggcaattttttttcttaagtacaaagcaggccgcttattctggcttatgggttaatagtacaatgcaattaaaagctgcccttcctttaaagttatgccagggagggatttacatatattgacttgcagttaagttaccccataatttatttggatacgtttgcaaggtgcctggatatgccatgacaaggaacgcaacacatttttatttgttcgatgcccttgttttagttactgctgagataaatgtcatgaatctcctttatcaggaatccgaagtctattagagctttcagacccatacttaggttgtacgttgggccctggatctattattcttaatggtaataataacagtagtgggagtggagcagcagtagtagcagtaacaatggcgatcctcatcttcttgtatttattgaacatctgctcatcttctctaatatattcattccagtcctaacattcactctggaagtagactttcatttttcttatttgacagatcagaaaaaagaaactcaaggaagttaaagaacttgcccaaggtcacagaacaagtgagcagctgagccacgatattaacccagggctgatcttattccaagcccagaacatgcttcctgttatatcctgaagcctctcagaggacacacacacacacacacacacacacaaacacacacagaatgccagttaatgcatttgcccatgagagccttaaaaggaaggcaccatcacaagagccctgtgtggccagagaggcctgtctggaaaggaaagcagctgcagctcagagccccgaggcatttgctcagagtaggacaggtcagagaggcctgtctggaaaggaaagcagctgcagctcagagccctgaggcatttgctcagagtaggacaggtcagaaccactgcaggtcagaagcaatgcagcttgccaagaccacccttagaatcattaggctgagctttgagttttcatactcatcactggaccacaaaacatttatagctcaaaagaatggagtccctgtcttcaggctgcaagaaagcgtggtgagtggccactttgcaagtcatcagcttgcatgtttgtcttttccttttcctgaagagaggcttcctgatgcttctccatggccccggcctggttcttacagctc

SEQ ID NO: 5231 - DNA, 1199 bp, Homo sapiens
ttagtaaaccactatagagaacagtttggaagttcctcaaaaaactaaaaatagagtttccatatgatccagcaatcccactgctggctgtatgcccccaaagaagggaaatcagtatattgaagagatatctgcactcctatgtttgttgcagcactattcacaatagccaagatttggaagcaactgaggtgtccatcaataggtaaatggattttttaaaatgtggtacttatacacaatggagtactattcagccataaaaaagaattctatcatttgcaacaacatggatggaactggaggtcattatgttaagtaaaaaaagctgggcacagaaagataaacattatatattctcatctatttgtgggatgtacaaatcaaaacaattgaactcttagagatagagaatagaaggatggttaccagaggctgggttgggggtattaagggcacattgggaggaggtggtgatggttaatgggtataaaaaaaatagaaaaagtgaataataccttgtgtttgataacataacaaggagactgtagtcaataataaattaattgtacatttgaaaggaactaaaagaatataactggattatttataacacaaaggataaatgcttgagggaatagatacccaattttccatgatgtgattattacgtattgcatgcctataccaaaatatctcatgtatcccataaatatatacacctaccatgcactcacaaaagttaaaaacttaaaaacattataaatgatgctggaaaaactggatatgtatattcagagggatgaaacatctagtttcatcctatctctcaccatacacaaaactcaaatcaaagtagattaaagacttaaataatataagacctgaaactatgaaacaatactagaagaaaacactggggaaatgcttcaggaccttggactgggcaaagatttattgagtaaggcctcaaaagcacagacaaccgaggccaaaattgagaaatgggattatatcaagctaaaaagcttctgcacagcaaaggaaagaataaacaaagtgaagagacaaccccacaaaatgggagagaaatatttacaaaatattcaactcacaagggattaataacgacaatatattaggaactcaaacaactaaatagcaaaaaaaattaataacaatttagaaatgggcaaaag

SEQ ID NO: 5232 - DNA, 1062 bp, Homo sapiens
agtgaagtctgctgggtccccagctttcaggctgcacctcagagtggctgcatgctcttatacctttcctgtccctctcccattggtatatgttttactctttacttgcaacttgttaccttggtggcagggggtgggacacggaggacattctgattaattttctaatgaaaccccttggtctcagggatgcatcctgagctttcctctctcccctgtctgtaatcctgggcccagcaggtgttcctgccccttcctcagaaggagagtttctcatttttaaacaatcccttccctcccagctgcagtgagttttcatcagtgccctaaagacaacagcatttattgacctttcctccacagattacaatttttgttccattggagagttggcagaagggcccggctgagccgtgtgctcctgtgcatgtctgccttttctcccttcaggtctgcgccacatcagacatgttcttagggtgctcaccagtcttttctgtgaacaccctgtagaattctgagagaaggagccggcaatttctatggctccctaaggctttacactgtcccaccagcccacacatagctgtgttcaccaactcatcgattccactggccaaaatcttcccaccagctttggttgcatctgccccaggtgagtgagtgcttattgtctcttttctccctgaaggtatctttctctcctcagattttggactaggtgtggtacaggaaaggattcccaatccagaccccaaaagagggttcttggatctcgcacaagaaagaatttagggtgagtctgcagtagaaagtgaaagcaagtttattaaggaagtgaaggaataaaagaatggatcctccacagacaacgcagcccagaaggctgctggtggcccatttctatggttatttcttgagtatatgctaaacaaggggtggaatattcatgtctcccctttttagaccatatagggtaacttcctgacgttgccatggcatttgtaaactgtcacggcgctggtgggagtgtagcagtgaggactacagaggtcacgctca

SEQ ID NO: 5233 - DNA, 1070 bp, Homo sapiens
ctttatagatgtccctctatgacctgctggcttgcatggtttctgaggagtcttctgcaaggcttacctttgttcttctctgtggaatatgtcttttttctggctgccttcaagatttctttttgtcgtttgttttcagcagtttgaatatatgtcttttgtttccagcagttgttgcatatggtttttgttgtttgtttatttattcatttgttcatttgtatatttatgctccttggtactatctgatcttcctttttttaattttttttattttttgagacagggtctccctctgtcacccaggctggagtgcagtggcaccatctcagctcactataacctctgcctcctgggttcaagtgattctcccacctcagtctcctgagtagttgggattacaggcatgtgccaccacagcccggctaatttttatatttttagtagagatggtgtttctccagacctcaggtgatttgcccgcctgggcctcccaaagatctgggattacaggtgtgagccactgcgccctgcctgatcttctgaatctgtggtttggtgtctgtcattttggaaatttattggctattatttattcaaatatttcttttgttctgccctcttcctcttctctttctgaggttcaaaacatgcctatgttagacaatttggtattgctctgaaggttttggatactcagtaatgtttgcagttttgaactcagttgtatttttgtgtgtcagtgtgggccattgctgctgacctgtcttcatgttcactgattatttcctcgactgtgtccagtgtgatgaacctgtggaaagaaagccttctatatctgtgactgtgtttttcacttctatcatttccacttgactttttattttatagtttccatctctctgcggagattacccattcaatctttcatccggcgttgttttccagtacagcccttaacatattaatcacagttcttttaaatcccctgtcagatcgttccactatatgtgtcatctctgagtcttactttgattacggctttatcttctaggagtgaattttttttc

SEQ ID NO: 5234 - DNA, 1053 bp, Homo sapiens
ctatcttctttctttttgccatggattatttgaactacattttccactagaactctcatacatctcctgtatgataattccaacatctatgttatatatgactctgattctgaggcttgctggccctttagttctctaaactacattttttcctgccttttgctatgcccttaatctattgttcaaagttgaacctgttgtatcaggtgacaggaactgaggtaagaaagcatttaatttgagaatttatgttactctaagagttaggccatgtttaacgttgctttagcctttagctgtgggtctcagaggctttagatttttctagtgtccttgtttttgtctcatcttgactttcggtttcccttaaagcttctcttcggaaacggtttatgtcttgtagcgctattatctgggatctagtgttattatattgagttcctgttggtgtgctggtaaggtgtggggtagggggagcattctattatcttccaattaaatctgtttttaattgggcctgtgtctccgggctgtaaccttcacaaatgtttccaaagtggtaaactttttttttttaatgccctcgacttccttccctggttgtagtagtctcaatctatttccctgaagccctgacacccaatgactatgtttcttcctcccttcctctttccagtgagataaactggagtaaactggtagggaaggaagttctttctcccacgtgggatcggctcctgtgcagtgctgtgctctggaggataagcctgtgtgttttgcattgtttaatcttccccaccttctaccagagccgtgaggggatgtttcttgatcttcaccatgagaacctagtggggtttctggaagtaaaacccctgaaagtgtaggcccttccctaagaccgtggtgcctgtgagtttcttaatctcatggtaggccaccctcagcctgtataacttcatgaaaattatcatttaaatgttcctaggagtttatggccacagcaccttttgccccacagaagctaatctgcattgtgactttctggatgcg

SEQ ID NO: 5235 - DNA, 1027 bp, Homo sapiens
tttagcttcttcttacattattattcatcttttaatgtgtccctttctacttccaactataaacattcagtatgagtttcatttatctgttaaatgttttcctcatctagagactgaagcgtgtcattagaataaattgctgagattggtaggaggattctaagataagtaagaattaaagtgaaattaaggccgggcatggtggctcaggcctgtaatcccagcattttgggaggccaaggttggtggatcacttgaggtcaggagctcaaggccagcctggccaatatggtgaaacaccatctctcctaaaaatacaaaaaattagcctggcgtagtggcacactcatgtaatcccagctacttcggaggcagaggttgcagtgagccaagatcccgccactggactccagcctgggcaacagagtgagactccatctcaaaaaacaaaaaaaaaaaaagaaaagaaaaaaagtgaaattaatatcctgtcaatatgcagcgttaatggaacctgaagtcaaaagtttgggcttggtgatctctgggttttgttctctactttgtcatttcttgatatttattttaacttgtttcctcaccttttcccatctctgctttgactagatgttgtactcaacacccaccaggaaaaccgtgccttgggatgaatctttacctgaaatgttttatttcattcccgcttgctggtgtgtgctcatagtgtaaacacatttgctgtcctctcatctagagatgcagaattaatccatggaaagcagtggtagtttttatatgacatttagatgtcagaagctgtcactttcattcctttgaagtaccgtgggcagtaaactagagctgaattatgcagttcaacctggtttctaactcagtatttttttgtgactctcctgttcctataaaaataatagtaaaggttttgtaacttatgaattaactggtttccagttccccaaaagattttttcccttcaaaagtccaacgtagagctcctttatagcta

SEQ ID NO: 5236 - DNA, 1047 bp, Homo sapiens
acaaaactaagatcaaaataaaatatacctacctgaaaaaacctacatatatttatatcttatagaaggtggaaaggtatatacatttaaatgagcaaaaagttatttaacaagaaaaccaaccaaagttacaaactttttagagcttattaaaggctgctttcacaggacacagtagcaagctctgaagttcaggtgttttacaagattccttttaaagatatttttattttttaaagagattttattgtgtatatttaaagtatataacacaatgtcatgaggtacctatagatagtaaaatggttactatagtgaagtaagttaacatatccatcatctcgcatagttacccatttttatttgtttttgtggcaaaagcagctaaaatctacttattttgcaggaatcccaaatatagtacagttttattaattatagttctcatgtacattagatcgctggagttgtttatcctacatatctgctactttataatttctaacacacatatccccatctctacctcccccatgcccatgttaactactgttttattctctatctctgtatgtttgactctctctctctctctctctctctttagattctacataaaagtgaaatcacgcagtatttgtctttctgtgtctgggttatttcgcttagcaaaatgtgctccaggttcatccatgttgtggcaaatggcaggatgtctcttttcataaaggctgaaaaatattccatttacatttatattagaatttctttatccattatttatctgttgacagacactcaggttgtttccacatcttggctattgtgaacagtgctgcaatacacgtggtagcacaaatgtctttatggcatggtgatttcatttcctttgggtatatgcctagaagagaggttgctggggcacgtggtagttctgtttttagtatctttttttttaaatatagagatgggttcccattatgttgcccaggctggtcttgaacttgcagcctcaagcaatcttgccacctcggcctcccaaagtgc

SEQ ID NO: 5237 - DNA, 1028 bp, Homo sapiens
ttcaaaacagttccaaaggcattatattcccaacattgataaatgattctaaggttcctttagaagaatagcagctaatagtttttaaaaacttgagaaagaagcataagaaaaaggaacttagcacttttagatttaagagtgaagactgggctgggcatggtggctcacacctataatgccagcactttcggaggccgaggcgggtggatcacctgaggtcaggagttcgaaaccagcctggccaacatggtgaaaccccatctctactaaaaatacaaaattagccaggtgtggtggcacatgcctctagtctcagctacttgggaggctgaggcaggagaatcacttgaacccgggaggtggaggttgcagcgagatcgcgccactgcattccagcctgggcaacaagagtgaagctctgtctttaaaaagagaaaaaaaaaaaaagagtgaagactgaataatcagaaaaaagtatgagactatccaagatcagagaatgggattagtggatcagaaaaacacagaaaggagacagactcttttatgaatgtattatgtcaaaattaaatgtcacaatcaaaaattgattttcagagtctagtgttgaggtaattgtttagcagtgggaaagaaaaatgaatcttatgtgctagtccctcgccagacaccaatgtaaatgagagagggatttaagagtttcagaaagtgagagagaggaagagggaaaagaaaacgaggaaagtcacgtgggactttttcatttctgatattatggcaggttactgctgattaaaactaaaaattctgaataaaatacaaaaaaactcttcctgaatgtaacaaaacctgacaaaataataaggaattatcagcttaaaatcttactgaacaggagtacctggaggaagcagggcaggaagctgcttttgccccaagagcatttgcccaacctggggaccttaagccttgtttttcagacctcgaactatggagaacaggaattgaagcccaggtgggtgtcc

SEQ ID NO: 5238 - DNA, 1031 bp, Homo sapiens
cttaggattctctgaactgtttgatttgtgagttgttttggaaaatctttagccattctcatttcaaatatgtcttctgccttgttctgtttttcttttcttcttgggcctccaattatatacatgttagatcatttaatattgccccacatcatttgtatgctatagtctttttttccactcttttttccttctttgggttttagttttaataattttactgacctatcttgaagttcaccagttctttctcctgctgtgtctagtccgatgataaactcacgaaagaaccaacatttctatttgatgtctgtagatagttttcatttttctttcgaaattacccatctgcacatgaatgatgtccatttctgtcactagattcttcaacatattaatcatagtcattttaaagttgagatttttgtaaattatctggctttttcttgttgtcaggctgtgagcaggacacttgtggatttctacatctgaattggcatcacttgtcagtgtttagttttgaagataaaaacaatagggctaaaatttctttgttgaatttttgtagaattctttcctacagtctgaagtttaaaagaagttagtggactatgattaggcgtggttctcttaagttttctggagcaccatgcccattttcacttttcatattgaaaactttatctagaggaaaagtttccctgttatgttttgattaatgacattgttgattctgttcacataatatgatttaatttttcacagactttaacttttggctgtctttcatgtctctcatttctttttcatcattttcctctccttatagttttcctttgagttctggtacagttctagagtttctcatttcaagaatgaagaaatcaacaaatatttattgagaagttattgtgtactaggaattatactagtttatatatatactagttataaaatataatttataaaatataaattatgtaaaataatttgataaattataataatatataaattttatatattattga

SEQ ID NO: 5239 - DNA, 1031 bp, Homo sapiens
ttcagaaataatgcaggacatcccagtaaaggtggatggcaagtacagctgcataatccttgtggatttgtaatgtctgttactatggcccgtatgccactgctctaggttggagttatattatttagttcccagaggaatcaatcaagctgctattcctttatctgagcaagcatgtcatatagtgagacagtatgaaatcacttttgtaagacatagtcagacatttaactatgtttattgcagtaattaatttgcttacacagatttctaagtagattagtctctgatttgagttggcatttctccagtacttctaatgaagaaacaaaatatggtagctataaaatatttcttgttgcaatctgactgaaccatgtgggtatttagaagacagatttattacctcccatttgtagatagaaagctttagaaaggagatggtcaggatcgggaacccaggtttgggacacagagacgattctcaagcttgctgctgatttttattcataaggggctgtgaaaggaaccaaactgcttttcagacggcactattttgcacatttgtggagggtagctgttaataaattcagccaatttttgctcttagagtgattgacagacctttcttttttgcgtgcttctaagagcacaggtggcatattttgagcaagttgttaaaatcagaagatagcgaaatgaaaataaagtttttgcataacactgtgtatttcaattttaaatgcagaatgaataataatagcatggcaacaggtatgatacagtagcccctgggctcaaaagaaattagtttgattctaaaagaaaataggtctgggagagcttagaaagattaggagttggatactgtctaactgaaactttgcaatttgaggatcagagatggcaatatattaatggggaatgaagatattaatttgcttacacaggtgtccatatatgtgtaactgacagtaaccactaataacccagaaagcaaaattcagtagaatatccaagagacagtgaaa

SEQ ID NO: 5240 - DNA, 1069 bp, Homo sapiens
aaattcaacttgagcctcatgattatctgaatactcagcctttctatatatttctatgttatctttctaccctattctattattctgtaatatatcagctgcagttcagtcaaccaaatcacccattgttttccttctggctgttgtcctcagagtttcccatccttccttgtttaggaggcccaaggctatgcctctcggcagccccagctccaaacctattttactatagttatttatttttctatttctttgaatctgtgaaatctgtatacgtatctatcaatcaatcatctctatagctatctatctgaaattatatataaaaagtccctatcaaatgattcatgcatttgttcatttcttcaaatgttttctctttactgtttctctcatttttgttagctattgaagcatcaggtgtcagcattagattcgggttctttttccctcattttttcattcgttaaaaaatgttccacagaatggaagaaaatattttaaaaaacgaaggattgtcatccagtatacaaagaacacttaaaactcaacagtaagaaaaaggaacaacccgaaaatgggcttaaggcctaaagaaacaccccaccaagaagatatacagatgacaaataagcatatgaaaagacattcaacatcaatagtccttagggaactgcaaattaaagcagcaatgagataccactacacacccgttagaatggccaaaatccaaaacactgacaacaccaaatgctggtgaagatgtggagcaacgggaacgctcattcactgctggtgggaatgcaaaatggtacagctactttagaagacaattcagcagtttcttataaaactaaacatattgttcaccacacgatctaacaatcatgctccttggtgtttacccaaatgagttgaaaacatacgtccatgcaaaacactgcacatgaatgtttgtaacagctttatttataattgccaaaactcagaagcaatcaagatatccatcaaaaggcaaatggataaacaaactgtggtatcttcatacaatgagatgctataagagata

SEQ ID NO: 5241 - DNA, 1030 bp, Homo sapiens
ctacatgaactcacagctcacagtgaggaaggaggaagaaacccaaaatactgacctagaaaaactgagctgtttgggacctttgcaaggagagcataatccccaaacagggctgtgggtcggaatcattggggaagctgggtaaaaatgcataatatgcataataaaaacaaactgtaagagctaggcaggaagcggaagaaagcagtgggtaacaagcactaaaattgcagtaatcattgctataaactcccatagattaagtcatcctgcatgacattcttcaaaagagtcaggctgttcttccttaaaaatgttttcttagtctttgggcagtagtttcatggttcctgccgttgcagttccagctatttgcctgcagttctccacctattctactcagatgtttctggacttgtcctattctccttacttatattctctgatttcatatcttgccattaccctttccttcaaaacactgagggtttattttcatttatctagtcgatcaggtcagcatctgaaataagaagttgcccttctgtgcattatttcaacatttcattcattcaacaaatatgaaccaaagcacctgttccgtgctaggatctgtactgggcactgggtatggagtgataaataaaacagccattgtctctgcccttatggaacttactttctgggagaggagagaaaactgtaataggtgccatgaaggaagcacataaaggcctgagatagagagacctgagagggaagggcactgatgttcgaactggtggttggcaaaggcttttctggggaagatacacacaaactgagatataaaatgagaggtagctagctatatgacaagtaaagaggaaatcattcatgcttctcaaactaaactaattgtcatcagttaccatgagaacacacacttatagctctcatccttaaaaatcctgtcttaaaaccatcattctcagcaaactaacacaggaacagaaaaccaaacaccgcatgttctcactcataagtggga

SEQ ID NO: 5242 - DNA, 1041 bp, Homo sapiens
tttttattagatatggttcattctcaaaatcacaaatctgactttgtttgttttaaataactttttatttgtaactcattattcctcatcttatttttgccagtttccattatctagtttgcttttcaaatttgtgttgttaacttgttctctcacaatgagactatatgtattatctcttgaactctatttgttttgctgtgaaggtagctttctctttactgatgagcactgcttgatgtgttgattcacctgggcccccttaagcatgattgtagaaagagcccagactttggcttccagcaaatctcttcctaatctaggaccttgggccagtggcctaatctctcagagcctcagtttcttttagaaaactgagctattgtgatcttttaaggattagagataatatatggcaaaattatgactttactagttggtggcaattactaatatcatcaaaaaatcttatttgttatctggaactcttgaaagtagcattatttgaacagtagaatttctcaggtatctcagaagacatagtcttttattcttagatttcaaaaattccaccaaaaatatttctaaaaggtaccctatccttccctgccttcttaagaagaatatactgataataatgtaagttgttcttgataattcaaattcattaaatgaacactggatattatgatataaacactaatccatatggggagtgtgtgtaaatgcaattatcttgttttttaaaaagaacctaagttcaacttttatcctttcctttgtcctcgcttttcctaagctctttctcagaataatagaattaaacttgcaggcccaacttactgggcaatggagagatggtaaaatttgctttcttggagagttctgcagtggcatttaatgaagcagctgcactgccctcatgcatgccaggcactttgacatcagtgacttcccctattctttggcaaggcttaatgaatcagagacataaacatctttttttttgtcagtttgtccatgcattcattttttttcatt

SEQ ID NO: 5243 - DNA, 1058 bp, Homo sapiens
gtgcagcacacgagctctgggagtgcttcccccgcaatgttctgcaagctctttctagtaaaggatggaattctgcaggctctaatgggcgggtggtcaggaggtgagccaaggccagaggaagacttgtctgaaattcctccctggtacaaatacagtgtgtgtgtagggaatgaagtgtccctgaaaggggagctcccagaaagggctgtcacttttataaagggctggtcacttaaaatacacacacacacacacacacacacacacacacacacacacacacaggagaagaggaggttatttttcattgtcatagctgtagagtttagctctcaagcacaaagggaagggcagagcttggggcatggttggaattggtgaaaacctgttgtttgaactcaagattggcattcaggggttttgaatattaccaattaaaaatgttgcatgaatccatgttataaactggtacttctctgtcactaagtttatccatcatgtgcttctaaccccacagagtatattctgtagactcattaccatggtttttaaaatcttacattgtcccaatatgttatgggccagtacctgggcaatcaccttgaaacattttgcttattacactgctggttgagaggcaggtgcagtctacccaagggcagcataggatctgtaggaatacagcattttccgcttccatttactctcacctggatatggtctccaactcattcagcttgtcttacattaaaaaatgagatagtattgtatgtgaaagtgttttgtaaactctaaagctctatgcaagtctatgatagtggcattattattattattatcattatggatagcatgacggtcaagcattgcattggtcctaaactgatgagaattggtgagaattgcaaagataagcacagtgctaggcctggctgactgttattctaggtagatataaaggtagcatttacatcacaatttactatcattaaaacattaacaagaactcataagaatattggcatttactaaaagatgaaacaattgaaataatt

SEQ ID NO: 5244 - DNA, 1061 bp, Homo sapiens
gctgcagtggctcacgcctgtaatcccagcactttgggaggccaaggtggatggatcacctgaggtcaggggttcaagaccagcctggacaacatggcaagaccccatctctactaaaaatagaaacattagcctggcatggtggcacgtgcctgtagtcccagctacttgggaggctgaggcacgagaattgcttgaactcaggaggcggaggttgcaatcagccaaggtcgtgccactgcactccaacctgggcaacagagcgagactctgtctcaaacaaacaaacaaacaaacacaaaatacattgggttgaaatttatacaccattacccagctgtgcaaagaaaatgttgagttaccttttagctgaccacatattgctctgagctcttatacctgttgatgtggggagtgtagggatgacttaacttaaaagtgccagttgccagatacagtggcttacacctgtaatcccaacactttgggaagctgaagtggggagacggtttgagcccaggagttcaaggctgcagtgagctatgactgtaccactgcactctagcctggggcagagtgagatcctctctcaaaacaaacaaaaaaagtgctaattagggtaactcagccctttcagtcttggagtttgtgtgtgaacaagtgtttaatttattcaaagaatcagtcttttgggactgtttattctcttccctttcatgtattcaggctctcctcctcctcctttccagggcctctgtgtgttagggataggattcctaaacctgtgggtggaagtggacctgagaggggcacttctgaggaggggagcatccccttagtccagtcaccgggtgtactgtgtgttgtacctgcctggtttgggtgaggtgctggatctgccactcactgaccaccggagaccctgccatttgccctagctgtgttctgcacacactgtcagcccgtacaaggtctgtgagctctgcccagccccacccccagctgccagtatgtagttctcaccacagccctagtatgtgggggccctgtggaatacgggc

SEQ ID NO: 5245 - DNA, 1042 bp, Homo sapiens
gtggacaggtgagtctccctccctgctcccatcccccaccatggcgtcacaagctcagggttcctcagagcccaggcagatgtgataaataggtgaagctggcccagtgtggaatggtagagaggagtggtgatgactgcagtaaatcagagggcattcatcccatctgaagggcatttatcccatctgaagggcatttatcccatctgaagggcattcatcccatctgaagggcatttatcccatctgaagggcatttatcccatctgaagggcatttatcccatctgaagggcattcatcccatctgaagggcattcatcccatctgaaggacatttatcctatctgaagggctgctgctatgttagtctacttatgatggctcataagtcccaggtgataggattttccgtttttttccacagggagctagaaatgcatatttgtatctaaaagtgtattttgtttcatgttgttgattttaagtttcttttgtttgtttgtttgttttgttttttgagatagagtctccgtctgtcacccagtctggagtgcagtggcgcgatctgggctcactgcaacctctgcctcctgggttcaagtgattctcctgcctcagcctcctgaatagctgggattacaggcgcgcgccaccacagccgggctaatttttttgtatttttagtagagacggggattcaacatgttagccaggatggtctcaatctcctcacctcgtgatccgcctgccttggcctctcaaagtgctggattgcaggcgtgagtcaccacgcccagccgatttaaattttttttaacaacaccacagaccacaggttgtgcgtggttggctgtggcctgtgagctacctgtggtcagcctctgccctgccccctccagtgggaaagcagcctctgccctcctccctcagcccttcttgcacacatgtgcggcatccagatgcccctaggtgattccctgcaggctcctccaaaccaccttgccaagttctccactcattgctcccttttgaaactctca

SEQ ID NO: 5246 - DNA, 1050 bp, Homo sapiens
ttcacaaaacatataaaaagatatgctgaattactttatcaaaaggtttctctgagtgctggatggaaagtagatcaaagaaaggacaaaaatagaaatgagaggttcggtgtctatttcagtcacccagtcaagagatggtggtggcagtaaagatggagaatcatggatagattttgataggatttaatgatcagttcatttttagggtagaggcgtaaggatgggggaggaatcaagggagatgcctgattatctggtttgaaccagaggcgtatgaggtgccactgactgagatgaaggatgaaagaggatagttggtagggaaaccgaacacctagttttacacatagtagtttggagtttccttttagatatcaaagtggagatgttgagtagatagttggatataggtgtggggagtttaaaggaacaatctaagctagggatacagatttgaaaaataatcaacatagagatgatatttaccgccaagggactgggtaacacttcctaaatagaatgtgtagagcgggaaatgagtgctaacagtgaggccccaggagcgctacactcagaggcagggcaaagaggaggcgtcgggagacaagggaagagcaaggagagcatttccattgtgagcaactgtgttgctcgctgctgagaaaacaggaaattgtggttattttttgtttttagagacattgacaagaaactttcagtggtgtgttggggagcagaagccagactgctgtgggtttaagaggcaatgggaggtgaagacagttctttcaagcagggagcagaaaaagggcacactatctggagagaggtttggagtcaagggggtttattcctccctcaagatcagaaggtccttgagagtagggctgtgatttgaatccccattggtccttggaatggtgctttatacatagcagataatctaatcactctgcattaatggaatctaactccataagggaaggcacagttttggtagtgcatattacagactgtggtcagacccatttcagtagactcaccaca

SEQ ID NO: 5247 - DNA, 1048 bp, Homo sapiens
aatatgttatatataataaatataaatagattatatataataatatttttatattatatattatatataatatttttatatttattatatattatataaaatatctaaatatatattgtatatctatatattatatataagtatatattatataattatatgttatatttatatattatatattatattatatttatatataatatattatataattatatatatgtttatattatatgtaattataattccctatctcttacccagcgacttccgggtaggagatagggaacccctcctgactcccgagggcagagcttcacggagaggcacggcattcccatgagccacgttgcccggcagattaccaaagaaaattttgccaaatttgattatataccatgtatggatgatagcaatctgagagatttgaatagaaaaagtaatcaagttaaaacctgcaaagctaaaattgagctacttgggagctatgatccacaaaaacaacttattattgaagatccctattatgggaatgactctgactttgagatggtgtaccagctgtgtgtcaggtgctacagagcgttcttggagaaggcccactgaggcagcttcgtgccctgctgcggccagcctgactagacccaaccctgaggtgctgcatttctcagtcggtgtgtaatcatgttccagagcccaaagccccagctctttgttcagttgacttactgtttcttaccttaaaaaataattgtagatggaaatcagttgtgtctggcagaagaataaataaaaatctttgattcagacagtttatgggatatattaaacattcttagactagttgaacatctcacttgccccaattacaaaaatagtagaaaaagcaacataaaacataatgaaggaaaaccttacttgaaggcccaagtcaacatctaagtccactgagacttagataatcgagtctacctcttcaataggtttgtgtggatggcctgatggagggcaggtgccctctgctcccctatgctacctctttctt

SEQ ID NO: 5248 - DNA, 1083 bp, Homo sapiens
tcctttttcttttaaagagttaagtttaggttaatacgttttttaactctaatttactccaagcagggctataactgaatgaatattctgttctttttaaactaatattcaggtaaaaccacctcagctaattgattatctgcagcagaagaaaacagaaggttataccatcattggagtggaacaaactgccaaaagtttagacctaacccaatattgctttcctgagaaatctctgctcttgttggggtaagaagcttcttgtgtccatagtatattctctgagccccagactactggaagatgttaccttgtttttttttgtttttgagacggagtctcactctgtagcccaggctggagtgtagtggcacaatctcggctcactacaacctctgcctcattggctcaagcaattttcaggcatcagcttcccaagtagctgggattacaggcatgctccacgagacccagggtttcaccatgttggctaggctggtctcgaactcctgacctcaagtgatcctctggccttggcctccatggtgggattacaggcgtgagccaccgtgcctggctagaagatgttacttttctgttttacagtttaccctgactcctgctcatacctgcacttttctttgatttgtaacatttataagaagctccctgggctttccttttatttcatctctctggcatggccagctgaacatggaattgacccatcagtctttttttttacactcttatttatttcccggtactacagacttaacttcatttgttaatgtttcttttagtaacattcagaatatcaaagagaaaaataagtgaataaacaaaaaataaaaagaatatcaaagagaaaaattgtttgttacaggaaaactaatctttcttccattttcttcctcagaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagc

SEQ ID NO: 5249 - DNA, 1030 bp, Homo sapiens
gtacttccaaggaaaaaaatgttaccaaactatgatactctggattctaagatgtgtctcaatttcagatatgctaaaacgtgaaaaaacgtgtatctcatgtttccatgaagtatcataatatgttggttaataaagctgattttgaaaacttaaagttactactacaaatgggaattgtgtctgaatccaactaaagttttttacttaatgctttgttaagtctcattctaaattatctcattctaaattatttcacattcttaaaaatacatatacatgtatacataaatatatagagattcagatttatttatatgtgggattgttttctttttccttcccaggtactaatttggtcgaagcagataaccaagcggagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggtaaagttggagttttctgggagctttgcctgaaagcttttggtcttcaacattttttaattaatccactgccacgggagcttcaaaggaatgtatgcgacatgatgagcttagcattgtgctgggaacaatcttaatgatcccaggtgttctgtgcaggactgtgcaggacctgtgaggtatttggggcttcagtgctcgttgttggcagccttcagtgtatcagcgacaaacagtttcagcacctcagtgtctctgcagaacagtggcttcctctagtggaggtgggtggaaagtaatttattattaaagttcttaaaacaagcccgcacatgtacccgtgaacctaaaataaaagtttaaaaaaaagtttgtatttgtaaaaatattttatagtgctctatctttgtgtattagtccttttgcataatttataatagtgcagtctttaatcatttaagaacagtgtttaaaaataacatacagctcac

SEQ ID NO: 5250 - DNA, 2002 bp, Homo sapiens
gagaatcacttgaacccgggaggcagaaattgcaatgagccaagattgcaggactgcactccagcctaggcgacagagtgagactccatctcaaaaaaaaaaaaaaggatggacaagacaaatctcttgtaaaaaaaattacaagtaatttttatagaagctctgccctgagggagggggagcgtgacttctcactccttcagtgtgggctgcacaagtgacttccttccatatgggatcgttataacaaaagactgtaacaagggctatgggagttataagacaggaattgtggacaaaaaccagtgtatatcataacatcacaccttgtaatgttggcagtacagtcactgacctttgataaatgttgatgacatgttgagtaaaggaatgagagaaagaggattgtttatctctgtttttatccttctcagagaaacttagagtaacaagtgtgttatcagccatgctgatgcctttggtaaactattgtgtgaatatggttgttttgaattggtcagtagaaactgggctgccaggcgcagccggtaagcatttccatgtgagccttaggggagaagtgcatttggtaggagcatcaaaatagcttctgatatttcattaaaagtttgggtccgtctggttccttcattagtatatgtcacttcctttgaccttcagtgtctgttgaaccatgtgattttagaaagcaagggattgcttgacatctccaggctgtgaagactaaagttcacaggaaaagactacaaggaaatttaaacagttttattattttccccctcatttcttaattttcctgccactactcagtactgtgtgggtccaggatcaccattagggaagacagagtagctcagaaatcagtagtgaggaggaggacagcactttgtgtggtatcttgctctaggagcattttcaagccatcagaagtgggactcttgaagactatttctgactttctcagcacaaattaagataataggagatggaggctccatttgaaaaacattttggttgtataatggttagcataaaacatacttttttcaagttaactcaggtactagagtatggggggcggggggaaatgtactgcagcattaatgaaaactagagctgggagaatgtgtttttccttgagtaaattgcaaatgcctgtgcaccgcatttgaccaggagggaagaatgagaggccctggtagcaaagccagtggaagaagttttactaggagcagttgtatcattcgtgtactttttttgtgtcatacaagtgagagtaaaatggtccatgtctgtgttttgaggaattttttgcctttcttttcagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggtaaggagccctcgtcaacctcatcgccctcactctcctccagcagggcccacagggagggggcagtgcccatactgtgtcagcttctccttccacatcctcatgctgccgtcctggagcatcgagggcttggactgggccaggcctaagcagctcactttggggtgtagttaattacagttcattgtcagctccaccttgacctcttattgcccttttatcctcaatcctttattgtacaaataatcttctacatacttgtacctgtttctcttcagtatagctaaatgtcatcctttgttgtttgagaactgcttagaagtggcacgacctgactttaaagacatacttttaatctctcagctatactagttatagctaaaggcttttttcttttctaagagaactctcctattccgcagacaaaatcatacatggaagctcagtatcaagcaag

SEQ ID NO: 5251 - DNA, 1681 bp, Homo sapiens
atgactgtcatcatttggagtgtgcagtacagttacttcatgttcctcaggtttagaacaatttcccctgtaagttctcacacagataggcagaaatcataactaattttggttaatcactatggcagccgttgaagaatttaagagaacctgccagtaagatttggaataagattctatattattgcatccacagaaaagaatgtactgatatactataaactctaggagaaaacttaattgaaatagtgttattaagtgttgaaagtaccataaaaatataagggaaaataagctttcctagaatttttcagtgttctagtttttaaacagtgatgttttttattaacctatttcatccattcaaagacaggcctttctccacaccacattttcctctaaaatcatgataacacttttaaattgatggtgtcttccagtgtgtatcagccagatggcagtgtgttacagttccaggaaaactcgttcacatcttccgtaagatcaagaaggctctggcatcagataagatcaaatgttgtctttctgttttaaatatgtgccgcaaagagatttgcttacaatctattgagaaagctaaaacagagcagacattgtcctgttgcggggtagatgaatagcctaagaatagtttagacaaattctgaaaacgaatttaccttagaagatgttcatgttagatctggtaaaagtaacatgttatttttctgtcaagccctttttgtacttgccgtttattacatattttagatttattttttattttcgaaacatccaaaaaggaatgctaattagtgaaatggaagaatttccatttcaacaccttaggaaaaaaaaaactgacttgacatacctaagaaaaggccaagttgatttactttgtcagtctcttcatttgtgatacgtaaagtccgttgttacctagataaatgtaggtttgatttcttggaagcaatcacttaagactttccattttcttcaaagcatcttacttaacctgcatgtgggatctgtactgagcaattagagattcaaaacaactgtcacacacgacagaggtggtaaccgcccaacaggttcacctcttccgccgcctacacagagccgatttatcaagacaggaattgcaatagaggaagagtacacagagctgcttgtgcaggagactggagtcttattagtactcaaatcgatctccctgagcattcggggatcagagtttttaaggataatttggtgggagggggaaggccagtgagtcaagggtgttgattggttgggtcggagatgaaatcataaggaattgaggtgtccttttgtgctaagtcagttccagggtgggggccacgagatcagatgagccagttaatcgatctgggtggtgccagctgatccgtcgagtgcaggtctgcaaaatatctcgagcaccgacataggagcagtttagggagggtcagaatcttgtagcttccagctacatgactcctgaaccataatttctaatcttgaggctaatttgttagtcctacaaaggaaatctagtccccagacaagaagggggtttgtcttgggaaagggctgttatcatctttgttttaaactataaactaaactaagtttctcccaaagttagttgagcctacacccaggaatgaacaag

SEQ ID NO: 5252 - DNA, 1029 bp, Homo sapiens
gaggtcaggagtttgagaccagcctggccaacatggtgaaaccccgtctctactaaaaatacagaaattagccaggtggggtggtgcacacctgtggtcccagctacttgggaggctgaggcaggagaatagcttgaacccagggaggtggaggttgcaatgagccaggatcacgccactgcactccagatggcatcaaagtgagactccgtctcaaaaattttcatctctttccaggctcctctggctcttctttttcatcttcgtgttcctataatgaagaaacagattctgttatttttccttgagttgccttttagatccatagctttattaatgtagtttgtttatgtcacctctcaaatgggttagcactgccccaggaattctcacaaagggcaggttggttctggtgtacccccaaaacttcctggtgctcccatccacagtagtgccagttgttacttttatttgcttagctcagcctctcactcgtcattagaccttgtatattctcttcgaatctgattttacctgtggacatcagacagagtttttgatgtaggcaaaggaagcttttgctgatggaatcaaaatgggattcaaaaaaggtagtggggaagaggggagtagtaggtagcttacagaacaccgggaaagctacagaatcagaactggaaaattggcaggaacaggggaggctcagtggcttccagaaatgcaaccacaggcaggccagagagagctagttcactggggacattaccccactggacacacggtgccttcagcagggctttgctatagccagctgtatacctactgtctctgctgcctgcagtggaggagggttttctgtgagctctgcttctctaagttgtaagttctcaatttaggaatcagaaatggagtctttggaaccgggtcaggtgccttcttgttagtggcaaggaggctgggaagatgaatacctggcatttttcagtgtcccccaacactcataagatggaagaattccctaaacttgga

SEQ ID NO: 5253 - DNA, 1068 bp, Homo sapiens
tgccccacagtacatagttagagacgctggtctttgctgcctcagccaaaggaaggccactggcaaaatgcaaacaaaggaagctgaatgtgtgtggggtgaggtgtttttcccctttgattctactgctttggcagttgtttctcttgaagagtcctggatgaatatcactatcagtaaaattttatttatttttattatcaagagatgaaatagcattctctgattattgatcatctcgcaaagttattctaacagtaatgaatttaacagtttttagactgttcatgattatgttgaaactaagtaacagtttttagcagcactgattttttaaaaactaaatcaaggataaaatgacggttgtattttattccagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaaggtaaaagatgctattatttcaactggtcataacttgtattaagtgcctacttgggtatagaattatgtctttgttttgaggctttcaattaaaagaatataaattattagttaactttaaccttggggatttaattttttttctatttaaaacctgttgttctttatcaaatgttttttatggaaagacttgttcaggatgtacagaccttcatagaaaaccttggacatgactgtgcggcaaatattgttatggaaaagtaagtatggtagattttctctgtcttcacataaatgagatactaaaaatttaacatcatatgacaaacattctgtatttgctaaatttaataagtgacatctaatatattaataagatgggatgagcctttaaaagtatgttagaaattatagtcccttgctaatacattgtctttacatctttcagtattcactagaatttgataaaattttaaaagtttttagtgccgactccagc

SEQ ID NO: 5254 - DNA, 1029 bp, Homo sapiens
aacagattcattaattaggattctttttacattcctaatgcttccttttcattaaagtcattggtgataatttaggaaaattgcatcttcgaatttaacatgtcttaaatttcctagctttgtctcacacaaagtcattttcatctcctgatttctttaatctgaccatggaataggtcttaaatgatcagataattatccttccaaaatgcatgagtttattcttcttggaacatttctcttttgtatttttagtcttttttggtctgtctgtgtctagtaaatgtcttatgctgttacattggaagattatttgaagtaaatatgttagtctctattaaagtagacataaactgggaggtcagatagaggtctgagagaccatggcctttgtggcttcattcatttaatctcatttctggtcacattttagggaacactcatctcagctgaaatactagaattgcctcttacggagttaccttgcatctactcttgcttcatctacaatatcttttccacatggtacctagataaatcttttcaaaatataaattttgattttagacatttttcctccacttctttgtatatattccctttaaccttcagtggcttcctattgcctttagggcagagacaaaggtcctctgcatggcctgcaaggtttcctggtctctcccctgcctgtttatgccacttcagtttttgctgctccctgtcacttagtgcacacatgagcatcctcctattttctggaatatggtatgccttcttctgctagaagacctttgatgtgctcttccttctgtctagaaagttctcgtgtcccttcatctttcctcttgagtcgtcacactcagcccaattgtcatttcttcagggaaacttcctcttactctctggatgagggcatgtcttcctagtgtagactccactagcaccatgtacttctcattcgtagccctcactataattgcatttttctatgtattctttgataatgcttttctcctgtactctaaattc

SEQ ID NO: 5255 - DNA, 1057 bp, Homo sapiens
ccaagtagctgggactacagccacgacactggctaatttttgtatttttagtagagatggggttccaccatgttggccaggctggtcttgcactcctgacctcaagtaatccacccgccttggcctcccaaagtgctgggattacaggcgtgagccaccgcacccgtccaggacttttgagttttttacaagttcccaggtgatatgtatgctgctgttctgggaactacactttgagaaccatggtttccattctgcaagttggggaccacagaggtgccagccatctgtggagtcattgtgaggtgtcaatccaaatgtgcaccaaaccttgtttgtggacttaaataattacttatatgtgctaaatatatatagatgcaaggatgaggagtaaagaaaaagcatttctaaattcaaattaacttttatggttttctttaatcagtagatccataaaacccccattatttatttagaaacccaaatttatccatattttgaaggatatgtaaattaatctcaagcaaacgtgtcagcaactttggctatgtggtattaagaacatggaactccgaactggccgttctaagcgtgtgcagccatgaacaacttgagtgactagagaaaacatttcagtgtcttttttctctttgtaatatcttagtattggcagtcctacctgcctgccaggacagttgaggattctatgacatgatttatgataatcactgtataaatggtagactttaatgtagctgtaatgtggttatattcattagctttgccatactcagtcttacatacctgaatcatactattgtttgaaaaactggataaatcaggctctttctacatatgttttgtagaaacagaagagctactgtgaaataaagagatgaaaattgcctgacatttttcaagatgcattttcatttcatatgatttttttgctcttatttttagatacatgttataaagccagttttaccaaagctaaacaatctgtttgaatatgcggtgtcagaggaaaatggtaacgattacttttatttta

SEQ ID NO: 5256 - DNA, 1047 bp, Homo sapiens
gcctctgaagatctcctgccctggccacagtctctctcgagagcaccggggcaggcttgaagaaaagagctggtgaatggatgtggactccctcagcaagctgtgaggctagcccaccttggtctttaaaaacttgtcaaaatgccatttttaaaactgctttttgggtgaccatgtcttgctcctgtgccagaagtagaacagataagtggcctttccattcttggagcgccttccttccttttagaattcaggttgcattgtgacctcagttctgatgctccccccacccaccgcacaacagtttaggattttgtagatttttcagcctttcctctttgtatgacaataacgatctcctatggttttctatgtcctaatgagcaactgaaacgatacatatctaaatgcctttattttgtcctcatatttcattgatggtttgactgagggtagaattcgagcctggaagatatttccattcaaaattttaaaggtatctatctattgtcccagaagctagagcttccagtattgctgttgagaaatctgaaaccattctgaatcctgtttatttatacaggaactgtttctctctatggaagtgtgtaggatcagtggctctagcattctgaaatttcacagttttgataggagtctattttcatccttgtgctgggcacttgctggacctcctgtgcaatctggaaatcatgttcttcagttctgggaaattttctagaatattctgtggattatttcgtccctttctgttttctgttctttttttagatattgaacttcctggactttcttgaaagcatcttttctctcctaaggattttctatgattttggattgagtttttttttttaaatgtcccctttgtgtgtgtgtgtgtgtgtgtgtgtgtgtgtgtgtgtgtgtgttttagagacaaatcctcgctcttgcccaggctagggtgcagtggcgtgattatagctcactataacttcaaaatactgggctcaagtgatcctctcatctcagcctccagagaagctg

SEQ ID NO: 5257 - DNA, 1042 bp, Homo sapiens
tttagtgaaattgaaaatagtgcagcttgtagaagtaattctcaacatttcaaaacctcttcccaaagatatactttaatgactgcatttcgttttcagttaagaaaacaaaccagactcttgatgtggcagatgtctttgtttattccccaaaggggagttgggggagagttaaaaggaaactatggaaatccttttttaattcctagacttttaagtccctctttactcaaaagttgttttgcatatgatttatagatggttttatttggttagtgaagagtaaaatgtttctcttcctgattcctaagtgtatacgtggaatcattcagaaaaatgttcagttgtgtgtaggccatgagaagtcctgagtcaccctcatttgcttgccttttgttcatagggaacagtatgagaagacacgcctttcctctgtcacagaccaaggtcagatgcaccaatgaatggaatacatatttacccaatttatcgtggggttctagaaatcgggagtgggggtggggactgttttaactccttcagtgccactggttaggcctctgacagcaatggtactacaatcaaataaaaattacgggtgtgactttccagattacaaactctatagatcccttgttgctgtttctcttgacagcctgcattttccttaatatgtctgaacccctcactgtaacttaaaaagcacacaaatagacaatttataaattactcgctaagcggttagaagatagaaaatgggtagatttatggattatctgtggattcctccattaatcctcagataaatccataatttgtcagggatacccacactacccctagttattacattaatttatacctaatttaacagtgaacattgttttaactcattaggtgtgtcatctgctccctccccatgtcaatacaacttaacttaaaatgcttgatttgaaacagctctctgattgtttgatttgaagtgtaacttgtctctttaaaagattatagaatatgaagtctgtatttgcactggttttaa

SEQ ID NO: 5258 - DNA, 1027 bp, Homo sapiens
caatttatgtgtatggttcacagcctagcttctatttacatttgaaaatacagatttttaccaactttggattcttttttagttatatgtttgtctttcctttttaaattgttcaaaactattttttaatggtcaagttactaacacttgaaaatcagatactgcaccaaatacagtgtttttccgtagtgtttttaatgagtgcacctattactactgtgcgagaattcatgttttaccagtcattgttatattacaaacagacttgcatgattaaccagttgttacacttactttttcaagttggagtatatatgactcagtgcagactggtctctcttatgtgaatgcacacatgcagaaatgcagagtcaattttacatgcccataaagacatttgtaaagaattcagctcttatggtctgttgtataaatgtgtatctaggcactttggaatttgacctcacagatgttacaacttgatcagtcgtttgacctaatttgtggtagctatctgtatgttttgcaatcttaatacagacatgctttccaaaaagattaatacagaaccatcctgccgttttggataagtctatccagctgtggaaagggcaacctgtggtttctctgtactggtgtttaatgggggaagaatatgaacagctttaaagagctgtgtattgtggttactactattaaaaaataagatctgcacgagtctgactggcctttgggtggcctttgtggacggctcgtagctggaaagtgttgatctgggttttctggcattcttttaagttaaaaagttaacatcgggacatgggtttgatcttttgttgtacctgatgacagtgcagagattctccacagctggataaaaatgtcacaaagctacttactgtacatgggcagtatcagatttcaaatcctaatatttcagctgtgcttttaatactcaaaatattaggggatggggtgttgaagctttcccttttttgcttttaacaatttatagaatttaacagat

SEQ ID NO: 5259 - DNA, 2588 bp, Homo sapiens
agcgctgccgtggagcacgagcagcgtgaggcggcagccaaggagaaacaaccgccgccgcctgcgcaccggggcccggccgacagcctgtccaccgcggccggggccgccgagctgagcgcggaaggtgcgggcaagagccgcgggtctggagagcaggactgggtcaacaggcccaagaccgtgcgcgacacgctgctggcgctgcaccagcacggccactcggggcccttcgagagcaagtttaagaaggagccggccctgactgcaggcaggttgttgggtttcgaggccaacggggccaacgggtctaaagcaggtaggggcggctgtgaagtgagggggtctaggggagaaaaggggacggagagcagaggaagggtggttctttggattcaccattttaccccagcccagaaacaacaaacaccccacttcctgatctgcctgaggcggaaccagtgcttggtggcaacgtgttcatgtgctgaagcagcataacagagatgagtcagactgggctgatacgctctgacacggggttttcctttcccagcacattcttggatgggagcatgagggcaccagtcaccttttaacctattgggggacattagcagtcacatgttgagtgcaaacgagggtacttttgtgcatgtgtacaaacaggcagttacaagcgtgtcattttcagtggctccattttaaatcagtctgctgcctcagaatcccgtacgcctgaaggttttaagttgcatgtgcacctgaaactcgtatatgagtattttctgtctgtgcttttagagaggaggaattctgtaacgacttttgtttcgggttaggaagagaatgatctctttcagtgcaccgccacttatgttacctttttccttttatttctttgtgtttccagttgcaagaacagcaaggaaaaggaagccctctccagaaccagaaggtgaagtcgggccccctaagatcaacggagaggcccagccgtggctgtccacatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtggga

SEQ ID NO: 5260 - DNA, 1053 bp, Homo sapiens
ccctgcgggacggcgggccagccagccagccggtcgcccccacggccctcgggaacctcgcggaggcgagcaggaccccccccccccccactcgcgccctcgcctcccgccacctcgagtccaagttcgggcccgggggcggcgcctcgacgcccagactcgccgaagggggtggagcctgcgctgtgacgcggccgcgctggccgtagaccccggatccctggaatgtgcattcgttccacgaggccctagtgccagcggcgccgaggcacgtctgcgcggagcgtgcgcactcgcggcggcggccgcccacggccccgcgcccacgtcacgcgcccgccgcgcatacctacataaggcagccggggcgactggcgcggcgaggcccccgatgaacagggcgggctggacggggctaagagcggcacttggtgttcgggagaggctagtccgaaccgcgctccctcccctccagagggctccgtggaaaacgcgcgagccagctggcggcgtgtgcacgtggtgctgggcttgggaatattcacagtctccctagttagtaaaagggacaggcggggcgtatgtcctttccaagacaaatgcaaagcaccagtgacggatttcatgctatgtgtccgacattgagctttcaagtataactcctaaaaaaccagaactgtgaaccacgctagacctaaattccccattctcaggagactgacggaaaccaagtgacaaagtgtccttgcataaaagaaaaaaaatgatttttagcacgatttggcccagaggcacaccagaggaaaacatcctgagggtggtcgggacagccgggtggggcgcgaagtgagggaaagtggaggaaaagcactcgatcactttgcgcggtgttccgaagggaacaccggcgctgcgctgctgcgctgccccgcgggcgggcgggcgccgcgtagccggctctcccggcagcgctccttcggcgcgcggggggagggggagcgcgcgcgcgggagggcgggcacgcgcacgaggggagggggcccgcgcaggcgc

SEQ ID NO: 5261 - DNA, 3465 bp, Homo sapiens
aattaaatgtcagaatgggtgaactttactaagattcaattctttgaatacaaagagcattttattttgaagttagaatcctaattaaatgcttatgacactttaaaaaattattttttttttctttcagagaattgtaagtgctcagagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatctcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagaaaactttggcttggcgtatgtttggagaagtgaactctgctgaatttattgagtctaaagctgtgggttttttgttgttaacgtctttgaggatgtctagggccgcaggcttccctgccagaagaatgcacatttgcttcagattccaggtgaagaaaatccctgtggtagtgtcagcgcctgagggcttccaggtggtggtgggcccagcgtcaggagatagcagtcacctgggaggcccgttacaacaggttcgtgagaggagcccagtggtggtggtgctgacgtgcgaaacatgaaggcttgttagagaaaccagctgtgttaaggtgacagaatgtgtacgttagcactgtaaaaagcagctaattggtagcagaacgtgctagctgagaatacgttgtattctacatcactgataatgatctgaagtgtacaagtcatcagtatcagatctatgagagtttttgtagttttgctctaacataaatttctctttgccacctccaaagttattatattaatagtaaaagtaatgctttggagagggtggaagggggtatgccctag

SEQ ID NO: 5262 - DNA, 1123 bp, Homo sapiens
atacttttttgatatcaatagaattgctcaattaatttgacctaaagagtcacagtactcaaattgccaacagactgggaaggggtaaaaatcagtgagtagggacaggcatggtggctcatgcctgtattcccagcactttggggaactgaggcaggaggattgctggaagccaggagttcgagaccagcatcgataacaaagtgagaccctcatctctacagtaaatgagaaaataaaccaggtgcagtagtatgcacctgtagccagctactcagagactgaagtaggaggataccttgaacccaggagtttgaggctctagtgagctgtgatggtgccactgcatttcagtctgggcaacagaatgatatgctgtctcttaaaaactatatacataaaatctgtaactgcagaggagtacaagataggcaccagtcaggaaacatttccaagtctcctacaggcatcacactgcaatttctccatcaatctgagagagaggacccaggcattggggaaagggaaagcattccccctcagtgctaaagcagtgctgcatactgagttgctctgctccttgcatcgcataacactgggtttgatcttcctatgctgatagatagattttatgatattctccatgctgttgtattaacaaaagataccacttacgacgatctggctatccagtcagcaaaagttgtagcaacatccactttgcacaagaagggagctcaaaatgacaagatcactgcaactgaggttgtgtcagtgtatcttcagcattgttgctaaatctgcagatacagtaatcaacagtgctagttcagaagagatttaattatagtatgtattcagaagcaggaactgacttagccagtcttttgattactgtaattctaaagtgaccatcagtggatcagtgtgcagccctgggtcggatcccttgtgatgggtatcactacatcatcatttcaatacctgggaaaggaattggccaagatggtgcctgggaacccagatgacaatgacctacacaattggagtatcctgaaacattgtgtagatgggacaatcatagtcctcacattggcagtggagattcacctgtttctgctga

SEQ ID NO: 5263 - DNA, 1067 bp, Homo sapiens
ccctagtagctggactataggcatgcaccaccatgcctagctaatcttttattttttttatagagagaggctgaggtaggaggatcacttgatcctgagaggtgaaggcactgagctgtgatcacactactgcactacagcctgggcgacagagtgagaccctgtctcaaaaaacagtcttttagatgcatgtaaaatgtaggctgggtgcggtggctcatacctgtaatcctagcactttgggaggccgaggcgggtggatcatctgaggtcaggagtttgagaccagcctggccaacattgcgaaaccctatctctactaaaaatacaaaaattagctgggcatggtggcgggcacccagctactcgggaggctgaggcaggagaatcgcttgaatccgggaggtgggagttgcagtgagctgggattgtgccactgcactccagcctgggtgacagaatgagactctgtctcaaaaaacaaaaaaacaaaaacaacaaaatctgtataaaataatgttgaatcataaggacaaattgcttacagttgtataaaaatctacaataatggcatccgaaaatattgtaacgtgcgtagacggtatagattttgcactcttttctctttacattcgagttagagctttctaagaattattcaactacaaactcaagttttttcttttattcatttgaatgtagatgaactcttaattcctacaagtattcaggagtaaagttcttctatcagatttttttagaatgagtgatttggttttttgttgttttatttttattgatatctgtgtattggttatatcccctggcataattgtggtgtcatttattaaatattttatttccagttacctgaccttaaagatgctgaagctgttcagaagttcttccttgaagaaatacagcttggtgaagagttactagctcaaggtaatagtcattgaaaagctaaggaaatgggtagaatttttctcactgatagaaatttataatgataaggggctttgtttgtgtaatttggctgttagaaaaggtactccaagtatctc

SEQ ID NO: 5264 - DNA, 1511 bp, Homo sapiens
gccttacagtggtagcactctattatgggagacgagtgggtatctgatgctggtgtgatgaaatccagtttatgagggttgactaagaaaaggtaccttgaccatagtaaatgaaccttctgtctacaggtagggagacctcttttttgagacagagtgtcgctctgttgcccaggctgaagtgcagtggcacagtctctgctcactgcaacctccgcctcccgggttcaagcaattctcctgcctcagcctcctgagtagctgggactacaggcgcccgccaccatgcccggctaatttttgtatttttagtagagatggggtttcactatgttggccaggctggtctcgaactcctgaccttgtgatctgcctggctcagcctcctaaagtgctgggattaaagcatgagccactgggcccggccctcagacctctttagtcatgcattgaagcttggatttgtagagtgctttaaggttttcagaggacatttgcttgtttcatggcttttgtttctcactgtagtcctgtaaggttagaccttatcttgggagagtgagagatttgcctaagatcacccagctaataagtattagctaataataagtattggagccttacattttcttaactatgtcagcagttactctctatgtcattggtagtttttagtgattatcactttaggtgtagtcctgcatcagtatccttgagtgactggttccaggcctcccctggataccaaattctgatgatgctcaagtacctttaagtggtatagtattttcatgtaaccatcatatgcctcctgtacactttagattttttctttcatttaagaatgccagtttgcaacattcagtaaagatataatctggcatatttcagtaataaaactccctaatactagtggcctaattcttgcccctgttacatatcctttgttggttggaaggggggacttgatctgcttattgtaattactttagaagtccagctattggagctatctccatcttgcaaattgctagatcttctgccccaaagggaaggagaacgctccagtgcagtgtcacatttcctacagctcattgaccagaacatgtcatatgctcttgacagatcacagggagggatagattcctagagttagaaatgttttgcaaatggaattaatgactgccacagcagttagaattcttttgattcccatttttataatgacaaaatgtaaatataactttgcatttcttgcaggaagaaagaaacagaagcttgccaaggagagagctgggctttccaaggtaatagtctggtttctgtttaaattatatattttgtagaaatattattttaaaatctgtaattggaaatgtaattaaaatgtaattggaaaaagctagttgatactggacattgcttttttattttaaaatacagcttatttttaggagtaggtgaataatgtagttccaatgacagttatcgagtccttcattatttctttt

SEQ ID NO: 5265 - DNA, 1024 bp, Homo sapiens
ccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgtgagtgggtcctctctcccctggccaggcttgctgccttcggccgccgcccttcacaggaggggtcattgcctcccaccagcctgtgggccgcgcagggcgaccgcgtggtgcggccctcaataggcgatggcgctggctgcgccgctccgggggctctagtgccccgtaggaattccattttggaggaaggatttttcccgttttgttttccccagacactttagccgtgcaaatgcactcttgatttctgttgcaatctcgggtgtgtgtggcctggggaggaggttgtctctttttttgtcgttcatctttttaaacctctactcttaactaaaaagtcgtgcatttttgtcgcaaattttagtctgaggctaaatccgcatgctcagtgcagtatcattgttgcattcttttttttgagacggaatctcgctctgtcgcccaggctgtagtgcagtggcgcgatctcggctcactgcaacctccgcctcccgagttcaagcgcttctcctgcctcagtctccccagtagctgggattacagtcgggcgtcaccacgcccggtgattttttgtgtttagtagagacggggtttcaccgtgttggtcaggctagtctcgaactcctgacctcagatgatccgcctggctcattgctgcattcttaaaccctcttggtagcttcgttctaagtgcttccaagatatgagtgaatgctatagaaattgcaggggagtccaaagggctgcgcttctcccgtggctcagtcttatttcatacctgcgacatcttttaagagaggtctaccagaggggaatcgtg

SEQ ID NO: 5266 - DNA, 1125 bp, Homo sapiens
cctggccaacgtggtgaaaccccgtctctactaaaaatacaaaaattagccaggagtggtggcgtgcgcctgtaatcccagctattctggaggctgaagcaggagaatcacttgaacatgggagttagaggttgcagtgagccgagatcatgccattgcactccagcctggactgcaagagagaaactccgtctcaaaataaaaaaagtgctattgcttgtcagttggcttggtagtctggtgggagtgggcgcagcagggtctctgctgtcttgtcttagtgtttccgtgtctcaggagtgcacctgatcagggcttttttcccggggcagccaagctgtgccaaatgccttgtacctttagtggggattatgcagaggatgtttcccacctctcccccggtagctggactcctcccttcctccggctgtaggggtcttctctgtgccctggagtgacagggtttgctatccctcccctagcagcttagccttctcctccatcaagagaatgtgtccggaattggtgggttcttggtctcactgacttcaagaatgaagccgcggaccctcgcggtgagtgttacagctcttaaggtggtgcgtcgggagtctgttccttctgatgttcggatttgttcggagtttcttccttctggtgggttcgtggtctcactggctcaggagtaaagctgcagaccttcgcagtgagtgttacagctcttaaggcagcgcgtctggagttgttcgttcctcccggtggcctcgtggtctcgctggcttcaggagtgaagctgcagatctttgcggtgagtgttacagctcataaaagcagcgtggacccaaagagtgagcagtagcaagatttattgcaaagagtgaaaggacaaagcttccacagtgtggaaggggacccgagtggcttgccactgctggctagggcagcctgcttttattctcttatctggccccacccacatcctgctgattggtagagccgagtggtctgttttgacagggtgctgattggtgcatttacaatccctgagctagatacaaaggttctccatgtccccatcagattagttagatacagagtatcgacacaaaggttctccaaggcccc

SEQ ID NO: 5267 - DNA, 2257 bp, Homo sapiens
tgcctactgatttttctgtggtatttagtggcacccaggctgcaggttttgtggttgcctttgactcttcattggctcacccatgctagtgtttgccactcctgtccgtttttcaactgtgatttcttcctaatatgagtcattcctttcttttttccttgtcctacctaagttctcattacctcctgtcagaatagtcgcagaggcctattgtagttccttaccttcagtcttcctctaatttgtccaacaaaacactgtgaactcagtcttcctgaagctcttcttcccggaacccttacctctttccctgccttgcattaatgaaacgcccttccccccatccccccagccgccacacacacacccctcacggggcctgctattgccttctcccctttggggagcctaccttgattctccccagtctctaggctaccagtgtgtccctgctatgcatttgacagcacccatccctcattacagtacttagtacactctactgaaattgtcgtttgcctcctccaccagactgtaagctgtggttacaaatactctgtcttacttcttcttgggttaccagcacctgtacattgtgttaattattctgtcagtgaaatacatccttaattcttagcttggcagttctccagtgtggccctgcctctcctgtgttcctctacacgtgggttttctcacctttgtccctttgccagtccatttgttttgcctggaatccttccttaaagtaccatttttgcctatgaaagtatttttcagtatgtggctaaaaatgtcccttcttcaaagcttttccgatactttatatcattaagtgatattttttcctctgcattattcctgtactttattgccttatgttgtacttatgtattaatatctttaatgacaggatgtaggccgggtgcagtggttgatgcctgtaacccagcactttgggaggccaaggcagatcacttgagttcagaagttcgagaccagcctggccaacatggcaaaactacgtttctactaaaaatacgaaaactagctgggcatggtggcgggggcctgtaatcccagctactcgggaggctgagatgggagaatcgcttgaacctgagaggcggaagttgcagtgagccgagattgtgccactgcactccagcctgggcgacaaagcgagattctgtctcaaaaacaaacaaaataaaacaaaaccaaacaaataacgggacgtagacgctgtacagaaggcacccaataaatgtgttttgatgatgtcattcacatgttgattattcatttagccatttctgtgtcttgtactgtttttttgaggtttgagagtttgactatgttagcaattttagcaagataaactgcaaacagaagaaatagttaaaatttcatagttttactatgtaaactatcaggttactgagaaagaaaataggttttccagaaaagatttataataactaccctacatggcatttatgttctagattgtgaacttgcagggttggtatcttttcaccttgatcttctcagtacctggttgcatttggcatgttgtcgacagctgtagttgttgacgtgtatttctgcctcttccataaagttttccctacctgccccatccactcttaaaggaggctatatatgactggaaataaagtgaacctgaatataaaggggattcccttacctgcatgatggacaccatgcatttttttggctaatatataaactcttagagatacaggtgatatgtctttttatattattcatcagttcagttagacatatttaaaaatttattagaatacacgataaaatgttaatttataaacatttctttttccttaacatttttcctttttttttttttttttttgagacggagtctcgttctgtcgcccaggctggagtgcagtggtgccatctgggctcactgcaagctccgcctcccgggttcacgccattctcctgcctcagcctcctgagtagctgggactacaggcgcccgccaccacgtctggctaatttttttgtatttctagtagagatggggtttcaccgtgttagccaggatggtctcaacctcctgacctcgtgatccgcccgccttggcctcccaaagtgctgggattacaggtgtgagccaccgcgcccggccttttccttacatttttcatgtgtctttcatcgtcggtgtctcttcctggagtcctccctgtaggagtcatctgat

SEQ ID NO: 5268 - DNA, 1091 bp, Homo sapiens
tcaccagaaacaagggcagaaaaggaaaaattctcaacctggtgttaaagtagcagatagaaaaatacttgatgacacagaagacacagttgtcagtcaaagaaagaaaattcaaatcaaccaagaagaagagagattaaagaatgagagaactgtgtttgttgggaatttgcctgttacatgtaataagaaggtgagtttgtatatggtaaaagttcagagaagttaataactttgttcttcctgtgttgaataagcattcaatagtaagtcatggatataacttcattgtaaattattacataaatcatcctaatatgaatggattccagtatccaccccctccttttcattcctgtagtccctgccaattcaggcttttgcagattatatttgaatattgcagtgacctcctgcctggtttctttctttcagccttgtctcctgttatatgccactagaaagtaagctccatatgtttaaagatgtctttcctttttcttttctttttcaggacaggttctcactgtcacctaggctggagtgtagtggcatgatcattgctcactgcagcctcaaactcctggactcaagtgatcttactgcctcagcctcctgagtagctgggactacaggcgcacgccaccgtgcctggctaatttttgtgtttttttttttgtgactatgttgcccaggctggtctcaaactcctgggcttaagtgatctgccctccttagcctcccaaggtgctgggacttcaagcatgagccactgggcctgatcctcttttttcatcattctgtctctctctctctttttttttttttgagacagagtctcgctctgttgcccaggctggagtgcagtggcgcgatctctgttcactgcaagctccgcctcctgggttcacacccttctcctgcctcagcctcctgagtagctgggactacaagcgcccgccaccacgcccagctaattttttgtatttttagtagagacggggtttcactgtgctagccaggatggtctcgatttcctgaccttgtgatccgtccgcctcggcctcccaaagtgctgggattacaggcat

SEQ ID NO: 5269 - DNA, 1214 bp, Homo sapiens
tttgagacggagttttgctctttttgtccagactggagtgcagtggcctgatctcagctcactgcaacctccacctcccgggtttaagtgatttttcctgcctcaggcctcccgtggagctgagattacaggtgccaccatgcccggttaattttttgtgtttttagtagagacagagtttcatcatgttggccaggttggtcttgaactcctgacctcaggtgatccacccacctcagcctcctaaagtgcagggattataggcatgagccactgcacctggcctggtttgctttttaaaaaaaaaatttttttttttttttttgagctggagtctcactctgtcgccaaggctggagtgcagtggcgcaatcttgactcactgcaacctccgcctcctgggttcaagtgattcttctgcctcagcctactgagcagctgggactatgggcgcgccatcacacccagctgatttttgtattcttagtagagacggggtgtcaccatattgaccagtctggtctcgaactcttgacctcatgatccacttgcctccgcctcccaaggtgctgggattacatacgtgagccatcacacctggccgagtttggtgttcttaaatttattcatttccctcattaactttttttttttttttttgagacaaggtctggctctgtcacccaggttggagtgcagtggtgcgattgcggctcactgcaatctttgcttcccagactcaatccagccgcccacctcagcctcctgtgttgcttagactataggcatgccccaccatgcccagctaatttttgtatgttttgtagagacgggattttgccatgttgcccaggctggtcgcaaactgctggactcaagtgatccagtcagcattttttttttttttttagtaaaaaaatagaaacagggtcttgctatgttgcccaggctagtcctgaactcctgggctcaaaccatcctcctacctccgtctccccaagtgctaggattacaggcatgacccaccatgcccggccagcataacgttgtttaacagtgtatttgaatcaagatgcaaatagtgatcccatcacgtgtacctagctaacagtcttcattcctctcttctttgccactctcctcaagccccttatttccttttcccttttctcatttcaactgaagacctttgtaccagttctggagctgttaat

SEQ ID NO: 5270 - DNA, 1027 bp, Homo sapiens
ttctgatatgatgtcggtaatttgatttaaaagtatctggtgttaggggtgaggaatggataggggtgcagatgatacaggttttgccataaattgatgattactgaagctggataatgagtacatggggttcactatccttctctctatacttttgtatatgtgagaaatcttcataaatcttcatttaaaaaaaggtatatatatatatgttttaggtatacatatatatatatatatatatatatatatatatatatatatattttttttttttttttttttttttttttttaaatagagacgaggtctcattatgttgcccaggctaatcttgaactcctgagctcaagactgagctgatccttccacctctacttcccaaagtgctaggattacaggtgtgagccaccacacccagccaatatgtatatttttttaatactactctagagtttttcacacaaggaaataccttaagtattcttaggagattgaagattgctttagagctttttaaaattgccttctaatttaaatttttacacactctttaaaaaaacctaaaaaataacagagaacagaagagaaaaatttatccacagtcttgttactcacaaaatgtgtacaatttagcattttggtgtctttccaggttttttgttttgttttgtttttgtgtttttgttatttttagacagagtctcactctgttgcccaggctagcgtgcagtggcacaatctcggctcactccaacctccaccttccagattcaagcgattatcctgccccagcctcccgagtagctgggattgcaggcacccgccaccatgcccagctaatttttgtagttttagtagagacagggtttcaccatcttggccaggctggtatcgaactcctgacctcgtgatccgcccacctcggcctcccaaagtgctaggattacaggtgtgagccaccgtgcccagccccagttttatttttaagtgtgattttttactgtggtaatactgtatatggatg

SEQ ID NO: 5271 - DNA, 1018 bp, Homo sapiens
gagtgcggtggtgcgatcttggctcactgtaatcttcagcctcctgggttcaagccatcctcctgcctcagcctcccaagtagctgggattacaggcacgcgccaccacacccagctaatttttttgtgtgtttagtagagacagggtttcaccatgttggccaggatggtctccatctcctgacctcatgatccgcccgcctcggcctcccaaagtgctgggattacaggcatgagccactgcgcctggcctttttttttgagacagagtctctctgtcgcccaggctagagtgcagtgcagtggcatagtctctgctcactgcaacctccatctccctggttcaaatgattctcctgcctcaacctcccgagtagttgggattacagacgcccaccaccacacctggctaatttttttgttgttgttgtatttttagtagacatggggtttcaccatgttggccaggctggccttgaactcctgacctcaggtgatccatccgcctctgcctcgcaaagtgctgggattttgggcatgagccaccatgcccagccccaatcctagtaactcttcatgccaatactctgaaaaagaggctttaccaaacttaatagatgtactaatgtacaatgtatagaccttatttggatcccggtttgaataaataaattggttaaagaaaaattttaaggcagttgaggcaaatgccaacactgactagatatttctgatatggctgggcgcagtggctcatgcctgtaatcccagcactttgggaggctgaggtgggtggatcacgaggtcaggagttcgagaccagcctgaccagcatggtgaaaccctgtctctactaataaaacaaaaaattagctgcgcgtggtggcacgcgcttgtagtcccagctactcaggaggctgaggcaggagaattgcttgcacctggcaggtggaggttgcagtgagccgaggttgcgccactgcactccagcctgggcgacagagtgagaccccatccc

SEQ ID NO: 5272 - DNA, 1585 bp, Homo sapiens
tacacttttagcttggatgacaaagtgagactcaaaaaaaaaaaaagaagaatattaacttggaggtagcacaatctgggattatatcctgactccactattttctcagatatattatgataaaaatattatacttatataaacttggagaagcttttttcttttttatttcagctttattaaggtacagtttacataaaagtgatgacttttatgtttaaaatgtgatgggttttgacaaaagtatacagtgttacaaccatcaccgtgatcgtaatagaacatttccatcattggaagagcctcttagcctctttgaaacccagtttctttgcatgttacatagagataaaagccagcaacctcgggtggctgtatacacaggacctaatatatacagtccctggcacatagaagacattgctagtgttcttatcatactcatcatttttttttctgttattttctagcttctgaaagttctgctgaagacagtgagcaggaagatgagagaggtgctcaagacatggataataatggcaaagaggaatctaagattgatcatttgaccaacaacagaaatgatcttatttcaaaggaggaacagaacagttcatctttgctagaagaaaacaaagttcatgcagatttggtaatatccaaaccagtgtcaaaatctccagaaagattaaggaaagatatagaagtattatccgaagatactgattatgaagaagatgaagtcacaaaaaagagaaaggatgtcaagaaggacacaacagataaatcttcaaaaccacaaataaaacgtggtaaaagaaggtattgcaatacagaagagtgtctaaaaactggatcacctggcaaaaaggaagagaaggccaagaacaaagaatcactttgcatggaaaacagtagcaacagctcttcagatgaagatgaagaagaaacaaaagcaaagatgacaccaactaagaaatacaatggtttggaggaaaaaagaaaatctctacggacaactggtttctattcaggattttcagaagtggcagaaaaaaggattaaacttttaaataactctgatgaaagacttcaaaacagcagggccaaagatcgaaaagatgtctggtcaagtattcagggacagtggcctaaaaaaacgctgaaagagcttttttcagactctgatactgaggctgcagcttccccaccgcatcctgccccagaggagggggtggcagaggagtcactgcagactgtggctgaagaggagagttgttcacccagtgtagaactagaaaaaccacctccagtcaatgtcgatagtaaacccattgaagaaaaaacagtagaggtcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagac

SEQ ID NO: 5273 - DNA, 1015 bp, Homo sapiens
ctttgggaggctgaggtgggcggatcacgaggtcaggaaatcaagaccatcctggctaacacggtgaaaccctgtctctactaaagtacaaaaattagctgggtgtggtggcatgcacctgtagtcccagctactcaggaggctgaggcaggggaatcacttgaacctgggaggtggaggttgcagtgaactgagattgcaccactgcactccaacctgatgacagagcaagactcagtctcaaaaaaaaaaaaagcaaataactaaagaaaaattccagaactgacagacacaaatctttacattgaaattgctcactaggtaccgaataaattaatagagtcataccgtagtacatcattatgaaattataaaatatcaagaatgaaaaaatcaccacaaaggaatgagaaaccaaaggaaggttatggcttataaccccttaagcaaagaagcaatacattcggaaggattcagaactctgaaggaaacaatttttaacctagaattctgtacctcgtgaaactctcaatcaatgaagtttgagggtaaggatgtattcagataagtaaggacgatgaatatttatatcccatgtacctttttaaggaaactactcgatgagctctagtacagatgagataaccaaggaagaagaagatgtgagattcagttaacagtggacctagctcaaaagaaagcagtgaggaggattccccggatgacagctgttagagcagacccagagagataccacccagatgctactgcagaaaatagctctctagggtgcagagataggatgaataaggggaaattggatacaacgcttaatttaatgaaataaaataatgtaaaagagatacaaaggaagatgtaacatgcagaaaagtagttggaaactcttggaaaaataaaatgctgtataagaaaggaagtttatcaaatgtactacttatttctgcagggaaccacatttacatatgttataaatactatattgtaaaaatgaaag

SEQ ID NO: 5274 - DNA, 1338 bp, Homo sapiens
agatgaagatgatgaagaagcagaagaggaggaggaggaggaagaagaagaagaggatgaagatgatgatgacaacaatgaggaagaggagtttgagtgctatccaccaggcatgaaagtccaagtgcggtatggacgagggaaaaatcaaaaaatgtatgaagctagtattaaagattctgatgtcgaaggtggagaggtcctttacttggtgcattactgcggatggaatgtgaggtaacttgagttttagctagtgattattacctaaaaacaattataaaatacttttctatttaaaaacttaagtaatggattacagatttattagtattctaattgaggtcatagtaccttataaaaaatagtttttagcatgtaaatacctcacttagtgacttacaattaatgttttcactacttagaagatatccctaatgtctagaaaaccgaggtctacacacttgatttttatgtactacatgtagatcagcagacaaaacattgttgaaatgatcagaacttctggacatctacaaaccaattatcaggctgcttgctgtcttgcattttaaactacattgccacagtaacctcttttttgtattctgaagtcatttctttccttctgtagtcagggatttaaaatcctaggaaacattagctattttaagaaagccttatctccttattaacagctattgcattacagccttattcagaagtctcagaaatttattagtatctttgaaaaaatctggttgaacatgtaagcagacctgcttcactaaaatagaatgcactttttgactgctcctaacctagggaactgaaaggcaagagtgaaatttggttttaagtcatgttcaatgacttaagcatttttcttagataaattttctttggctttccaaagaaattttgtattttgattttatccaaaattggcaagccagttttgggatctattcattcagttatcttttaagaatcatttattttagaatatttgatagtatatttgaaatgtagcctataagacagatacctggaaagattaaccatagaagtttaagttgtggtttcatggtgtacctagtgtcttcaaggaggaatacagttctcatgctttatacttaaattatattctgtggtttgggaagttaataggaaggcatcatctcaaattctgtgtttgagtgttgcaaatgaaattttgattctctttaatcacttcccacaatgccctttctctaaagaaaatcacttctgagagttttgaggctgtccttactaacttttcattctactttcacatacatataaatgtactcatag

SEQ ID NO: 5275 - DNA, 1038 bp, Homo sapiens
tgagcatagtggctaacgcctgtagtcccagctactcaggaggctgaggcaggagaattgcttgaacccaggaggcggaggttatagtgagctgagattgcgccactgcacttcagcctgggcaacagagtaaggctgtctcaaaaaaacaaaaaaaaacaaaaaaaaacaaaaaaaggatgctgctgtgtgccccagggttactgtagtgactaaatgagatttactaaggagtccagcctcacacataagaaatgtgcaaaaaatagatgctattactaatacttttaatagctgttattgttatgactctgagcacagtgttttaaatgaattttttgacaaaattttttttttgcattgaaaagattagaaagaactagaataaattagaatgttaatatggctcaatatctgagagtttagacaaaagaaatgaatacacattaaaaataactctatagttatattttgaaatgttttcaccaaatgtaatttctcttcatgtttccagatacttatatggttttgaggagtactgtagatcagccaacattgaatttcagatggcattgccagagaaagttgttaacaagcaatgtaaggagtgtgaaaatgtaaaagaaataaaagttaaggaggaaaatgaaacagagatcaaagaaataaagatggaggaggagaggaatataataccaagagaagaaaagcctattgaggatgaaattgaaagaaaagaaaatattaagccctctctggtaaatcagatattgttaattgtcttttgctttctttggtatattttccatatcctctataaagttccaaaatcaatatattgtataatattattctttattatttgtttattttcttcattaagtgctacttttgtataatttttatcataacttcaaaatagctgttagctatttttgtctagagctttaaagtagcaggagtttcttaaaagtaatttataacttttaatattagaattggttgatacctcctgttgctaagagataaaccatggat

SEQ ID NO: 5276 - DNA, 1032 bp, Homo sapiens
ctttttttttttttaacttttctcatttttgctgtaagattttaagctgttttaggggaatatcctttctttcctcacttgataggccccccttttcctagcaatttctacacaaaagccttcaataaatatgtgtggaataaactgaaggtttacatacaataaatacagacagctttggggcaagtatagtgataaagtacagaattctccctgagttcgtggaattattttaatttcatttccgtacagtcagtgagtatgaggacttgaagacatggtttttctcctgttaagtgaaggtctgcattttatttttttagtctagagaaatagccaaaatattattttttttaaccaggagaattttcagttggaatggttcataagacagttgtaagttaaatgctgaaggtaatatgaacaagtggctatgtatccttcatatcttcaaggaggttcagttttagtgtgtctgtgcaggtgtgtacttctaatttatgttttgctagaaggaaattagaatactggtgtgtgattcttcaattcccttcccatgtgcccggagctgtgtagtgctaggtaccgggacaaaggttaagccaacccatgtaaacatggaacttatctttgggtacttactccctgttggaggagaaaaagcattaatcaaaccaagccatgtaaacatggaacttatccttggatacttactctccgttggaggagaaaaagcattaatcaaacaatcaaacatattttaaaatttgagtatattaagccctgtgaagatgtggtccagagtgcacccaataggggaatttaatctaccatctgtatgttcttttctctttatttggtatttttcatattgttttaaaagttttaacgtttttgaaagaccattcagagtattagtagtagtagtagtccataacattgtcctttaagaggaaagctgcttcatactgccagtattttgggtcactaatcccatttaataaactactgaaattaatcccatctcataaa

SEQ ID NO: 5277 - DNA, 1028 bp, Homo sapiens
gcggccacaacctcctgggctcaagcagttctcccacctcagcctccttagtagctgggaccataagtgttcaccacctcttctggcttatttttcaaaattatttgtagagatgaagtctcgctatgttgcccaggctcgtctcaaactcctgggctcaagtgatcctcctgccttggtctcccgaagtgctgggattacaggactggcccagtagggattttaaggatttttttttttaaatcaaactcttttaaatgttctccagatgctgtctttagtgacttgttatactaaaaaatgttctacttattgccttctaatccatgccagtagttattactaacatgcccagatacattaaaccataacaatgccagtttctgtttctgtttgtattctgaattttgaactgcctgaatcctccactaggctcctctaatttccagatcatgaaagtttatgttctgagagtgctgttactccaaagaagattcatttgcatttgaatatgattgtgacctcactagcaagatgacaaataacctcttctcaaggcagagtagattggctgtgttacatgagaaagctcctttgcttttttgatacttagaacagtgccttaagtatagttggcttttaataatgtctctcccaatttctctcttgcctgtttgccgaggcagaaaattctagttagaatatttctttggagttacttaaatttccaggaatatgcagatactcttctgttaatatttgtgactatgcagatatccctctggtttatgagatgtggatctaaaatttacttataacctaaagtagcttaggttttgtctcctaaagtagcttaaattttaagaagatacacagtggggccatgtaaaaaaccaaaaataaactttaaaaaattgtaagaagaatattaagaaatatagataacatccaaagattttcgtgttttgggaaggggttgagtttttttgttttgttttgttttttgtttttttgagacggagtctctc

SEQ ID NO: 5278 - DNA, 1024 bp, Homo sapiens
tatatcgtagtttaattggcagcttttttcttttttagtggtaggtgtggtttacaattagtgacttaaattagatgaaatatggtaactttatgtttgtatgaatttcagtaacataaaaataaaccatcatctctgtaaaggagagataatttactttttttaagtttaagaacagctgtgtaggctgagtgcggtggctcatgcttgtagtcctagcactttgggaggccaaggctggcggatcatctgaggtcaggagttcgagaccagcctggccaacatggtgaaaactcgtctctataaaaatacacacacatgaaattagctgggtggggtggtgcacgcctgtagtcccagctacttggaaggctgaggcaggagaatcacttgaacctgggaggcagaggttgcagtgagccaagattgcgccactgcactctagcctgtaaatataactgccaggaacttgagatttcagaaaacatttctccagagtatctggaaaatcacctggcttacccaaacaaaattgccacttgtggatatttgctaccaatgcccctatcattcttctctgtagtcctgtactcataagcttagctgcttagctgctcatacctattcttgaactgcttctgtcactaatttctacgtgatctgattgttaagtacaaaatcttctttaaaaagaatggtaataataaattaatatagacatttatttatattgagtgcttattacatgtgattttatgtgtaataggccacattggtattgtatgtatttaatatgtaatttatatttaattataatatgtaataaatgtataatataaaagtgaacatatgttttattagtatgataaactacactttacaaatgtgaagctatgctcagataagttaaataatttttcccaaggatgatggatctagtaagttatgaacctaaagtttgatctcagatattgattccatagctcatgctttttcacctgtttatataagacgcttctgatta

SEQ ID NO: 5279 - DNA, 1049 bp, Homo sapiens
aattaaagctattttggttatgggtaatagaacccatttcaggtgatgaaaagcagaaaagagaatctattataagggtacagagcatctcatggtacccaaagaggggaactccagtttggcttgaggaggcagttggaaagctagcaggaactaaggctagctattctctcagtcactcagagaacccacagtttcttatgtgcactttttccccctctgcatctgttttatttcttacttcctctcagcagactggttttctctacttctccctgtgcatgccagaaaatggctaccataggctgcatcacatcctttctctaccggctaattggttaacctagctttaacttcatagcagagtaaaaccgatcggcccagtttggatcaggtggctagcagtctaatgaattacttgttggcaaagcatattgccagaacatatctctttgttaagagaaataacttgtaattgatacttgtcatgttagtgacttagtctttgtaaagctgtgtgggcttctttgtcgtaaaaatttggtcatctgtaagatagtttgtccttattttacttattaaaatatgatttgttgggtccctcatatgtgcatagtcattgaataggcagagcggtctgcgcgcgtgcacacacacacacacacacacacacacacaaaattaggcctagtgttggattttcctactcttaccattgtgcctgtttttagtatgcatttgatttagcacatgataatcataattcaaagataagtctgcagcagacttaacatttatatatagagtgtttttaaggcagaaggtattatttaccctctttttagaagtggagaaactgagaatcagggagtaaaaatcagtcaactaataggttgcagatcgtagccatagctgagttgagatattctttacacaaattatggccttattcttctatatccttttacctctatgtgagtgtatatcaaactggacttctccgaaattctctttggcctagtttgcaagttctctgtgtagaataaaaa

SEQ ID NO: 5280 - DNA, 1438 bp, Homo sapiens
ctctaggattagaaaagttttggttgaaaatagaacacttaactgtaactaagagtcttcttttttcattatgtgttggcctttaaggcaccagaattatacttcagaaattccttgggagaatttgggttatgtcttaaaataaaaaatgttcatgttctttgtgctcccttttgatacctacccagaagcagcccatgtacaggtgcacaaggaagctggcatgaatatgtttgtggctgccctctttaatagggaaaaacagaaaaccacttaatatcaccagtagaggacaagctaaataaccatggcaaattcctacaatggttatagcacaaaattaattcgacagtttgtgtttactgatgtagaaagatctctaaaacattttttgaatgaaagaaaagttgaaagacagtatattaaatgtagtaccagttatgtaaaaatagattcacagaaatgttattaaatatggatacatgtacgtgtatgtaagtgaaggtctggaaaaaacctggaagaacatatgccaaaatgagaatagtgattattaatgggaattgagtgtagtaatttaggacttacttttttttttttgaaatggagtctcactctgtttttcaggctggagtgcagtggtgcaatctcagcttactgcaatctccgtctcctgagttcaagcagttctgcctcagcctcctgagtagctgtgactacaggtgcccaccaccacgcctggctaatttttatatttctttaatagagaaggggtttcgccatgttggccagcctggtcttgagaaattcctgacttcaggtgatccacccgccttggcctcccaaagtgctgggattacaggcatgagccactgcgcccagccacattaatgttttattatttttacaaggataatatgctcatagactgtacaactaaaggccaatttaaaatttatttggaaaaaatacattgttttgtacataggtccctgtaaaggcagagtaagactggaaaaataccctaaataaggagacagtagttatgtccccgagggatgtgggaacagagaagataaaaggagacatttgctttttgtatacttctgtatttttatagttttataaagcaaatgaattcatgcattaatttgtatgctgaagaaaggactaaattctttaggaccaggaattcatgtaagagtatctcattttgtcaagcttatttaacagtacttagtgaaaatagtagctgccggttgaattactgggtagagaataaaggtgtcaacagaaatagtttactaatttgctgataattaggcattaatttgcttgatgtgatgcatgtttattactttagggcaagtagaaaaataaaaataagtagattctttctcatataccatcatgaacactggtagtttctggtacattc

SEQ ID NO: 5281 - DNA, 1078 bp, Homo sapiens
tttcaattcatactgatatttccagttttcatgaaaaattacagaggttttgtttaacttattttatgatttatttatttattttatggtgaaaaatatgtctatttagtgttagccagctgggctcactttagatgatcccaattttgttggcaacgtcatcatagtcaggaaccggtagaacatgggccttctttccatcaggcctgatcagggtgttgatattggccatgtcagtgccacagagctttttcttagcctgtttgatctggtatttgttggccttgacatccacagtgaacacaagaatgttgttgactttctgttcttttcatggctgactcagtggtcaggggaaacttgatagcatagtggtcaagctggtttctcctggactggaccagtcttccaaggatatttgggctgcctccagaacagcagcagtgttttgggctgtccttaggtgggtgacgtgaagatcttctcttttttgtgtggctgtggatacggatacctttcagcactgctgttttggcctttagagcctttggtttggctttgacgttgggagagcaggggcttccctctttgcctgtgatgccttcttgatgagtacagccatgtaacttcttttatagttgtgtctttttttttttttgggacgtagtctcgctctgttgtccaggctggagtgcagtggcgtgatcttggctcaccgcaacctccacctcccaggttcaagcgattcccctgcctcagcctcccgagtagctgggattataggcaccctccaccatgcctggctaatttttgtatttttagtagagtcagggtttcactatattggccaggctgatctcgaactcctgacctccggatccgcctgccttggcctcccaaagtgctgggattacaggcgtgagcctccgtgcctggccttttttttttttaaattgagatggagtcttgctttgtccccccgcaggctagagtgcagtggcatgatctcggctcactacaacctctgcctcccaggttcaagcaattctcctgccttagcatcccaagtagctgggat

SEQ ID NO: 5282 - DNA, 1077 bp, Homo sapiens
tatattttttgcatcatacgtttaaaaattggttgctcctaaatgaagctttagaatcctttgcaagatagtactactgcttcaagcagctaaccaccaatgaacaagaattatgagttcaaactctggcatagaccaaccccctaacttggatctcctaactcataatccagagttcttttccagagaactgctccgcttttaaaaaccagtgccaggattcagatctcaaatgataccattaaacactgataggcaagaagcatttgtttctatgagtaaataactctctgatgtattagaggctggtgttaatttttgactaggctgaactctgagcgtttattatttcttcaggtattaaaccttcagataatttcaaaaacacagtttaggccaggcacagtggctcacgcctttaatctgagtactatgggaggcagaggtgggtggataacaaggtcaggagttcaagaaaccccgtctctactaaaaatacaaaaaatagctgggcgtggtggtgggctcctgtaatcccagctactcgggcggctgaggcaggagaatcgtttgaaccctggaggcggaggttgcagtgagccaagatcacgccattgcactccagcctgggtgacagggcaagactctgtctcaataaaaaacaaaaccaaaccacagtttatcccttaggaaaacaccaaaaagcttcttatgtacatgaacttgtattagggtcacactttaaggtggctctagaaagtataatgagagacttacagtaagactgctttttttttgacgtggcatctcactttgttgtctaggctggcttggaactcctgggttcaagccatcctcttgcctctgcctcccgagtagctttacaggaggattacaggtgtatgccactgtgctgggctgagactgcagtttttaatgaatgaaatgccactgtgctgggctgagactgcagtttttaatgaatgaaatgcctctgtgcatggattgaagccagcttttatggcaaacattaacagtatggtttggttccccatctctgtgccccttgagttataa

SEQ ID NO: 5283 - DNA, 1050 bp, Homo sapiens
actacatggaaccattgaaagttgttgagaattgcttgaacccaggagctggaggttgcggtgagctgagatcaggccactgcaaaaacaaggggagagctgaatgtaaggatggaaattccaggtaagaagtccaagtggaaaatgaataagggcctgaactaatgcattggaagtggagcagagaggatagatctgagcctttttgaagtagaattcagggccgggcacagtggctcacacctgtaatcccagcactttgggaggctgaggtgggtggatcatgaggtcaggagattgagaccatcctggctaacacagtgaaaccccgtctctactaaaaaaatacaaaaaatagaaattagccaggcttggtagcgggcgcctgtaggacgctgaggcaggagaatggtgcgaacctgggaggcggagcttgcagtgagccgagatcacgccactgcactccagcctgggcgacagagcaagagtctgtcttaaaagaagtagaattcaggacctagtaactcatcctggggtaggaagaagatggaggtttttttcttaggaaattagatagatgttactgtcatttgaagcatgctgtcattggacctgctagttaagatgtaagagtaagtaggtaggatgaagtcagaggcttggttaatctggtgtgaatgttaacctcatatctatgatatttgaagggatttaagatccataacatggcaaattttgtgctataaatttgtggtcctttagatgaataggtaatcttgtaaaatactaacatgttttctgtccaaattgctaaatctttgtttattgtaattaaaaaaaatactaggtgagtacctatgtcactgaagaatgtttttgccaagtcagccagtgaattcagtcattgaacacattgtgtactttccttgtaccggacattgttctgggttttgaggatgcagcagtgaatagaacaagagttcttaccctcgtggagtttactttctactatggtggacacacgttaagaaaaaaaataatgctaagtgc

SEQ ID NO: 5284 - DNA, 1106 bp, Homo sapiens
tcgaacttctgggctcaggtgactctcccgccttagcctcccaaagtgctgggattacaggcgagagtcaccgtgcctggtgtaatttctgtattacgatgatcattgagctacagaaggttttatgccatttattggatcttaccaaacatatttgtacttgggagcaagcttttaagtttgaattgtctgttgtattaacgacaacaaatctttaaattttattaagtgacagtttattgaggtgattgaaagttagattatgtagtaatactttttaggtgttgttttaaagttgaagtgttgtatgttttagcagttttcccatgtactacctttaagaatttatgtaaacaaatacattcccattactgtctaatatatgctatgttacttttttcacagtatgtttttgaggaatatgattcgtaatacataaggaatttgtgctgtaacatagatcgtgatgttggtgttatgttgaatttatttttcatgctcttgatagacttttaaaaatcagtggtgccggctgggcatggtggctcacgcctgtaatcacagcactttgggaggccgaggtaggaggatcacctgaggtcaagggagtttgagaccagcctggccagcgtagtaaaaccctgtctcttctaaaaatacaaaattagctgggcatggtggcacacacctgtaatcccagctattcggaaggctgaggcaggagaactgcttgaacccaggaggcggaggttgcagtgagctgaggttgcgccactgaactccagcctcggcgaaaaaagtgaaactctctctctcaaaaaaaaaaaaactaaataaaataaaataaaaatcagcagtaccacattataaggaggtggtagattattaaagtttgtaaataattccaagacttatttttattatgtcaggttgatttttactttttttttttaagacggacttttgctcttgttgcccaggccggagtgcagtggtgcgatctcggctcactgcaacctctgcctcccaggttcaagcagttctcctgcctcagcctcctgagtaactggaattataggcatgcaccatcatgccgggctaatttt

SEQ ID NO: 5285 - DNA, 2144 bp, Homo sapiens
gtggtctcctaagggggttcttttgggagtcgctgggcccggccaaggagcagaggaagatcgcggtggtggtccctgcggcgcccgaattcggggcctcggcctcccgggaacccccaccccccgcagccgctgtgtccgagccgccccctggctgggcggccgcacactcagcggtttagcggccgcggtcgggggcccgggcagggtgggggccgttccgcctccggggccctcggccctcacgttgtccccgcggcggggccagatgttgatctcgctcccacttgtcgggtctgagcccggaacgggacgtgggcaggggctctgtggcgggccggtcctgcccgcggcccacaggccctcctggcccctcggtggcccccggccggcctctcgctcggacgcggcgcgtgggggcgcggattcgctcggccgggcgccgaggccctaggggagagcggccggccctgcgccggacgccgggcttgttgtgagtttcttctctgacagaaatggcgtcattgtcgtagacgggaaactccgtcgggtctcgacaatggggacgggaagctgccgagctgtgtaggtggttgggtttgcggggatggcggggccggagggagccccgagtcggcgtgtgatggttcgggggctggcgcctggttgcggctctttcttcggggttcggacgtcgctcgcttctttccctccgcctccgccagtgcagaggggctcctgtggtgttgactgggtgtcttttgtttcccctccaggtgcagctgaacctggtgttttagaggataccttggtcccagagtcatcatgaaggtaagattgcctgcggaaaacgaatctctggggttatcgaattcaggaagtaggaggtttcgacgaggtcgtcgtgtggggcttccgagttttgcagaggaaggtgtgtttggtgacttggtgaccgagcccttccccagagagaccggggtcagctggcgggctttgctgtggagttggaggcagttataggatgtctcaactgaagatgattctcccatattgaacatctctttttgtagggaatgagaggaataacggcatgaattaaagtgttttaaaaggtaaaataaaaagcaagtcaggtaatctgaccctagaaactgaactgtattgtggttctatcagttacactgatgaaagagaatcttatttattgtgtgaacagtactgtaaaattttagcagaaaactctttgactcgtcacaaaaataatttaattgaaagatttaaaaagagaatttttgtgattttttacacaattcagagataccagttgtttcttgtatttccagtgacttggggttatatggtttatttttctttattgatctggttggtctgtaaataagtcagaggctctgttgcattatgatgtgtggaaaactgatggccaggttcctcttagatgtcaatatgttaactgagtggagaatagggtcaaaaaatttgcttaattgttggaagaaatgataacgataaaaatacaggtatttttgttacttgagagaatatgtatatgaatgctgtcttttttttttttaaacacatgctagaataaaaccttagatttttgaaaagtctggattcaactggtggaacttagacactagcttgtattttttcatccattacaaattcagaagtgcttgaaaagggtagagtgttcacaagtgtagaaatgcaacagatagcatgttagaatatcaacgttgtctacttttgacagttcctttgaactatttaaaaaaatatttcacttgtcctcagaatcaagactgctttgacaattttgcatccaaattaaaatttgtaatacttgtggttgtagaaggtaaaagctgtggctacttaaatcttggtctactatacagagtaattaagtttagtctaatttttttaaggttttctctttgagtttgggatgctgtaaactacctgaaacagtttattcctatctcatttcatgaagcatagacatgtttcaggaatgaatcccttttgttagtcacaaatcctagctataactctcatcacctgtgtaaaacagtggtgaaagtgcatttattaggtaactcgtatatgtaccttga

SEQ ID NO: 5286 - DNA, 1168 bp, Homo sapiens
accaaaatggaaactagagccctgggaagaaatcaagcacaaagctggctttagcttcagagatttctgttctggattcttgcagcttccactttggccatcgaaggtgcaggggacagaaggcacatgcagtgtctgtcagttagaagccctgcatagagctggggtcccagagcagctctcagtccaggacaagaaatcaacccacatctacatggtccactttgatagtctgattcctttgctgtactttgtctcatctttgaatataattcttttttgtatctggtaattctgggatctgtagtctttgctgggtctgattttgcagtttgttgtttctacaactgttgttcatggcgcttgttttctgatgcggtctttttttttttttttttttgtgaccatctcatgtctttggaaactgagtcctctatttaaaatgcattcctacagagaggatttacatatttacatttttttctgccatgcatctaggaatactaccatctatgaatacttcagatttttggcttggaactgttgggcttacacagactgactaccagccccagacctacctaagtgcaagctgtgggtaggcactgaggggagagagactcctttccatcccactgaggggcaagactgagacagacaagctgagtgtgttttgttttatcacccctgaggctgtggcccctcagagatcctagctctgtgtcagtctcccattagtctcctgaccctgggcttggccttccaaacccaaggatcagcagctgccttcaaggcacaggctgactcagcgctttctcctaccctgtttcttctttgatcacggagttgagccatgctttataaaggtttttaattttatccaacatttttgtgttgtcaaaacattgaatgagtttctctctgtgttctgctacattgctggaaatagaaaccaattcacgtagctaggaaatagtctagtggttaagaacttgagcttgggagtctttaatccctcctcttcatttaccagccctgtgacctggaacaagttttttaactcttcgtttgttcctcaattgttaagagggaaatagttcctacctcacagcattactgtgagatttaagtgagatatttacaaagcacttggtacagtccctgcaat

SEQ ID NO: 5287 - DNA, 1050 bp, Homo sapiens
agagtcagccccggatactctttagagcaagatatttcctaggcgtggaagtatcttagcctctcccttagtctccgctgccgctattgttggctgccaccttctctccctggatcgctgcagtaaccttcaacaggactctgatctgggacctgcgtccccatagctggcatcacccatctccacactacaaatgagtttcattatttcttcctcattatttcagttatcagtgacctaaatattctttatcatgaaatttctaattagcaaatattatgtatgccttctgctgttaattggaaataaactttagaaacatggggtgatgctatttggtgtggacccattattgttaaattcaccattcttggacctaatgaaattctaaatttattttattgagatttctgacatatgactggcaccctagcaaaactgcatttttaaacagatgtacagggactgtcaatgtgaaatgaaggagtcaattttgtctttagtcatgattatatattttacgtctagataatgaagtcactatcctttgccttccagaaggtcatttataatggtttaattgctagaagttgtttccaagggaaaatatgtttcaatgtaataagtcaggtttttttaagccataaaatattttgagtgtaatataaatagcatcggatgcatcttgtacaatagcgttctgtgtgagaggcccagatgtaacacctaattcattatgctgggcctttgttattaagaacacacggggcaaggttcaggcgtttaatagatttggcagcaggagttgaatgatgcctaagaagcatttgtttgaacatatgttccatttaagccagatattttccttcaatatgctctttctttgccttttaaaatcaggttagtacttctctgtgttatgccatttagtaaagaccaagtgatggccttagttgatagcagcaaaattttgttagagcaaatgttctcaacatttgaggaataagaaatttagataatgacaggtacagttttgaatgaaagtgttag

SEQ ID NO: 5288 - DNA, 1027 bp, Homo sapiens
tcaactttattttttcatcccaatccttttaacatgcaagatcagggtaatttttttaactgctatatttcattatgtgaatataccacaacttggctgttttttttttttctctcagtggacatttaggttggtcccatttttcttccacaattacaaacaatgctgtaattaatatcctcatgtgaaataatgttagtagggatatatctacaagtggcctcaactgaaccataaggtgtacacattttcagcctaaatagatattgccaaattgctttccagagtgggagcatccacttaatcctactggcagtgtatgagagttcccatttttctacctaaagttccaaacaactgcatgtgtttctgctgggttaccttgggaaaagaactttagtgtacatcatcagttctgaatggtaactttacaacagcatttttctccaactctcaacttttcctttatagaaggtgatgctctcttacacaaccttcattctcgccctcaaagacttattgatcatataaggaatctccatgaggaagatgccttactgaaggaggaaagcagcatctatgatgatattgtttttgtggatgttgtcgacacttatcgtaatgttcctgcaaaattattgaacttctatagatggtaggttgtaaaaatgttgggtagctagaacttgttttattgttagtttttttttttttgagatggggtcttactaggctgtaaggaaaccccttactaggggtttcctaggctggtcttgaactcctgagtgcaggcaaacctcctgccttagcctcctgagtaggtaagattacaggcacatgacactgtgccttattgttcttttgctatcgagacaatttatcaacttcaaaccactgagatttcagcaaataaaaacaaacctaaggacactgagcacctgggatatgacctattgtatcccagttccttgcgaaaactgagcttctaagatgctgccactttattttgataaagatccacaatgtg

SEQ ID NO: 5289 - DNA, 1049 bp, Homo sapiens
gcaagcaattatttaatagtggctatacctggtggggagctaagattatggatgattttaattttcttctttttgtatatctatcttctaaatgttccataataaacatatattagctttatataatagaaagaaaaaataaacttttagcaattaaaaaaattctctcctgttgtacaaaattctatttgtgttgaaaatatgtttaattttaaatccttttttttactgcatcaaggctgattgggtttgtttgctcggaagaatgatagtgattgtttgctggcatatcatcagcaaagagtaacagaagagaagtaggtagtgtattccatttgcgagaggaagttcatcatcgtattccctccacacttggtgattgcctggagtcacacgtcggcagtatagcttgtccagtaagcaggtcgcctgtaaggttttcattgtgtagctcactgaagcataaatctcagtgggcatcacaagtgattcttcacaagtgaagactactgtgtgtttctcttaaaatatttatgttttggctgggcgtggtggctcacatctgtaatcccagcactttgggaggccgaggcgggtggatcatgaggtcaggaaatccagaccatcctggctaacatggtgaaaccccatctctactaaaaatacaaaaaattagccaggtgtggtggcgcatgcctgtagtcccagctaccagaaggctgaggcaggagaatcacttgaacctgggaggcagaggttgtagtgagccaagatcataccactgcactccagcctgagtgacagagacagagcgagactccgtctcaaaaaaaaaaaaaaaaaaaaatatatatatatatatatatatatatatatatatatatatatgtctctaattttatgttgtccttaatggtacagttggaacctgtaactaatttcagtaaaaagcagactatttttgttcacctaagtcactagcgacgttattgttagcattatggacgcttacatccttagacagaatttcactcctgttgcccaggctg

SEQ ID NO: 5290 - DNA, 1083 bp, Homo sapiens
agtagagaactacacaactgttttaatgacaaaggatgatgttgggtgtggattgatggaaagaccagacagagataccatttgggtaaaaattaaataatttgcttatctaaagaatgaaaagaaaaaaaagtcagtgcagacaggttaatgatagagatgggccatgtttccaagttaaataaaatttctccaaagggtgaacagttgtggatgatagcctgaaaatgtacctgtcaccttctgggtccctctaggtccagtcataactagatatgcactaaagaatgcctcgcctgccaggtgccctcattagtcctggagttaagccacacagtatggtcgcagagtgtgacagaatcaggatcagacataacaaattattcattcatcagcttcagcctttctaggctgttttagtctaggccgagtacattcctgaactcagtgctctggaaccacaatcggggtcagtttcctagacatctctgggattcactttagatcacctgtagagttcatcccgcagcatctcagctgggttaaggtgtggaggctagacaactgaccggccctggtgactaaccaagaaactttttcctacccattctgtggtgtgccattcacaatgtgttcagcaataggaaccacacatttttgtaacatactatgggtctttggaattgagtacaagtagttgaaactatatgttaattctgtcagtgtcaaagggatctccttttcatttgtatctgaacttccattttaaaaacttctgaatacgctactctcagcatactgcttataggatagcctgctccgcaaaagcagtcaaaaaataaattaaaaaaaacaaaacgacttttaaataaaagccaaactaaaacaggggtggaaaaaaaggaaaatgcagatatgctaaaggaaaacaacactactagaatctcatatttggagataatcacatttaacatttttgcttctatgtgttatagttgctaggattatgccgttcattctactttataatttacttactttaacatatcacgaacatcttttgatgtgctctattatttgtaa

SEQ ID NO: 5291 - DNA, 1086 bp, Homo sapiens
ttggggtatctgtagagattctttacagaattggaactttaggatccaggagactttatttttcagtgtgattcatacgcgtttggaagttccttatgcttagataaatcctgaattaccaaattttgaagttttggaaaactgctgattttaccagttaatttataataatcttgaagaaacaaatattatgaatcaactttctcttagaattattgtctaatttatttctgtaaaagaaaaaatagtaaaaaatgtaagacacaagtaacattatttatgccttaaaattaaaagtttgtaaaaattctggtgaggataaagaaagctgctccagcactttgggacaccacggtgggaggaggagcacaaaaccagcctgggcaacatagtgagctcccatgtctgaaaaaaaaaacattagccaagtattgtggctcatgcctgtagttccagctgcttgggaggctgaggtaggaggactgcttgggtccagcagttcgaggctgcagtaagctatgatctgcttccgctactgcactccagcctgggtgacagagcgagaccctgtctcaaaaacaaagacaacgaaagaaagctgatcctaactaggttctctgtgtcaccagggaaccaattttaggaagttgataagtttttaactgtctgtgtttattagcaattcccattatgttcagctgtgtttctaagggaggttatacttccaagtcttaaatatgctgattaggacttctggtattttaaggtttgttaaaactgtataattaagtaacacctcacttttataagcagtctccatggctctcaatccaagctttgccattttctagctgtgtgacctcctctgcctcagttttatcatctgtaaacttgggataaaagaatctccctcatggggattgacataaggatgaaataagttgatacatatgatgtatttagaataatagttcctagaaggtggaaggtactgaacattattttaaagagcctgctattttataaagctgggtttcaaacagctttttaaataaattggacaatatattcaggtctgtattacaa

SEQ ID NO: 5292 - DNA, 1057 bp, Homo sapiens
cagcagtgaagaccactgcccaggggttgccagaggggtcaatggatgaatttagtggctgtcctaacatggtggccatgagggagaccccagacctcagcagcttctgcatctctgggcatggtgagaagccaggagtggaaactaaggaggtcatcactccagcagttggggagggcacttggctttccttagaaggtggcagcaagggagggctcaatctcccaagtccaccggctttgagttgcagcactcaccatgtgattccattctcttgtgtgtccatcgcagccctgtgggcctcagagtccatttccttaagcctgtgctcctgctccttgtgatggcttcacaggccccccacaggctcagttttcccctgagcctcacccatctgggaaattcctatatgggcgtcctgtaacccactgcaaacttcaaacactcctattcaactcaacatacacgtttttaggatcttaaatactgaccatgctattaaaggtagaatcatagacgtcttagagtaaattgggaccttagagctctccaacgctcctgaattttacaaatgagggaagtgaagctcagaaaggttgagctgcttacccaaggtcacacagctagcttacgggcgggggtagatctagaagcctgatgttcaccggaactcatttctccatgccacattcttaacaaatgtaggttttgtcaggatttagactaactcatctgctaaacttcaagttgatttatttgagtgatgtgtttagttgattcattgtatatctctgctggaattatttctagccattgctaaagcggttaggtctgaaaatcagaagaatctctgtaaaatgctgaaagatgagccaatttttaaaacccagaagggaatgtgtatggcctgtgtagctggaggcttctaaacattttttttcttcatctgtggaacatttttatcattctggggaagatttagacattgaatgtactaaaaggatttcatttgactgctatgtatttacccctgcctgtaatccgctaataaatactc

SEQ ID NO: 5293 - DNA, 1044 bp, Homo sapiens
tcttcaggatataacataaaacagcttcattaaataaaggaagacctgaatctgcaggtccaaactgcttgccgtattccagaaaagagtgtgagagaaatgatcgacacagacacaaatacagctgagggtcttaatctcaaaaggaaagagtgatctctccatcaacaaataagtcaatagcaaaaagcaaaacaaaagcaatactaataataaagagcccattaagaatataggcagaagaggccaggcgcagtggctcgcacctgttatcccagcactttgggaggccgaggcggacggatcacctgaggtcaggagttcgagaccagcctggccaatgtggtaaaaccctgtctactgaaaatacaaaaatgagctgggcgtagtggtgggcgcctgtaatcccagctactcgggaggctgaggtgggagaatcgcttgaacctgggaggcgttcaaacactgcttcagtaaacaaggaaagaggtcatgaggaatctagtgagccaagatcgtgccattgcactccagcctgggcaacaagagcaaaattccatcttaaaacaacaaaaaaaaaagaatataggcagaagaagcagtcagttaggacaaatacccctaactttgattacattctttttttttttttgagacacggtctccctctgtcacccaggctggagtgcagtgtcgtgatcttggctcactgcagcttccgccttcccggctcgagctatcctcccacttcagcctcccaaatagctaagactaggttttgccatgttgcccaggcggtctctaactcctgagctcaaacaatccactcgccttggcctcccagagtgctaggattacaggcgtgagcccccacacccagccttggtacattcttaatatgtgttaggtgcttgaattttcacaccagccctgagatgttggtgctatcagtaccccatttcacagacaagaaaacaggcccaggccaggtgcagtggctcacacctgttgtcccagcactttgggaagccaaggcaggaggat

SEQ ID NO: 5294 - DNA, 1099 bp, Homo sapiens
ggccagacccacatagcagcaggcggaagggggttgaagaagacagtgctgaatggtcctcctagcgctaagcaggatgacaaagtcatgtgggaactcctcatggaagacggccaccaggtgccgaggccttggaccacacagacggtgaaagaggcgccagtggccaggctgctgaggacattgtggaggctgttgcttagggtgatcacccaggccagagtgctgataaagtagtggacacctttcagctccagcaggcactctggggagcctgcagaaccagcacagagagtgagcccaccacgaccttcccatccatcatggactgcttgccatccagttcactgtggcagtgctgagggctcatgtggtccaggtccccattctgcagcttctccatcacccccctcctcctggtgcttcttggaaggaagcctctcagaggcataatggctatgtctatgtgatgttcattttcctgtttgagaaacatcttcaagatctctgaaaaataaaaataaaagcccccagacaccactgcagacttggacacataatcatcttccagagggttgaaatcaaaagccccaggaatgagctaggagagcacattggactagaggattccaatcgccagagctatgacgtggagcagcagcttccttctgtaaaaggccttcttgaaggcaccacgatggtgcccatgagggagcagagggagatgacagtcacatagaggagatcgtatccccacacttcagttgcactagatggtcatcccagcattgaacagcatgacagagaatcctttttcttgccttatccagcttctagaggctgcacactccccttcgcttgtggcccccttccaccttcaaagccagcagtgtagcgtcctcagatctctctctgactctgacactgactcttctgctcgccctttcacttacaaggtcccttgtgataatccatggtaattggttccaccaggataatccatgataatggtcacacagaggagactatatccccacacttcaattgtgctcagcctcccctcttcgatctatgcattctctcgttctcctggtccaca

SEQ ID NO: 5295 - DNA, 1631 bp, Homo sapiens
ggcaactgcattgaaattctttaatttttcataccatatgggagaagttgggaccaatttttttgcttcttgtaattgcatttgacatttcagaagagttatcccaacttggtatggtgactcacacctgtaatcccagcactttgggaggccaaggtgggaggatggcttgaagccagttatttaagaccagcctgggcaacaaagcaagcccctgtcttcattttttttttaattggcggggcatggtggcacgtgcctagggtctcagctacccaggaggctgaagtgggaggatctcttgagcccaagagtttgaggctgtaatgagctgtgattgcaccattgcactccaacctaggcaacagagtgagaccccatctctaaaaacaaacaaacaaaaaagcaaaaaaaaaaaaaaaaaaattcaagcaaatgtttgactttatcgcttccaaggagaacaagtgccagttttgtcagagaggaaatgcatgtccatctcctgggtcctgctcagaaccaaaggaagctgaagactctacaaatgcaaaagtgaagggaatggcaaaccctgagagaagccatacagagaaaggaggctgggcttcctgcagggaagctgtctttaaaaagggccaccacctagcacctgcggatcaaagtgaatagggctgatgcgagtctcaatccccatattcagatatgcggggaaaagtgacttttctaaatgttttaaaacgcaaatcgaagcatgcattctgcctgtttggcctgcttgggttgcctcagtgtttccccagaacttacacaggaccaggtatctgtccactgggtgacccgtaggacaccatcatctgggtggggaccctttaggctggttgctgttggtggtcttgggtcctgcctggggacacaaaactctccacaagactgcccatgacctcctccgcttcagggcacccaatggccattttgttctagggtcttgtaacccccccccgtctcctaacaaggctttgtggcccccaaccaccccagcttgcagagagggtcactctccggtcctgcaggcaatgctcttcttcctcctgcttctggccaagacattttcctccgatactctgaattctttctcacctctggggtttaggcttttggaaacaaaagccagaaagactcttgggccatgtctggttttttgttgttgttgttgttgttgtctttgttgttgttgttgagacagagtttcgctcttgttgcccaggctggagtgcgatggcacaatctcagcccactgcaacctccacctcccgggttcaagccattctcctgcctcagcctcctgagtagctgggattacaggtgtgtgccaccacgcccagctaattttgtatttgtagtagagacggggtttcttcatgttcgtcgggctggtatcgaactcctgacctcaggtgatcctcccacctcggcctcccaaagtgctgagattataggcatgagccaccacgcccggccccatatctgtattttaacccatcacacccatcccttccttgaatggggaagtattggttgatatcacaaaatactatccagtctcatggttgaaactaaggatcctgatt

SEQ ID NO: 5296 - DNA, 1035 bp, Homo sapiens
gttatcagatttaacctatcaaaaattttgactatttattggatatcatccaagtgatcttaaaattaaaatatatatatatatgtctatgtatgtatatacgtacagacaatcctttgtatctgtgggtttcacatccgtggattcaaccaacctcagattgaaaatatctggggaggaaaatgaatggttgcatctgtacttagtatgtacagacttttttcttattattatccaaacaatacagtataacaactatttatatagcacttatattgtatttggtattataaataatctagaggtgatttaaagaatacaggaggaggccaggcacggtggctatgcctgtaatccctgcactttgggaggccgaggtgggtagatcacgagatcaggagatcaaaaccatcctggctaacacagtgaaaccccatctctactaaaaattcaaaaatttagccagacatggtggcactcgcctgtagtcccagctacccaggaggctgaggcaggagaatcgcttgaaggaagcggaggttgcagtgagctgagattgtaccgctgcactccagtctgggcaacagagcgagactccatctcaaaagaaaaaaaaaaaagaatacaggaggatgtgcagaggttatatgcaaatactacaccattttatatcaaggacttgagcatccatggattttgatatcctcaggggtcctggaaccaatccctctcagatacctagggacaactatattatgtgcctgtgctgtatgtgtaacatcttctcaaaagttacattgtcaagctcattcctcctgatcataatttctcagttcttatgatgggatatggtttttatagtgataagatgtgaaatgtattaaactgtgaaaatgtaatcagtgatttctgggggggttgtatgtgtgtttaccattctatcactggatcaaaatatatgcctttgaactaaggtgagacatccatagcctggtcctctgttgccaatggcaagatagagttagtaaaatattc

SEQ ID NO: 5297 - DNA, 1072 bp, Homo sapiens
tactacctcccttttgtgaaacactttcttctggtggctttcagaatactagtctcctgatttttcttctaggtcactggtgggtccttctcagtcttttgctggttcctcctctttttgtctacttcttaacgatggcataccttaggtctcttgtcttttgctaccttctcttctctagctgtactaggtgatcttatccaaagtcatggttattccctaatgactcctaaatttatttttccagttccaaattataccctgaaatccagacttggatatctaattgcctacacagcattttcaacttaacacagccaaaacaaaacttgattctacattcctccaaacttgttccttctctggtatgcctcatctctgaatttcagaattcacccagttgacaggtcaaaaacctgagtcatcctttactcttctccttctttctccttatatccaagctattagcagacattatcttctctacttacaaaatagagtctgaatctaacttctaacttctcctaccctaacatctatcacactagtccaaaactgttacctagaacactataataacctaactggtctttgctttcctctttaatctttttcagtctaactttcacactgtagctctatatttcataaaggtaaatcgaattatgtcatcctcttcttaatctaattgcttcccatttacatatctacgccaggctataaggacctggctttcttccttatgtcacttcttactattcttctctcttaatcactatgctataacctcactgacctctttgttattccttaaacatgccaagtaagttacattttagggccttttcacttgcttttacctttgtccagaatgctttttccctaaatatttatatggctcatatgcttacctcactggggcctctgcatatgttatctcttcaaacaggcttctccaagccatcttatctaaagtattaaccctccccacattctgtcccagtgggattcatcctgggatgtaaagatgattcaacatatacaaatcagtaaatgtgatatatcatgttaa

SEQ ID NO: 5298 - DNA, 1027 bp, Homo sapiens
tgagaccagcttgggcagcatagcaagaccctatctccacaaaaaaaaaaaaatttaaaaagtagttgggcatggtagtgcatacctatagtcctgttattcaggtggctgagatgggaggatcacttaagcccaggagtttgaggctacagtgagctataatcacaccactacactgcagcctgggtgacggagtgagaccctgtctcaaaaaacaaaaacaaataaacaaaactatgatcatggccgatggccaacaagagatttactgtttcttaaaaaagttgttcagaataatcctcccctgaaacgatgaagagtggataaaatatatatacaaaaatatatctttataaaatatatccatgttttaatataacttataagtatatattttaatataatgtaaacatataatgataaaatatatttttattcagtcttagttgtgtgtgtgtgtgtgtatacatagatatttatagagagagagagagagagccttaaaagcattgaagatctgacaagctagtaagaaactaccaagccagagaggtaaataagcaggaaggagctttagccctgaggacactatcaatcctgaaacactgacactgtccttggacagcctctgtggaagaaatggaaaacggcacccaggaactaagcaagctggggagtgccaagagagcccgcctccaaaaggctggtccctttcattctgctctctcagaatgaaaatgagttgcatgggagaaccctggaattccctggtttgtctaggatcctcaaagacttcactttgcgttaaggtggccccaggctggtgtggtagtgggtgtcatctggcagaaacaaggaagttacttgcattctgttccacaaatagaggaattcctacaagtaaatgttataatgtagtgacaaatacacaaaaccaggcacaaaaaaatacagctaagaaaataaatttatgaaaaagttaaaagttataataaaataaatatcatttaaagcaaccttgattgcc

SEQ ID NO: 5299 - DNA, 1052 bp, Homo sapiens
aaaacaagatgtgatgacattgtgtgatactttgagtcaaatgactaaactggatgagaatactatattgcattttcatctagagatacatttctaaagatatatttttgttcacccattaattctttgatttgagaaaattcagctaggatattattgttgttgttgttgttgttgttattattattattattattattattattattattattattatttgagacggagtctcactctgttgccaggctggagtgcagtggtgcgatctcggctcactgcaacctccccctcctgggttcaagcgattctcctgcctcaccgtccctagtacctgggactacaggtgcgtgccaccacacccagctaatttttttgtatgtttagtagagacggggtttcaccatgttagccaggatggtctcgatctcctgacctcatgatccgcccgcctcggcctcccaaagtgctgggttacaggcatgagccactgtgcccagccaggattttgttatataaagactcacgctctgagatttcacttatatgatcaatttcatcatcatcagtagagtctagagtcctgacggctgtgtgccttcatgttgtgattagtctcataattgtgaaacatcttcctctgtcagctttcttggtagaaaatgaaaaattctgaattctccaccgtgttcaatgaaagccaaaagtagactacagaagtggtgtctccagccttcttttatactttcctgaaagatgacactatactttggacaatgcaataagaaaaccaaaagatgacgatttagttcacatattagattatcctcttgggagattccatcattctcccatttccttgcttgtttgtttgttttttgcgtatttaggaataattgatgagtagtgatgaaataatttttagaatgatgaaatcgctaaatgtttcaggatatagaaaaacaagttagttattaagatcttgtaatgtaacttaggttgattcactggatccatgtggtaattccaagacagaatgagttttattctgt

SEQ ID NO: 5300 - DNA, 1103 bp, Homo sapiens
tatgaaggaagatttattatctttggctataaaaagtgaccccataccatcagaactaggtagtctaaaaaagagtgctgacagtttaggtaaattagagttacagcatatttcttccataaatgtggaagaagtttcagctactgaagccgctcccgaggaagcaaagctatttacaagtcaagaaagtgagacctcacttcaaagtatacgacttttggaagcccttctggccatttgtcttcatggtgccagaactagtcaacagaagatggaattggagttacctaatcaggtaataccttgtccttagtccaactcttatgtaatatatatacatatatatacacacacacatatatatataaaaaatgtaatatgtattacataatatatgtaatatatatattattgtgttatatataacatataatatattacttttatatatgtgtatatattatgttttatgtatatatacacatacacacacacacattttataagtgtcagatgaataataatggatattgtgtttcaaagttgaaagatctaaatttttgtgtgatactgttggctgccctgcccagaactcctttaccaaactgatcacccattcaccatctgcgcatcagcacccatcttccaggaatcacccttgaccgatggaagatgcctgggaaggatgctcatagctaatgctgatagatgtggctctaagaagtggggacaatcattgtggggcacttcaggctccagagcttcccaggaaatgaggctgggacgagacttctcctaaaaccacatctttgtccagattcttctcctaacctcttctgctttacctcacattcttacaagttttctcctgagatcatttctcaactaaaaaggaatctagggacctggaatatggcagacctcttctgtcctcactaacttacacctaactgttcagtcagccaacaggctcttcctacttcagttccagcctccatgttgccttatctctaaaaaatcctgatgcttccacactgaatttccacaattgaaattcacaagctttaacacagcacacaaaactcttcagtcttgctttgact

SEQ ID NO: 5301 - DNA, 1048 bp, Homo sapiens
cagcctcccgagttcaagcaattcttgtgcctcagcctcctgagtagatgggattacagtcgtgcaccaccatgccagactaatttttgcattttagtacatacagatgggatttcaccatgttggccaggctggtctcaaactcctgacctcaagtaatctgcccaccacagcctcccaaagtgctgggattacaggcatgagccaccgtgcccagcctaaaggatatatttaatattttgtttcaagcttgggtagaattattctatgtaaggtcgatagatatttttaatttatgattttgaagaaatcatatgtctataaagtacatgaaactttaaatgtttcattggagagattaatagttttcctcttgaccctttcttgtgacatgtttgtgagatgtttgaagatctctcaggttaaaaaaaaaattattgtattttaattcctgtatttttagtgaatttcatggagctttttttaaggaggtatctaaggttttgtaatactgtttttctgcttatttattgattcactaactctctgcttttatttttttctgagtttgcagaattcacaaattgttaatcacttaagaaatctgattaatgctctttgggggaagttgtcttcattgtctgcatcttttgcttgggtggaatttgtcagactccttttaatttctcctcttcccatctggtttgctttccctgtcttagtaaagcacagatttttttatttacagattttaatttattcactctaaattacagctacttttttatatagctcttactacatactgcaaagagaaagactgatctaattatctttttagttaaagggagaattcattcatttcccctgtgaagtatttactgagtgttgaccatacgccaggccctatctaggcaccggggatgaaataatagtgtctatacctggtgcctagttcagtgctgaaacatttgagaaataatttgaataaagaattatttaaacctcagttttagagaacatttggcatatagtgtatgattttgaa

SEQ ID NO: 5302 - DNA, 1053 bp, Homo sapiens
tcaccatgtttgccaggatggtctcaatcgcctgaccttgtgatctacctgccttggcctcccaaagtgctgggattacaggtgtgagccaccatgcccagcctttttttttttttttttttttttttttttttgagatggagtctcactttgttgccaggctggagtgcagtggtgtgatcttggctcactgcatcttcctcctcccgggttcaagtgattcttctgcctcaacctcctgagtggctaggaatacaggcatgcacccccacgcccagctaatttttgtatttttagtagagatggggtttcaccagttggccgggatggtctcgatctcttgaccttgtgatctgcccgcctcagcctcccaaagtgttgggattacaggcgtgagccaccgcgcccggccccattttaacaatattgtttctttctattcatgaatgtggaatgtttctccatttgtttgtgtcatctctgatttctttcagcaatgttttgtaattctcattgtagaaatctttcaccttcctggttagctgtattcctaggtattttattctttctgtgactgttgtgaatgagattgtgttcttggtttgcccctcagcttgggtgttgtcgatgtatggaaatgccactgatttctgtacattgattttgtagcctaagactttgctgaagttatttatcagatctaggagcttttgagctgtcttgctttctatgaaaaagccaaacccattcccagcacttcatatacttgctaggagcccttttcctccaaatcttttcatggattccttcttctcatcaattaagtatctgctcaaatagcccatcctaaatagcctgtctaaaatgttaccctttttgtcactctgtaatctctttcctagataatttccttcatagcacaacattatatctgaaattttcttatttttacccattattttctgtctcctgtgctaggaagtaggcttcatgaggatatggatattgtgttcactacagcatttgaagtacctgacacagtgcctggcctgt

SEQ ID NO: 5303 - DNA, 1060 bp, Homo sapiens
gttctatctatgcatgattggtctgacaggaatgagaggatgtaggggatgttggcattcctacttcttggagtagtgagagtgtgatcacagtggaaatcttaaccactcgacagtggtgctatccatggagagtagataattcattgaattattcccgttttaattaatcccccaattatccacccagactgattgaagcaatgaatatatcagttgattgtggtgtaacagaccatgttccaaaacttagtggcataaaacaatgatttctttgctcatgattctgttgagttggcagttctggcatggctcagctggaatagccactttggctccttgaggtatcagctggtcttacatctgagtttgcagtcagttagcagattaactgagggctattgggtggggctgttggccagcctcagttctcatccacatggcttctcatctttcagtaggctagactcagcttctttacatgatagtggaaacattccaagagggtgcagaagctgcaagaagtcacataacaacatgttgatcacattgtattggtcaaagctagtcacaagttgagctcagatttaagggatggggaaatagactctatcacttgataggaggaactgcaattaatttgtggctgtgtttaagctaccatggtctcttctctgaccaaaattattattattcctcctacactcactcccctctacgcctcttgaagtatattattccatcatgacctcagggttgaattgatgatctcatggtatgcatcagttctggatacacatgaggctttcacatgtagtaattttgttgcagctcttcttgattgagaaacttgtgaattagacaggttatctgctccgcatatgccctatatacaataatgagataggagtaagttaattgtagtaagaagagggacaggagaggaacatagccatctctcggccatagcagtcctgaaatccagtcagcacatgttgtcatggcccctgttctagggtctgggaatataattatcttctgtgggagtggttccctaatc

SEQ ID NO: 5304 - DNA, 1035 bp, Homo sapiens
tgtgaactaataattactgagtcctttagcttgtatacatctaatttatcaaacgtttttggcttaaagtatggtatgaccatatggttttgctgttttcttattataaaattaacagagttttaaaactagttgagactagatgttttcatctaaccttcttttacagatgagaaaacagatccagaaacattaagtactcacataaattaattttaaggccaaatgtgatttatatctttatttcattttagtagaaaatgaataattattttgtgatcgtaaaactctacaatctgctttcagggaactaattaatatagttagttgaaaaaataatgaagtgtttgtaacaccaatatgatggattttttttaacactttgaatgttaccagctttagatgtaaaattggccatcattaaataaaatttctttgctgtgaaagcattttgctaatagatacatatattgaggaaatatggagactaaaacagtacttctgttttcactgtaagctaaggaacatagcaaatacaaattaggaagcatttacttgtcatggaattttcaggacatttgtaggtttatggttttttttgagacacagagtctcgctctgtcgcccaggctggagtgcagtggtgcaatctcggctgactgcaacctccacctccgggttcaagtgattcttgtgtctcagccacctaagtagccgggactacaagtgtgcatcaccacacccagtgaatttttgtattttcagtagagatggggtttcaccgtgttgaccagctgatcttaaactcctgacctcaagcagtctacccccgttggcctcccaaagtgctgggattacaggtgtgagccactgcacccagccaagtttatgtatttttattctttttcatgaatgtgatttgttaaatgagtgattaaatataatttttatatatttgtatgacttttctgtaaataaaatttaaaatcagaaaaaatcatgttagaccatgtatagtgatttattttgaaattt

SEQ ID NO: 5305 - DNA, 1051 bp, Homo sapiens
aattaggttattggatttatttaatacttttactttctgaaagcatataaagaaccaatattaatatataatagaggttattgccgtattttagaatgagagatgcactttatatttttctcctttctaatattcaaaaatattaaaaatattgatgtttgttatactaaaagagagttactgtaatacctagaattttgatgggaatcaaagaattaaactgtgaggtcccaggatgaacaggaactaaggtagtattaggaatttctctggtacttccctttcatttttatctacttctctttgtatcccgttggttcatttttacctggttggcttcttctgaccctcagctacctcataatgactaccacagccccatctctgcgtgacctttcaggacatcaactatatccctttagtttaaattcccgagagagaaagaaaacctgattagtccagttcctctttgcaacccacactatacgagtcacatcttgtgatgagcatggattgtagctgaactggggcccagagcttgactgtgcctcttggcaagaggcatagtcatatgtgcactgccctctcagcagggactgtggggagggcttccccctgaagcgggtgaagggaggtgaggcaatacatgtcttatttaacttaacatctctatgttaaatatcttttaaaggttactggatacctcaaaattacttttagcccagagatgaaactattttgaaactccttggggatttcgttgttcatggtttttcccttctggaaatttgtacattttcctctgtatttatgttcccctattctgtttgctgtagcttatttcccttaatcttaaaatgtcacattaccctttatttgatttaaatatgtcataagaagtgaagtggcgtaactttagctattagaatttttcagtttttattcacctgattggaaatcctttttattaactgaactttggtgtttggggaggatgggtcagtgattgtgggctctatcaagtgaaaaatgggttatatttttaaaatac

SEQ ID NO: 5306 - DNA, 1097 bp, Homo sapiens
ccttactgctgttatacatgtttttttttttagttttctttacacaattctacataaattggaaatatttcattaaacacatttttctactttaacttagcttaaatgcataatacagaataaatataggaacagcacaaccatttatttccatattcactagttaaggattattatattcccacattttaaatatagaacatctagttcagagccaattcttaaccctccgatgctgaaatttctgatgctctttagagctgaaggtgttacttcttgttaaaatgtacatacttcttttcaagaggagcaacatttttcttccaagtcatttactttttggtataaatgtacaatgtggaaacatggaaaaagataacaaagctgtaaaacatcttgagaagtttgtgggggggcaagaagtttgtggtgcttggaggcgtgcctgggagttggcactaagtacagctgtaattagtcagttttctgtcctgtccacacagaaaaccgtctagttacagttgtaagttgtgccagacctaatcgctaaaatgctctgaaaggtagaattctgaaagatatagtttggttgtgagtagtctgtcaaaaattgtatgcagtattaggaaaaacattggataggactctgcagacctagctgttaagtcctctgacttttgggaaatctcttaactgctgtctgccttagtttatctgtaaaattttgagggaggtgatatggtcattaacccagagatcgtttaactctctgaaagttgattgtagaatggattctcattttaaaataatttattaaatgcgaactctggcagttttcctttattgtcaatcaacttgtcacttacctcagtattagttgaaaaaatgtcttttgagtatggcagttacgtcttacatatgactgtgttccagaggctcatttctaagatggttgttgagaatgtttagaatgcataagatttgcccttacagacaaaataaactacagtatacttgagtgttgcattgtgagacttccccgggaaaaaggtccggcaaagtgctgagattacctcaacatgtctaactggcttact

SEQ ID NO: 5307 - DNA, 1050 bp, Homo sapiens
atgatcattctgggcgctggatggagaatagactttgttgtaggggaagggttgagcaggagcagaagctgggataccaatccggaactgttgccctaatccaggccagagataatgtagcttggaccagagtggaattggtggaggtggtgagaggtcattgatttcaggataaattgagggtagagatgtaaaagacaccaaaatttagttccgaacaagtagaaagatggggtacttgtttactgagattaggtttacgagaggagtaggtttggtggggagaagggtgggagttggttagaagacaataaaattagacattcacgtttttaaagaaaaaaatattcaatgatacttgtttaagaatggtaagtaaggctttattcagaaccatctcaataggtatagagacctctgcagtggggccctgcagtaggggagggagactgggctcaactccgaatacagcatgagaaaatgggaatttatagccaagcagcagtgtggggatcgtggatggaaaattgctaaaaggaaacatcagggataagggggattctggctaagccgacctaacgggattcttgctgaagacaggccagggcgatcagacattacctggggaatggtggaggatgaggaacctgatcagatatttaggatgattagatatccaggatgttatgctaaacagacttagcagggttctttgctaatactggattttacaaggaagtgcacagatgggcctcacagaaaattcaaaagcctgagtaagtttggccaagcaaagaatttttgtcaaagctgagattattagtagtaaacacaagtgactttgttttgaagacactttttacgttaccttgactataccagggggttaaaaatttcacccataaactgccagctttgatttcatgattattttcttcttaattcttttggaccaacctagtcattcttttcccaattgtagttttatttttgtttgattgcactcacatagtgtgtttgttagcttcggttgtagagagagccatatag

SEQ ID NO: 5308 - DNA, 1879 bp, Homo sapiens
ttcatgcgctgctttttcatcaaaacctaccctgtcctagagatctatgggcatttggtggatgataatgagcagcccctcccagatagaatgtcaatatttgagcagtaggatattggcatttgttagttaaaggcttaaatcaaaagaatgtccaatggtaggaatttcaaggtgtaggtcagatatttgagaataggggatttttttgatgtgccttaaattataccaaagattactaattattcctctttgcccaaaatacttgcatccaaggttctagtctctgttgctgtgctggtctttagccccactgcttgcactgatgtccctccttttcacggagacctatctgaggtacaggatggggctggcaccagatgatgtcccaccacagtccctcacctccggcctccacatgacagaaccaatttacactcaaccatgacctcacccctccttggtttctccctcgatctgtggccctttttggatgtattcttatctaacaacacaatccggaaagactgaattgaatatttatactaatggttcatatcctttattgctcaatgatctaattaaagggatcattgccacatttcatgtttatatttctacaatttgtttagaaaacatctcctgaccatatcagtagctcgtgttatctttttatcaactgcttcccagagtcctaaaacaatagaaattttggattgaaaagttcagcataaggagtttgagtcagtaaaggatgggataaaggagtcgagatgattcaatgaaaagtatcacaaaaaagagattgatcaacaagagaaataaaaaagcccaagaggaagtggtaggggaaggaatttaagaacagcaataagtaaaactcttaagtaactccaaaaagaaaatggtacattttgccaaagaccacttatacttgagaacatggaagaatttgcctgatactctctttggggaaaagagtctctcctcttttcctcaaaccccagtacactcagcctctctgccccaccttctcctgactttgtcctcacttgcttctgcagtacattggaacctgaattgaaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtgcttattaactgttctcccagatttgtacaagtattggatgattccttgagtttacagctgtacaaatagtgtggaaaataaactttttttaaaaaagaaaatcttcctctatcttttctgaatgaagagatttaatgttgggaggctgattcatgatagacagacagacagccacttaataatctgcaaaacctgtggagcccagaaactcttatcccagtattatgagagctagtatgtttctcaaccacaaaaaaccttaggggttgtaatttacctaaaaatgagtgcagtgtctcacacctgtaatcccaacactttaggaggccaaggtgggtggatcacttgaggccaggagtttgagaccagtttgggcaatacagggagactccatctctgcaaaacatcaaaaaaaaaaattagctgggcatggtggcacacacctgtagtcccaactactcaggaggctgaggtgggaggattgtttgaatccgggaggccaaggctgcagtgagctatgatcgt

SEQ ID NO: 5309 - DNA, 1068 bp, Homo sapiens
ctcaggttatatcaactccagaagagtagcagggcggcataaatggactgctgaggctgctttcaggggcagacccagactgaacaccctggagatcccttcctgtgtgtttcttcggcacatccatgctttctcttccttcttactgcaagctctacctcttacacaacaggctcttagttcctcgacactgattccttccctttgagaccacatctcctattctgtggccactcagcctcctccttgaaggcaggtactttgaccacagcccctgccaacatctgcttcttgtcctagtctggtcccctgggtctgctgtgctctcctccatgtgggcctcatgcagggaattccatatatttatgccagttatagccctttactttgttttcttttgctaacagcttcattgagatattatatgtcagttatgttaaagggaaccaaatttgttagtaacagaatcaccaaactcaaatgaggaaccaaattcaagtatctttgcaaaagaaaatgtgttttatcacctctcgatcctttcagtcattctgttttcatgtctgccaatcacttcattgtaattcttttcaagtgtttttcataaactttttctcatgcatccttattatttcttttcctctttcccccctttttcctcctccaggaacctttactggacagactggaacagagataaccccaagattgaaacttcctacatggacggcacgaaccggaggatccttgtgcaggatgacctgggcttgcccaatggactgaccttcgatgcgttctcatctcagctctgctgggtggatgcaggtgatggaaagctggacactgtccagggcgggtctcaatctcctaagtcaggggtgggcaaactagggccctggggtcaaatctaaccagccacctgtttttatataacccagaagctatgaatggtttttacggttttatctggtacattaaatatatactggtacaaaattgtatagatacctgcatactgtccttggttttgcctcctggcctgcaaaacctgaaataatttactatctg

SEQ ID NO: 5310 - DNA, 1035 bp, Homo sapiens
tatttttgctcctatggcattgtcatgctgatgatatttgttctgtggagtcaccttgcgttctctgcaaaatattcacatcaaagatacatctttaaaatagagcagcctcattttgtatttctttttacttggcactgaatgtagttttttctattttcaatggaatgtttccctcacaattgatattctagaagatttcctgtgcctgtggaacaactcccgaagcattttttcccttctttgttgccttcagtaaagatgatgcggcaggaatgaagctgaggttgaattaactatgtctggctttggacatagaccctgaacccttttctggaagccaacaggctatttaaatcatgtcttccagttttcatgctttggtttagtgaaaaacagtttgaaaatgcctatctccgtgtgttaaaaatgttattgttattatctatgatttcattttaaaacccagtggaagaggggaataggtcattgtttgctatttcctgttgcttttggagctcataaccatccaagaacgctgtaagcacagtaagaagcattccaagcaaaagcctagttactgtgaaaacacagaattaaaccaaaatgtgatctttgtagaagaaagatcactgggaataattttcttttttttttttttaagagagaaagaagcttccagttatctccttagcatggtacaggttggtgcttccctagtgagtgagagtgacagttaggtatcattttcatttcttccttatttcataacagcccggatcccaggctttctttctttccttgagttacagacccaaccaagtatctctaaaaagtatcatatctttgaggtaagcagtaaggaatacttcttcctcggactgcacattgaaggataagattatccagacctttcccttggaagagtagctcataaagaagtattttgagttgagggagagggggttggttgctcttgggtttgagatcgggaccaaggctggttctaaggagacaatatgcacggagctcatg

SEQ ID NO: 5311 - DNA, 1049 bp, Homo sapiens
ctactaaaaatacaaaattacctgggcttggtggcgggtgcctgtaatcccagctactcaggaggctgaggcaggagaatcacttgaacccgagaggcagaggttgcagtgagccgagatcgtgccactgcactccagcctgggcaacaggagcgaaacgccatcgcaaaaaagtaaaaaaaggttcactgtatgttctatcaatttgcttcatttctttttgcctcaattttttaaaagtgttttaaaaggaactacctaggagtataaaggagatgtaaatatcattttcttgacaaacctattcaataataatgatgtttctgcattttgaataactgatgaaacaaaacccagtgacacacaggcagccctcgtggttctgagcgagctgcggggactcctgcagccccgccagggagcgctgacggatgacgcacctgacagctttcttgttgcctgtttctctgatagaggtggagaaaacccggtgccagcacgagcgagaacacattctcggggcagcgggggcgacagacccacagcgacccattcctccggggctgttcgttcctgagtgcgatgcgcacgggcactacgcgcccacccagtgccacggcagcaccggctactgctggtgcgtggatcgcgacggccgcgaggtggagggcaccaggaccaggcccgggatgacgcccccgtgtaagtgggtgcaggccgtgcttgggcgtgtgcctgagaaggacctcgggggaccggaattgctgaacacgctctttgctcttctgctggacctaaagcttgaactgttccactggctccagccccacccgctcctgctgcacccttcttccctctcacttaccccgctcctccccgtgcttcctctcctcctcaccctctctgttctcttaccctcttctttctccttccccacccaacacacacacgtgtagggtgtaaatacccagtggggcctgccacagcggtacctgtaatggtagcagagcggctgtgtgtgctccaggcctcccagaagaactctctgc

SEQ ID NO: 5312 - DNA, 1056 bp, Homo sapiens
tcttcaccccttttaattggctcctttgagactcactgcgcagagagaaggctcactgtagaaccaagtctgcctacacgcattcaaagaaataactctggcttgtcactgagtaattgagtggtcattccatctctcttggaattccttgttgaaacagtgttctaggtcggaagcctgcactgggaaggttaccctgcaggtcagaatggggcaaggtgaagaaataaatggggcaaggtgtgctctgccaactgtgaggggctgggggctcaggcagggcctgtggactgaccaggaggaattctcttttcatgaggattggtatccattatcggggaagggatgtttgtggacttccatctttggcattttctgtaaactcataactctcttttccactgggaaccaacttttgcagttaattgaaatgtgcaaaacatgtttttgtgaaggaaaggtgggcctcagcttgcccataagtcagcttgatgtgaagatgtagatacccctctgaatggacatagccctgtgacactgggctggcatatggagtgtggtgaacttgaggtcctacttctcctcccctaggcatcttggtgcagggcatgatggcatgcatcagctcttctcttgagggaagaacagggcccaggcttaggcaaaaagctgtagcagttaacttccagtatgccaagcacagagaggccagtagatgggactgtgattctcttaagggtcctgatgatagaactcatggaaggagggctgaggaggaggtgagtgtcacagaggctagctgataatgccccatcttgtgctgttgcctcaagatggaaggcaaaggttgaggtctacagggtgattttcagctggttcagttactctggggttcctaaggcaccattgcattttgcttctgattttctaaaagaactcagagccaggacagagtcccatcctcacaatgtcagaacacaaatcattccctcccatcaggctttgtgtagttggattatcccagatgaaggaggactcatgtttttcctccatgag

SEQ ID NO: 5313 - DNA, 1035 bp, Homo sapiens
cagtctgggacttaccttcctggtaacgtatcgctagggaggggacatagtgcctactcacctgcaatcgtcagtttcccagtatttcctgcaaagagcctgacagccttgaatggctgaattggctctggccagttcaaagcagcatgatgctgtgtgtgtgtgtgtgaacgggagccctcccaggctgtgagacggctggcatgcggggatggggctccttcaccgatccatgcctcctcattacacagctctgcttcaacttcgtaagcctcctggatagtaataaggtgcagaagtaacccagtctgctgctgttgaactgtgacctcgtggctaattctgcccttggtgcctgagcttgccacagtgggagtgcttcacttcagaaggcacaaccagccatcctttatgtaatctgcaccatcctagaaaatcctccgatatccttgtccagaaagacaggtggtcgcatgtagacttgcttttgtcctgtggtgagtggttgttctgacttattacctccgtggaatgcgagtgtattcccagtcaggacacttattgttctgggtcactagaacatgccttgaagtgttaatgtatcgagacatgaggcttaaaataggaaattgcattaagcagatcacttcatgtgttatttggacttgggaagtgcgttagaggagaatgaggatgagcctttgtgattcagtgtgtgcagcgctgatatgatggtatatgacaccccaaacaagggtggttttggtgagacgtcgcacagtgactctccacagtaatttggagacgatttcacagagctctgtgattcactctggtccatggcaggatggctcccgctgtttctcaatttagagcccgtagagatagttttggctcatctctcattgagtaatcgtcgagtatgtagaaggcatttagcaaattggtaatgagactcttctcctctaagagcctggcctttataaaagggaaaaattggagaaacttagagttgttgaaaatatgtgaaaagta

SEQ ID NO: 5314 - DNA, 1042 bp, Homo sapiens
atcttactaatactattagtctgcttgattccagaaattgcacatacattacctggtctgatccccaccttgacctattttgtgtgagaaactgagaccaaagatgttgagtcatcagccagtggccacacagcttgtgagtggtactgagtgtgaattcaggggcgtctctttccaagtgtgtgtcctctcaacctgaccttcatctctagttctgggcgtcttcaaaacttacagagaaccacttgagagaaaagcaacaaatacacataatacgaataataccaatgatcatatggggaatccaggtatttcatagaatgagtctcaatacaaacaaatggtcttatttaagctgttctgtctggtctgtcatctggtagccttatgggcagggaataccactggtgccttgaaagccgttgattcagcttcttgcatccttaaccatcttccctctgtctccctgccttgtcccctccatccttcccactctgcagtgatcacttcctcctccacccgggagtacacggtgactgagcccgagcgagatggggcatctccttcacgcatctacacttaccagtggcgccagaccatcaccttccaggaatgcgtccacgatgactcccggccagccctgcccagcacccagcagctctcggtggacagcgtgttcgtcctgtacaaccaggaggagaagatcttgcgctatgctctcagcaactccattgggcctgtgaggggtaaggggatacagctcatgctgggcacaggtgctcatgcatttttaaaaccccactctttgacattgtttttggtctcttactctcagtctgtagaagaaaattatgctaaagtatcttctggcaggaaaaaaagaatgtcttgttatttttgattcttggaaaagctgcctgtctgttcttctaaccaaaggcctattcgtgattctatctaaagtaaagtgcagaatgctaacctgttgaggtgccttacagagtggaccctcttaaggctactgctggcattggcagggctt

SEQ ID NO: 5315 - DNA, 1008 bp, Homo sapiens
cccagacagagcctagcacagctgggagtccaacccctgtcctccgctatttccagcacaacccttgagccaacccaacagatgctgggctgtggctaggaagcctcttctctcctctgcgtgtggctcagttgggccacagggatgtctgagctctgtcttcagtgtcaccagttctatgttctacagccaaaccaaagcacctgcagaagcgttcgcaccaaccccactccacactgtgagcctggggcgggcagaagggcgcgctccccagtcagcaaagtgacagtctcatcttgtttttcagggggtgagttcactcgccaggctgaggtgaccttcgtggggcacccgggcaatctggtcattaagcagcggttcagcggcatcgatgagcatgggcacctgaccatcgacacggagctggagggccgcgtgccgcagattccgttcggctcctccgtgcacattgagccctacacggagctgtaccactactccacctcaggtgagccccagctgtgtcccagggccagccccagaccggccactagcctcgtgctcttgacccaccacggcagccgtgaactggggctgtctctgggatctggagagggaaatacaccgggccttacagtcaccttcccctcaattatagacataggacgcactactccttgtagagaattttgtgcaaaaaagacaatacgcatgagttagagttgtaaaacctggacataattattatgacatttaagtgtatttcttttcagctttttctccagcatctatctatttacatgtatatgaaatatcccaacatataatttcatgataaactaattttattatacatctatttgtacttttttttttttttgagacagggtttcactcctgttgcccaggctggagtgcagtggtgcgatctcagctcactacaacctccgcctcctgggcttgagcaaccctcctgcctcagcttcccaagtagctgggcctacaggc

SEQ ID NO: 5316 - DNA, 1058 bp, Homo sapiens
aacacagatcctcagggctccctctgcttgggtagtggtggctgttggtgggttgctggcctgtttctaagaagcctgtccttcctcctaggagtagtaactctgggcagcagggtgtctgggtgtttgagattgggagtccagccaccaccaatggcgtggtgcctgcagacgtgatcctcggaactgaagatggggcagagtatgatgatgaggatgaagattatgacctggcgaccactcgtctgggcctggaggatgtgggcaccacgcccttctcctacaaggctctgagaaggggaggtgctgacacatacagtgtgcccagcgtcctctccccgcgccgggcagctaccgaaaggccccttggacctcccacagagagaaccaggtctttccagttggcagtggagacttttcaccagcagcaccctcaggtcatagatgtggatgaagttgaggaaacaggagttggtaagaccatttaagttgcagttggtaacgatcttggatgtgtgggcttccagacaggcgtactgctggggagatgtcagttgtgagcattacatggtggtttgtaaagataagagcttgggaaagtagaggctgaactctcacagccgtggagccttggtgttatatgcccagtggcttcagagatgctcagtgatcttttgggattaggaccatggttttggagactgttgagtgtgtcttctttcaagtttcctagtattccgttctgtctgttttaaagagaaaacgtccgttagaattgttttgaaagtcagattttcttgtgatttctcagatcagaaatgtattcatccacctgaaaaaacattttagaagttcttttggctgtctatgaagcttatctttgacatttatttcctcttggttttggaattagaattgttgattatttttcttcccaggtcccgtcagtttcagagttggtttgtgaagattaaaaaatatatatatatcaaagtagatactctttaaaaaaaaatagggtcgggggtggtggctcacacctgtaatcccagcacttt

SEQ ID NO: 5317 - DNA, 1058 bp, Homo sapiens
tattttaggttttgctttcaaattatagcttatgtaacaatatcaataatttgaaacagtatgcaacatgttagccttactaataagctttttctttcttccataggctttctacaagtataagagacttacagaattttaaagtcttattacaacacagtaggtaataaaggcttttatgtgtctaactagagacataaagtgactgtggaaagccttttaattatggacattcatcagaaagacactaatctgacttcaagaattctgaactattaaatagaaaatttaaatgctcacttgaatatttatgattcttaatagattattatcaactagagatatttataaatgaagtatatacttttaaaacatgtaagttatactaattttgtgtttaatttcatatgttttcatgtaatgaaaattctattttttttagaattggttttgtttttattctattatcctttatttccagttgtcaaactttaaatggctatgtctgcattctaataacactgttcagtctgttatggaaaaggagaactagggaacaaatgttgctcagggctggtgtcagtgagaaaaatttatcaatgctttttaatgtgtttttacccttgcctcactgtgtgtgtgtcactttctataatataaagaaatactataatatttctagaatctggaactgtcaccatgatgaatggccctttcaatgcatagttacagaaattcctgaagattccccaggacttcaatttcattggtttttatttgcagtttttagttgctgtaattgttgctgtttccagtctaaaggacctcctttggtaaaggtgaacaagacctctcccctatgctacccagccagattttgtgtgtgtaatgggctggcccaagagtgttcttttacttagaactccttttgattttgcttttctctgcccctagaaattttagggacaaagacattttggaaattgtcagttacttttagaaagaaaacactgcagaaatatttaacagattacttcttgataaaatttaaatgggat

SEQ ID NO: 5318 - DNA, 1049 bp, Homo sapiens
atatctgtactgtccaataaagtaaccagtttccacatgggactgtggaacacatgaaatttggctagtgtgaaactgaattttaaattgtatttaatcttagtttatttagatgtaaaaactatattgttaaacagaaccttattgttttggtaagactactataacctatgcgtcatgtaacatatttttgttgtagtgtgtgtatacttttgaattttaaaaatgtggctattagaaacattttaagttaacactcgtgtgtggcgttatatttcaatggaacagcattactgtcatcagtgggatacatcctcagtctgttctcagtgaggaaccaaaccctgggagcaactctgtcattgacctgccattccagtgttttctttagacggggagtgttttaagaaatttgatttcctgatctaaatttgtatctttagacctttctgagaaccaaatagacttggaagggttgactgcatagactgctttttcatgctcactctgtcacaatgtggcaaatacttgttttccccaaattcacattgaaactgcctggagaaggaagttggtcctgaaaaagacgtgcctggcttcttatcctttgtctcttttactacttttgcctcacaacttttctattttcaacttaaaggttttaattaaacaaaattttataaaaattgaagcaatatagtagttatataaagtgaaaagggaaagctcttctattccatagtacagagtttgaaaggtgttcttccagaccttttctacagccacttaatacttttaaagcagaaaatacaattttttcacttaagaaaaccatcaagtcctaagaaacacttcatttccatgttagtgatatatcagagacataacactgctgaaaagatgaggaaaaggaaactactacatagaaaaagaggaagggaagaggagaaaagaagaaaaatgaaatatgaaagaagacaagactaggtaaagagaatggttcctagctgttataggagtactctatgaagtaattaatagctcttgct

SEQ ID NO: 5319 - DNA, 1046 bp, Homo sapiens
ccacattggatgggagattatagaaatacagttattggtattttagatcttgtaagtatagacacaatttaaattaaaagaattctgaaaataaatttaattacttcggaaaaaatacgtttaacgttataatttctaagttaattgaaaagtttagcttgagttttgtgtttaactacatgttatatgtatttacaaattaatttctccttgaaataattattattgactagtcctaataattcagtatagttaagaaatataaattactcaaggaaattaatacatatattttcctataacttgttttttgtcatcccttcatgtaatcactaatagcagaattgtgacatcatctaatctttaactgacctcagattatctattttaattacactagaatacagtattaaaagtttcagctccaaatttaataatttttcttttttattcctccttcccatagtaatcaaagcaaagaagctttcattgactgggcaagatatgatgattcacgggatcacttttgtgaacttgatggtaatacaataaactattataattaaattattttaactttaacccttttataagacattttaatcaatgaaaatataaactgaattatagcttcagtactggattttgctatgtagaccttattattcataatggcatttattgagagcctgtgttccaggccctatgttaagtgccttaaatacattatttctggtctttgcagctaccttcataagtgtgtattatttcatatctgagaaaactgagtctgaaaaagactaaataacttgcccaagatcacacaatagcaagaggctgaggcaggatttgatcccatatccgaatccaaaacctgtattctttccattatgatataccatctgccatggaccttcaattgaagccacttagttataggtctgtgaacattttgtaaaaatatttacactggaatttgctagaggtcttaacaaactcatgtaaagatgctttctaatgctggggaggactctaattcgacttct

SEQ ID NO: 5320 - DNA, 1050 bp, Homo sapiens
aactgtgtctcaaaaaaaaaaaaaaaaaaaaaaatatatatatatatatatatatatatacacacacatacatacacacatatatatacacacacatacatacacacatatatatatacgtgtatatatatacgtatatatatacgtgtgtatatatatacgtatatatatacgtgtgtatatatatacgtatatatatacgtgtgtatatatatacgtatatatatacgtgtgtatatatatacgtatatatatacgtgtgtatatatatacgtatatatatacgtgtgtgtatatatatatatatatatatatattttgactgggcatggtgactcacacctgtactcccagcactttgggaggccaagacaagcagatcacttgagcccaggagtttgagaccagcctgggcaacatagcaagaccctgtctgtacaaaaaaataaataaataaattagctggatgtgttggcgtatgtctatagttcgagctacttgggaggctgaggatagaaggatcacttgatcccagaaggtcaaggctacagtgaactatgatgtcagtgcactccagcctgggtgcagtgagaccctgtctcaaaaaatatatgtatatatttatcactcccagaaagtttctcattccctattccatcttttatgctcctcatttcccagtttgaagactactactttaaccttgggacactatcttgaaaggaagtgctgagttaagtccaagaaattctcatgcaaatagtgttgcatccatcttcaaactgacatttggaaaagctgaagtagataacctctaaggtcccttctaactcatttataaatcaaactgagccagctttattagcattagatgcacattcaatgttttttcgggcttaggcatggctttactgtggttttaggcaggggttaggtgaaagaatcagcaaagcctcttcaaatgaggatgctcaaagaagaaatttcctgaaagtcatattgttaacaagaaaataggaatttgtatcactattgatttgttcttcacta

SEQ ID NO: 5321 - DNA, 1030 bp, Homo sapiens
aggcggaggttgcagtgagctgagatcacaccgttgcactctaacctgggtgacaagagtgagactctgtctcaaaaaaaaaaaaaaaaagatttgtatttatgtaccataattgctaatgactcagtataagttagcaattttatttattgaagacaaaatttaatataggaaaataaaagataataaacacccacatacatatcctccatttcaaataaataatcctccattccaagtaaataaatattaacattttttgccatatgttttaaggaacaagaaacatcacagataaatttaaaatcccttatgctgtattccctaatccagtagaggtaactactatcaagaattagttggtgtatatccagtctgtttttgtttttatatatttatatgtataaataagatagttttattttgtgtatatggttttatttttcctttgtataaatgatatcctatatttaacattctgctacatttttcattgtacattttgctttctagatctgtccatgttgaaacacagatttattcttttaactgatgaatgattttcatcatataaatatcccatattttacttagctattcacttattgatggatgtttagctatttccaattatttacttttacaaacatgccaccttgagcattcccaaattttttttcacattagaagtagaattgttgaatcttaggattgtctttttaatacccattcttgatattgcctgatgacattccatagtacttggtgtgaatatatactgactccagtgctgacagcttgtatcattctctacatccttaccaaaagttgataatgtttgttgagtgtgaaatagtaccttgtttttattttatacttcgtaattactagtggatttgagcattttttatttattggacatttgagtttcttattcattcaacaaatgaatgtctacaatgtgccaagcactgttctagggtactaggaatccagtagcgtaatggataaaatttccgccctcgtgcaa

SEQ ID NO: 5322 - DNA, 1124 bp, Homo sapiens
gcaacctccatctcctgggttcaagtgattctcctgcctcagcctgttgagtagctgggattataggcccatgccaccacacccagctaatttttgtatttttaatagagacagggtttcaccatgttgtccaggctggtcttgaactcctgacctgacctcaggtgatccacctgccttagcttcccaaagtgctgagattacaggcatgagccactgcgcccagtgcctcgtctttctttgataagatactttttattgaatcagtttccttaattattattggcctattcagattttcatgacttccttactccagcttttgtaggctgcatgtttctagtaatatcttcatttcttctaggttatccaatttattggaacatagtcgtgattagtagtctctttttcttcgatgtcagttgtaatgtctcctctttaattctgattttgttggcatcttctctttttctttgttaatctagctaaaggtttgtctatttgtttatctttaaaaaaaaactttggtttcattgattactgatttctagtttcatgttagtgtggtcacataagatacttcgtatgatttcagtgttcttaaatttgttaagacttgttttgtggcctaacatgctctatcctggagaatgttccatatgcactgagaataatgtatattctgttactgttgtatggaatattctataaatatctggtagggccatttggtctaaagtgtagttcaaatccagtgtttcctcattgatttttttttttctgtctaggtgatctaatgttgaaagtggagtattgaagtcttattgtattgcaatttatctctctcttcaaagctattgatatttgctttatatatttaccttttcagaagttgggtgcatatatatatttagtttttgtaacttcttgataaattgacccccttatcattttaaatgaccttctttatctctttttacatgtttgacttaaagtctattttgtctgacatatggatagctacccctgctcttttggtttctagttgcatagaacatctttttctatcttttcagtctgtgtgtgtccttagaggtgaagcaagtcttttataagcagcatat

SEQ ID NO: 5323 - DNA, 1088 bp, Homo sapiens
tcttttttacttcttattcctttcctttatgcagtaaatatttattgaatgattagtttgtgtcaggtactatggatacagtagtgaataagacaaaacttttctgataagagagacaaacaataaacaagtaaacaataaaatataatttcagatgcttataaggtaaattctatggagaaaagtaaagtaggagagaatgaatattggggaattggagggtgggagaggtaggtagccctacattagagaaagtatttgggaaaataaggtatttatgctaatgtaacatttgagcaaagtcctacctaatgtgaaagagccatgagaaggtttggggaaagaacatgccagggaaaagatgtagaataccaagtaaatggtcttgagatagaaataagcttggtgtgttgaataggcagaaagctggtatagctggagtgaacgagagggagagttggaaatataggtaggcaccagatttaaaaaacagtaggaccgtattgaccatgtaaggatgctggattttattttaagcaggataagaaactactgaagggatttttgtgcaaaaaagactgtaagggtagaagacaagaaatagaggaaccatttaggagactcttgtgttagttcagataaaaacaatacagatttgcaatagaatgctgcagctgaaaaatgtagaaaatgatcaaattagggttgtacacaaaaggcaacaccagcaagcttttctgatgaattgagtgtgacgtatgatatagaaatgaaatcaaggatgatgcctaagttttgagtgcacatatacaagcacaaatgtacatatatgtaaaatcatgaccaaatagattttattccaagaatgcaaggatgattcttgcattgatgttgataatcatcaaaattcaatatgtgctcctgatttttaaaataataagaatgatgtatatttcttaacatgatgatttcagtcctaacatcagcatagctaacacgtcttgcatatggggaaacactagaggaattctcacttaggtcaggaaccaagacaaggatacccactatctgcattaactgttggatat

SEQ ID NO: 5324 - DNA, 1048 bp, Homo sapiens
ggtttcctgtcacccaccacaaggctcaacttccttctagagcactcacctctgtttccctccagtgaaccccaagtcaccctttgcgccttgactcttgccaagctaacaaccctgtgctgcccttcccacctctaaggacttgttcaaatcatgccctaaatctagaaaagccaaccttcagccttccacatccttcccagctttctgaattccaaaccaatatccacaacttcagggaaccttccatgattagcccacatctgtctacactccacataccagggcactgcattagactggaacttagggataaatatgaatgtcacattgctatctattccgcctgatattcatgcttttagtaacgagttttgatgagtcctcaagaacccacatggtccagacaatgtgtcagtttaaaatgctgtagaatgataacctaaaccaatgaccctaagtgactgtgtgaggcagtggcacctgagctggtgattgaggctggccaaacacccggcatccgcatcacaaggagactattctctgctcagcatcccagaaacatatttcgggaaaggtatgtgttacaatattcacctatctggggactcaggactgcatgccttttagttccaagggactgatgtatttttccttgaatacatacaaacaagactaactccttaggagaaaggactgccacctgaaaccgtctaccctgatgggagatgatggccagtgcaagcaagcagttttagggtctccacgtcctcaagtctgcttatatgattaaatgtgtgactccagtcctgagacaagcttcctggttaaattcctatcaatatggggctacacaggaattttaatatgatgacaaatgtcaattccaatgtgcataatttgacactctactggctttgccatttatactgattgcccacgttataaaaaggggcaaattacaatctccaagtaaacaaaaaacatacacaacttccacatactgagttaggacttgatttaaatggaccacttatcccacccctgc

SEQ ID NO: 5325 - DNA, 1054 bp, Homo sapiens
ccaaactgtaaggggccaaggacagtggtatggtgcaggagtaatcagatggatcaatgtgactgaacagtaggcccagaaacacatgcaggcataggtaagaggtgcagcaggtgattttacaaagcagttgggggagagaatggtccaagtgctggccctggcatgatttgtttcccatttggggaaaagtctgatgtcacaccttgtagaaaagacaactttagtcagagtaaaaacttcattgtaaaaaacaacagttcaaatgtttagaagaaaatcaaggagaacatgattgtgactggaggataggaaagaattcctttaaaattttgattcaatagaaagccacaggctgagagaagattattgctctgcataaatcaaaaagcctcagtttccattagaacaactggcaaagaatatgaattcactgaagaggaattacagatggccagttaatgtacaatgtcatttagcctccagtaagcaggaaatgtgattaaatgtgatacccatcaaattggcaaaactgttgaagtcgttagtaccagggattgggtacgtagtggcagacagtgtgattgttccaaccactttagaaagcaattggcaggatcccatgaggttgaaagttccagtaattcctgtgatctggtcattcccttccttaggtatatatgctgtaaaaacttcccaagatgatcaaagggacataaaaatgttcttctctagcattattagtaaaaggggaaaaaatggacataaactaaacatctaacaacagaggcaaatggatagataagtggtatttatagaggaatatcatatgcagttaaaatgaaggaactagaacataagtcaccatgcatagatctcaaaaatatgtttccagaaaaacatgttgttccgtgatatgtagtgtttgaaacatttggaagcagatttgggatgatggttttgtttgtggggcttggggtagagggagaataggaccaaggagcagtacttgggggattccagctgaatctgtaatgtttaacttctcaacaaa

SEQ ID NO: 5326 - DNA, 1034 bp, Homo sapiens
actttatttttattctctaaagttttagtttgtgttttctgttctcaagtcttgaggaatgctcacagattatctttctgctcatctctgaagggtttagcacttttgagcattacacatgaactgtcagaaaggacctgagtgccttagtgtgaattaatagctgtctccatgtctaagaagttaccatcattgggttttttcctccaggctaaactcccatcttccagcaggctttgagtgtctctgtagagtgagcaaaaacatatcagtatacataactatttactactaagtctttggatctttagatggtgctttctcagctattgcctatggctgaacaactgctagaaaagatccagaaggagcccacagctgtgctgaaagatgaggccatggttctgcatctcactctgggaaagtataatgaattttcagtttcccttttaaatgaggatccgaagagtctagatatatttataaaagctgtgcacacaacaaaggaactttacgcgggaatgccaaccattcagatcacagcccttgaaaaggtcagtgatttctttcagaaactaaggcatagcatgttcaagcatttaaaggtagaaggcaacaggaacagcgttaaaaaaaaaaagattaatattttatttggagaagatagttacaggtggactagacgttttaaaggaaaatgatgtatttgacccatttttgaaaactgaacgttgtacatgggtcattaaaaagaattgcattttaactgacaaaattaagtgggaaacaattttgtattttgagagaggttgatataaaaattatttctggaatttaaacttgttcactgaactcagttgccttttttctaccccctctagattacaaaaccattttttgcagccatatcagatgaaaaagttcagcagaagcttttaagaatgttgtttgatttattggtgaactgtaaaaactcacattgtgctcagactgtcagcagtgtttttaaaggggtaagctgcaaacttcttgta

SEQ ID NO: 5327 - DNA, 1026 bp, Homo sapiens
gagtttatagtatgctcttgtgtattttcaaaagaatgcaccaggtaacatatgcctaacctttctctggaatattaaatattcaaacagtgaacagagaaggagtttgaattcgaagggaaactttttatcaagtacctttggtactatgtaaattttgtactgtttcagtttttaaaattgtttcttaaatttttttttcctttgattttagtggtgacatctttactcattaacctgggaagccccgtaaaagaagttcgtagggctgccattcagtgtctccaggccctcagtggagtggcatccccgttttatctgataatagatcatttgatttctaaagcagaggagatcacttcagatgctgcctatgttattcaggtaagctcgttagcaaagaagattgagtgtgttcatgcctctgtgtactggagcaattttctccattctcgacatttcactgtgtagggattttgatggactaagtcattggatttaggaactgataggtcaatatctgtacatctgtgtccccctacttttgaaaagatagcaatgtcatatttcaatttagttcttttcattggataaaggtttagtgtgtagcttttcatagtaagccagctgtgtgtttttaataacgtttcttattaaggttttaaggagaaatggaaaattataaacaatgtcacatcatttgggtaagagtcttccgtaattaatatatttagcctttgtagtttcttaacccttttttatccaattttctttttggtatcttaggatttggctactttatttgaggaactacagagagaaaagaaactgaaatctcatcagaagttgtctgaaactttgaaaaacttacttagttgtgtgtatagttgcccatcttatatagcaaaagatttgatgaaagtacttcagggagtcaacggtgaggtatgtgccatttaagtggattgtacattcctgtgatgttactaaagaattgttgtaactgcttgtgggtgaagaagacaa

SEQ ID NO: 5328 - DNA, 1148 bp, Homo sapiens
cttgtcttggttctgtgttttcaagtgcaaggttatagtgaggcttctgaatatcactcttcattgacatcttcccagttcattaaaacatggaatatggaataatttgaaatgattagacaaagcaaaactttgccttaaattatttgtttctttataattgtacactagtgagaagaggatttggaaccagcttatttgagtaagaattaaaagtttgcttttttttttttttaattaggtgcatctagaagatgtttttcagttattcaagttctgttctgttttatggacctatggttctagcctttcaaatccactaaactgcagtgtgaaaacagtgctgcagactcaagctctttatgtgggctgtgcaatgctttcttctcagaagacacagtgtaaacaccaactggcatccatatcttctccaggtattaaaagtagcattgttatgttttgtcatgaccaactgttcatgctttctctatatggtttatgtagtttggaaaattataacttaaaaaaaaatagcagagggcaggcgcggtatctcacgcctgtaatcccagcactttgggaggccgaagcaggcagatcatgaggtcaggagatcaagaccatcctgggcaacatggtgaaaccccgtctctactaaaaatacaaaaattagctgggcgtggtggcatgtgcctgtaatcccagctacttgggaggctgaggctggagaattgcttgaaccagggagttggaggttgcagtgagccgagattgtgccactgcactccagcctggtgacacagcgagactccatctcaaaaaaaaaaaaaatcgataaaggccaggcgaggtggcttacacctatagtctcagcactttgggaggctaaggcaggaggatcacttgaggccaagagttcaagaccagcttggacaacgtgatgagatcctgcctctacaaaaaatacaaaaattagctgggcgtgatggtgcgtgcctgtagtcccagctactcagttgcctgaggtaggcagatggcttgtgcctgggaggtcaaggctgcagtgagctgtgattgcaccactgcactccaaactgggcaacagagcaagaccctgtctcaaaaaaaaaaaaaaagggctgtacatc

SEQ ID NO: 5329 - DNA, 1115 bp, Homo sapiens
agaccaagaaaatttttatacataaaaatccaaattatgaaacaaagcaaaaagcaaaaagtaataattagagggccaggtggctcaaacctataattctagcactttgagaaactgagatgggcagatcatggcaaaaccccgtctctacaaaaatatacaaaaattaaccgggcatggtgacatgcaactgtggtcccagctgctcgggagactgaggtgggaggatcacctgagtccagggagttcgaggctacagggaactgtgtttgtgccactgcagttcagcctgggcgacagagtgagaccctatctcaaaaataataataataattagaaagtgattatttgcattatgtcttttaataaatacagaaaggctaggaagaaacatttggttctgttgctacttggagaatactaagaaagacttctctaaacttatgtcagtctactgaaaaatgaggtttttgtaaccaaatcttggtttgaacatgcattttagaaaagtgactagcaaaatgaaaatgtattcttcctattctgaaggtaatgagtaatgtcccagtctttgaaagcaagggctaagatcagattcatatgtttattataaatctgaaatagatgacagcttttggttcagtaagggggtgggtactgagataaaagtttaacctcttttcagagatagttgattggcaccatcacaactaatttgtaatgtgacctggggaaagactaattttggacttttgttttgttattgttataagcatgatagtacttgttaaaaatagagaattttagataaaagaaaaatgaaggtgatctatacaaaagagctttaaaaaatataaatgactaaataagtggaatgcacttgtgcaaatagataaaaagctggatatcagtgtgtgtgttttattctgagaacgattttctgctataagtgaatttaataatgttagcttgcaaaataaatttttcccaacacaattttaatttttacatattaaggagaagaaactgaaggaatggatggtcaaatctacaagagacacttagaagctatacttacaaaaatatcactgaagaacaacttagaccatttgttg

SEQ ID NO: 5330 - DNA, 1046 bp, Homo sapiens
tgcttctttgttatttgaccctaaggaagcggccacaatcgacagggacaccgccttcgccattggtgagccatcttttaacttagaaaagctcttggaagcgtttgttttctggatgttactgttttttttttttccccttgttttctcttctgtcccgtcctcttccttagcagtttctagcatgttgatgtatatttttaagggaaagagaacataacagtcaggtgcttggtgcttgaaatgtttatgagtagaggtatctggatttcacagatgaagaaacaaaattagagaggtcaactaatatgtcaaagagaagaacagctaaaagggggatggaggcagtgactggggtgacggagaagtcctctcagaggactggcctagttattgtaggggatatccaaaaaaaaaaaaaaaaaagtgttccctgccacgaagtactttctgttctagtagatgagataggatttactctaaaagttgaaaactagaaatcagtgtttgggactgtattataaattatatgtacttaaagaattcagaaacttcttaggggtaagtaaaactgtaaaagaggggtgggatgaatttgcttacgaagaattgttaaataaactggccttttttgaaatttaggatgtactggcctggaagagttgcttggaattgatccttcctttgagcagtttgaagcaccgttgttcagtcagctagcaaaaaccttggagcgaagtgttcagaccaaagcagtaaacaaacagttggatgaaaacatttcattattccttattcacttgtcgccttacttcctgcttaagccagcacagaagtgtctggagtggttgattcacaggtagctaatagaattacagaaataactatgggttaatcactttggtcttgtaaaaaattaagtagttgagaacttatcaaattaaagctgaaaaattaggtatattaagagattgatacaatgtccattgtgtgagataagcatgctcttctgcctttaaattcttttttgttgatagtgaaaagta

SEQ ID NO: 5331 - DNA, 1033 bp, Homo sapiens
gcttttcttgctccagcaaaaactgcctttcaatttaaaacgattttagagatagggtcttgctctgctggagtgcagtggcccgatcacagctcgctgtaatctcaaactcttgggctcaggcggtcctcccatctcagcttcccaagcagctaggactgtagcatataccaccatggctggctaatttttacttgtttactttttaatttttttgtacagaccacatcactctatgttgtccaggctggtctcaaactcctggccttaagcgacccccccacctcagcctcccaaagcactgggattacaggcacaagcctccgtgcccagccaaaactgtctttctatatagggaaatgtgttttttagaaaatgaaagctccctaaaaactggatatgactttcaaagaaaacaataagaaattcctttagttgagtgtctttgatttagctgattactgaaggcagaggactgaatttggtatcatctcaccatcacttatacccaaggatcgtaatattactgctacaagaaaaatctgtgttctctatggaaggtcatccagtatatgaagtatgtagagtaagagaaatttatgagagacactgtggttcaatggagaatgttggcttcatagtcctgggctattcactaaaattaggtgtaatcttagatacaccctcttatttgcagaatttacactccctttctataaaatttgtaaggaaggttggcataatctctaggatcccttctttcttgaagaaactatgactttctgaggttcctcctcccttctccattaattcaacacatttttgtcctcaatatcctcactgaaagccagcctcagcatttaagaaggcaaaaagaaagaaaataaacagaagatcttatttctgtgaggtttttcattcttatttgtgcttacattttaagtgtacctcattcaatagttcatttagaaaataggtaaactaaaaaaaaaaaaagtaaactagaccaggcatggtggctcatgcctgaagt

SEQ ID NO: 5332 - DNA, 1052 bp, Homo sapiens
gtgagtgataaaagcacagtaaaaatctttgcttaaaagtaactcaaatttttctctaagtaatctacctacttcctgatgtttttctttaatattttggaattgttcaagacagaatggagcctacatatatgggttccactagtatgttgaaaatgtcatatcatggagaatttgtaccttccaggtgtctgttaacccatcttctgtgtgtacttctggcatcttttttggtaggatcatttgacgggtggtagagtacctgtacttttggcaccattgaaaccggctctggcccacttgtttaaatagctatcagactcagtgtatatactttatatttttttcattccacagttgagagaaccagtgtttaatgctcttgaaattgtttctgtatcttccatggttcagatcagatgcctttaacaaaatggatatattgcagctgtagttgcccagtgtttacttaatacatctacatttttttcttgtctattttggtccctttgataggaaaagctataattttaggcaggactgtacgtcgatttgtagccatgcttccttcccttcccttgctcatccatgttagctggcagtttttcttttgaaaagttaaacaaaaacaggatatgtgcaatagaaatgtatatatatatgtgtattttaatacttgtggacaaatgttaaaagttgtttaagaacaacaaaatcaccaatgtcttccactttaagatatgtatagttttgtaagcattagtgcttggtagcatattgtagtgccatgttaggggttagtgcatgagcctagtgattttaaacttcaggatgaattattgataataacagtgtaaaaagagtggaaaatctaaaacttttctttttccataatgtctaaatatgttatattctccctggggaaaagaggttaaggcccaaaagactcatttatgaatagaaatatggggtcaaaatctgagatactatgtttgaggacatttcagctttccataaggtgtctggaaaccagctgtctttgtgtcttatga

SEQ ID NO: 5333 - DNA, 1054 bp, Homo sapiens
ttaaactttgatatcagccgggcgcagtggcttgtgcctgtaatcccagcactttgggaggccaaggcgggtggatcacaaggtcaagagatcgagaccatcctggccaacatggtgaaaccccatctctactaaaaataacaaaaattagccaggcgtggtggcaggtgcctgtagttacagctactctggaggctgaggcaggaggattgcttgaatccgggaggtgcaggttgcagtgagccgagatttcgccactgcacttcagcctgacgacggagtgagactccgtctcaaaaaaacaaaacaaaacaaaaaccactttaatatcttctactctcagatgctgaaagctaagttgtggaccctttttcccaattaagaaaaaattaagagaaaatggtgcatgattttcattgctgctgttcatatcagcaaaagggcccttatcagtaattatatggtgtgtaaagacaggttgattatggaattattaatcttttcttaaacatattgtctttttccaaaaatgtggctgctatgaactgaatatttgtgatcccttcccgctcaagttcacatgttaaatcctaatctcaagggtgatggtatcaggagccagggcctttggaaggtcattagatcatgaaggtgatggtattaggagccagggcctttggaaggtcattagatcatgaaggtgatggtattaggagccagggcctttggaaggtcattagatcatgaaggtgatggtattaggagtcagggcctttggaaggtcattagatcatgaaggtgatggtattaggagccagggcctttggaaggtcattagatcatgaaggtgatggtattaggagtcagggcctttggaaggtcattagatcatgaaggtgatggtattaggagtcagggcctttggaaggtcattagatcatgaaggtgatggtattaggagtcagggcctttggaaggtcattagatcatgaaggtgatggtattaggagttagggcctttggaaggtcattagatcatgaaggtgaagccctt

SEQ ID NO: 5334 - DNA, 1047 bp, Homo sapiens
ccaaaaccatacagtttaaaaatcatcacacaaatagaagtattcccagctgatctctccttactaaacatccgcagttctcacttgagacgcatcagaatcacctggagtgctcatgataacacagattgctggactccatctttcagaaagtctacgtaagtcattttctgatggatccaattcaagtgttttcatgtttaaccaattctcagtgatgctgatgctgctgattttaagaccacactttgaaaaccactgccctagatgtaccaatgctcttcactttctccacagtgaatgtcaagagccacaaatgtcacagctgagatgctgctgtccaattaggtcctcacatttctgcaaccacccattgaactgtatagtataagagtccatttttgtttgttttgttccatttgttcccatagctgtttataattaaatatatggcatactgcatttaagtactttattaaaataaacctgtcgaaatttgagtataaaaagaaaaagatacttctgtgaaaattaagctgaacacaaaaacacttgataaagatgtcttaaatgttgctagcaaattaaatctgagtgacacttaaaatgggaaagtgagcttctaatgttgtcccatttaataatttcctgttctttcatcctgctgtttgctcactttgtacatgtgttccagttcatcaataggcctcgtaatcgtaaccaaacacaatatttgagatatggcccagccagcatatattataacttttaaaatctaacctgaaaattgcatcaacttcccccaaccagagcaacatgtaatgtcatttggggcttaaaataaaatactttaaaaattggattttttttctcatgtgctgagattacatgtccctaattttgtgttttgctgctaggtttcttcgttcattgtttacttattcactttagtgtatgttggctctttacccttctttccactaaatttatcttgtgagttatagctcatttttaaagctttacataattttttgaagtatttctttg

SEQ ID NO: 5335 - DNA, 1028 bp, Homo sapiens
ccaatggcaaggctagtgttgtgaagtaaataacccactgttgatatggagagtaggagtaccctggtgtcttctattgcaccatcagaaatcaaatcagcaatagaattcttgacttgtcactctcctcagtgccccatttaattcctatgtaaaatatcgagttatttttaaatcttcttttgagttattgcattcctattctattcttcatccacctctctattttcttaaatcaatgcttatgaaatgttagttagtgttgacattctccaacttggtattcccagcttgctctcaaattttatcacatgcaccttgctctctacatataaccaattattctgtcaaagttaataatctaactacacattttttccgagctgtgcttctattttatatgcatttgatttttatcttagcagtgccttttgaattttgttaagaagcttaatcaaataagctttgagagaccttactgaatttatgctagagttactttttagaaagtctgtgactgtaaacggtattttgtcctaaaatgtttattttttattttaatatagtctgtctatggtttacaaaatgatattagaagtcacagtcctacccacacacccacaccagaaactaaacctccaacagaagatgagttacaacaacaggtgagtcaacctatgagatgacctgttaaaggtttacagagtaacagctatgaaaaccagagggtaaatgttaatagtgggtatttttataggttatttgtatgactgactgtttcatgtggaagatttgcagttaaaagataataaaatgttgtaattttaagtattgtaattacttgaaaatgtatcaatatatggtaatggttttcaaaacccctcactctttatttacccaaatccttgttcctctaaccaattgtaaaaatcacatatgctgatttgtaagtgactccatcatcaatagttactttgtactccaaagctctcttttaaagagtaagaggacaagaggttgagaacatt

SEQ ID NO: 5336 - DNA, 1045 bp, Homo sapiens
cagatccacgctgtctgtggtacccacctgttaggcacttagtagtcttctaggttatcagatcgactgtcctggtattgcagtgcttgtgttcgagtcacccttactttacttcagaatgaccccaaagcccaagcgcagtgaggctggcatattttattattttattattacttattgttgttttctattttattattagttattgttgttaatttcttattgttcctaatttataagttaaactttatgataagcatgtgtatatataagaaaaacagcatatatagggtttggtactatccgtggtttcaggcatctcttttgtgggggtgggcagtagtaaaacatatccccccaggataaggggggactatgcatatttgaaacctgaattttcccagaatcatgattttttaaaactttctagggtgtacttgatgtcttgctatcagctctatttgatggtgcatttctaatcctccactcacctgtcgtttaggacactgttctcccaggtacacatcagctgcagtgatggaacttaaacacagctgttctgtattcctctctctcactgtcgctcttcaccacaggctttgccgagttgtcttgaacacaagtgtaccttctgctataactaacaaaaatgtactatcgcatgaaaggaactaaatggcatttagatgcttttacttaaaatatcaataatgaaaccaaaaactccagcttctcttttgcacctcatgaggacactcacgtaaatgttatgacagtagtatttctcaatgatatgctccgtttactccctcaggagtggcttccacaatgttaaatcctactttataataaataacgttataataatgttgcaacccagcttagttcggttgaaaagaaattcatctttgaatcactagaaataacacaattctcttccaggctgatgtaaatagcatttcattattccttacatccaacaatactatgtgcttaatactgtatccagcaaatagtatatatttgaagattttaatggaatgtc

SEQ ID NO: 5337 - DNA, 1011 bp, Homo sapiens
gcagtctcaagagaaatataaaaatatttcaaactagcttaaaataaaaatatgctttatcaaaatttttaggatccagtgaaagcagtgcttagagagaaatttatagcattgagtacatgtactagaagaaagaaagatctaaaattagtaatctaaacttccacatttggaaactaggaataggagaacaagttaaatccaaagtaagtagaagagaagaaatgataaaaattaaagcaggtatcaatgagaatggcaagagaatatagagaaaatcaataaaatcaaaactttttttggaaaaaaccagtaaagtcaataatcctctagccaggttaactaaggaataaagggagaagacacaaattactaatatcagaaatataaaagggtctatatctactgattctgtgacactaaaagcataataatgaaatattctaaacaactctatgcccagaaatttgaaggcctagatgaaatggaccaaaagaaaaaaaaaaaaaaaaaacaggaaagaaagaaagaaaaacacaatgtactaaaacttaccaagaaaatagataatatatatgggcctatatatattaatgagaaggcctacatcttaacatctattattaaagattaacctattcaattaaagaaattaggccaggagtgatggctcatgcctgtaatcccagcactttgggaggccgagacaggaggatcagttgagcccagttgttcaagaccagtctgggcaacacagcaagaccctgtctcaaaaatttaaaaaacagtaaattaaatgaagaaattgaatcaataattaataaccttctaagacaggaagcaccagcccagatgggttcactgatgaattctagcaaagagggacaaattatatcaattctttacaatcttttccagaaaatagcagagtggctacctcctaactcattctatgaggctagcattaccccaatacccaaagcaaacaaagtcattgcaaggaaggaaaac

SEQ ID NO: 5338 - DNA, 1026 bp, Homo sapiens
tagcctgtttcttttctccttaacaaccttgatcgcttgcagccttctgctgggcttctgtaatgccttctaccatagcacttcacttgctgcgttgacatttcctatttccattttccccaggaagctgaggttctgaagggcatgggcattttgttacttatatttgtatccctagcattgaacacgggacccaatacatgttaggctcttggaaaatgttctactgatttgaacaagctgtggtcatgtctgctgtatataacatgtttatggaaggtgttcacatctctggggaagcttagcaaggattcctagatacagtcatggtggtgaaggggctcagtgcaaaactatagaggctgggtttgaggactgactgcgccacatgatacgtgtacggttgtggacaagttctttaacctcttcaagcttcagtgttttcatctgtgaaatgagatagtaataattatagcacctactgaataaggcagttagaaggagtgaataagataacacatgtcaagtgcttagtatagtatctcagacagagaaacactcaatgcaagttagccgttatctgttgatgcaagcaaatgcatgcatcttggttctcagattttttgtgtgacttagaaaatctatttagtttttgtacttcaagttctctctacccacggaagttatttaaacagtgtgaatcagttgttaagcaagagaaggagaggaaaggcagaggagaagaggagtgatggggtgggttggggggtgcggggagagagagaaagagagagagattctttgaccaaataaagaagtcaaggcaaaaagctaggacgtgaagtctgtgctttgctatattggttggcttctgcaatccctttttcaggggttcctttcaaggtaactacagagtgtaattcatttgaatcactgctacctgataaagcatctaaacgagtttttataaccaagttgcaggtgattaaagcctgtagcagagagaataacagccctccaaaatgt

SEQ ID NO: 5339 - DNA, 1052 bp, Homo sapiens
ctagttagaaaacataaatttttattgttctgattaaaattatgcctataataattaatctacttgcaggtattattcttagaaaatatctcattgtaggccgggtgcagtggctcatgcctgtaatcccagcactttgggaggccgaggcaggtggatcacctgaggtcaggagttcgagaccagcctggccaacatggtgaaaccccatctctattaaaaataaaaaattagctggggtggcacacacctgtagtcccagctagtcaggaggctgaggcaggagaatcactggaacacgggaggcagaggttgcagtgagccgagatcgtgccagtgcattccagcctgggcaacagattgagactccatctcaaaaaaaaaaaaatctcattattcagtaggtttctgtattttacttgaatgttctactagctgagtatagaggtgtttaaagccctggaaggatagctctcggtggtcttcatactagcccacttatctgaaaaacactgattattgattgaatgcctactacatgtcaagctaggatcatggaatacagagcctactaaatgtcaggctaggagcatggaatacagagcctactaaatgtcaagctaggagcatggaatacagagttaagtcagacacaatccttatacttcgaaagcttccattgtagtggggaagagagagttgatcttcatagtactgtgtcgtaagtgttgtaatagaagtaaaaaggaggccacaagaaagacaaaccccaaacacatagtagagataatttcttttgcttcatgtaactattacagctttttatgagaaatgggaatgtttagtcttaaggacacactatgggcaacttcacacagctaattagccactaagccctttggaaaattcaaacctcccgatgttaacttatgcaaagtagagcacactgtatttcaggcccagagggaaacatttcttgtcctctctttccactataagttaattatttgtttcactggtcccagaggcttcttgacaaccaaacttctttg

SEQ ID NO: 5340 - DNA, 1046 bp, Homo sapiens
tactctagtaaatttcaaagtgagaagaaatttttcaataagacaaaataaaattctaattaacaactatcacatagtatattctttcctcttctttctttcttgtttttttttttttttttttttgacagggtctcactctgtcatctgtcaggctggagtgcaatagtgtgatcatagctcactacagccttgaactcctgggcccaagggatcctcccatctcagcctcccaagtagctgggtctacaggcacataccaccatgcccagctaattttttttaaatttttttgtagagatagtaaaattataccttaaaattaactgaacacctaaggcttaacgaagattctacacagtgttttattggagtctttcaaaagacttgtgagataagcagagctgacttcatcttcattttacagtaaagtgactaaagatcagagaataaaaatgttttgacaaaaacatcactgctagtaaatacaaaaaaaaaaaaaacacttaaacataggcctgacatatttttacttatttgtaattatatttgaactcatacatgttctctaaggcataaaaacagaaactaaggagttttgtaaaccagattctacatttttttatttttttaggctaatctagctttctattcgggtcagttcctaatagagaccacagaatgtctactaaatcactgccatgaaaggtgaatggatttcttttcattttttctttttattttccatgaatcccaaaatacccagcaagacatgctgtctctgagaaatatcctgttacctaaaatgtaatcagttcagtccaaaaccacctgcccagcaaggcagataggaaaattaaatgaagagtatgttcctccagctataaactaaggtgaaatttctatagaggcagaaaaaaagtaaaagtaccagagaaagctaggtttttatagaaaatgctacctgccaccaatatagttagaaaatagaggtttagtaaacatcagaaaaaggaggacaatctagttcttcttattctgtttct

SEQ ID NO: 5341 - DNA, 1027 bp, Homo sapiens
cttttctagcttaaacttttcccatctcaatatttcttctaattatacctaggagtcatcccccatagcacatgtattggacacaaagtatttatggttgcaaaaaaaaaaggagtgtacatgaaaaatgttataaaaggagaatatttgggattgatgaaatgccactctggagtatggctgcaataaattctctggagaaggtcttaggaatgcagatttcaaatgcaaaccacagatattctaattcattagtgctgagatggaaccagggaatctataatttttgtttttattttactttattttatttattttttcccctagattaaatattaagctcaggttatagaaatatgtatttttaagctgattttaaaaatatgggattggtgtctgctggtcttagatgcatgctaactacgtttttctttatatttttaattcaatgcaatgaacattgatcaaatactcactatgttccagtaactatactgggttttgtgggctagtattttaccgttgctggggaaatagattacatatacattagcaataaacgtgtaactaacttgtacgaggaaccaaggtaagttcctttagcagaggtttaaaaagtcaggtgtaggaacagaactgtttaaaggctataactttgtaatctcatcttcaacaaagaacttgaattgtctgtccttaactacaaaaaaaaacctttaagaagtttgagtataatagtatcaaagcctttagagcaggcagatagatgattatttgtatcttattttgtgatttctgcgaaattgtactaaaagacatttccttcatgttctctaagtttctaatgaaaaaaacaataaaataaatgtattttataataaactactaaaaaattgtgtctttgaagataaactttactttttcctttttaaaaacaataatgtataatttgtattttccttttccttttttctgtagttgccaagaagttcactgctaaatttaatgttccattctttctttttct

SEQ ID NO: 5342 - DNA, 1078 bp, Homo sapiens
ttgcattttatatacatatgtaggtgttcaaacaccacacacacacaaacacaatttacttttggaagagttcaggctaatagtctagtagaagtcccacggcattctgtcagtctggatttgtcatatggtttccccgtagtgtcatttaacttggtttcttggtttccatataatttggaagataggtctggagcagcactgcccgacagatcttgctgtgaggatggctgttcttcgttggtgctacccaatacagtagccaccagccatatgtgagagggctaggatgatagaggaaaagaaattctaacttgtttaacttaaattattctaaatttaaatctaaacagtcacatgtggctaatggctaccatattgggcagtgcaggatgggatgctttattagatccaggatagacattttggcaaggatagatgatgtcgtggacttactgctttcctttgctggagggcatctcattcattctctgtctccctttctctctctctttctctccctctgcctctctctctccctgtttcttattgtgaactcatgaatgctttttgaagctagtttttgaattctttcacatagtttgatttaaattagtgtttggcacaacaaattgtcaccagttcaccttgaccaaacctaaacttggtattaactggtttgttttttgtttgtttgttgtttctgtaaggaatggtatttagaaaccaggatcagggaactaaatttgcttgttgctactgtgtcaatgtttctaaaccctttcagtagaaaccctaagggaaattacgtttataatctttggttcacactatatttttcaattcaaatttagtattacagaaaaattaagtgggagaaaattaatattatgagtgttctttttcttggtttctttttttttatatttgtatctcctttcccttagaaaaaaaattatggtggctaatattatcaacctatctctttagttttctacaatattgtctcaaaattagaatatcactactaacaaacccattaataaatttaaggtatgctttcagaccttttcttttt

SEQ ID NO: 5343 - DNA, 1045 bp, Homo sapiens
gcgcaaaagggaaacgtaggttcagagcccccacacagagtccctactggggccttgcctagtggagctttgagaaggccaccatccttcagacctcagaatggtagatccactgacagcttgcactgtgcacctggaaaacctgtaggcactcagtgccagcccacgaaagcagccaggagggaggttgtaccctgcagagccacaggggtggagctgcccaagaccatggggacccacgtcttgcatcagcatgacctagatgtgagacatggagtcaaaggagatcattttggagctttaagatttgactgccctgctggattttggactagcatggggcctgcagcccctttgttttggccaatttctcccacttggaacagctgtctttactcaatgcgtgtaccatcacggtgtctaggaagtaactaacctgcttttgattttacaggctcataggtggaagagacctgccttatctcagatgagactttggactgtggacttctgagttaatgctgaaggcatgattggttttgaaatgtgggtacatgagattttccaggggccaggggcataatgatatggtttgtctgtatccccacccaaatctcatcttgaattgtagttcccataattcccacgtggtgtgagggaccctatgggaggtaattgaatcataggggtggttacccccatgctgttcttgtgatactgagttctcaagagatttgatggtctgtaagggacttttccgcctttgcttgacactcactccgtcctgccaccctatgaggaagatgccttcttctcctttgtcttccaccatgactgtaagtttcctgaggcctcccaagcaatgcagaaccatgaatcaattaaacctctttcctttataagttacccagtctcagggtttcttcatagcagtgtgagaatggattaatacagtgaatctgtagtggcccagggatctgcatttgagtgtggcatttgtgacagttacagcacgtggggattcccagctccttgtccctggctt

SEQ ID NO: 5344 - DNA, 1056 bp, Homo sapiens
catctgccacccccactctccacagagctgagctgtggttacttcttcactttgccttcagccaagagataaaaaacggtttattttttccaaactttgagattcagatgccattgcttctccccttaaaggagaactttcagtgagaagtatcttatcttgtatcttcctcaaaatggaaaaagcatcttgggaaatatgcaaagtaggaaaatattcaaggaaactatgagtttcactctaaacatcaccatcagaactgttcattaaactgggagtaagatcatggcatcacagaatatttatttttgtatttattatttaatttatttatttgtttgtttattttggacagagtctcactctgtcgcccaggctagaatgcaggagcatgatctcggctcactgcaacctccacctcccaggttcaagtgattcttgtgcctcagcctcaaagtagctgggattgcaggcatgtgccacaaccttggccaaactggctttgaaatcctgacctcaggtgatcttcctgcctctgtctcccaaagtgctgggattacagacgtgaaccatcacgtctggcccatagaatttttaaatggcagaggatcttcaaagttatcggatccaacctttatcctaaagtggaaatctcatgtttaaaatctggcttgaatacttccagtgttggtgggaatgcttttgttcatgtcacctcactggcttttatggatctctaattgatataagtctctgccttcaaactctgcctggagcaaataggtatataaaacatttctgtaatctcagcactttgggtggctgaagcgggagaatcacaggggcaggaggtcgagaccagcctggccaacatggtgaaaccccgtctctactaaaaatacaaaaaattagctgggcatggtggcaggcacctgtaatcccagccactcgggaggctgaggcaggagaatcgcttgaactgaggaggcggaagtggaagtgagccgagatcgtgccactgcattccagcctgggcgacagtgcgagactccatct

SEQ ID NO: 5345 - DNA, 1028 bp, Homo sapiens
ggagtgttcaatgggcttcaggaatgagttgcattcagtgatggaaaatagcaattgctattgatgaagctcccaattattgttgaataacttgaaagagttttaactaggataccactgctctgtcttcaatgaatgatcgtattttcaacagtgatgcaaaagacacactatctgcattttcctactttaaaataataaacatgagattatattataatatggtgttttacacatatttttaaacctggatggggtttttgttgttgttgttccagagttacagttaagagtatcaaacatacgtggcactggtctttaggtcgttattccccctttccccttagaactttggcttgcccaaagatctttttttttttttttggctgctaatgagctggaattattggcttattttgtcctctttttttcattttcactcattggaagcattgagaatgctgcttaagtggccaagaatcaggttataagaagcaaatgcatagaatgttctggactagctttgttgatgaagtgaatataccatgggcatagtttgccaaggtggctcagtccatatcctacaagagaggaagcacatggtaccatggagcttgtattccattcatgatatcgatgggtgccaatgtgaacatttatttctccctctgtgattaagttctttaacattaattaaagaggaattctacttcatattttcctggctcttctaatgcaaactttatcctatagtgtgtcttctcactaaccagaatagcaatacaatggaaatggagtcacctcattaggtgtaacccaagtgttgtggcagcctggtgttgcaggtgatgggttgatgggtgcagcaaacccatggcatgtgtatacctatgtaacaaaactgcacgttctgcacatgtaacccagaacttaaagtaaaaaaaaaaaaaaaaaaaaaagagttcctaatccatcctgtcagttcacttgacatctcctatctgcagtgtctttgacagagttgagtg

SEQ ID NO: 5346 - DNA, 1050 bp, Homo sapiens
actcacggattctctgatggctacttttggatacattcatcactatggccctttctcctggcttagttccctcaaaaattacatttaagttttttgatacaactgcatatgcagacacaaccttggaatgatgtaatttctattttaaaactcctcctgaaagaaggcatttgagttgaagatttcttaaatcatttctacaggtggtttgggtgttattaggttggggcaaaagtgatcatggttttttaatggcaaaaaaaactatcacttttgccccaacctaataattaatgtctaaccggattcaaaatgcattatccaccatactccttctgatttcacaccagtaaaatgcagcaagcgacaggagtccactttgcaaagtcctgctgtagatgacaaggccgggatggtttgataaggtcaggaaaagatgaatcaaatttcaataaaaagatttaataagctggaacagtaccccaaaatttgcagcttcttccataaccccagggcaacgtagatatcaaactggcgaatcgccatttgaattctgaattgattggttgccattaggaaacagttgttatgtgaagggtacaattgataatacagggaaagagccaatgtagaaaaatgactctgagttttgggagcatgaaagttacaaaatccaaacatatattctgcagccagttctagactgctacgtgtttcaccttattccacacaccgttcaggggatgagtccagttcttgattgctacgtgtttcaccttattccacacaccgttcaggggatgagtccagtttcttgattgctacatgtttcaccttattccacacaccgttcaggggatgagccactcattgtctctcacttggaagaggaacagaataatgtctattattcaacatctgacatgaattttgtaaggaaggtgagatcctacccagagctctttggactgttgagaatgaaggcattttgttgatccatgggctgagtctgtatcacaagatgacaaagcaagtgtaatggaatatttc

SEQ ID NO: 5347 - DNA, 1066 bp, Homo sapiens
ttgcatggctacttctatctgctggccctctgaacatccatctcaaaatatgtccgagaaggatgttttgagatattttgatttcctccaccctgtatttgaaaagaggggtgctatgcagtcatctccacaaaaagctactgagccctaggactgagcaggctgagtgaaatcaccttcttttcactgataaagttaggaggtcactgccaagtcttgcttcaggccccgtttcctggctccctcgaatgaaccccctttctgaccttttggctgtgttaagccgcaaatggttatgccttcctggccacggagcctgtctctgcttaatctgacactgctcatatctgcccctattatatagtttatgtagtggcaaattccaaaacaatttaactcccatcttcaacacattttttaaagtaatattgtcatttccaatgtgccaactctggaactatattctaaatatgacatgggctttaacaatggcaacagctatcaatagactataaacttggtttagaaccagagtcagactgccttacttcaaattctcctcttgtatttattagctgtgtgaactcggggaagaaagcttataactttaagactcagttttcccttctgtaaaatgggaataataatgataatgcttacttgatggtgtgaccagtggagaacctgtatgggtctgcagaaactcgatccttgcctcttcaaaggaaagaatttggccaaggggtagaagtgggtttaaggcagcgggagagatacaggcaagttttagagcaggagtcagagttgtttaaaaagctttagggcaggaacaaaaggaagcaaaatacacttgccagaggaccaagtgggtgacttgagagatccagtgccccatccggtccttgactggggttttataccttggcagggtttttgggcttgcatttcttctcccctgattcttccttcggagcgggctgtccgcatgtacagtggcctgtcagcacttggaaggggctgcgtgcgcagtgtgtttactgaagttgtgtgcatgctcacttgaggc

SEQ ID NO: 5348 - DNA, 1070 bp, Homo sapiens
tctttcctactgcccagcaagtcactttccgcactgctccctccagatctccatcagccttttgcacatcagctcttatttgtaattgcatcattgctctgccagtctgcctcttccatgacaacatggtagccttgaggtcatagactatacaccccaccacggtgcctcagatacatagtaagtttataatatatgtttataaaaataaatgcgtaagagatttgcaggccttctttctctgtttctgtctccgtataaggctaatgtgtatctctttaggatgattgagaagttgtctagaatctaaacacattaaatcatgattgcacctaattataaaactcaaggttgattcatgcagattttacttgtaaaatatgtatttttttaattttaaagagttatcatacatttgacaaataaaaggaagtaggcagtagagaaaggcatataaatgaaaattaagtttatctgttatttcaaatctttgggaaataattgaaagcaaaagtcggagtggtgactggaacacattgtacagaaaagtctaaatgatacccgtgatatatttgataatatggaattagcatgtcaagagaattccaaaagcagaatatgagattgctgctgtctctgttagtcaatggccatagtgatcccccaccatgctgatggacggtggcccttctgaaaagggagcccagggtagctatcccagagtcattgtgagatttcatcagggatgtctctaagatacccaccgagatctgagtatattcttttattgctgcagctatctgttctcagttgaggtaatgtgagaaattggctggttgagaaccctcctaagcattgaggatgcttgttataaatgcactcacacacgcatacgaacatacataggaagaaacataatcgatttcttacacagaaacaagtacatatatgaaacacaattgaatttcttctgtttaataggtaaattcctaattttataactaagaaatgacctcatcttatactagccatcagtaaagtcaaagtagcaatattctgttttcaattat

SEQ ID NO: 5349 - DNA, 1363 bp, Homo sapiens
tttcagttctatcagtttttgcttcatgaattttgaacctctgttgttaggtggtcatagagatttcatattaaaataaaatagagtaaacccttcagacaaatagaaacaatagaaatttctgtttatttcttgttaagaagttatcttaaaagcagaatgatctttatacgtagaccatgtggacagtttcttgtgatgtccttagacctgactagtggttctcaaagtttaatgttaaaaatgctataaggttatacacacaaattcatgtatatttcatggatgatttaaggaatgtacaagaataaactttacctgatttttctgttgtggacatactttagaatattacctcctgcaaaagtccacttccataatattttcttttgccttcattctgcttaagaatgtccaattcaaaggttacttcctcagtcaaacttctatgaactgctgttttcctcagtagattaattcaagcttttatagctcttcaaatatatttctgtcatggaacctgaaattctattgtacaggttgcctatctgttatccaaaatgcttcagaccaaaagtgttttgaattcggggtttttttttggattttggaatgtttgcacgttcataatgagatttcttgggggatggggcctaaatccaaacacaaaatttgttgatgttttgtatacaccttacccacatagccagaaaataattttatacaatattttaaataaatggaaatgaagtttgtgttacatccttatgaaacaaagtttgtgttaagtacttatgtgtgaaacaggaaataaagtggaaccttctacttgtgtcctcatgtcagcactcaaaaagttttggattttggagcatttccgatttgggaatttcaaattagggatgctcaacctgcatatcattacctatgagatgcctttggagaataacttaatcatctgtttccacattgtttgtcataccaacctgatgtgtggttaggtacttacaggttatttttaaatgatgaatagatgaatacatgaatataatttttctgctgtcgtcaacagagtggctaggtaatcatgtttttattggctcttgagctcaatgaataattgtggagtcatgatccctagactacttcactcaatacatttttttttctgctgatcaattaggcaggatgtttattatcactgagtgcaataataatccagtcactgaataaatgacattcattatttctctacttttcctggtataagcttcctttctctgttgttgatgggtgcaaagttgcatgaaaatgcctcgcctttgcttccaggatccacaggtgagctactctcagagggtag

SEQ ID NO: 5350 - DNA, 1043 bp, Homo sapiens
tgagaccaacctggctaacacggtgaaaccccgtctctactaaaaatacaaaaattagccgggcgtggtggtgggcacctgtagtcccagctactcgggaggctgaggcaggagaatggcgtgaacccgggaggcggagcttgcagggagcccagatcgcaccactgcactccagcctgggcaacagagcgagactccatctcaaaaaaaaaaaaaaaaaaaaaaaaaaccagagagagaaagaaggaagaaaaggagagagagagggagggagggagaaagaaagaaggtaaattgagacagcactaagtgctatggagagaattaaaggtgagccatgtaatgtggctgaagaattaggttaaattgggtgttcccatggcctaagggggtgacatttaagttagggttaacatggagaggtgagcaggaagagagtttcaaatcatgtgagagctagtcccaatgccgtaaggaggaaatgggattggtgtgtttgaggaactgaggaagggcagctgggagtatggtacatgaaaaagaccgtgacaaagaataagattgggcacatagatggcagttccatcttctcacgttgtatgccaaagtaagaagttcctaatttactgatagcaatgtgaacccaatgagaaacttttaaaagaagaatgaagccatctggttaagtatttaaaagttcattctttgggaggctgaggtgggcagatcacgaggtcaagagattgataccatcctggccaacatggtgaaaccccatctttactaaaaatacaaaaattaaccaggtgtggtggtgggcacctgtaatcccagctactcaggagacggagggaggagaatagcttgaacccaggaaggggaggctgcagtgagccgagcgccactgcaccccagcctggtgacagagcgaaactctgtctcaaaaaaaaaaaaaaaaagttcattctttaagtcatggggcaaatggatcgtaactgggtaagaatggcaacagcaaaaccaattaagaagctgttgcatta

SEQ ID NO: 5351 - DNA, 1068 bp, Homo sapiens
ctacaagcctgttccaaatttcattgttttattcatatttttctttctctgttttctttctatttaaagataggggcaaccaggcataaagtaaacttacctcagggatataatcagcccagatctgatgccaaagcatgtgatttttttttttaactaccccgtgcttgatctaatattttggaaagagcttcagactccagcactcttcaggaaatctaagttcttttcctggatctgcctttattaactgtgcatctggatccaagtcatttttctatgaaactcagtgtcctcacatgtacttttatgatcattttattgctgcatttataagattctacttatgattctatcatctagttgggtttatctctctgtaccttgggtttcttatctgttcagcgggctcaatgcccatagtagtctttatagatagataatataacatttatttcagtcattttttttatgtgtaacaaactccttttaacctagtggattttatctatatttatgtgattttgttgtgcgtaccgtttctgtgtgttagcaatttagacagggcatgttatttcagctccatgatttctaggggctcaggtggaaacgtaaatggctgggaggagatcacttctacaatgatttcctcattcacgtgttttggcattgtggccggggtggacagaacgctgggctcacctgatactctattgactagagcatcaacatgtggccttttcaaaatagcagcgtcaggctagtcagtcacctccatggtcagtggcttccccagagccagtgtcccaagagaatcaagcacaagccccatggcttttctggcatagcctgagaagtcactcagtgtcactttcaccaccacctcctgttggctaccagcaactcataaggtagcctagatctgaagagggaggcaagttagagttcccttcttgatggaggaatggcaaggtcacattggagaagggccggtgggatgagaaagattgagggggaacacctaccttcagaaaacacaatatgctgcaacactaagtaaaatcatga

SEQ ID NO: 5352 - DNA, 1051 bp, Homo sapiens
agagagagaaggaaagagagaaagagagagagaaagaaagagagagagaaagagaaagaaagagagaatgagaaaaaagaaaaaagagagaaaagggaaaggaagaaagaaaaataaaggaagaaagaaagagaaagaaaagaaaagaaaaagaagcattctacaatcagaatgaaaaacagaacaataaccgttgttggagtttattcattcattccgtcagctaaatcagtatgagctctgtagctgatgttgccatggaaaccaggcaggaacagagctgcctggttcctgcctgttccaggctttggatcctgtaaattctaagattttaaaaggatttttgcttatgttagttagtctgctcttgacaaccaaaggcactctaactgattctgagagtaccaagttggaagttagattatctgggttctgacatcagatctgccattcaatgtttgtgtggcctggaattagttgtgtcacctctctgaacatcagctttttcatctgtggaatcaaaattgtttaattgcttgaaccccattgttactatcagttttatgattttgtgagatctattattatagtcaattacaggccttctgtctcttgactatccatggaatcattgtataaatttgcttttccttctacatgaaaaaccaaacatcttattaacatcatgatgaataaattagaatagaaattagatttaaaaagctgagaggcctttgaaggccaaattgtatgcctaaaatgttaagattttattatcctggaaagagatttggtaaccatgtggagcaggatggatttgaaggtaatattccataaagctttttttcctttttttttttaacttttgctatccttttgcagtaaattagcaaacattaattaagtaactactatgtgtttggcacagcaccaggtactgaagatgcaataggatgtggtataaacctctttcgactaagtctggcaacagttaagagagacccaaggaaataacagcctaaagcagggagaattgtgtgtctttctcatg

SEQ ID NO: 5353 - DNA, 1093 bp, Homo sapiens
ataatttgttcctaattttgttctttgtggtgtctttttggcccttatacttatcatacctttatatgccacacccaaaggtccattaactagtgaacttcttgaagataggataatgcctaatcaataccacggctagtatagtgccacattatttgctgcttgataaatatttgccagagaaaattgaacggatgttcatgtgcttgtcaattttttggaacatgagaaagttgtagtagtatttgaaattgatgctattaactggaagtatggggagtgagcgaagaagtgaaaggtggtctttccattgtgggaaagggaggggcaggaactggggcgcatacctgtatctctctacaattttcctgcttgtgaagtatggccccctgctgtaattgacattgttacaccagtattcctagttatatgaagaaatttaaaagcaaaggtgtaacttttaggctgattgtctgttgtctttgaagcctgcaggataatactctgtgaattatcacgttgctaggcaaagttcgttggcgtagaaaagtttccttgtattttgcctcccgtagaagaccatctgaatagtttttccctcctgaatttttgcttgttaaaattcaggcttcagtgatgttcacagagtttctagcccaaatcagttcaattagaacctgcaagggtgtctgttccttgttaggactctaagtggtctgacttgtgtgaccttggtctttactaatagaagcatagaataagaacaagctgtggccacctgggaaaggatgttacattttatgatttcctccttttatctacttaattctgttcctttaaagaccttggtatgcgtgcatgactcctgaaagcttgatgtagctcccaataaatatgtaaccgaattaattgcttttgaaaaggtcaccagtagctttaaacattataaattatgagattcaataagttctgccaataaaaatccctctattacttctcgttcctgaaatgtgtaagacctttagtctagaatggttttctcatttctctcccattcacgtcccatgtcaatttgttttatctacattaagtc

SEQ ID NO: 5354 - DNA, 1087 bp, Homo sapiens
gtgtaggggaactccgctttataaaaccatcagatctcgtgagacttattcactatcacaagaacagcacaggaaagacccgcctccatgattcaatcacctcccactgggtccctcccacaacacatgggaattatgggagctacaattcaagatgagatttgggtggggacacagccaaaccatatcacagggatttaaatgtcataaactctactgatgacctcattgccacttgtcaattacaccctcagaaatggtttctacttttactgaagttcattatgttaaagggcagactgcctttggagctgagactcctgacacatcatgacttttctcagcattgatcagtttagaataattttgtgatgtctatatttgtcattgtccatgggctttttaaatactgcagctagttgtactttgagatttaaggaccgattatttccttatgacacacagaaatctatattctgcaggctttcacaaaagtatgttcagacagagtctttgcagggatttggccctgaaatctagatgtcccttgttgattgtagtgtgtggtgtaggccaccagacagaataagagggctgcaagtggcatgtttatggggctgtgaagtcactttaatgatattcctcttccttgagcagtgtggcataaccagagacttctggaaaattactatagttgggctggcagcagcaagccacagggtgctggcacttgttcagaaagcccaaaagacctgagagaaaaaccctagtttgggccaaatggaaaggagaaggaggagttccgaggttgaatcagactgattcctggggaggtaggtttgatataatctctttgttatggaacaggcagatagtttgtgcagtcaggcttgttggtgggatgacaccactgttcacttccttctcttcccccatccccatttttttgggggtgggaattcttagcggtgtttctgaactaggtttagatggaaggaacggaagtggcgtgtatgtgtaataataagaaacgatctctcatccctttatcagacagagctgaagaagggagtcagtgtgtaggatg

SEQ ID NO: 5355 - DNA, 1041 bp, Homo sapiens
taattttttgtatttttagtagaaacggggtttcactgtgttacccaggatggtctcgatctcctgacctcatgatccacccacctcggcctcccaaagtgctgggattacaggcgtaagccaccgcgcccggccggccgaagccaaagttttaagatgcctgcagctgatcctcccccttcactttgttccactcaccctcctgctgttcctgcaatgtgctaggcctgctctcacctcagggcctctacgctggctgctgtctctgctcagaatactttcccccagataaaccatgaatattacttcctcactttcttcaagtctttgctcagatgtcaacttcctaataagggccccatttaatgtcccattctgcccacagctctggcccagaactcctgatccacagtgctgatgattttctaacatatttgacatctatgaatgtcatagtatttttcttctttactcgatacttctgatatatcatttgcactaactactacatttaaagtatatttttggaagactgagctgttggaaatgccttttagaattgataaaggtaatgcacattgctttagattctattcaaaaggtcagcataagcttgtttctacacttaagtgcagaggtagaaaacttttaagagattacactattgtaagtatcttaaaattgataagtttcaagaggaaaaagaattatagttagatcagtttacttccaaaataactttgccattattttaataaattcacaatttttaatgaggatgctggttcttttgaattgtggcacacttgcagaatgtctctcactccatttccccattgtccttcagcaaacacttacacaacttaacatgctgctctctctaccagttcatcttgacctccataacccttaaccatcatccctaaatattcagggtaacatgctgtgaaaacttcaatcaagaataaatctccttactttgtggactttcaagcaaacactgatgattctatttgaacccctcagtgtcatgacctaagc

SEQ ID NO: 5356 - DNA, 1060 bp, Homo sapiens
gactgtgagcattgcctgggccttgttgctccattgatagagcacaggcagagtggatttagcataattcttaagagtcctaggatttttggaatggtcaatgagcattggcataaacttaaagtcaccagcggcattagcctctaccaagagagtcagcctgtcctttgaagctttgaagccaggcaatgacatctcctctctagctatgaaagtcctaaatggcatctttttccaacagaaggctgtttcatctacaaggaaaatctattatttagtgtaactaccttcatcaattctcttggctagatcttttggaaaacttactgcagcttcttcatcagcatttgctgcttcactttgtacttttatgttacggagatggcttctttccttaaacctcatgaaccaacctctgctagctatcaaattttctcctgtgacttcctcacctctcagccttcataggattgaagagagttagggccttgttctggattagggtttggcttatgagaatgttgtggcgggtttgatcatctatccagaccacaaaaactttctccatatcagcaataaggccgtttcactctcttatcattcgtgtgttcactggagtagcacttttaattttcttcaataacttttcctttgcgtttgcaacttggctgactgtttggcttatcttagctttctacatgcctctctcatgaagcttcatgcttctggcttttgattccaagtgagaaatgtgtgactcttccttttacttaacacttagaggccatggtagcattattaattggcctaaatttaatgttgttgtgtctcagggaatagaggggcccgaggagtgggagagacacagggcaacggctggttggtggagcagtcagaacacatacaacattcatggatgaagttcaccattttaaaggggtgtgggttttggtaccctaaaacaattacaatagtaacatcaaagatcactgatcacagatcaccatcacagatatcataataatgcaaacaagtttgaaacactgtgggaagaattacc

SEQ ID NO: 5357 - DNA, 1092 bp, Homo sapiens
tccatatcaaacattggaagcttgaaatcagcttccaaacgtgcaaatacttttgtttgtatttaccccagggaaatcagcaaacactacaaatcagtgcttgattgattattttattagctgtcaagacttcagaaagtgatggagaaaatgttaacattgcaaatataaacttaaaagtgcattaatgcctttcactattacatattactttacataatagtaaacacatatattattctgtatctgaaaactattaaatgatctgattcagcaacaaaaaagtggctcacatcattgataaacaaatggaattttgacattcatcttctgaaaaattgaagaaaaggggacacttctaaactcagtttatgaggccagcattaacccaatacaaaaactagataaagatataacaaaaaaagaaaactacaggccaatatctatgataaatatggatgcaaaaattctcaaaacaatactagtaaaccgtcttcaccaggtcattaaaaggatcatacaccaggaccaagtgggatttgtcgttgggatgcaagaatgcctcaccacatgtttggtattgtgaaatacttacatttggtcttccatcagtctcctgaatacagctcctcaaatccgggaatctccaaagtattaagtatctctttatgctaatgagttgactgattactggctaccctatgtagcttcaggatgtggggactggtcactggaaagaccaaggcatgattagaaggtagggactttcagccccatccttgctcccccacctccagggagaggagaagggctaaaggttgagctggtcttcagtggccggtgatttagtcaatcatgactgtgtaacagcactctccccaaacccccaaaacctgggttcagagagaggtgaacacttggaggttcctggagggtggcatgcctgcagagggcatggaaacactatctctaggtagatagtggcaggactgtactggaggacagctagtgtctgctcaagaattgattgcttgcttgatgtgtggggaagaaccccccgcaatgagtgtcagaagcatgttatgaaagtag

SEQ ID NO: 5358 - DNA, 1106 bp, Homo sapiens
gacttctgtgtctgtccaaataatttaggtacattgtgactctgtggaattggagttgggttgcatttcaggatagatgtgagtctgcaggttgactggaatcagaacctcagggtatcaggacctcggacagctctcgcgtctgttctccgttggcagctctgcttctctccaggcatcttcatctgcctgttttctactgattagctttccccctctactttgtctcttggactcgttcatatcattgacttacagtagttcattcttctgatttcctagtccagagttttgagattcaaatctgattgcccagtttatcctttaatacttgggcagaggtttgccactggcttgtgtgtgcatgggctgattctgactgaagatttacttcttattcctacaacggggtcagggaggaaggagaagactgcagttgtaagcctcctcctcttaggcctccacaggcgctgacaggcgcctctctagcttaaaggaagtagactgtatcttgcaaacatacatcacaatttaaatgaaaaaaattgtcacaacattcattggtatttaaaacattgcatattatttagaacttgatatattcattggcacttatagccacaaaaacatattatcaagaaattttctattatcacaaaatcagatgccttcatgttttctctcttatttttaagggaaaatatcaaagcagtttggggagtttgcagtgtatgataataaatatgatatttaaacgatgaaactaaatggtgaaaatctcttgttttttattttctgccttaataagatttatatttgtgttttttactgttagtagaatttagaaattattttatttcctggccctaccaatttgatttgtgtccttcagagtattcttagattacagtataaaaattcaaagtctgagcaatattcatgatcctatttttatttgtcctttatgtgagaattcatgaattacagtacctgtattttacattttgttaaaaaaaatcttgtggaaaaggtaaggctattggtgatatgactgtatagcacttaagcactccatgatctaaaagtatttccaaactaacatcttc

SEQ ID NO: 5359 - DNA, 1034 bp, Homo sapiens
catttatatatattcttcggacaatctatcagctttaaaaggcaggtcggattgtccgcactttaggaagggctttggcctatggactatacaaccactaagatttctgtctaaccaaaactctgttgtttttgttgaaacttctgagctagctttttgatcatggggaggtttttaaagtctgtgtaaattttgtaattgctttttacatttacttattagctcactatccgctgaggaaagatgaactgagctccaaaggctaatttgtaatttcattagcaattgaaataatctcatggaggttttttctcttcttgtagcaccatttgaccttattagagtgactgatgttactttcatttactgagatctccttcattccactggacgttaaaatagcacgtgctaaatctctgcctgggggtaatatttttagctgctggtgtgctgatgggcctaatattttcctattcctgcctttatagtgagatttttatgatattcgctctttctcataggactgttatttctagctgactaatatccaggcagtataagacttgaagagtaccagagaccaggtgtggtggttcatgcctgtaatcccagcactttggaaggctgaggtggacagatttcttgaggtcaggagtttgagaccagcctggccaacatggtgaaaccccatctttactaaaaatacaaaattagacaggtgtggtggtacgggcctgtaatttcagccactccggagggtgaagcagaagaactgcttgaaccagggtggcagaggttgcagtgagctgagattgcaccactgcactccagcctgggtgacagtgagaccctgtctcaaaaaaaaaaaaaaaaaaaaaaaagagttgaagagtgtctacttgtacctgtgtggatttgaatccaggctctctcgctaaccagctgtataaattggtcaagttactaaacctcttcaaggctcacgttccctgtctgcaaactggggtaataatagtacctgcgtcttagagttg

SEQ ID NO: 5360 - DNA, 1051 bp, Homo sapiens
agatcatttagaagcccagttgacatgatttcctccatttactcattggtagaagatgtcaagaacaatacaaatctacatgaccttcattgtccacacaaagctctccatgtcagccaaactggtttcatagaaattttttcctctagtacagaaatctgtggacattttttcattgttaatgcttaagatggtgtatgccaagggattttgaagaaaatttggtaccatgtagagagaatagattcatactaatatggctattaacacataattaatattattacaatgttttttctctttgaacttttctaggtgcattcgctctggaaatcaatgtcatttgtcactggttctaaattttatatttggtattttgtttttaggcttttggttgattgttaattattgagtgtttacttactgtgtgccaggtccattatgtatatgacttgttttctttaaaataatcttccatattggttattagtattctatttttctaaaaataaaaagctgaaaggcaacttacgcagactgagtgacctcccaagactagtggcagaactgtcgagctctgtgaggctggaaacacctgtttttcactgcagtgtctcaggacctagaacaatggcacaaaataggtgtcctcgaatattggttgcatagatgcatgaatgaatgaataaaatagtgaatgaatgcctggtccaaagtccctactcttgcctctttactgtgttgctctctagataaatgagtgaatggacaggacattcgaattcaagtccattcattacatatgcattggccttggctgtgtatggggcagctatgtgtatggtaagtgctgaagatagagttttggacagtgcagataggtctgaaccatcgcggagcttatttaccatggcaaacacagatgccaagcacctcatcataggatgattaataccatgaaagaggaagaactgactgatataaattatttatttttggttttctggtttctaaaataaatactatgttaacctctattttctgttgacag

SEQ ID NO: 5361 - DNA, 1035 bp, Homo sapiens
tctttctttttcagcaaggggatcagagctgattatgaataaagatgaaagactatgtgctactttaacctgcactaaatcaaaacttttcatccgtgtagcccagaatcattaaaaggtagtgatgaatatgtgtttgagggaatattgctatggctttaatggaaagatgcacaggcgtcctggtacaatgctagctgttttattctctagcctgggcgaacagtactatactgtgtacctatgaatgcatttatatgtgtctgagataaaacagtatgatgggaaagataaatcagaacttagctttctatgttagtcttaaagcattccaactgcataaatcaggaaaataatctacttgagtttaaattattagtattgtatttttaagttaattgaaataactggatacctgtctattctatttagagttggttttgagaagaaatattttggggggagttcggtggtttcaaataagtcataatattttgtgtttggtaagactctgagtattgtaatatgcaagctgtgagaattttgaattctatcttatgggtgtatacaatgtgaagagttagacttttggttggaaaattatagtagtaagctatttccgttaggctaaacaattgtattccctctctgtttccctttaaaagattaaggactgagtagattggacacctaatagttatcttcattagaaataaactaaatatgcagcaactagtgtgtgtcattcagtcagttattatgagaacaaaaaaagaaaaaataagaagacagggctttcagaaatagttatttgactgtttagtgtacctgagcctcatattggtaattttgggtttactctacacagtgttgtatagcatcgaatcgccattaattttacttttaagttaacagactgtaatgatttcaggaagagaatgtactacctcattttttaaagcatgattattttgttgattaagctgggaactgcttgtgctactcatttttcccttcttttattagctttttgct

SEQ ID NO: 5362 - DNA, 1029 bp, Homo sapiens
gagagaacaatggctctcccccaggatcaaccctctactcttcctttttcactggaatgttgcctccttaaatttccaattatatctcttcagtcctgtgagactttcacactctctggtttctgtcctccagctgtggccctccgcctgggaaaagttcacattctcagcctcttagtttgcaagtagagttgacaaacatcctcagttgcaaagtaaagctgccaaacatcagcttacctttctgcagtttttttactttccagaatcttggtttctttaatgtctgctcgttttgttactggaaagggctcccaatccagaccctgagacagggttcttggatcttatgcaagaaaaaatttgaggcgagtccacagagtaaagtgaaagcaagtttattaagaaagtaaatgaatatcctggctaacatggtggaaccccgtctctactaaaaatacaaaaaaattagccaggcctggtggcggaagcctgtagtcccagctactcgggaggctgaggcagtagaatggagtgaacccaggaggcggagcttgcaatcagccaagatggcgccactgcactccagtctgggtgacagagcgagactccgtctccaaaaacaaagagacaaacaaacaaaagaaaataaatgaataaaagaatggctactccataggcagagcagcctcaaaggctgctggctgtccatttttgtgattgtttcttgattatatacaagaaataaaaataataaataataaacaaggtgtggattattcatgattcccctttttagaccatatagggtaacttcctgacgttgccatggcagttaccatggcgttaccatggcagttgccatggtaaactgtcatggcactggtaggagtgtagcagtgaggatgaccagaggtcactctcgtcaccatcttggttttggtggattttggcgggcttctttcctgcaacctgttttatcagcaaggtctttatgagctgttatcttgtggcaacctcctgtctcat

SEQ ID NO: 5363 - DNA, 1052 bp, Homo sapiens
agaacttcctcaaacaaataagacgtatctaaccttatcagcaatgttgatgggtgaggaatattttcgaggctagaatatcaggaaaggagattgagatgacccacttccaattctgggcctttatttttatatttcttcctggcatctgacaaattacagaagtaagatgcagtgaacttgaaatgagtccagagaggtacaacagtggtgaccaaaaaggtgcaagtgttagtccgttagggtccagatttcaagaaattgaattaatttgtccagatgagaagactgaagaggcatttaattacagccattgaggagtgaaaagattttgtcaagggaagtagaacatctgttcaccctattcaatgaggccaggacaaaggggaaatgacttataattcagcaagatgctaattaaatactaaaaatctctggtcatgtatatgagctttgaagtgatgggaagtatgtctgaagatattttctttagaaaatacagacaatgtagatatggaaatggattaagtgaattctagaaatctttttgatcctttggaaagcttttatattgacattatctcacaaacttcctatcttttctgtgagaaaaatgacaggctctaattccttcaacacattccaccaacacacacacacacacacacacacacacacacacagaaaggaagctaaaaccaaaccaaatgactgatatttaagatttatatcagttatgaatatatttgcttatagggcagcaaaatatgtgactccagttgatatggtttggatttgtgtcctcacccaaatcttatgtctaattgtaatccccaatatcggaggaggggcctggtggggggtgatggatttctctcttgctgttgtcataatagtgagtgagttctcatgagatctgcttgtttaaaagtgtgtagctcctcccgcttcgctctcttcctcctgctccacccacggaggatgaatctccttccccttggccttccgccatgcctcctcagccatgcttcctgtacagcctgcagaaccgt

SEQ ID NO: 5364 - DNA, 1034 bp, Homo sapiens
tagacacgtccaggcgcagtggctcacggctgtaatcccagcactttgggaggccgaggggggcggatcacgaggtcaggagatcgagaccatcctggctaacatggtgaaagcccgtctctactaaaaaaatacaaaaaattagctgggcgtggtggcaggcgcctgtaatcccagctacatgggaggctgaggcaggagaatggcgtgaacccgggaggcggagcttgcagtgagccgagatcgtgccactgcactccagtctgggcgacagagccagactccgtctcaaaggaaaaaaaaaaaatgagaaagggatagacacccatttttgcagactccacaagccagttatctctgaaggctggacagtctgtggacagctgctgtgtgcagacagcagcacaggaaaaggaagacagaggagagggagtagaggatggtaagtgacagacacatggatccagggaagaagaagagaagcagtgaaaagagagataaagaggaaaatgagacatccgcaatgctgagagttgatgtcatttgtttccagagctcctaatcgactcaaaaacttctcggtataggccaaaatcctcatgacacttttttttcccctatctttcctactcacaaatctcaacatttgtctttgaaaggtactcatctacttctcaaatattgtacttacagatagaagtcttcagaacctgcatactattttgtgtctcagccaccaaaaaaaaaaaaaaaaaaaattatggagagtaattgggcaaattgagggtatgaacgccagaagaaacaatgtattttgacaagaaaaattggttggcaaacgttaaggtttttatgagtaatcacaatgattctttaagtaattataatttgttccacactctgtcacagttgttttgattgtggctttttattagtgaataaagttatttagttgtccttatttttaggaatagattcacagtattgaaatatttcaaataccaatgatgttaaatttcttgaatattttccct

SEQ ID NO: 5365 - DNA, 1056 bp, Homo sapiens
gaaatgcttagactttaaagccattattaaaataaaagtactggatatatattgatctcaagagtttaacatgcaaattctttctcaaagcatttctgctttaagaaagatgcccttttcagtaaatggcatcaataaatgccctttcagatcaataaatgcccttttcaacatatttagcattcacaaattcagttaagtaataaaagtaactatgcccatgctttcttttatagctgattaataattgcatattgacacatgccatcttattgatgatgtatactgcctcagcaagcttcttccttttggtcatatttctctgatcttgttttttttctcccgcattggtttcattttcattcctgctttttcttcttgacatatatatatatatatatatatatatatatatatatatatatatatatgttaagacagcttgcagaactgccctgcccccacttttattaatttgaaaagcaaataactctgaagtaaacagtatgcctgtgatcttttgtgcagtctgtatttctgcccagactccctatttgtgtccctgtaatgtctgggaggaggccagggtatagaagccattgcagtggagagccacatagagaagagccattggaagcagctctggaggcacccctccccaggccctgcctgcgcctgcctcactgcgaggacttctcccctctcagagccactcaccacagttgccagacgtgcagtgctttattttctgctggactggagcatttagcttgttaatgtttctttagaaagataattgtttctagttaaacatgttgtttgaaaaatatacccagatgtatatttttatgtcgtggtgctataatttctacttttttccccttcaaaatatctaagttactggaaaatttcaacttaggaacaaatctgttggagaaagtgaggtatgtttaagtgtttatttcttaaggaaagtaaatgttctacataaaaaatgattattgagataatcactgttaactaatttaaaaacaaaaaatgtcatttaagaggccc

SEQ ID NO: 5366 - DNA, 1053 bp, Homo sapiens
tatgatacctttggtgaactaaaggtgccaaatgataagtattatggcgcccagaccgtgagatctacgatgaactttaagattggaggtgtgacagaacgcatgccagtaagtggcatttgtggaaatgttggctattttggatgaagtaggctgtattcatgagtcactttactttataaatatttttcagagttaaaatgtaaagttattagaaaagatggcttcgtgagtaataagaggttctctttcactaaaatgttaaagaactttttgaagttttagcatgctattattttgagccatcgctttgaatattttggattttttaaaatttaaggccgggcacggtggcttatgcctgtaatcccagaactttgggaggccaaggtgggcagatcacgaggtcaagagatcgagaccatcctggccaacatggtgaaactctgtctctactaaaaatacaaaaattagccgggcacggtggcgcgcgcctgtagtcccaattactctggaggctgagacaggagaattgcttgaacccgggaggcggaggttgcagtgagctgagatcgcaccactgcactccagcctggcgacagagtgagactccgtctcaaaaaaaaaaaaattaatttaattttaagttccgggatacacatgcaggatatgcagttttgttgcataggtaaatgtgtgccatggtggtttgctgcacctctcaacccatcacctagatattaaaacccggcattagctattttttctgctgctccccctccgcccacaggcccctgtgtgctttgttcccctccttgtgtccatatgttctcattgttcagctcccacttacaagtgagaacatgcgggtttggttttctgttcctctgttagtatgctgagggtcacagcttctagctccatccatatctctgcaaaggacatgatctcattcttttttatggttgcataatattccatggtggatatatacaactttttctttatcctttattgatggacatttgggttgatttcatgtctttgctattg

SEQ ID NO: 5367 - DNA, 1055 bp, Homo sapiens
atatgcatatccataagggtttgtactcttaggcaaatttataaagcgatcgtgtataaatgatataaaaaatcaatttgaatggtattcaaatttcctaatattaaaaatgcaactttgacttagttcatgctattgtattagcaaaactgttttaattgcatgtgtccttatagcagcagcattgtgtattagtagccttttaagagaactgtgtagaagactataaaaagggctttataactgatcttttgacatactcactttgagtggcatatgcccaggaaaatatttaaaagaaagaaaagctatttgtacaaagttttctagcagttccactcagataactttaagggggaaaaaagcccaacgattggaaatggttaagtaaattttggtgtattgctagtgctatcacagaatgttatatagccattcaataatattgatatatgtcaaattgtatgcaaaaaagtgagattcaaaaatgttaataagaacataaattgtgtttactgatacatgtgaaaatttaggtctacattgaaaagaatcagaagataacatgtaattcagtttaacattaggggttctttatttttcttctgttaaatattgatgtatgcaataaaaaataaaagattaattggtaaagtggtttactgaactggtgagaaaattactgatttcttagaagtttctaaaattctattttaaattaaaatatacatttctaggtgttaaagtcaaaaaagatcatcttcagatatgtgtggcagaaagttttacaaatcttggtggggaggaattcttggtcaagatggacttcataatttattttttcttagttgatcaccattaaggaatagtaatagaaatattagtaatacattctaggacatcagcatgaagacgtcatatactaattaaagtatgcccctaaatgcaaacatgtcacttgggaatcttaaaaaccgtggagatgaaagttggattcatagatgtgaccgaacctggtttgcagagagacctgtgcgaaggccagatcttggggg

SEQ ID NO: 5368 - DNA, 1029 bp, Homo sapiens
gttccatgtggctggggaggcctcacaatcatggtggaaggtgaaaggcacgtcttacatggcggtggacaagagagaatgagaactaagtgaaaagggaaacccttttaaaaccatcagatatcgtgagacttatttactaccatgagaacagtatgggggaaacaactccatgattcagttatctcccaccaggttcctcccacaacacgtgggaattataggagctacaattcaagatgagatttgagtgggaacacagccaaaccatatcaccttcaaagaagaaataagagaattattagtaatttgctcagaatctggtatgtggaagagccaacatggggacccagccttttgtgattctaaaacctttgatctttctactaacattcactgttagagagtgtaggcgctgcaggagaaagagaaagtgcccacgaaaattagtctagcattgccgggggtaaaaagcacacactggtcctgcagcttattgaatcagagaaatgtgaagataagatgaactaaacaaacatattttagagcatggatctcgaagcagaatttggctaaattttaacaaaatgttcttcagtaacacatctcatgatctgaagattgtgttacaaaaaatattatcaggccaaaatttgttcggaatacactaatttttgctcctctatatgtgaggaaaatgagactagacagatttaagtaattgacaacttacttaaagtagcaaagtcatggattgtattgacttttaaaaatatagtaaaagtcatatttaaactttatcctaaagtttaaatctaacagaacaactgaaatacttgaaatagacctataaaatagtaattaaaatgagaaatacataagatgataaataaaatgaaggtgaaggtattccagatctaccgaaaagattttcagtatcacagattattcataagaaattgagaaaaggaacaatcagaagttgcaaaagatggtatagccgaatataatggaaataggaaaaattag

SEQ ID NO: 5369 - DNA, 1049 bp, Homo sapiens
gttctgcatattgattcaagaagctactatggaggaaactgggctagtttcagcttttcaggattgctatcctggttgaaggagtatcagcaaaacaatgacattggggaagaaagtactgttgtatggcaggacctgatccatgaaacagaagaagccatcactcttcgcaagaaggatgaaactattcaacacacagaagctttttgctacgccagtcaggatatggaggacaacgttgaagagattggtgctctgcagaaaaatccttctttgggggtgtctaataccttcactgaagttctggattctgcattacctgaagaaagccagttatcgtattttaatagcgacgaaatgcctgcaaaacacactcagaaaagtgatacagagatttcactagaagtaactgatgtagaggaatcagtggagaaggaaaagtattgtggagataaaacttgtatgcacacagtttcagataaagatggagataaagatgaaagcaaatctacagtagaagataaggccgatgaaccaattagaaataggattacttactctcaaatagttaaagaaggcaggaggtttaatattgatttggtgtcaaaactgctgtattctcaaggattgctaattgatcttttaatcaaatcagatgttagtcgttatgtagaatttaaaaatgtcactaggattcttgcatttcgggaaggaaaggtagaacaagttccttgttccagagcagatgtctttaatagcaaggaactcaccatggttgaaaagaggatgctaatgaaatttctcacattttgtttagagtatgaacaacatcctgatgaataccaagctttcaggcagtgttcattttcagaatacttaaaaactaaaaaactaactcccaaccttcaacattttgtactgcactcaattgcaatgacatcagaatcatcttgcactacaatagatggtcttaacgcaactaaaaacttccttcagtgtctcggacggtttggcaacaccccctttttatttcccttgtatggccaagg

SEQ ID NO: 5370 - DNA, 1064 bp, Homo sapiens
gaggtcaggaggtcgagaccagcctggccaacatggtgaaaccctgtctctagtaaaaacacaaaaattagccaggcatggtggtgtatgcgtgtcatcccagctactcagaaggctgagacaggagctgctggacccttgaaggggaagttccagtgagctgaaattgtgccactgcactctggcctggggaagtctgtctcaaaaaataaaaaattcttacaattatttttcatgcacaccactgacatttatttgtaaattatgttcatatattactgaattaaaattatataaacatcataaaacagacaacaataaaataatgagataataatttaaaggaaagaaaacttctagagttttctacccccatttgatggatcatcttgcataccccctggagtatattcgccctgctttgcagacctcacaggacatgggctgtctcctgatacagtttcaagaaagaacaagcactctttggctcttcttatgagagccccagtaaaaagaagaggtgggatgggcagacttctatagggccctgccataaagtggatggagcaggacagggccgactggtaaagttgacttagaatatactgtggacgtgaggtcaggagacctagattctggctgtgttctgttgctaaatatatgactttagaaaagtcacttaatcttgctgagctacagtgtctccacttatgaaatcaagggttgactatgacctaaatagtttcttccattcttaaaatcttagatattgtccttcccctatacctgcagctggggcaggggtcatgcagggcaactgtgcagcctttgtggatggcgtcccagagctgtggggggcacagcctgcacagcctatcgcagtggtccctggttggggtagacatacatgaataagcactctcataattcatcatactttctgagcagcaatgcacctagatgaggaggaagaaccaaaatcagaacaggctggtgggtggtgagagatcttgatttctggattctttgaaggttgctggctataaaattttgtattggaaagg

SEQ ID NO: 5371 - DNA, 1093 bp, Homo sapiens
aaaaaaaaaagtatgaactgaaatgattttaggttcagaatgtttctgaaagcagagacatatttttaaaaaaacaaacagaaataggatacactgaaattggagttaacggtggaattagtactaacttactttttcacgttgaacatgacctcccttcttctttcctgtaatgccatctgaagagtccttttgggcttctacgccaatcagtggaagaaatcttagactagtggggcttgatatctggaagccataaattagtcagtgagacacactcaaagtgattacttctgtaatatgaattcaggagttgggatgaggagtgagaaggcccagctgcttcaaaatacacaccccccttcttcccagttgctcagcattaaatctttattttattttattttttatttttaaaatagagacagggccccattatgttgcccaggctggtctcaaatttctgggctcaagcagtccccttgcctctgcctcccaaaatcccagggttacaggtgtgagacactgcattccgtctacctcttagaaattcactactaaatcttgatagttcaccctttagcatcatctgttagcttaagtatttgatacctgttacaacatgttcttaggaaagataacatctaagatataagttaatttgaaatatttggtctctggcttattatttcttgggttaattaattagttgtctaacaaaggttacctggggtggagacttgaaggatgagtagggattttgagggaaacaagaaatgaatgaattctgggcaggggggcagcacgggcacagtttcagaggtattagagagaccagtgatgcttagggcacggaaagtaatttcatgtggttggaatataggcagagtatgaggaaaaggtggtgaaaaaagagggtggatcctggaggttttataagccaagcaagggcatttggattttaccctgtagttgacaagccaacagagtaacgttcaaaataaccaccacgtggtatggcagagacaagggacccggtcattgacacacacagtccaagacttttctgggactgcacatgatacgtttttgg

SEQ ID NO: 5372 - DNA, 1067 bp, Homo sapiens
ttcaccccagaaagttctttcataccccttctaaatctctaaatctctctgtgatatttgccctctcttccagaggccaccattgttttaattttttaaactgagtgttagtctttcctgttgtagaattttataaacgtggaatcatacaacatgtattctttctgtaaagtttttttgacttaacatattcttgagattggtctatgttaatgcatgcattagcattttattccctttaattgctgaggattccattgtcctaccctaccatagtttgtttagtcattcttctgttgtggaaactaggctttttccttttttgagttattattaataactttataaaacttttataaagattcttgtttattttcttaaagtgtattttaatattaatatggctatattgattttctttaggttagtttttgcatcatacatcttttttcattcttttatctttaagagtttggtgtccttgtatgttagatgtgtttcttgtaaacaacatatagttggattttgtttttttaatccattctgacaaccttttaaacttgcatactttaacctattaaaggtttcataattattgatatatttaaggttaaatctaccatgttactatgctttttctatttctatgacccatttttcttcctttctttgccgtcttttatatttatctggagtcaggtctggactacatagaaataatttctgactttgagaaacttaggacattttcttccagataatatttctctaaatgaagaagacaaacatctagagatctgactggtacatttttctttttaataattctttttgtacaacacatagcatgacttgaaagtgccttttactgcacatgttctgacagtcattcttgctgtggagtaaggtgaccaatgggaggaagtggaaagctaaacattgataaccatattattttagacctactaatgctgttgatttcatttgttttcttatgtgtcagtttgctgacagtaaataagaaacaccgcctaaacttctggctgcttgctgcttgcttggtattc

SEQ ID NO: 5373 - DNA, 1121 bp, Homo sapiens
gtacaccaatcaagtgtagatttggtcttttcacatagtcctggatttcctgcaggcctttttcattccttttcattcttttttctcgctttatttcattaagttgatctttaatctctcatatcctttattccccttgatcgatttggctactaatactcatgtatgcttcacgaagttctcacgctgtgtttttcagctccatcgggtcatttacattcttctctaaactggttattctagttaccaatttgtctaaccttttttcaagattcttagcttccttgcattgggttagaacatgctcctttagctcagaggagtttgttattacccaccttctgaagcctacttatgtcaattcatcaaactcattctccatcccattttgttcccttgctgttgaggagttgtgatcctttggagaagaggtgttctgggatttggaatacttagtatttttgcactggtttctccccatcttcatggatttatctacctttggtttttgttggtggtgatcttctgatggggttttgagtggatatgctattcctttttgttagttttccttctaacaggcccctctgctgtgggtctgctggagtttgttagcggtccactccagaccctgtttgcctaggttatcactagcggaggctgcagaacagcaaagattgctgcctgttcttttttcttgaatcttcatcccagaggggcacatgccagatgccagttggagctctaatgcatgaggtgtctgttggccccacctgggagttgtcttccagtcagaatacatgagagtcaaggactaacttgaagaggcagcctgacctttagcaaagctcaaacctgtgctgagaggtctgttgctctcttcagagccattgggcaggggcgtttaagtctgttgaagctgtgcccacagccaccccttccccctggtgctctgtcccagagagatgagggttttatctataagtccctgactggggctgctgcctttttttcagagatgcccttcccagagaggagatatctagaaaggcagtctggccatagcagcctagctgagctgcggtgggctccacccagttcgaacttcctggctgctttgt

SEQ ID NO: 5374 - DNA, 1060 bp, Homo sapiens
tataataacacagattctgcaacatggcagcagcttgggattctgtggagactacattgtgatttgagtgttaattaacgcatttgtagctggcagcataatacaaacatccttctctctcgacagaatcattgcaacaacaccatcttgtcttcctgaaaacctatgctttgaaaatagcctgggaaagtcagcaccagagtagtcattggaaagcacctaggaagaaaaatacagccttatgatggatttgtgaagaaaaattctcatgataaaagcttcatttctctccaggacacagtgagggaccccatagatgagagcaatgcaagtgcattgtgctgggacttactgagttgtgataactgacgaggtttctattctgccggcagaagtggacttggaacatgggaagtctagaagctggaacacaagataggttagagcaccaataatacatgcagaaagatggaatagctaaaggtttataatgaacatataaatggcaagtgtatatatgggcgatcacaatagcatttcagcacatagagactgggtgaagatattatagttctagatgctggataagctttaacctggtaggttgttagaaatcattggtcagcacaaaggatagctcagggaatgtgtacatttgttatcaattaagccattttatctaaatgcagacagttgattagcacttatttcacctatttcaagaagtgggcaccagcccaatggtaaaagaccagtaattcgcatccagcctgggcccccagtgtcagagcctgaatctttgcaccggactcaccgtgttggtccctgccatgtgtcccagatgggtttgtagaccttgtggaaggcgatttggtaacttgctgcccgtgcacttttgggctcagtagtgacaaaggatcagtggaaatcccctgtctggaggccttgctagcttgttcctggatcccagcagagggggccctgtactccttttgaaagaggaatacttatttatagattttatggaaaattatgagattctcaagagttgccagtctga

SEQ ID NO: 5375 - DNA, 1084 bp, Homo sapiens
aggctgaggtgggagggtcacttgagcccaggagttcgagtccagcctgggaaaagtgtgagtccctgtctctaaaaaataataataatacttgaaggggtatacatcatcccatttctgtaaacaaagaaagtccccaaatatgtaggagcacacagatgtgcgtgtatacagatgtgggtggaaaagagtctggaaagatacacaccaaacacagtgtgttcacagtgatcacctgtggaagagggagcagagttagggcaaaggagggcttcctatttctattctagaggcatcacattgcttaaatgtatttctttgttagtgtacagtgtgcacatatatttaaatatagctatatttgaagagtcacttaattgtaatcaatatattgtgaatagcagaagcatttagtatatatgtgtgtgtacatgtatatgtacatgtgtatgcatttatatatgtgtgtatatacattttgtgtgtgtgtgtaagacaccatgatagaactatacttgcaatgagaaatatttagggcctgatcatgtagatagagggcccatcatcaaatacctttctgatgtcttgagcccctaaatagtaagtgccacagtaatgccgatccgagcctgcacctgcagggtatcggttgtaaaatggagttgggatgattccaccttccccacagggcactactcccgacccaccataatgtaccgacagcgcgtgagggcaagattccacaggaattcctgcatactttcaccatgtgtaaacacagacactacattttcagttttgttaatgaaaattcaaaggttttatttaccttctagctgttgtttttaaatatgaaagtcaaattcattttaattcacttgcatctgtctaggtaacatttttgccttttaccaatcctcaccccaaaccaaaccaatatcgacaaaaatagttcagatcattttcacaacctatagtatcttattctccacctcaaagcctgcctggttctcatttaatttatttccgtccatcccccttacataagacaaatgttcatgacccctcttctcttcagcccctc

SEQ ID NO: 5376 - DNA, 1031 bp, Homo sapiens
atgaatctcaaataagttatgttgaatagagtgggaaaaaaagaaaagtattctaagtagaaggaacagagtgaacaaagatacagagtcagaaagaagcatggggtgttggaagatctgtgagcagcttcttgcaggagcaaagcatcccagttgtaaagccttagaacatagaactggaaaaggcaagaataagcttgggaccaatgcagatgcccagggtaggatgtggagtcagacctacaggccaagggggaactaccgaagacctgtaatcagagccaggacctgacagcactggaacaaagctagagaaagtgcccaggtgagcagtggggaaagcggggagcgggctgatggccatgattaaggagggagtggcagggctgaattatgagggtgtgaaggttaatttaatgagtcaacttggctgggctccggtgcccagttgtttggtcaatcatgagtctagatgttgttggggaggtattttctagatgtgattcacattgacatcagtaggttttgagtaaagtaggctctgctccatattgtgtgtaggcttcatccaatcaattgaagtggagtttcccaaacaagagtggggtttcccaaagaagaaggaattctcctcaagactgcaacatatagaaaccctgccttagtttccaccctgcctgctctgccctgcagattttgaacttacagcccccacaatcatatgtgccaattccttaagataaatctcataaatctctctttctctgcatggatctgcttatatgcactttttttcaataaaaattacactgaatatgcctgcttctccttcctccacctcttctacctctgccattcctgaggcaggaatgccaacccatcctcttcctcctcctcctgagcttattcaatgtgaagacaatgaggatgaagatctttatgatgatccacttccacttaatgaatagtaaatatattttcccttatgattttcttaataccattctcttttctctagcttactttattat

SEQ ID NO: 5377 - DNA, 1035 bp, Homo sapiens
acgcaaatttttttctgtcctgttctgctaggggaatcatataaaaacagtcttttaagtcaataacaattataggccaattgtgaggaatcaccacgggggaagggagcccctgctgaaggggtttcataggttgcaaattggcattaatagcatgtaagtcatgcaaaagtctccatttaccagactttttgggaatgacaaaaatgggcgaattccaaggactatttgatggttctacatgtccagcttttaattgctctttatctaattcatgggctttctgtaatttctctcccttcaaaggcaactgttctacccaaatcagatcttgaaagagccacgtcaggggtaggagagagataacggtggccattatcagaaagaggttttttaaatttttaaattttactcaaatcttagcatagaattacaatctgggatgtcgcttgtacataaggagcacacaaaattttgccacaggccggagagctggagagctgagcaggcaggccccagggcggcagccactttgcacctgcttaggcgctgtgctttgtctgtgctgcttctttctgtactgctccttcctccaccccgctgcctggcggctgctgcctgctgcacaaaccttcctgcatgtgcctcctgcccatccccagcaggctagcttctgcatgctgggcctggctcctcattgcgttgctactatgcaggtcgagttcctgggagcatctgttggctccaggtctgcaagcctccctgctgctgagcctttccttctgcccaccgctcgcatggtcgcgcagctctggtctttaatgttttttcgtatttttaaataagcgttaaaagaaatgggtttatacatctgattgccttgttgatcttgcattactgggcaggcaaagagctccccttttaatgctgcttgcttaagacagggtctcttcgctgtagcatatcccctgtcctttttcctatctactggaggagggggcttaggcaaaacctccgtttccccttttttatttt

SEQ ID NO: 5378 - DNA, 1050 bp, Homo sapiens
tcctctctaccttggtgcatctccaaggcattcctctccagacaccctgtgtcatctcttcaacagctcaggatttgggaagacaaaatactatatagaaatggaagtgcactttggaaggccgaggcgggcgggtcatgagatcaagagatcgagaccatcctggccaacatggtgaaaccatatctctactaaaaatacaaatattagctgggcatggtggcacgcacctgtagtccaagtaggctacaggaggctgaggcagaagaatcgcttgaaccatggagatggaggttgcagtgagccatgagcactgcactgcactccagcctgggtgacagagcaagactccgtctcaaaaaagaaaaaaaaataagaaatggaagtggcttgtgcacagtctccgcttttagccctggatgaaaactgtcttgaggtcctgtcttctttcagatgaagaaatgaaggaaatatgtatcttagtaaattatcctgcatgttttgagagattcaaacatagaaagttaaggaatgtgtgtacaggaaatatttaaatagaaaatagattagctacaaaggaatgtgtgtacaggaaataacaataactacagttgcagaaaatagcatctggtaccagttggtgaccctggggcaggacgctggaacacacagcaatcaggagtgggattactttacactggggatcatctgtactttttgaagtttcttaacctatgcatgtaatgatttctaaaaatatgaagaagtttgctggaatcttaaaagtgcgtgaatagatttaagtcacaattattttattttattttttgagaaagggtctccctctgttgcctaggctggggtatagttgtgtgatcccagctcactgcaacctctgcctcccgagttcaaatgatcctcctacctctgcctccggggtagctgggactacaggtatgctccaccatgcccagctaatgtttttgtattttttgtagagacagggtttcaccatgttgcccaggctggtcttgaactgctgggcacaag

SEQ ID NO: 5379 - DNA, 1050 bp, Homo sapiens
ggtgggaggacggagagcatcaggaagaatagctgatggatgctgggcttaatatttacttgggtgatgggatgatctctgcagcaaaccaccatcacccacatttccctatgtaacaaacctgcacatcctgcacttgtacccctgaacttaaaagctggaaataaaaaaaggtatttcataaatatatttacttctcagactggatttggatgaaaaattgttttgtgattactgtaatgaaagcaatggaagaacagtagattactgtcatcttttgctaatgctgttacttgtcaaatatacatagacaaggggcccatgactcatatttacagagtgagaacacactgcttctctctctcctcaccttaaagtgaagagtgctgtgtattttaaatgcaaactcgaacacctagaaggcaatttcatagaggtcaaaccgtagcagtttccttaagacaaaatacctgctcatttcagtgcacattatcaggtattggtcattttcaacaacaaaaggtcatttttttttcacttggaggaagctaaaatttgctttaatttttatttttaattcatgcaactggaattagggtctggctatttcttctatcagtaactaaattctaatgacttaattctacttctcccaccatctggaaaatattattctagctactaggcattctcctttcctttgggtggttggactcactaccctggttactagataacatatatcatatatatgtgatataaatatgatatatggttgtatatatgggggggggggagatcttttctgaaacatacatcacctctaggtctttcctctgcagcttcttgccctgtgccctgtgtttctgttctgcattctcagacattacaacatacacttcttgtgtgtctgtcctggaactggtatcttgcttcccctaacttcacccccaggaagtttctgcttttgcccttctctccaatgcacaggatgaggaggtagggttgctgcatttccttataccctaatccagtttccaacctgttgtt

SEQ ID NO: 5380 - DNA, 1049 bp, Homo sapiens
aggcccccgccaccacgcccagttaatttttgtattttttagtagaaacggggtttcaccatcctggccaggctggtcttgaactcctgacctcgtgatccacccaccacggcctcccaatctcaatgattttttagtagtcatttcctccttaccgtctcagtcagccattcacatggttggttacatcttaggttgtattattagcaagaacagcatcacctgcgtaccgaacattctgtgtatatttcccctactatgccgcctcagtaattcttagcccattatgtggaattccatccactacttttaaaaaatatccaccactcccttcagtcttctgttcctactttgccccacttgccttccatggtctgtgcttatgtttgcgtccttgactgagtccttaggtagttacctaatggaaatgactgaagcgtcttctgaggtgaaagtagctaggggaaaatgtcagagctgtgctgacccatttcactgtaaattcaggaccacacatttcacataggtgctcatcacggcacagccatcctcctacattttcctaaagcattgactttcctactccctgcaaaaggcctcttcattccttcttctcttaaacctcacatccccttctgcaatcacactatcgtctaggttaatggttttgtctaatacttcattgaagaaggagaagacgacaacccagagagtttttgtttccaacgttaaatctgaaatgctttctacctctgtgacaatagtttctgttgtccctctgaaaatgtctctgatctaatccaaggcaacccctgtgtctgtgccgtggcttttatgatcatcgcctttttctcctgcattatcaatatttccctttctgtgggatcttttgtggcagtaaacaaacaacctagcaaacaagaccaaaccttaccttttcagtctctgtcaactacagtcttaatgcttagttttcctttataatgaacgtttccttaaagagttgtccatactttttattgctaccttctaattcctgtaaacagctt

SEQ ID NO: 5381 - DNA, 1030 bp, Homo sapiens
aaatatttgttgtgatcactgctgtataaacattgtctgtgtacaacaggggctccaataaatgtttactgaatggatgaaagaatgtatgtgaatgctgcattggcatcagagttggcacatatttatgaggctgactttttggcatcaagagcaaactgttcaccaaggaagttaccaggggaatctattgaatcaatgcctttgttcacaaataggaatttttgctttcatccaaagaaacaagattttatttgttttggtttttaatgagtttaatttagctgaaaatgtttccagggctgtcgaccaatggccaggaagtcaagaagttgctcttttttagcagaaggtgaggtaacgacttcaaatagggtaattatatttattttgccatcctttaaatttcatgttactaactgaatttgttgaattcttgcagctccaaaactactgattatagattcataaaactaagagatcctaggcttcttctggaagggttatatttgcatattctgtgtcatgtaacatactgaatccttctcttaagacacctgtaggaaattatacttcctacactagtggtaatcctttccttttcttttttaacatttgacatagaaaatttcaaacataaaagtatgtagaagagtataatacaaccttcatgaatccataatgtagcttccaaatttatcaatgtatggccaacctaatttcctttatagcttttctgattatcttctattttctttttcccatactgagaatcctagtcctcaacaacaatgaaaattatatatttagaatattacataatttttttttgctcaaccccaccaagacacctgaactgatcttagaaaacagtagccaatactgccaccaacaatacagttactgaaagtttaagagtttcaacacatcattttaacatcagttcttctgagtgtaataatacaagtacatacacatttaggttaatttgttttggtttatgttaaatttttaggtgttgctttttaca

SEQ ID NO: 5382 - DNA, 1053 bp, Homo sapiens
atttggtatgttcgcgatgatgtgatcacttctatttagttctaaaacatttttgtcaccccataaggaaactcatacccagaaagagtcacctgccattttttccttttccaagcctctggcaaccacaaagataatttctacttctgtagatttacatattctagacattgtatgtaaagggaatcacacaatatgtgacctttcgtgtctggcttctgtcacttagcataatgtcttcaaagtctatcatgtagcatgtgtcagcacttcactcctctttagggtggagtgctatttcactgtatggatagacaccatgttgtgcttctctattcattcatcgatggacatttgggctgtttccactgctgaccatggtgatggtatgatgatgaaaatgtatgtttgtttcaatccttgttttcagttctttggggtatatacctagagttggaattgctggattacttggtatttctgtgtttaaccttttgaggaacttccaaactgtttccacagtggctgtactattttatagtctcaccagaatgagagaatgagggtttcctcaccaccttttgttattttctattatggttttaaatttttattagagccacccttgcaagtttgattacaaagcttttggcctacaaaaatagaattgccgtaactgaggtaaggaaagctatgtgctaaatagggaagaatgggatgatcagcgttgagtttgggcagggtgagatgcctcctaaacatccaggtagcactgttgagtagacattggaaagataaatagatttgggctgaaatataatataggagccactggcacttacttgccattgaaatccttgggactaggggacaataaagggctcaaaggtactccaaaattaagaggttgggtcaaaaagaagggacatgtgaagtggacagaaaaacaagagagttgcatgtactgaaagggcaagtgagaaaattgtgtcaaggaggaggaatgaatgactacgtgaagtgctccgaaagattaagtaagattaaaatcga

SEQ ID NO: 5383 - DNA, 1049 bp, Homo sapiens
tcagataagctttgttatctgtatactatgctggtgattttgctttggggaagcaactgtgacgttatgagtcctgttttcagctcttcttctctggacctacacagcagtctgttctgattgtgcagccatagttctaagtgctggatggggatgctggcaggggttcgtgcatgttccctggacagcaagatgtgtggtgcaaagagcttctacacctgggcaacacagcaagaccccatgtctaaaaattttttaaaaattagctgggcatagtggcttgtgtctgtagtcccagctactcaggaggctgaggagggaggataacttgagtctaggagttcaaggttacagtgagttatgaccacaccactgcaccccagcctgggccacagagcaagaccctatcgaaaacaaagcttttacaaatacatgagaaaagacaactcaatagaataatggaccaaaatgtgagaaggtgaaattcagaatccagagaccaataaatacaagtggacaataaatacttgaaatgttgctgaactcacacattattatggccatacagattagagaaacatcacgattctgttttatgtctatcagcttatcaaaaaagaaaaatgattggtaacatctatggtcagcgtagggcaggaaagcatccccatttgggagaatgtaggcacagcttctctggagatcaatttggcatacctactaactctttaaacatctatacaagcaatcccacttgtagaaatgcactttcaagatacgctgatgcatatatttttaggatatttattgtggcattgtttaaagtagtaaacaaagaggcaatccagatgtccatttccagggggactcttaagcagtttgcagctaatcagtctagtgtggcagttacgactgtggactttggaaccagactgcctgagtctgaatcacggcttcactgctcactagctgtatgctcttgaggaagttatttttcttctcatgtctcagttttttcatcagtaaaggggataagaaatagtacctat

SEQ ID NO: 5384 - DNA, 1063 bp, Homo sapiens
ttgttggtagagacttcattccccacaaggtggagcctttcttttattgttttctttttttttttttttttttgagacggagtctcgctctgtcgcccaggctggagtgcagtggcgcaatctcggctcactgcaagctccgcttcccgggttcacgccattctcctgcctcagcctcccgagtagctgggactacaggcgcccgccaccgcgcccagctaattttttgtatttttagtagagacggggtttcaccttgttttcttgctcttccttttcccctctgtgggtgtgtgtgcgtgcgcacgtgtgtgtgcctacacgcacatgcatctctatgttacttgggcttaaagatgagtctctctcttatttgacaccaaggggagatagatagctggcctctgcttgcttagaggctcaagcctttcaatgcagcatttatttcttgactactggttttgccaggcactatgctggacatgagagatgcatgaataactaagaaacagctctgccctctaagctcataaattatggacaatatacatataaatacatatttataatgcattgttaaatgcagcaacagaactgtgagccaactacaggggtagcacagagaaagtgcaatcaatacggagcaggcagagaagagtttgcagagaaggtgatttcaggtgtgggtgttgaaagacaattaggaacctgtgtgatggatgcaggggcgcctatgtgatgtattttgagaataacagtatttatggatataaatgaaagatgaggggtagcagaagtgatgatactgcagagaaagggaggagccaggtcaggatgtaggccatgcttttactagagggttttaagcaaaggaataacctaatcagttctgtatttggaagacagcttttgtgactacatggagatggatgtaggaaaatgacagggagaccagtttaggctctattgcaatatcttaaataagggataatgagcagctcaattaaaaccctggcagtgggaattgagaagaaagggacataattgaagaatattttggacg

SEQ ID NO: 5385 - DNA, 1022 bp, Homo sapiens
agagtctatcatgttatctgcacatcaggaaagtttacctctctatacctagtcagttttgtgcctattgcattccttacctcatttcctgtgctgcccatggtccattgtctgaaaataaattttagatagtttgtccagattcctaactgtttacaacaggaggacaaatctggtacagtaattcatcagagccagaagacagaatttcatgagatcaattttagcacagcttattccaccaaatcctactttgtatacttcatttccattaaacaatatcattaaaatgtcttcatatcgtcaaaaaacttcataaaaacttccatttaataactagtattctatcatgtgaatattttgtaatctattcaattctttattatcagactattaggttgttttcatgagtttgaatattgctgtagcaaaccttcttatgtgctctctttgtgtttctgatactttttacttacttttggaatagtaattctctcactgtattataggatttttgtgggtttctcgaggaggagaacaatgaattacaactctttacatctgcccgatgcctagcagtccagggaatatcaaagaaactcagtaaatttcccatgaacaaatgggacttggtgctccttgcgaagtgattgacctacacagatgatgccttttatgtttgtaagcttgaaccttttcaagacacacttacgatcttcacattcctgggaggtcagaaagttgtatatcagttctgctataagatagaagaaacaaatacagagaggtaggaagtcaggccaagcagctagtccctcgcagtgacaggaccagggtctcagtcacctctctcctattcctgtgccttttctacctgctcctctggattctctgaaccaaggcagccacccagaggtctttggaatttctaggctccagtgctgcatgctgctctccaagtaagagcagaacacagtgagcttccaaaggccttcctaggacagagctttcctctgggaacc

SEQ ID NO: 5386 - DNA, 1042 bp, Homo sapiens
caaatgacagagcaagctaagtggtacagtgactttatgtagtatcctaatatagtgtgtgtgtatgtgtgtgcatgcatgtgtgtacagacactttctttgtacatacagatattgttattcttttctttccagcatgagtggtctgttgttggagaatcatgttctgcacttggcagtcataattccattcgtattccgtggttccccatttggcattattttccgacctttttttgtgtgtgtgtgtgtatgtgcttagaatatttggcctgcgtgcgggaaaggggtcttctatagtcagccatcatgagccaagacactattatctgagattcaaatctccttcaaaaactgacttggaactttccaacaccagcccattcattcatactaataaaacatctccaatgagaacgaagaaaagatggataagaagagaaggaagtatggtgggataggcattgaaatgcttcaaaaatccagtgctccaaggctgatgctaactttgggtggggcgtttcaggagtgtgaaagtgtgaagaatgtacatttatctctggagtccctagctctcatttcaagatgctttttctccacactgatcagcctgctcgtggtgctgctcccaataagccgccgagtaattcctgtcttctcatcctcctgacttcctggtcacaccaagagtgttggcgtattggtggcttattcataagtgtatcctataagccaaaaaatgaaattaattatcatcatcgttgtggcttttcttcactctagggaatgttacaaaatgaggtaataagaagacaacaatccccagagctttgttgaaggtggtttatgaaaaggagagctttactatctctctgcccattttctttaacaaaaaacaagatgaattagaaggcctcatgtcctctaagtgtaaaggaggaagaaagaaaggcaggggccgcatggaacagatggaatatccccgctgataactagcatttatattgacaaaacatcaataatgagcagtgtacaaggagga

SEQ ID NO: 5387 - DNA, 1075 bp, Homo sapiens
acctgtagtgagccgtagtatcttgatttatttagtaagtgcctcacacttaaaaaaagattgtctcctctaagtgtgaatttgcacctacttaaacagagtttatgttaccagtgaatagtaaataaatgccaagtgcacacttgcctcctggaataaattgtttacatgaggagcaaaggataaatggattggagcacacttggtcacagcggtctaggctcatattatgtaatgtcatttttgtcccacggagcagatccatgaaaatactgtaccccacagggtggatccgttaagcgccagaagacagagttcaacctaagggaatgaatctttaaaatgttcccttaaaaatccaacaaacaaacaaagagtctggcaaatgcttaagaacattaacatttactgggatcatttcctgcggttttagataaacaacacagacaagctatagttggaggcaggattctctgccgcctccaactcatcagtcaagacatgaaagtgtagatgtctcatgagtgtcttccagtggatctcagggcatgtccatcactgtccttgtcaccactacagtcgacatatatctacccactaacggacttctctcactgcaggttgacattgcagtgtcttttgaagaatttttggtttctatgaactctcttgggtgtggcttgacttattttaacataatcatagggacatatcatatttaatatatttaatttgagaagctctggatgattgaatacaagttttctttttcatctcttcttccatataatagctacatgccaatttctggctagtttctctaaaagtttttacttctctctatagacttctataactatctcaggtttaaacttaagtaacagtttttagttcttagttcttctccaaataaatctgatgagtcctttgaattctgggacatggcagtagttgtaataagttatgttctcttactgaattgactgatagatggcatagttagacagacgtggagtctgtggcacgatctcacaccagaaatgttgcttaaactgtatatattgaggacattaaa

SEQ ID NO: 5388 - DNA, 1236 bp, Homo sapiens
ttaataataggatttatattagtactcattaccattggacacaatgacataagtactctccacagtaaagcagacctttcacaacagtcactctgtgtcctaaaattttccaacatagatgtgatttatataactttgttgatacgtaaattgtcttggggtttacggaaattaactattatgtttgcactaagatttgctgggagtggtaggtggacatatctatatatcaataaggactaaccgtcttttttgtacataggagattgataatactgtatttgttttaagcccacagtgttttactccactttcaaaaagatcaatttggcactttttttcattttttttaatggaaataagatttggtctctcattttaggttaaatgataactagaaagattaaactagacagatagtttaggtggagtatatttttaaaactcagaacatgtatattggtcctgtgttaccaagtttatatgtgacagttgaaaaagaaattcccttgaaatgatcatgaggttaaaattttcttcattaggggacttggagaaccagtagtcgtaagattagttgatagtttcactcccaagcaatgaattgcttctgtgtgtttccctgtaggactcaatagtaaatgctgtctgtcttacacatttataaggaccctgcaagacgacgacaaaggcctttggcctgtgctactaaacaagaagcctatgaaaaatttcttctttaaacttgttttttctctttccagtaagttcacatttggataattttaaaaagaaaagtaattacctttgtgtttccagaacactataattggggtgtatcttaattcagttaaatattattagtagacctggattttcccccttgaccccatcagtctataaaggttaaactgcaacttttatgaaatggtctttaatatttccacaataatcctgtgctatatttgttttaagaaacaaagtaactctatacacttcaagactttacaggattttttaaatcctgtattgttggatcaattaataaagatgcaaaaaaactttatagagatgtaaaaacaaaactataatggatctcctatttttctttaaatacaaaaaaaaaaaggtaaatgaactattctccttgtaaagctaaattccccattctgtctaataaaggaagactgaaaaaaggttttaaagaacataaatggaaagatacaaatgctttga

SEQ ID NO: 5389 - DNA, 1050 bp, Homo sapiens
agaatcacttgaatccaggaggcagaggttgcagtgagctgagattgcaccactgcactccaacctggcaacagagtgagagtccacctcaaaaaataataataaggcaaatttttaaatagctaatttaaaacaatgttttgttggcagtttaaatcaatgaagtctgatagtttgtttctactatagttgtaataatatataatcttgcaaagattgtgtgtttaattgggtatacacataactagaactctaatttttaatatatcctttaatcttccaatatacccaaatgtacaattattttttccagtatacaacccttcagtgaaaaaaaagtgttatgactgagataatttacataggaaaattataaactttatgacttaaagtacatttctcatgttatctcaccattttttcttaagtaatgcatacttatttctacagaattgttgaaattgagtcagtggttctgacacttgggaaaacataaagactaggactaatgctagagaactgaacccttctgttttgttccttcagcactattttcttatccatattttgtaataaaatggaattaaatgtgaaaatatctattaggttttcaaatcaacaatatatgttgtatatacgttaagaattgctcattttaatacatattttactatatcacatgtggagattgctgttgtccatgttttttctaattaatttatactgttttccacaaatattagaaacttcattgtacagatcgtctgcataaaaaatccttaatgaaaaatagagttttggatacaatgatgcttatctgtattttatctcattaagcttggttattctgtttcttattctagttcatttattttggggaattgcaaggatttgctatattatataagggaacactttaaacacatttcaaaagaatcacatcaacagttaatatgttttaaaaaattatatatggagcaatcatgtgagatgtagcatgacatagtgaaaagatctagttatggcacttaactatgtgtgaccttggcc

SEQ ID NO: 5390 - DNA, 1008 bp, Homo sapiens
acggggcagcggcggtggggggtctataaaacagttttatttagcatagtaaatggaaaatcagaagttatacatacttccaattagagtcctggcgcaaaatagtgatttcaaaactaggaattcattgagctgatttaggagttttaattttccagttggtgctatatttggatgtgtgtgtcaaaattaaattatctggaagtatctggtttaaagtataggaattaacattgtgcttctaaaagcatgtgtttaacctttaaatatcctcacataattcaaagcccttaagaacttgaagaaaagcagtatatgctttattactcctttcagagttaaatgaaataatcaatgttttcttttttttccctacccattttgaaatgtctcacatactttacctatactttttaaagttaaatctgtttatagttggagcaggtgaaaactaaccttaatttatttcagtggaagaagatggattcatggggaatcactcagcgtatattggccaaactgggctgtagaaatttaactggttatgagcattatctcacaaagtgctgttatatcatttaactctagtaattaggtgtaattgaatataataactacaaaaactacttactttccaccagaatttaactgatgctgttatatttgtttgcttatgtgctttgtattcagagctgaggccattgagatacatgtgtgaccaaagagtaatgaggtggatatttgtttgtgtcctatatgcatgttctcattacttcataatgagcctcatatgtggacgtggctgcaaaggccagtgtgggaggccagctgttacaacggacatgaagatgtgtgattattttcagtaggcagacatctaagtaagccctaagtcttgagttaagagtggaggggaagttgatatgaaatttcatctttttatttttgattggtttacatctaccacaccatctcctacaagaccctaaaggaacagtactttgcata

SEQ ID NO: 5391 - DNA, 1042 bp, Homo sapiens
cttataatttgattatactcaataatattgtgaaagatactaactcatggagagcgacatctgcattttaagcttgaaatcaggaccaggatttgaaactcagatctgttatttatcagcagtgtaacctgggacaaatcacttaatctctctgaaattcagtttcctcatatatactaccttccaaagtgtgtaaacatgtaatgagttgaagtttatgaaagcaaagatgcaatgcagaatcttgcttcagctattaaatgatgaaataattcctgctctgtagtattgttatgaggattaaatgtaacagtacatttgagtgtgcgcttagtatagaactttaaagcattacataaatgataaatatactgttacccaaatgacagcctaagaaacatgccacaaaggtctttagcagccaaaaaatgtcaaaagtctatgaactaccaactatcatgcattttagtcataagagaacttgtagactattattcgcagcctatttactcttattatccatattattctagaactttaagtatcaggttaaaagtagtacttttggaggtaggaggacacagtgtagtggttatgaacccagctttgatgtcaccttggacaaattacctaagttctctattcctcaattttttaaaaaatagaaataataaaatggtactcacaggttgtgtgagcgtgttgtatgtgttgtaaagatataaataagctaataattttaaacaacagtacatagtaagcattcagtaaatgtaagttatttttattatggtaagaaaagcagcaaagacaagtttagcaacctgtagcctatatacttttcaaagaattcactgttactgtttagaaaaatcacttaccaactaaattcaacttaaaagtgatcatttccactcctgtcccctttcaccctagcccagaatacactcccaagggacctagatctacaatttacagaattgccaccagaaatgaggttgttctgcctgagaaagctacagtcggttccgttgctgatatt

SEQ ID NO: 5392 - DNA, 1033 bp, Homo sapiens
tatatttattaactgacaacattcctttcagtctcgtagtgtggataagcaacacgctgtcatcaactatgatgcgtctacggatgagcatttagtgaaggatttgggcagcctcaatggggtaagtcaatggtttattttttgtcttgtttgaacatttgtttaatattgtaagaataaaaatcagattacatttcctagctacattttctttttctttactttgtatgttattttcaaatgcttatcaggtacatagcactttggggaccatccaatagaatatgaaactagcccatattccaaagaaactataagcagatgaatccagaaggtggttgtcattgtctgtgatggctaaagaagacttctttaaggagttggaacctaagcttgacttcactatatggctgtaatttatatgagggaaaacggtaaaaagtcatggcagtgagaatgcaaaaaagtactctcagggacagagaagtaatggttaagtttagaaaataaagatggagctggggccgggcgcggtggctcacgcctgtcatcccagccctttgggaggccgaggcgggcggatcacgaggtcaggagatccagaccatcctggctaacacggtgaaccccctctctactaaacatgcaaaaaattagccgggtgtggtggcgggctcctgtagtcccagctactcggtagtctgaggcaggagaatggcgtgaacccgggaggcggagcttgttgtgagccgagacagcgccactgcactccagcctgggcgacagaacaagcaagactgcgtctcaaaaaaaagaaaagaaaagaaagatggaaaggtgccagagagtagacaactttctctgctagggtaaaaaaggtgaaacaacacaaccatttgccttcacaaatatagcacattatctaaccgccattgttcattattcttggaattcatactttgaatatatttttgtgttactgaagtgaattttttcttatttcttcatttggtctgtctacatttggcataat

SEQ ID NO: 5393 - DNA, 1035 bp, Homo sapiens
tatcatgaggtgttttttttgcaattttttttttttttagttcatcagctgttgttagtgtattttatgtgtgacccaagacaattcttcttccagtgtggcccggggaagccgaaagattggacacccttgctataaaaggacagggactggagtctttcattcttaccagaagtttaagtaacaggaaaaaaagggcctggtcaaaattgcctatctttgcagttttaagctcagatcagctaaggttttcccattagtatcagaaacgtgattaagttagcagtctttgttaggatttaaattatgtatttctgagagatttttattaaattttcattgaaatatccaaatgggttgtgaatatcaagttgtcatgcaccttctggttcagtttaatctagaggaaatgtgaatttgattatatagaaatgaaaacagtttaatgcttaagtggttagatatccattacatattcttcctattccctcagttttccttgactcggtcactagatgtattatgttctgtaatcttggtcttctgcttaattcctgtcatgggtgctgaaacacattgatactttatatacatttcataataactaaaaacataggaatttttttttcattggctgcttttttaaaaaaatagttacacaaatgggattgtcttattctgtgagtactaaactgatcttctttgccttgagttcctgactactcttcttgaattgttactgtctttattaaacaaacaaacgatgtattcttgtgatcccacataacaggcccactcctcactccctaatccccagagttgtaatggcatctcactcgactcagtggactctgttgttctcttaggtcttaagtgtgctctgtcttttgctgtaggtgtttatgtaccgtcagtgttcaccataagcagttggagggcggggtacattgtagattaaggatattccagatttcaaacaagttgttcacttagtgaagcagcctgtcctaaattacttcctccccaaatcacttt

SEQ ID NO: 5394 - DNA, 1044 bp, Homo sapiens
tcaaaattctttctatttctttaggttctgacaatttgactgtaatgtttcttgtgtggagctctttgagtttatctgctggtagtttattgagcttctaggatgtgtgtattgatgtattttggaagtatttttccattaagacttcaaatacttttctgtcatatttccttctgggacacctatatgtgtatattagtatgtttgatgatatcctactggtgcctcaggctctgttcattttacttcatttgtttttctgcttctcatattgaagataagacagcctcactgttcttatcttcaggttcactgaacctttctaactcctcctcatatctgcttttgagcccctctattgagtttttcttacttcagttagtctgctttttagctccagaatatgtttggttccgtttcataatttctgtcttcctactgatattctcatttttttcatacactgttttgctaatttttttgttgatggttttctttagctcattcaacatatttaagacagtagatagttgatttaacaccttcaactaataactacaatgggctttaacgggagagtttctgtcaaatcttttttgttgtttctttattttcattatgttattttttggtttttgagaactgtattttgtatcttatttttatttattcatttgttttgaggcagtgtttcactctgttgcccagactgacgtgcagggcatgatcatggctcactgcagcttcaacctcctggatgccaccatgcccagctatttttttttttatttttcatagatatgaggtctcattatgttgcccaggctggtcttgaattcctgggctcaaggaatcctcctgcctccacctcccaaagtggagagattacatatgtgggctaccatgcccggtgagaactagaccttttaaacattatgttgtggtagatctggaaatgtaatccttccactctccagggattgctgaatcttacttgttgagggttaaagtgatgatctgtttgtgacttttgtaaactgtttt

SEQ ID NO: 5395 - DNA, 1050 bp, Homo sapiens
gataccaggattactaagtaatagccactttactcaagcaactcagtttataagggaaaatagacaaaaatgaatatattttgtacaaagaagtttaggagttgctgtaggtatatgtgaagggcaagataggtggtcagaattgagaggctgggaattctatgggtgtttttctgggggaagtgattgctggagaaagctcactatgaaaggtcttgggacagcatagagctttcattttcaaattcagttggacatggaatacaagggaggagcagagtaacatggggagataacagggctttttactcaaaactgaagagtttgaattctatcttgaactctatagggagctattgaaaattagggagtgaaattattacatttacttttataaatgtaattttgatagctggatagaggaaggatttggagagtgggaggctagagacaagggattcaggtaaaagagttctgcagtaatttattggtaagaaccagtgggataagaggaaaggcacaaagaaagatatttaggatgtggaatcaaagggacataatgacttacctaactaaagcgggagtgggagagaaaatatctggtcagttggtgatgccattcgctaagacggggagaacaggaaaaaaggcacatttcgttagatgaaagggttctttctgttttttaaaaattaaatctgaggagtccaggaggaccttgaactggaaatgactcgtaagcagagggaaggtctgatcttgtaaaaaaggttttgacttgaaattatatgtgtaacattataataagcaatattggaagcccagggttttcaaagaagtcccaaagagattatgtatagggaagtaaccccgtaaaaacagaatttaaagaaaaagtagacactttcaaagagattgaggcgtgcccacagaagtgagaggaaagcagactgatacttgtagaaggcaagaatggtcaaagatattgagaggtaatttaagatagcaatactagagatcattagatttaacaggaggacattttcaacc

SEQ ID NO: 5396 - DNA, 1034 bp, Homo sapiens
ccttatttcaagccatacacttgtgtttaaagtctaaaattgtatcaactctttaacaacagtcatctctgctaattcaaagcaaaaagcagagagagagagagaaatgttacatggcttttcaagttatatttatgtaattcaaggtactattttttgagattttgctctccttttctaatgttcataaatggcctttattaaatgatagtgttagtaacacctattaagtaatgataggttaagtttcttttgatgttggtcatggggttttgttttattttagtgttcctgattaaccaataaaaagttggcagccttatgttgattcttaatttgttttctgaaaaattggtctggaaaccactgatgtagtcaacataaaccaacatttttacacttagctagatttctcccattgtgtataaacacacaggtgatgtttttaaaccagtattttaccattgcctcctattaaatttcatctccgtgaacgtagctatagttaaaacttgagatcttcttgaatcatgattctgtcatccaagggattagctttccttcctggctttttgacatttataaattcaacaagccaaactcttatgtctccatcctggccatatacttaatatagccaaggacaaagccatgcacatttataaatagaatgaatgttacataaataaaagatgctgggaggaaaggtgacacaaaaataatgaaaaccattcggatgggttttttttgtttgtttgtttttggggcctttttgtttgtttttgtttttgtttttttgagacggagtcttgctctctcgccaggctggagtgcagtggctcagtctcggcttactacaacgtctgcctcctggattcaagctattcccctgcctcggcctcccgagtagccgggactacaggcacgcccggctaattttttgtattttagtaaagacagggtttcaccatgttggccaggatgatcttgatctcctgacctcatggtccactgcctaggcctctgaaagtgct

SEQ ID NO: 5397 - DNA, 1115 bp, Homo sapiens
ctaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaagacaacctagacaaaagacacgcctgcctcttaaataaggacagtctggtgttaggacatggccagagagccatctcttctgtccgggaaaggacacattgatttgtgccataatctgtttactgaaaatttatctgaccttaacggcaggtaattctagaacaaaaacagggtgtaggccaagtgc

SEQ ID NO: 5398 - DNA, 1050 bp, Homo sapiens
cattaaggttttagctgcccgtattctctagagagtttttatactctggggctcaaccacgggtacaccatcattcccagctccttccgtttttactgtagctaaaaatactgctgaaggtatttgatctaaaagatgtgtgtgacttgcttggtacaaatattggaaccaataactttataaggaggtagagatttccccaaatctcaataccttctagaaatgctgactgcagttacagtggtctatttgcagaagaagagagggcctccgagttcagtgtcttacacagagcagggagccacaaatgcttcttgatggatcagttctcacctaatacgaggatatcttctggtacattaggggtcagaaattttggctaatgccagcttgatcccatttctagaatcttctgcattaagagtgggatacagaaaagaaaaacagtgatacaagaatggaagtgtttattcttcagacaaaggcagagccccctcctcttcggagtgacagagtcagagcctcagtgcagtgggatctggcctgtatgctttctttgtttacacccacatccagcggatgctccctggagaggttagaatattcaaaaaaattggtaatgtacttcctatatgggtttgaggacatcgaattattttgcttgaagagaaaagggttgagtattggaaagattcactgatttccattgcaggacagcatatgattaaacaagcttagaggcaagcacgggggatttaaaatggagcacctcccccaggagactgtgaggccagggggcccttgggactttgttcaaagttctgcggtccttgggcctgacgggtgctcagcccagagcagatgcgtgggagcgcatgttgactgagtggctgaccacgtggccacataccaggaagagcttccaacagcacaggactgtcatcacaggacatttatgagaacagggtgctgatcatctgtgatctttgaaatacaggaaaccaggaaagctgacaggaggaacactgtgattgtcagcggcctgttttg

SEQ ID NO: 5399 - DNA, 1045 bp, Homo sapiens
tttatcttcaggattatactaatagaaccatgtttcatctcctgttacaattcttcaaagaaatgcttcaggatctttattccacttgtttaaaatttccattgaaagttctgctcttgtctgcagccgatctgggtgcaatggttttggcacccatcaagtggaaagtttgctcaacttaaatttttcagtcagaattctgtaagctgaaccagatgagatgtctatggtgttggctgttgtttctgctgttaatcattggtccttttgaattagggcacaaacaagattaattttttcccttgcaaattgatgtggatggtctgtcgctgctggcttcgtcttccacattgtctcatcccttcttaaaataagttatccatttttagactgctgatttatttggggcatacttcccataacttttcataaagcatcagtgatttaatcattcttccacccaagcttcaccatgaatttcatgtttgttcttgcttcaattttagaattcatgttgctcttacaggggctctgtccaaactgatgtcttatccttcttagtccctcaaacttgatcctgtacagtcatgttataacaaatcagtatgagttaattttggtgcagaaattttttgaaatctgtgcatggttttttcataatacacattttccataaagtttatgaagactactcaagaatattatatattctagaaatttgtaatgaaatctgaagttggggcattctgatgatttttgtgggactgcttctgttcaagtactgtggcagtttttttttgttgtttgacgaggtcttgctctgtcacccaggctggagtgcaatggcatgatctcggctcactgcaacctccacctcccaggttcaagtgattcttctgcctcagcctcccaagtagctgggactacaggcatgtgccactacacccaactaaattttgtatttttagtagagatggggtttcaccatgttggccagtctggtctcaaactcctgatctgcctgcctcagactcccaaagtgctg

SEQ ID NO: 5400 - DNA, 1070 bp, Homo sapiens
tatatttttattaactgttgaatgtttgactttgatattctttttctttttatatttaaaagggttggtatttctttattacaaagaactgcaaaagaggatatcgccttaccttacaaaataagatttaggtttgatttacaagcaccaccaaaaaacatttctgtaagtgaatattttataatagcaatagattcccaggagaaattgttgaaaccatctgtatatatctagaagaagatgctcatctctttgggattgtttagatcacattttcttttttaaaaaaagaggattgatgtttgctttgaaaagttgattaggctttaatttcagaacttacaaaataatggctcttaaagctatatcacttattcccatcggtttaaaaatagataattttatcatcgtgaagtatttgataaaacatgtttctttttacacgtgaagcaacagagtttgtaagtactgagcgttctattagctacaactatgtcctgtttccaaaataccttactcagcattcagtagttttttaaaatggtattttcatgttgttgaagactatagaacaaattatgtcatttttcttaatacacagttggagaatctaatgctggacaaagatggccacataaaaattacagattttggactttgcaaagaagggatcacagatgcagccaccatgaagacattctgtggcactccagaatatctggcaccagaggtaggcttcggttccattaataggaaagtaacattgacataatgatttgcaaagtaaaccatttaagcattaaaagttaactgtagtatctactacttttatctatatttcaacctgaatcaaaattttttggctcttaatttgttataatggggtattgtaggatcaagaatatactgaaattaaattttataaactataagcacaaaggtactagctatagtcagttaaatcaatttttatttcttggccatatccattttatcttggctatacccattttgattcatttattaaaatagaataattgatttcagcaagagtatttatatttataaac

SEQ ID NO: 5401 - DNA, 1046 bp, Homo sapiens
ctgcatattacaacctccccacacacctcgggctcaagtaactctcccgcttcagcctccagagtagctggcaccacaagcgcataccaccacgcacagctaatcttttgtattattggtagagacagggtttcaccatgttgcccaggctggtcttgaactcctgagctcaagcgatctgcctgcctcagcctctcaaattgttgggattacaggcatgagccactgtgcctagcctgtgttttgttacttaaaataaattattgcatattgaaaagtatttttaatgcagtcattgagccaacagaaatgttttatggggttccactcttgaactttgttcttttctttaaaatacagtgttttttagaagagcccacatcatgacaatttacaaataagccattaaactcttcatgttttaagaaaagatgagttcatttattcaattcttatggtatgttaagtttgcatttagcatctcatttctcaaaactgtcacattggattgttactgttatttacttttgttttatagatgaaattgaagcacgtagaaattaataatatgcccaaggtcacacagtgaataagggataaagctcaaattttaatatgaaccctctgacttgaacccatagtcttatccattttgctctctactgcctcccaggcagtatgctaccagtccccatggccatgacccttaccccatctctctcagtcatcccttaggcttatcttatttcttactatatcattgtaatttttttaaaagctaatttataaaacaagtagggtaaccagctgtcttggtttgcccaggactgcccagttgtagcactacacgtcctgcattctttgaaacccctcagttctgggcaaactgggagttggtcaccctcagcctattccttacccaaacctatccttgcatctcatttcattcttcttctcacaaccatgatctgaggctcagagatgagatacgaggttacagaattagatgcaagtcagaattttacacacacgtacacacacacgga

SEQ ID NO: 5402 - DNA, 1015 bp, Homo sapiens
agtgctggccagatgcagtggctcatgcctgtaatcccagcgctttgagaggctgaagtgggcagatcacttgaggtcaggagtttgagaccagcctggccaacatggtgaaaccccatctctactaaaaatataaaaattagcccagtgtggtagcacatgcctgtaatctcagctactcaggaggctgaggcaggagaattgcttgaacttgtgaggtagaggtttctgtgagccaagatcatgccactgcactccagcctgggtgacagagtgagactctgtctcaatcattcaatcaagcaatcaatcaataggatgtccttccctattgcttgtttttgtcaggtttgttaaaaatcaaatagttgtagatatttggtcttatttctgagttctctattctgttccattggtttatgtgtctgtttttgttaccagtaccatgctgttttggttactatagccttgtaatatagtttgaagtcaggtagtgtgatggctccagctttgttctttttgcttaggattgtcttggctctgtgggttcttttttggtcccatgtgaattttaaaatagtttttttctaattctgtgaagaatttccatggtagtttattgtgaatagcattgaatctataaattactttggccagtatggccattttcccaatattgattcttcatattcattagcctggaatgttttcccatttgtctgtgttctctcttatttccttgagccgtagtttgtagttttccttgaagaggtccttcacttcccttgttagctgtatttctaggtattttattctctttgtggcagttgtgaatgagagttcataaatgatttggttctctgttgttgttgtataggaatgcttatgacttttgcacattgattttctatcctgagcctttgctgaatttgcttatcaacttaagcttttggactgagaggatgggattttctagatacaggatcatgtcatctgcaaacaaagacaattttac

SEQ ID NO: 5403 - DNA, 1027 bp, Homo sapiens
tggtaaaagataggggtccagtttcattcctctgcgtatggctcaccagctgtcgaagcaccatatattgaataaggagtcctttccccattgcttatttttgtcagccttgccaaagattagattattgtaggtggctggctttatttctgggctctctattatgttccattggcctttgtgtctgtttttttacagtaccatgctgttttggttgctgtagctttatagtatggttcgaaggcaggtaatttgatacctctagctttcttctttttgattaggattgctttggctattctggctcttttttggtttcttgttaattttgtagttttttttttccagttctgtgaaaaatgatgttggtagtttggtaggtatagccttgaatctgtagattgctttgggcagggaaatatggctattttactgatattgattcttccagtccctgagcatggaacgttttttcatttgtttgtgtcatgtatgatttcttttaacggtgtcttgtagttctccttgtaatgatcttttaccttcttggttagatgtattcctggatttttttgtgtgtgtggctattgtaaatgatttggctctcagcttggatgttatcagtatatagaaatgctactgatttttgtacattgattttctctcctgaaaccttgcaaaaatcatttatcagttctaatagccttttggtggagcccttagggtttcctgagtatcgaatcattatcagtaaagagagatagttatactttttctttgcctattaggatgcctttttatttctttcttttacctgattttctctggctagcactctccactaatatattgactaggagtggtgagagggggcatccatatcttgttccagttctcaaggggaatgcttccagtttttgcctgttcagtatgatgttggctgtgggtttgtcatagatggtgcttattattttcaggtatgttcctttgatgcctagtttgttgagggtttttatcataaagtgat

SEQ ID NO: 5404 - DNA, 1029 bp, Homo sapiens
ttaaagtgtacaatctgataacttttgacccatgaaatcatcaccacgataaaaataacatccccacaaatgttctcctatacaggagattttaggaggaaaggtgcatttgaactaaatcttcaagaacaggtatgttccccaaataagattagctcattcaatcaaaagtatgtattaaatgcttactgcgttcgctaggatgaataaaacagtcatgatttctagaaggagatgcatattataaaataataaaacaaaataaacccaataaatataatggcaacagagtgctgtagtatgagagagaatgatggagaacctactataaatttagttatctctttgaggaagtagtgttaggttgacatttgaagggtatgtgggaaggaacttcctgtgctctgatgagagaagcctgttgagcatgagactttagggcacggctgtagatgcagtcatctttttgcaaggatgggctgaatacctgttcacttactaaaccgtgggagtacagctacactctagtgcagttcctgttaggctattatgagagagagttatggagaaaatttcttcctaatagaatgatgaaatatgcttgtatatttagtagtttgagttaatgcattttacattactgtattcctatagcatggctaagcttaacaataaaaaaaaactatgtagtctttgcctttataaaggaacttaacttgataaagataagctccctattttagcagcaaataattcactttcctttttgaacaaagataagattattcaactattatatatgatttttaatacttccaatgaaaatattttacctcaaaaaccttaaggatgatttttcttataattttttgagaggtatttctgaatttaattttattttttgcaatacatatttatgaagaatataatatgtgtcatatactaggcatggtgctgaagatgcaaagatatggtgtactgtcataattttctcattttcctatgcctttgccaagaaaaaaatagagc

SEQ ID NO: 5405 - DNA, 1052 bp, Homo sapiens
ggtatttacatgattcctttccatgtggttatggcagagcatggccatttcaaggtagtcaaacttcttacacaaaggctggcttaccacagagtgggtatttcaagggagggaaaacagaagaagcaacatatgtataattggaaaccctgaggaggaaaaagagggcagtgacacaaaacagtatttaaatatcaaaaactataatctgaaaacatacttacaggcttttgtgttctccatttttcacttagcataatacttttaaaatttatagatactgttccatatatcagtagtttgtttctttttatggctttgctccgttgtgtgatgtacagtcatatgtttatatagttgcccctggatagacgtttgggttctttacattttgggcctattagaataaaagctcgtgaatattccagtacaaatctgtgtgtgaatatatatttttaatcttcttgggtaaatacatagaaatgcaatttctgtgtcatttgttatgatcaacttcattaaaaactgcagactcttttcaaaatcagccataccattttgcattcccaggatgttacttgacaacatcaccacacttggcatggtagtctttttaaattttactcattctggtggatgtatagtggtattttttagcttcaatttgaatttctcaaataactaatgatattgaacttcttttcttattctgatttgccatttatacatcatcttttttgaagtatcttaaaatcttttgtctgttttaaaaattaggttgttgtcttaatattgagttgtcagatttatttatttcatgtaagggctttatcatatatatattttataaatattttctcccattttatagtttgtcttttcatttcataatgggaaattgttccaaaatacacttttgttgtaatctattgtaatcagcattttaatgcatagttagcattcagtaaaattaatcaattttgactgtacaatttagtgagttttgacagctgtataaagcagtttcccatcaccacaatcatgatctagaa

SEQ ID NO: 5406 - DNA, 1050 bp, Homo sapiens
gttctcccttacagccccgttgacaatagtggataacctccactttttccttaatatcacttatcagaaagagtaattatttaagttggataatttacttgtttgtgttttccactagcctatgaactctgtgagcaatgggatcttattttttttattaagttaccttataccagcactgttcttaccaattagtgagtgcacatcagcagttttttttttaagtgaatggacttggttcagtatatcacaaaatagccacttgtataatgcttaattatgtatttcatattccctctgtgatgctcattaactgtagtatccccttctctggtttttcccattaacactgatcaccatgtaagtagaactaaagctccatgagagcagagaattttgtctatttgttcagtgtcctgtctctgatgtgcagacgaatacccagaagatacttgttgcatatgtgttgaagaagtcggtgggtgggtgggtgggtggatggatgaatgaactcttgcacacttgacatcttggaattctttcctatgatacacaattcagttcaatagacatttattaggtatctgctgtatgcttaccattatgttaggcacagtgtatatggaaatcagtaagttctggtgtcatttctgcttctgatttattttgttttacaatgtttgctattctaattaacttaggaactatagtacgatatgacattggctttcaaattgagcacttaaaactgactcctataaaacaaataagactgagatgatttcatgtttatgctttccttcactcgttgttaattatactttctgttcagacacaattgatcttaccttctttgaatggttgtgggatcttagcttctttgattaatctagttatcattatctttcgagtttaaggtcaaatatttttataaagataacaaatataatgcagtgtcctgatgttttgcttttcatgtctttcttccatctaattttgattttctgacagtgttaagaaattgattcagcaagggctttatttaagatc

SEQ ID NO: 5407 - DNA, 1034 bp, Homo sapiens
atgagaattgcttgaataccaagatcgtgccactgcactccagcctgggtgccagagcaagacttcgtctcaaaaaaaagaaagaaattgccacacccactctcacctttggcaactgccaccctgatcactcagcagccatcaacgtcaagagaagaccttctgccagcaaaaagataacaacttgctgagggctcagatgacccttagccttttttggcagtcaagtatttttaaattaaggtatatacatttctttagacatagtgctgttacacacttaatagactacagtatagtgcagtgtaaacataacttatatgcactgggacaccacaaagttagtgtgactcgttttattgcaatacttttgttgtggtggtctggaacaaaacctgacgtatgcctgtatggaaaaaaaaaaaagaggctatttggttgagacatgaaacattggttcttgagaagcccaggtctattgatgtagagtaacctttccttcattacaggtctgaccatactatttgattgtcccatgaataatattcatttacttacaccattggaaacaccaaattggcgttcagtttttaggatttatcaatagacaaagcaccgaagacttaagtatagttacagaacagactgaaaatgttataaaccctgtcagtgtaaaagaaatggtatagttgatggatgtcagctgaaagcatgttataattttttttttaaaaaaaagcaagaatgaattggaggccagagacagggtgatggagccaccagggttgcaaaggcagaggttgatggagccaccatgggcctagaggacagaaatacaaattactgaggattagttacagaccttgaaatcgaatttcccttgctgggtttagaacttgcttggaatcagtgatgtttttatttcttccaatttctccctttctgagtgggaatatctgtcctaggccttttctaccattgtattttggaagcagataacttgttttctagtgtgagaggtccacagatttaga

SEQ ID NO: 5408 - DNA, 1044 bp, Homo sapiens
atattttgaggattgggatatgtaaggtatttagcatcctagctggcacttattattaattaagctgatattttctgggaggtagtataatgtcaggtaggttttgctgcttagtaagtgatccaactttttatgcctttattttcttatctacagagtggggctaatagtagtacctgcctcatatggttattttcagggttaaatgaatagataaatataatagtacatgccatcagtattaaataaacttaacaaattaaattacaaatcaaatgaaattaaaatatgctattgttataaatatttgctataattattattactattattactacctactgtgtattattactacctactgtgtatcaagcatcagtaaatatctattccattctgttttttcttttatatattagcctcacttgtatcccattatttaatttctgttcatcagactggggaatatcctattagacactgtcttatctcactacttacacttttctgagtaactgtacagaactacgtatatttcacaaatgatagactattctgattgaagtagtgccttgctgctttctcccaacaaatctatttatcgtttcttgaaagaaaatatgctcatttatagcaagatgattaacactatgaagatttggagtgtgacaagacctggggtttggttcctgctgtgcccttctcagagcaacatatcagggaagaaatgattttgatatctttttactggtgatgttaattttgattgcttgactacagtggtgtctactgtgtttcttcactttaaagttgctattttttccattcataagtaatcagtatcttagaggaaatactctgggactatataaataacctattttttcttaaacttttaggtactaattttaacacccatatcagtggattttgcccataataattattactgttgtgttctaatggtgattttctatttccctcattccttatacatttattcttagttaagctaagggtttatcaattttgttaatcttttca

SEQ ID NO: 5409 - DNA, 1093 bp, Homo sapiens
agcctggccaacatggcaaaaccccaactctaccagaaatacaaaaaaattagccaagcatgggggcagacacctgtactcctagctacttgggattctgaggcagacaatctcttgaacccaggaggcagaggttgcagtgagccaagattgcactactgcactgcagcctgggtgacagagtgagactccgtctcagaaaaaaaaaaaaaaaaagaattcttttctctaaggatgttgagtattggcccccactctcttctggcttgtagggtttctgcagagagatccgctgttagtctgatgagcttccctttgtgggaaaccctacctttctctctggctgccctcaacattttttcctacattttgactttggtgaaacctggcagagacgcaacaaaaaaggaaaatgtcaggccagtatccctgatgaacatctatgcaaaaatcctcagtaaaatactggcaaactgaatccagcagcacatcagaaagcttatccaccacgatcaagtcagcttcatccctgggatgcaaggctggtgcaacatacacaaatcaataaacgtaatccatcacataaacagaaccaatgacaaaaaccacatgattatctcaatagatgcagaaaaggctttcaacaaaactcaactccccttcatgctaaaaactctcaataaactaagtatcgatggaatgtatctcaaaataataacagctatttaagacaaacttacagcaaatatcatactgaatgggcaaaaactggaagcattccctttgaaaactggcacaatacaaggatgccccctctcaccactcctattcaacatagtattgaaagttctggccagggaaatcaggtaagagaaagaaataaaggatattcaaataggaagagaggaagtcaaattgtctctgtttgcagatgacatgatcgtatgtttagaaaaccccgttgtctcagccccaaatctccttaagctgatatgcaacttcggcaaagtctcaggatacaaaatcaaggtgcaaaaatcacaagcattcctatacaccaataataaacagccaaaccatgagtgaactccca

SEQ ID NO: 5410 - DNA, 1035 bp, Homo sapiens
gctttttattttgatatacttctactcatctattactgcttttgtcagcatcaagaaatcatttctaaagaccaaattatgaagcttttctcctgtggttttttcctaggagtttgtagtttcatgtcttatatttattctttgatccattttgagttggttttgtgtgtggtgtaaaataaggctccacttttgttcttttgcatgttgatacccagttttctcagcagcattatatttccacattgtgttagttgtgacgcccttgtcaaagatcatttgactgtatatatatatggttttattacctgggctctctgttctgttccattagtctatatgtctttatgccagtaccaatctgttttaattactgaagctttagaatgcattttgaagtcaggaggtatgaagccctcagctttttgctttctcaagattgtttcagctgtttgggattctttatggtttccatacgaattttaggattttttttttctgtttccgcaaaaatgctgtaggattttgaaaaggattgcattgaatctgtagcttactttgtggtgttgacatcttaacaatattaaacctttcagtgcatgaacatgggatgtctttccatttatttgtgtctcctttcatttctttcagcaatgttttgtagttttcagtgtacaaatctttcaccttcttggttaagtttattcctaaagtactttattcttttttatgcttttgtaaatgggatttgccttagtccctttgggctgctacaacaaactatcataaactgagtagcttataaacaatagaaatttatttcttacagttctggaggccaggtgtttaagttcaaggtgctggcaaattcagtgtctagagagggccctcttcacggttcatagaaggtgtctttcccctgtattgtcacctagtaaaagtgccaaaggaactctctgaggacttttctataaatgcactaatttaatctatgagttctatcatgacctcatgaaggcccacttcctaatacca

SEQ ID NO: 5411 - DNA, 1028 bp, Homo sapiens
actggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatacaaaaatcctcaataaaatagtggcaaactgaatctatatgactttagtgtaatatcattgaagacttagagagggttagtgtgagttagaaaaactctctatttttaatattctgcccagtctaaaatttttacctgtcataaactaaatctgtatatctctcacctgtcttatatttatttcagtacatgatataagggtggactctatttttttctcaatggcgagcccatcatctcatctccatttattagataatccatttttttctcactgattgtggataacacatatacatatttgcgcttttaggatttagtctttttttcccctttgacctttctgtactctagcattaacaccacatggccttaattagagaaactataaaatttttaactgttaatatagcaacatatcccttattttttttaacaaaaatgttcttagctacattagtgcattcttttaaaaaattatggtaaaaattacataatgtgaaatcctctttcatttttaagggtataatagagtattgttaactatgtgcatattattgtacagcagatctctagaacgttttcatctggcatgactgaacctctgttcccattgaacagtagctctccattcccatacccccagcccctggaaaccaccgttctactttctgcttctgtgaattcgactactttagacacatcacataagtggaatcatacagtgtttgtcctgttactgtcttacttcccttagtataatgtcttcaaagttaatccatgttacagcatattagaggattttcttcttttttaaggctgaataatattccattgtatgtatataacacaattgccttctttcttttt

SEQ ID NO: 5412 - DNA, 1050 bp, Homo sapiens
gcagtgagccgagatcgcgccactgcactccagcctggtgaaagagcaagactctgtctaaaaaaaaaaaaaaaaaaaaaatctcataattatttttcagattttaccatgttatgtaatgaatggttaaatatcctgtgtacatctgagtaatttacttctgtttcatgcattatgactataaataaactgcttattctggtgtatgagtacaatggagttttatgccactattaaatataatgatgtagatctttatttactgaaatggaaaatatccaaaacatataatatcatcaataatggtctcatttttgtttctaaaaagtgcttagaataggtctaaaaatgtatgtattcaaacactaataatggttataactgaatggtaggattatgagtatttttattttgcctatacttatgtatgtatttttctgtattaagcatggatgatttatacagtgaaagtaaatcaagaaatatgtttgaaaaccatcttgcccacacaacaatttgaattcagtaatgtcaccaaactgtatacttaaaatggttaaaatggtacatttcatgttatgtatattttactacatttttaaaaagcccatggctattatactgcaaaaaccaaaatcaaagccaaaaaaccaacatgcctaattccttgagtccactagatgtttgcatgcctcttataattcttttagtaaatgccttatgtcatttttatattttaactattgtctcaaaatgaccacagtacgtttatttggaatttcaagtaggcagaaagtatgccaagaacagttgttccagaagactcttgaggtgtatgtttgtttaattagaggcaggattcggtgggcaaacaagacagagaaatgttgatggggaaaatattggctctgtaagtgtgcttttggtaaatggtagtatctgtagtgaccatattcaaagaagaaaaatgtgttaggagaagttcacattaacatatcgtgacttcaaattcaactcaagttcataaatagtatttcatgttaattccaa

SEQ ID NO: 5413 - DNA, 1567 bp, Homo sapiens
atgcaatggggattgtttttaaaggaaggcaggcaagtagttatcagcttcaatagtttatactgaggacatagaagagattccagcatgaccaccttcctttattcctttctttttccctctttcctttcctctgtatctgccttcccccctttctgtctcactcaactttttcgaaggtcagcaatcaactattacttgttgataggtgcttaagtaagggaataccctacatataattagtatcactcaattatttttaaatacttaggactccttccttgattttcttttctagccatctcaaataacaaccatttgcacctactgtgttttgaagttttctaccttgtgtgtatgtgtttgacttaaagtaacacaatttggaaacataggagtcatcaaaattaatatttaaatatattttttaggaagtctaaattgtaatgaatatttaggaagtttttattgagggttattatgttctcaacattgtaccaggtactgaggggaaaaaagaaggaaataaggaaaccaacctttctttgagcgttactatgtatcaagccctttcacatatgttttctcattttatcttcacaacaacactgtgaggtaagtattatgctccccattttaaaggaactcagagtggttatatgacttgcttaggccactgtttggcaaatggcagagcccacagcatgaacccatgtctaacagagtgaacctagagttttgtgttcattttcttattccacagatacaagatctagcccttggctttaaagaatttatagtctagtagcaaaaatatgccacagacccttgggattggtattttgagatgttttatggctaagttttgaagggagttttgcaattaatacatgcagttacaatttaggaaaaagaggtatcattaaagacagaatcatcaagaaaagcttctttggacattgagattgtttggagaaatagtaagatttcaaaagataaagttactttccaggtaacaagaatagcattaatttgaaaaattatttctgagaaactttggctgaatttcttttcatcttgtcaaagtaagtgggtatgaaatcttcagaaatgaatgaaagctccagatggtatgttatgtccttatccctgtatagagtgaaaaatatcaaatgaggaaaaagaataaatgataggaataaatatggcgtttgaaatacttagcagaatgccctaatcatgtcagacattgttttctcagggccacagttaggcactagctaccctgtttgttagcttacctcgtgttttatttgtagtttctgtagtaacattgctgttcatcttttctcctggtagaatataaaataattttactgacaaataaatactccattttaaaatcctacctacagagtttttaaaatttaagctaaaaaggttataaactgtagcttggaaggtggtacattatctctttatatatttattttttaaaaatttgccttcttgtatgtagggaagttggagtattgtggatgggaagtggagggtggggtaggaggat

SEQ ID NO: 5414 - DNA, 1051 bp, Homo sapiens
gtagccttccgtgaagaggtccttcacatcccttgtaagttgtattcctaggtattttgttctctttgtagcaattgtgaataggagttcactcatgatttggctctctgtttgtctgttattgttgtataggaatgcttgtgatttttgcacattgattttgtatcctgagactttactgaagttgcttatcagcttaaggagattggggctgagaagaaggggttttctaaatatacaatcatggcatctgcaaacagagataatttgacttcctctcttcctatttgaatcccctttatttctttatcttgcctgatttccctagccagaacttccaatactatgttgaataggagtggtgagagagggcatccttgtcttgtgctggttttcaaagggaatgccaagaaagagcccatatagccaaaacaatcctaagccaaaagaacaaagctggaggcatcacgctacctgacttcatactatactacaaggctacagtaacaaaaacagcgtgctactggtaccaaaacagacatgtagaccaatggaacacaacagaggcctcagaaataacaccacacatctacagtcatctgatctttgacaaacctgacaaaaacaagcaatggggaaaggattctcttatttaataaatggtgttgggaaaactggctagccatatgcagaaaactgaaactggaccccttccttacactttatgcacaaattaactcaagatggattaaagacttaaatgtgagaccaaaaaccataaaaaccctaaaactgtaaaaccataaaaaccctggaagaaaacctaggcaataatattcaggacataggtatgggcaaagacttcatgtctaaaacaccaaaagcaatggcaacaaaagccaaaattgacaaacgggatttaattaaactaaagagattctgcacagcaaaagaaactatcattagagtgaacaggcagcctacagaatgggagaaaattttcgcaatctatccacctgtcaaagggctaatatccagaatctacaaggaa

SEQ ID NO: 5415 - DNA, 1884 bp, Homo sapiens
aattgtaggcttatgtattttcttttgtaagctaagttaaaagaaaattgagtaactaaatttttggaggccagtgttgtaggacatatattgtaccataatttattttttgcataaaagctgctgttcatttttttcagcattaacatgcgtgctttcctcatgtaggagaatatataaaaaactggaggccaagatacttccttttgaagacagatggctcattcataggatataaagagaaacctcaagatgtggatttaccttatcccctcaacaacttttcagtggcaagtaagttaattataattgttgattcatcttgtatttatttatttttatgattttatgtgtcagatatcttaggctatatgagaaacctgtgaaaaagtttgggtttatatttaatagagaaattttcagctttgatagaatttcagtcccttagcatagaggttatcgataacatttggtcttatacaatgcaatagagtttaatatttttatgtagaacttgaatgtgataaatataattccccaaatacatacttcaagtttttgtttataacataaaaacaaggacctttgaacttggttgttagatttagcatgattataagatgttgtggtacttaatgcactttaatcagtttcctgtcataatcttagctcttttgattgtgtgatgagaaacaggtgatttatattagaaatcatcttctggggagattttatgttcgtagttaaatttttcttccttacaaatatctaacaaaaatgtttaaaacttacttagaaattttgtatttgcatgaacatagcacaaaataaactgaaagatgacaatgatgataatgacaatgattattattgttatgttattaccaggctcttccaactcttcaaatatattgattaatcaattagagaatctttgtgttaatttagaagtaaagtgttttaaattacgctaagttaaacttgcctaagatctagctcgtctgtattattaagctaaaatctttaacgagacaatatccttaattttgattttggttatatgttatctattagccatatttgggaaaaaaagatacaagggaaatttgaagctaaaaaatgcaataatataacaaaaaattcaagaaaataagtctttgaatgttacaaatttcattttaccattataaaagccgtgatctttttttactcctattgtttaattcaggttagcccttattagtgggttagaatggctactgtattttttttaagaaaaagataaaacaataaaccaaagggttaaaagatttgtgaagtcatttgaacgatatggatactaacttaaaaaaaaaagctttctctgtttatattagtggattcttaatatagatattttttaaatgagatcactatgaagtgtgtgtgttagttaaggaaaacatcttttttcccaccaaaatgctcattagataataatggttttctttcaatagaaaattattttttaaaccctattgtcaactgaaataatatattgtattttgtattgacttaagaacagattttcattttaaagactttttgagtgaacatttgctttaaagtgatagaaattagcttttagaacataagcagcatacattatctaaatgccctacctaaagccagtgtagctttttagtttatccattttaccagcaaatgttattggtttttctgaaataatttataaaagtacagaattcttgtatctgctgatcaaaatgcagcattttttgaccttatgaaatttcacaccccaacgagttttaaagacatactgtatgtcacagtctgccaacatctgctccaacacttccactggcagaggctgaaataaat

SEQ ID NO: 5416 - DNA, 2457 bp, Homo sapiens
atgagatgctatttagaaatgccaaagaataggggctattgccatccccagtatgacattctggatcactaagaatggttaaagaaatgggagaaattttcacttaaaattttaattagtcaactcatccccttttcttctccacctctcacagctgcctactagacttaaagctccacgagggctgggactatgcttgtatcatttattaaagctccatgagggctgggactatgcttgtatcatttattgctgccttcttagtacttgtacatattttgacactcaccgagtatttttgattgaataactgttagcccgtttttcttaaatctaagtaaagatgtttaaagtggcttttttgatctaggtggtcttgagcagcagcaccttaaaatgagtgagctgggcaggagttcataatgcttagacattgctcaattttcacagactatcaacacacatccaaagctggttgatgacaagtggtcaaagacattgcatagacatcagaatagaatttaacacttttcagttgcctgagggcaaggaaagaacatgtttcaagactcaataaaagataaatgataacctaaaaattcaggtttttaggagttggaaaatctaatcaatatatgtatttaataagtacctataatatgcaaaatcactttaaaaagttacatttcatattgtccctgtgcagttgaaaacttacgctagtttattgcaatgtagataatatgaacaaaattcttcaggatatttttctttttcttttttttttttttttttgagatggagtcttgctgtgttgctgagattggagtgcagtggtgcaatctcggctcactgcaacctcccgcttcctgggttcaaacaattctcctgcctcagcctcccgagtagctgggattataagggccccgccaccacgcccggctaatttttatatttttagtagagacggtcttgccatgttggccaggctggtctctgactcctggcctcaagtgatccgcctgcctcagcctcccaaagtgctgggattacaggagtgagcaaccacgcctggcccaggattatttttaagacatcaataaaacatggttatgataagttgagtgagaagcacatttctttgattctctaagagacatgaataggcttccactcagaactaattgtactcctctgtataaaactgtaatcagtaattttaaatactgcaaatgtcttattatatttattgtcatgcatttcttcagcaactataattgattactgatatttaagatgtatcacataattatggactatacagtattttttgtgctaatatttatttatgaaatccattagtagaaaagattttgccatattcttttaggtagttcatatgtgaaaatttggtgtctgtcaacaggcaactaaatatttactacattgtgaatgatgaaattaaatagattttatgctgaaattaacattgtatctgtttttgtcttaggtaaaaattggctcatgaagacttttatttaaggagtattgccaaagatagtttcttgaagcatgtacatttatttttactgaaaactgcctttttctggtttaaagctgctctttgaaaattcataaaatgtttatatttttatggtactgtacatttgtgtgtatcatttataaaaattcagaagaatctgacttctgctcttttctttggaagactagtttacccctctgatatcctgatattcaaaagaactaaaagtattagtcaaattaatactgtgtttagatgttggataacctcttcatttccttacataaaatacatgttttatatacctgacactagccaaagagacttaaaaaattcatcgttgcctcatttatgtaaatacttctgaataagtgcagtactgattagtagaacatttaatgtgtggtttgtagttggattataaattatattatcataagtggtattagtattagtatcacttgctaacaaccaaatcaaatacttgaaatatgtcaggtaatgttctaagggctttttacattatgtccttacaaaaaccctttggtggataaaaactatgatttctgtttttcagatgaggaccctgagatgtaaagaggttaggttcatgcatctaataaatgatgtgattaggattcaaacccaagctgtgtgactccagagtccttgctcttaaccattacattgttctgcctggagcattttaatgatgaggttgagtgggaaagaaactgaaggctaatttgagaagtttgttgacctcgtattgatcacaacaatttgttgtaccttttgttacacaacatagcattggtttaaattaaaatttcttttattctgaaaatgtgaccacatgcttttcacattgacagtatggccagcttttttttttttttttttgcataaattct

SEQ ID NO: 5417 - DNA, 1045 bp, Homo sapiens
gcaagtatacatattaaggtgattgaaatattaaaggcagaatgtctttgaagttacaaagaccagatttaaatatcacttaacttagatgagtgaatttactcatagtcacttaaactatttaaatgtgaatttcttcatcttttgaaagaaggaaacaatacttgctattcaaggatcttgtgaaaacaaaatgagataatatatttagaatgtcttgaatgaattcagtagtagctgttagtatttttattaggtgttatgtgcaagtctagagctctgtagctattacaattggagtatttatataatgctctgactatcatagaataagaataccaagctgtagaggctgtttgagagaatggtcacagatagaaggttgtttcttggaaccttatgtttatttagggatatatgattgttttataaatgtggagggaaataaattatttaaagaaaatataaagaaaacagttggataaaagtatttcggatgtatggtattagtggttatttagtgatgatgatttcaaattttgttcttttgtttgtttgtttttgagatggagtctcactccgtcacccaggctggagtgcaatggcatggtctgagctccctgcaacctccacctcctgggttcaagggtttcaagcgattctcctgcctcagcctcccgagtagctgggactacaggcacgtgccaccacacctggctaatttttgtatttttagtagagacggggtttcactttgttggccaggcttgtctgtaactcctgaccttgtgaaccacccgccttggcctcccaaagtgctgggattacaggcgtgagccactgtgcctggccagctgatttcacattttgttctacaaaattatttttcatacttaaaaaagtaacctcagtttattttggagctgaacttttctctgctacggccagtacttaagctgtatttgggttattatctttaaaatgagactttggaacacctagctaaaaataatatttcttctcctcatggaggtttaaagcatta

SEQ ID NO: 5418 - DNA, 1037 bp, Homo sapiens
tcagtctttgacttaatatttgcaagtatttaataataccccatacattataaattaaattgtatttggtacctgctagatcttatgagaaattattcacatttaataagaaaacagcaacttgttacttttgtggcagatatgagctcttaaaagatgcaacgtaggtaaataaaaatgagaatgtttaccagacccactaggatcatttggttctgtaattcttatttatgaacattttcttacagctttgttctaatttaattatccctattcccctttaggtaaaggatatcagaattgtgattatatgaagaagaattcttcttaaaaatcatgtattcttggcaaatatttcttattagaagcttttaaaacagtcttaatttttccttacagacaaatttttctgcagtgttgtcattgatataatcaaaatggtttcaggtagttcagaaattgttgacagacttaactaagaaaaacttttgatcaaatggtgtaacaacacctttcctggacaaagccatcattattctgttaaattttcagatcttatattcacatcccatttaccctaagtattatcactaaatggagtattcagtgtacacacatatcctcaacttgattttcctaaatggaaacaatttttttttctccactaagaatggctttttattcatatgtgataaaaagataagtcatttggtaacacctttgaacctgttttcaaaataatgaaaagtttctcttctaaaaatactttttttctttccctcgtttatttaacaagaagagttattatgtaatgtttttctgcagatttttagaaaaagaatgatctctctccactttgtagagaatgatcccattttttgtttaacaccagatagtatcatgacattgttaatacagtaggattcacccagtttgaaagtatgcagaatcagacttctgttgttggtcacatatttctcaatcaaaacatctgtctatgtcgaaaccaaagtcggcccagtataatgaacttttaa

SEQ ID NO: 5419 - DNA, 1050 bp, Homo sapiens
acttgctttgggggagaatgaggggcaagagacaggagggcaggagaagatgagagagatccaggttctgaggctgcttctgataccttccagtgcaaagtactttgtgtgctgaagtgccatattttggagtattgttttctgagctccagcattagccctatttgccagtagaatatggtgtggcaagtactttaaaagaatgctttacatgcttattttctcaagagtatataccgtgagcttttcggaatagttggaccatctgggaatacgtaaaaaataaaaggaaaaggacaagagattattgcattttgattggctccaaattgtattaacccttaatatttatctactttataattttaagatactaatatttgaggagatctctttattcgaattactggtttaagataatattatgatattaacaagtctctttttttctcctcacatcttttagaccagagcagacaggccaagtcaggctgagatcctatttatgataaaaatcatagaactctatgtagtattgataaaacacatgaagattatattatacttagcttttaattatattttgacatttgctcatgtttgatttagaacttttttttttttttttttttttactatgtcttttggtctcatcaaaaagattttaagatcctttttattttggcaaaaatatatgtaacatgaaatttaccattttaaccatttttaaccatttttatttttattttatttttaattttttttgagtttgagttttgttcttgttgcccaggctggagtgcaatggcacggtcttggctcactgcaccctcacctcctgggttcaagtgattctcctgcctcagcctcccgagttgctgggattacaggcatgtgccaccattctccgggcaattttgtatttttagtagagatggggtcaggctggtcttgacctcctgatctcaggtgatctgcccaccacagccttccagagtgctgggattacaggtgtgaggcaccgcgcccggccaccatttttagatatac

SEQ ID NO: 5420 - DNA, 1029 bp, Homo sapiens
tttgaaatcgtgaagaactgacagcatatgaccagacagtttttctacaaaagcattgggattgcctgtcctgtcctatctgttcccataaagttttaggtgaaatacaaaggtttatgatctaaattcacaattgctagtatgatgcattagcacaccataagttcacagtactctttgcactatattcctgaatgattaaaacttacagctggcatagtatcaagtgctggctgcccaagtgtctccctcacaacctatagatagagtttattgcctgtcacagaaagggagtacaccacctggttagaactttggcggtttcttggagggaagaaagcaaggatagtatgtactgagaatcaaagtttggttgaggttgagtgaatactgggtgtgtgtgtgtgtttgattaaaattggatgatgaccattatgcaacagcaagggattcaaaaaatcttacatactgttggggctttctattgaatcgttgatgcgtgtttcaggagtttgctgtgatgaacaatcaaaccgtttgccagggtgaggctctccctgaatagtcaagtcatgttaacgtacactgtgagttgtttagggagttgatagttttagtcttcaagttgtatgtggtttctgttaaactattaatgtcataggactacaacatactacttcaagctcttaaaatggctttcccttatttttgagagatgtagctgagtgctgcttatagtcaggtcaattcttataaaacaccaacatccctctatgcctaaatatcaaatcagtgttataattatttttttaaactaagattatatcaaattttttagtttgatacttacaaaatagttatgatgcttttttttcttggttctctttttttctttgctagaaagactttgaactataaggatggaggttccttttctgcagacttaagaaagaggatgtgaaacttggtgtcatgagttctaaatacctcaagttattgttgcaagaatagggttttcagttttgcaat

SEQ ID NO: 5421 - DNA, 1033 bp, Homo sapiens
atgtatccccatcattaagcaatgcatgactgtaatggagtaatgtgacctggtattctttttcctttttatagttcacactgtatatttttaaacaatacttcagtgtttcagtttatttgtgaactttgatttgtgcactcatttacacattcatacatacattgattcactccttcataaatactttattgatgaaatattacttactggaagtgccagtgaggtacaggagatacagcagtacacagtgctgaaatagtcacagccctcatggacttgacagtgtgtttatcattggattggatttaagagaattagctaatttttttctgttgagagttcatgccatatttgacttttggattttctgagatttatattaatacatttgaaaattttggttttagaattaggctaatggttacagttgtacctcagtttattgtgctttgtttaattgcactttgcacatattgcattttgtacaaattgaaggtttgtggcaactctgttgagcaagtctatctgtgtcattttttccaacagcatatgctcacttgattagcatttttagcaataatgtttttaattaagatacgtactttttaaaagacataatgctattgcacatttaatagactatagtgtagtgtaaatataacttttatatgagctgggaaaccagaatttcatataacttgttttattgccatatttattgtagaggtctgtaactgaacccaaaaggtctctgagatataacttgtatatagattttgatttggtcactacatatgtttatgattgttagcttatacttattggcattctgaaattttccttttttcacttaatattgtttttgtgctctgtccgtgtgcaatgtagttacagctgtagctaaagctattggtaggttatgccttttagctgctgtatagtattccatttgaatatgtagcactactttttatttattctttaattgatagacttttagaatatttccccttttcctcttctagtcagt

SEQ ID NO: 5422 - DNA, 1325 bp, Homo sapiens
ttctagtaaattccattaacagtgggcatcaagtacagccatttaaggccttttatgtttttcttgaccccaggtttttggaatctgaatgttgatttatcactaagacaatgattggtaattgtaatttctaacattgattactcactatggtatgtgccaggcactatgctaattggtttatataaaataacctaagctttagaacaactttctgtggtaggtgttaccaaattattatcatccagttttctagtgaaatgggagtttcagagggattgttatccaggttacactgataataagtggcagagccaggatttgaatccatgtatttgactacaaagcatatactttttacccccatctcaagctttctgtctagcacttgcattttcttatttttacagattaaaaaaagtatgtggcagatggtttaggctaaatataaccaaagctaaatgcatctccccctaaattacttaccactgtacttaatatttatttaggatgtattttgtgtttagcactagcacaaggaagaataattttactttttaataatatttgaaatacatactttgaacttcaaattcattctcccattctatttattcttccatggcattgtctcaaatacctgtcattggcttctctcctctacagtttgacccatcagttgggtttacatttgtttcccacaggtgattgtggtgagcatgcacccacttttgcagctatctaataaaaagatggaaatagttggacaactcatatcaactatgagaatgactggtgatgactgatagtaagagctggctactcatgctaacgtttgttgctaggtatgttacagtagtctctaataaaaatggtggaaaatgttatgagaggaaacgcaacgaaatatttttctgggtataaagtaatgttacaaattgcttttggtatgagtagccagttaaagtttcaaatatcatacttagatgatatttttagaaacatgttgaaaaatagtcatgtggtgcagaatgatgtttcagtcaatgatggactgcatatatgacagcgatcccataagattataatggaactaaaaaattcttattgcctagtgatgtaacatcatagcacaatgcattacgtttttatggtgatggtggtgtaaaccaacctattgcattgccagttttgtacaaaagtgtagcacatacaattatatacagtacatagtacttgataatgataataaatgaccgtgttactggtttatgtatttattatactgttgtcatttcagagtgtactctctctgctttattttc

SEQ ID NO: 5423 - DNA, 1034 bp, Homo sapiens
cctgtggattctcatagttgtcctatttattgtagaatttttggctcaagaggaaagctactgaaatccttaaaacaagaattgctttattttactaatatcttaaggaagtctaccctgtcccttttctccttttcactttcttttgtttgttcatccctgtattgagtgctcactttttcttttgctttctacttcttcattagttcttttctttctacttttcatctttcttagcaaaacattgtagaacccacactttgataaatgctgtggtagggaaagggaatactagtaagaagaagaagaaggaataacagaaggggctcctaacctggatttaggagtcagggaataacaattacacccatgccttactgagctgttactacacgccaagcactattttaggtgttttacctgaattaatctcatttaattctcatagcaaccttatgaggaaagcgctatcacccccattttgcagatgagtatgaggcacagagaaataaagtgacttgtccaaactcacattttgtgtatgatagagccaagaaaggctttctagaagttttgagcttgaagctgagatccgaaggtagagtaagagttgcctggtacactgtgaatggaagcaggttatgggaagagggaccagcaaaagtgtgacagaaaggactcttgcacctttctggaagtgaaagtagattagtagggtttgagggattctgtgagaaagggactagtgagaaatgatgctggaaagattgctctatgttcagataatttacatatgttatttgtgtgtgacggttcatttattcagcaaatacttgtgtctatgaaatgccagttgcatggctgttatctgttgggaaggtggaaagaaaatagcaatataggggtggcatacatctggatgaagttacgtggactttgaggtgttttaaagtagatgaatcttaagcaaagtcttagtacgtctgttttgtttcaaatcagcatatgccttgactttctcattttgttaggct

SEQ ID NO: 5424 - DNA, 1098 bp, Homo sapiens
caagtggaggtctgagtttgagagccaaatgacctgctgattgaattgcagaaccaggccaactttttcaagcactcttcaggtaatataaataagacagtgccatagagcagggatctttatggtttttgttgcaattgtagctactctgtgattgtgatgcaagaaaacagccatagacaacaggtaagctaatgagtgttccaataaaactttatttagaaaaataggcatcagccttttgtagtttgctgatctcttgcatagaggaaaaagacacatttgcattttctgcagcctactagtttcaacaggaagaaaaggggcccagcagaatcctgcataccaaggatttttcctcaccagtttttcaccagattaaaatactccatcttaccagaattagagggagtaaagggagagaaagaaacctgaaataatactaatgagctctccttgtaagaaggggggcaaacgcttttctcacaagtcccttgacactagaatttactctgttactcaggtatactgcctttccagtggactcaaaagaacctataaaacacaaagtattactttgtactgcattttccaaacttgagagtctaagtgttttggtgctaattttggcgtagtttctctcattttttggttagtgatagtaaaaccatgtaatgagctcccaggaagacccttctcttccggccacatgtgttgacatgaggacatgcctttggcctattttgggcagctaagattactctgtggattgattcatattttttgagtgcctacaaaatatgaggcattttgataaatgctggggatacaataatgagcaatagtgatccagttcttaccctcacaagagcttgtgctgtgtaacagaaagggctctaaaaagaaaaagtgatttctaatttgaaacctgagggactagcagcacatgccaaaggggacaaagttcagcatgttccgggatttggggaaagcattgtttatctggggaacagagtgtaaggggaaaatggagatagatagctgaggctggaaaaggaggagggagcctaggttgcaaaacctgtgtaagcacttggg

SEQ ID NO: 5425 - DNA, 1035 bp, Homo sapiens
caatactcttattttatttttgagacaggatctccctctgttgcccaggctggagtgcagtggcatgatcatagctcactgcaacctcaacctcctgggctcaagtaatccttccacctcagcctcttgagtagctgggactgtacaggtgcacaccaccacgccgggctaatttttaaattttccgtagaggacgggcttaccatattgcccaggctggtcttgaactcctgggctcaagtgatcctcttgcctcagcctccccaccccaaaaaaatcctgctaggattacaggcctgagccactgcccccagcctacttttattttagaactgagagcttcagtaagatcataacaggaaaatttaaaatctcccccattacttgtaaaagaacatctttttgagaaattaaaacaattttttttttttaatgagccaaggactcatgaatacagtgatcacaaatgagatcccctcatggtgatgagaatagccatttcagaaattaccactgaacatagtaaagaatactggaactaatagttggtggtgtaaaatgtgatcaatcaagagagtctatttctgttatgtataataattttttttttttttttttttttgagacggagtctcgctctgtcacccaggctggagtgcaggggcgcgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggccaataattttttaaggtaaactttttcttaaagtatgagatacataaaagtgaaagaatcataagaatacggctctgtaaatattcatgaagtaagcacaccatgtaacacctatatttaaaaaacaatatta

SEQ ID NO: 5426 - DNA, 1077 bp, Homo sapiens
aaattaaatttggcaagtgattaatgcttaataaggagtaattgttttatctattttagggaaaaattaatttaacaaacctattattatgtgaaatttaggtaatgaacatgggcagtacataatttccgtaacatttatagcatcgaccacaaaaaggctgaattagtgtcatcaaatacaaagaatgttcatttcagaatcaaagctgttcggaaagcagtgctcatggttactataattaattcaacatttcaggactatttaaaattgttatgtcatatcactttagtagatatacctttcagatgcatatatgcctgattttggataagtgtattttttgtacttttcagtttaaaaatttttttcttagttaaaaatgttctctcatttaatgatttttggttttgtatcaaaagcaaagaaactttcagttatctcttaaataataaaacagaggtcgcccaacctgcactgttttggaccctgtatacagcattaacccagctcaacagctggctgtgattggctagccaatcagagtaccaattctgtagtgtcctccacctttccctgaagctagtagagttttggttgagtggggtataaatgtgaatagcagattagctaattaaaatggtcctagatagttgtaggctccagtgctgaagttcctggaggataatccaacctccctaaactctcttgataccgaagaactcacctggaatagctacagcctacttttctgtccccctccccaccttccctgcaagctctcttcccctgtgggctgggtcctgtttcagctcttccatgcatgtctcaggaactgttcctgtagacaaaggtccattcagcactagaatgctttttccaggctgcatttctaaatctgagtccctgtgtatcttccagatcaaagtgcccctctccccacaacaatggactagatttgccagggcctcatagcagaatatcctgtctgactctctcttcactagactaaggagaaaaaataacaaaacaaaaatgaagaatttattttaaaagatgaatatagcattcccccct

SEQ ID NO: 5427 - DNA, 1095 bp, Homo sapiens
tcctgtgagaatctgttgccacagctgatctgataggaggtggagctcaggtggtaatgctcgctcacctgctgctcacctcttgctgcgtggcctggttcctaacagccaccatccgcggcccaggggtggggaccctgcacttggtaacagcacctcctatctctccatccctcagcacattggcagtaaccaagaatgtctctatgtgttgccaaatgtccagtgagggtggggagcacatcactactcctggttttgagtaccactgctcacagtaaaatcaaatgcagatacaggcattctacagctaatcattcagtgtaattatcaactgtggtaaatgctaattatggaaagtacagagggccatgagactgtaaccaagaaaataatgactccataataaatttggagttcagtcaaacaaatcaaagtttcccttgagtgtatagtaggtatttgatgtcagaaaagaaacttaagacatggtcttttactttaaggataagctggctgtgtatcttccaaaccagtaccctgttgagagtgaaagcgtgctctataataaggaaactgggaaaataaatagagatgaggcaaattgtacataatctacttccaggctttcattatctacccagagaataagaccagtatatgaaacacacagagaataattcaagacagtatatacattaagcgctaacctatgtcacattattagaagagagggttcattgttacttctccatctttgctttatagaaggcttcatgggaaaagatgggattctagcccttcaatttagttctggaggtttgccataaaatatctcaatgttcctattcagttattttacactctactacctaagcccctaacctgttcaagagttgtgtttgacatagcagacaatagagaacaactggagagtcttgatgaggaatatattatgatgaaatggttacaactcctagaagaaacattcatttctctaccaaccttgatcagcattgaggtacaaaagaacagtattatacaactatcagatgtacatactgaaaggacatttctttcttaaaccaaattcta

SEQ ID NO: 5428 - DNA, 1039 bp, Homo sapiens
taatgcatactttggggattcccatatcccaccaaagcttatgctttgatctttaggtggaattgctttatgataaaagggttcttttactgttcattttggatgatgtggatgagtcttagagttttattctggtctttacaaatatgatttgctattttctaaacttatctaatgactaacttaaggcttgttatgataagattataagaaaacactttggggaatcttgagagttttctttgtaattataatttataattctgtaacatagagaacatgattaacatgaagctctaaatgtatccaatagttttgctttcttatcagtgaatctatcagtatactagtagtaactggagaatttcaaagatatgcttacactttaaaccctcaatttccagtgcttcaggtgggtttgcacatatgacaagacaggcaaggagtaagaaggagccagtataagaattaaaaaggagaccgggcacggcgacttatgcctgtaatcctagcactttggtggccgaggcgggcagatcacttgggctcaggagttcgagaccaccctgggcaacatggctaaaccctgtctctactaaaaaaaaaaaaaaaaaaattaaccaggcgtggtgtcgcccgcctgtaatccccactgctctggaggctgaggcatgagaattgcttgaacccaggaggcggaggtggcagtgagccaagattgtgccactgcactccagcctgggggacacagcgagactctgtctccaaaaaaaccaataataattaaaaaggacttgagtgatacatttattaatttggcaaatatttattgatgatttcctacatatcaagctgctctgctggaagactgtaagtcaaaatagggttcttgacttcatggaatggtttcctcacttcagcatttttgaacccgatcattcttcctcgtcatagcaggctgtcctgtgcgctataagatgattagcagcatccctggcttctgcccgtgaggtcagctgtctccagccttcttggcacc

SEQ ID NO: 5429 - DNA, 1032 bp, Homo sapiens
attttaccaaaatttatatgattgtaatctgttgtataagccccaaattttctgtcattcagaaatatcggcagtgaaatccgagttcagggtaaaaatgtttctgttgtgctgcagagccagccactggagggtgttcatgttaacttcgtagtctcagtattctgctgattagattgatgaaaaagtgaagactgtccatttacaagtcttttgaaattaaagcaaaagtactattcgtgtctgaaatggaaataaacagaaaaggagttttaaaccttaaaggaaatatgatatttaaattctaaaattagtaagcaaataactttcttttgctttttactcaaagacactggtcagtaataactgtaattttgaatatacttacaaaattatatgcagttatgaggttctgataagtacacaaacatcccaaatttatttactaaacttttttgacattgttctaatcgttttcatttaaatttgagtatgctatagaattttgatgtgtacatctgctctgtgactccttccttattttaaatctgttgcaaaattttccccaatcagttggcatgcttttaagccagtagtgataaacagatatccatgaagggctggtagagtcttttgtcctgaatgggttttgagctcaagcctaaagtaaatattaaggtgaacttccaagtgattcacagtaaagcactagcttctcattcattgaatataattgataaagtttgtattattacatagttatgataggattttaaagacagcaggattctctgaaatatagcttaccaattggaaaattactttagtgtgatgtattctgaggctgtaaagtttatatcatttttaattgataaaattgttctaagttcttattagaatcttgagaaacaaaaattctactgagtaggctgtttattcactttttaaaaatgtatgcgaatttcagtagaataaaatgatgatttagaaattggttttagtttattagttaacagtagtaaaataaacttt

SEQ ID NO: 5430 - DNA, 1046 bp, Homo sapiens
cctttccctggcagaacattgtgtataaagtaatcttaattctttgtgaagccaatgaagacagtagattctctattaaagtaccctgtacatttccatcataggactaattgcaatttaaaattattattaattttcttttttattttctttctccccctgggataccctctgtaatggtagtcttacacacagtagggccttagtaaatgtttattgaatatgaatggatgcccctcctcaccagttgagagcagtgcacatatatgtaatacaaattatttaacagtgattacaaaccttaagcctttgctctatttgctaccagactgattttctaaaatagtgtttttaaaagttcactcaaacttactctgtgccagacttacaataagttttgagaatacaggcacaaataaagacataattcctgcattttatggaatttggaaataaagaggaagaaatgcttaaacctctttggacaggccaagaaaagctttgtagaggacacctgatatctttaaggttcttttcagccaaaaaattgtataattcacaggtgcccttttctgtggcagtaggtaaaaaccttggtagctgcaaagagaagacagctgccagcagggtatttttggctgttcctgaggctgccctcattctgattaacttgaacgtttacttcggcctgaggagtaactttgtaacttaaatctaatttcttactaaatagagattatttttagattatccattattttgttagcagagataattgaaaggagaatttagtaatgttttctgtgactttactgaagccagttcaaactttattgtttaatttttgtttggttaacaagggaatcaggagacattagcacttcctactaataatacatcatataacttatttatcctgttaattttctctttcaatcccgctagaatgtaaactctataagaagggatttttgttcttcgctcaataaatatttgtgaaatgaatacttaggaagtcattggtagccttaccagggtagtttaaa

SEQ ID NO: 5431 - DNA, 1034 bp, Homo sapiens
ctgagtaggtgggattacaggcgcatgcctctacacccagctcatttttgtatttttagtagagatggagtttcaccatgttggtcaggttagtatcgaactcctgacctgtgatctgcccacctctgcctcccaaagtgctgggattacaggcgtgagccaccacgcccggcctatatctcagttttttaaaagttgtggcacctaactaaaatgaactgtttttgatagggatagagaagggttctgtaggagtatacagaatgacattttgacctactgtgtgaagttgacagcaaactcctgaaataagtaatatttcaacagagacctgaaaaatgaattggagttactcatgtgaaaaaactgttagcaatggaaatgaggaaacatgtaagaatatatcagttaaaattaacagctgaaagccaattttagctgtaacaggtataagctcctacttgtgtcactatgtaagattttgtcaaagactttttgccttaagtaatgtaattatccatggagaaccatagcaatataatatttgttataaaatatatatattatatatatgtatgtatatctcctagcttctggggaaaacagggcatttattttttattttttgattctaaatatttttaaattatagtttatggcattttataattttaaatattcttgaagccagaactaaattctagagtttgtttatgctttatttttttccccctctctatatattttataaggcaattttctaagctttgatcctatggaaattttaccgttttcattacttttgacagtttgagattagtttcagaaccctgtaagcaaatagtaaatataattagggaaaattaaaatatttctgtttcctggtaggcaataagacattaagaaaaaaattcagacttataccaaagtagaggcaagtataatcagcacccatgtaatcatcaccagcttcaaaaattttcaactcatgaccaatcttattttatctatatatccacttactcctttaccca

SEQ ID NO: 5432 - DNA, 1076 bp, Homo sapiens
aacttgagagaaaaaatacaaacaattatagagagacagtctctgattaacatgaacataaaataaccatcaggtgacaaaccttttcacaagaaaaatgatctgtgcccaagatcaattttatagacattaactcaaagctgtgattttatacacaaagcagtattgtagcaatggtataaacacaggaaaaattcttgtgaaaggagtggagcctgcaaatgtggaactatgtggaaaagggaaaagtttgtagtatgtagaactatggcaggtgtttatatttcacagtgtaaaaaataaacttaaattgatatactggtttactaatgaatttatgaattttcaatgaatttatgtagagcttattctgttagatgggactaatagtaagaaatactacaaagtaggaaaagtttgtctctaggacccttttgtgaccttttttttcttgctctttcacactcctcatgtaatggtcaccatccatagatccttctctgttcactctgttcaaaagagatctccaagacctgtaggctttgttaagttatcttaaaaatgatgaataaacacactagagtattgatggattgtttcacatttaattgggactcttgaaagtccaaacagaattttcttatggtaaaattcaaacattgacgtctgttaggggagatatttatagagaagagaactttttgagtctgctccttaatttacaacctgttgtcagttgggaaggaaattaacattgttaaatgcttatatgctagtgtctgggtgtctgtgctaggtcatacacagtataatttgattctcacaatgagcttgtgagtatgacattcttattctcattttataaaacttttttttgtggggggcgatggggtctcactgtgttgcccaggctggggcacagtcactattcacaggtgtggtcatggctcactgcagcctggaactcctgggctcaagctatcttcccacctctccctccccagtagctgggactacagcttattcaagttttataagagataaactgaaagaggcatagaaagatgaagtgacct

SEQ ID NO: 5433 - DNA, 1049 bp, Homo sapiens
atttagactttttcttctctaagttaatgagtccaggactgattttgttagcctttctggagctgttaagaattcctattctttcgtttttggtagtcattgtctccacatttgctttatggagtcctctttggtggatcccacaggtggggaggagacacaggattcataagatggccggtgggtgagtgacttagaatttgggttagaactggccgggcgcagtggctcatgcccgtaatcccagccctttgggaggccgaggtgggcagatcacaaggtcaggagattgagaccatcctggctaataaggtaaaaccccatctctactaaaaatacaaaaaattagctgggcgtggtggcaggtgcctgtagtcccagctacttgggtggctgaggcaggagcatggtgtgaacccaggaggcagagcttgcagtgagccgagattgagccattgcattccagcccaggagacagtgtgagactctgtctcaaaacaaacaaacaaacaaacaaataataggaacaaggacgggtgcggtagctcacgcctgtaatgccaacactctgggaatttgaggcaggaggattgcttgagttcagaagtgtgagaccatactggggaacatgacgaaacctcgtctttacaaaaaatacaaaaattagctaggcgtggtggcacacacctgtagtcctagctactcaggtggctgaggtgggaggatccattgagcctgggaggtcgaggctgcagaaagccatatttgcaccaatgcattccagcctgggtgacagagcaagaccctgtctcaataataataataattggaatacaatgtgaaatttggacattacattgtcttggtgaaatctgtaaatacaatgtaatggttttgagttttttccttatgtgaattttattaataatttatatggcagagctatcatgccatctgtatgtactaggatgttaccaaaatacatgcagttgacagtttgggaaagcatagagcaaatagtatatcctaagtagatcttttctttggct

SEQ ID NO: 5434 - DNA, 1055 bp, Homo sapiens
taattcagccctgtataaaagttagaacaattacaaagtttatatgctcattactcaaattttaacatttttccatagttgtattatctttcttttttcctcttcttcctttcttccctctgttccctctctttctccccttctgtatatattttaaatatatttatatagattttaaacatatttttaaatacttaaatatatttatgttcaaatatatagaattttttcctgaaccattttagggtaaatttgagacatgatgcctcctttagtcttatatacttaagtgcatgtttcctgaaacaaaagtggtatcctacataattatagttaccaaaatcaagaaattaacattgatataatatggttatgcagatattgccaataattgcctttatagctctcattctacaaaaaataatcttgaatcatatgttgaattcaattgccatgtctttctaataatctttaatcaggaggcacatcatattgatttgtcctagtcctagtaatgttaattttgatcacctggttacagtagtgtttaccaactttcttcttcattataaagttatttttccttctttataattaataggaatcttgtcgtatgattctttgagattatgtgaatatctggttgctcctcaaactttggcccaccaattttggcatccatttagggttcttacttgaatacattattaatgatttatggtagttttctaattctgacattcctttttcattttagttggctttttactataaggaggaaatttctttctccctcgtgaattctgtcttactcaatgggttataatcttttactatcatcatttattttgaaatgcttaaatgattctagattgggcccatgaaagcactttcaggccggcttttaaattcttttgacatgtctccatcaatttttgaggacttgctgggacaacaagatattccagtctcgtcatatactttcctacctctagaagcagctctctagggagctctggttcttcttagtggaaaatagtattaactttccttta

SEQ ID NO: 5435 - DNA, 1043 bp, Homo sapiens
cgggaagagctttaggagctctgtgctagggacccaggagcttgggaggaagataaaaatacatatttcttgtaatattacaatatcacaggcttgaataccagggtgtgaggatcattagaagccatcttggagggtagctaccagagtctcatatatttccttataaaatacctaaagttctttcacatttactgcttctttaatccacccagaatggggtgtgtatgtgtgcatgcgtgagtgcccatacgtgtattgtgtatggtgttaaaggaatctaatcttttattctttcaaagatacgctaatcgtcccagttccatttgttaaataattcatcagcattgttccatttatatatgggtttgcttctgggttctctgtacttctctgctatgatctgaatgtttgtccttccctacctccccaaattcctatgtcgaaacctaatcccggatatgatagtgttaagaaaaggggctttgggtgaggtgattaggtcatgagggctctgcctgcataaatgggggcaagaaggtaccccagtgaagtagttagcttcttcttctgtatgaggacacaacaagaagggtgccatctatgaagaatgggcccttcccaaacattgaatttgctggtgccttgtacttggacttccagcctccagaactatgagaaataaataagttgtttcctatgtttataagctccctactttatggtatttttgttacagttgcccaagcagacttaagatgttttcctgtagcctatttttctattcttaggccaataccgctttacaagttttgatctctcttaggcaagtctcccctttttgttcttcatgtttggcttggttctcttgtctccaaagggccattaagagagactagttggctgggtgtagtggctcacacctgtaatcccagcaccttgagaggctaaggtgggcagatcacttagcccaggaatttgagaccaggctgaacaacatagcaagactccacttctacaaaaaatacaaaagttagctgggc

SEQ ID NO: 5436 - DNA, 1035 bp, Homo sapiens
ggagggggagcacaggaggccgtgaaggccagccctgctggctgtggctactgtgcgtggaccaagagcatgtgcagcatgagggctatggtggtgcccagagagcagtgtccagcgtgagggagattgtggtgcctggagacctggcagtatcacccggcatgagggagatgctggtgcaccggctgtggatgtgagcttgcctggtgccagaactcggaggggccagactctaatttagtacttttttatgtgattggcagtttctaaaaatttgtaatttgatgtcgtttcctttcttattctgaataaatattcaatttaggacctaaatttgtttttatagttttatgttcctttttttttttgaagagggctgttcccccaattttataagctttaaaattccgttaaaacctggattgacccctgggtttccttgtctgcctttttaatcttgtctcatactcaccccctcattccctgcagtctaggcactttcatctttctgttcctcaaatggattatgtttgttctcatgtcaggatttctgcacttgcctggtctcctctttccttagctttttgaaggatttttcattatgtacttctcaggacgggtgtcttctcagagagtcttagaacacccaatctaaagtatcttttctccctccctcatctctgtcacgtcatccattttgttttcatagcatttatcagcatcttttttatttgtttatatttttgttggctgtctctgccttttagaatataagttcagtgtattaatatgagagctgtattgttcactgctgtcttcccagagtctagaataatggctggacttattagcattcaacaggtattttttggatgaaaaattactaaaaagctggaatttgtacattttcccatgggtttatttataatactagcataatttcttattgttaattttgtgtttgtgtatggtactgctttctattatcaattgtataaactcgtttgatcttttctgctgaaaatgttgactaag

SEQ ID NO: 5437 - DNA, 1035 bp, Homo sapiens
ttgttaacaaaacatagttcagatcccttgattaaaaccctccactggtttcttgtctcatgaagaagaaaaaatcctaactgttcttgatgatctttaaggctcagaatgatctggacagaggtatttaccttgaagctcataaagcataggcctttctcacttgcagagtatctttctgaagctggactaaattggttaaggccactgtacttttccactttgtcttctttcctgtcacacaccctatcctttcaggctgtgttgggatggacaaaagcagttctggagtcctaaggagaagatgagtgggatatgtttctgtgacctgcagtcattttaaagtttagctgttgctagctgactccatgtaagaataccttccaggaatttgatggctgtgcactctggcagtgcagctggcatggttatagggtgcttggccgaaggtttgcatagcaatatgaacgcatcctacgacacatctagccaacactggaagactgtgggtaatggacgagaaaccaagattgactttttgcaagtttttaaaaataatcttcttgtaactcacatgtgaaagaaacatgagaggttttcacaaattcagtaatttgagacatttacatagcatcaccaatagttgtgaagctgaaactttagttctaaactataagtagtaaaaaaaaaacgttgattctctattgtaaacaaaagacaactattttctgtgttctctgtgtagaaaattatattataaaattgaggtggggctgggcacggtggctcacgcctgtaatcccaacactttgggaggccgaggcgggcagatcgcaaggtcaggagatcgagaccatcctgactaacacggtgaaaccccgtgtctactaaaaatacaaaaaaaaaaaaaaaattagctgggcatggtggctggcgcctgtagtcccagctactcacacctgcggctgaggcaggagaatggtgtgaacccaggaggcggagcttgcagtgagccgagattgcaccactgcactc

SEQ ID NO: 5438 - DNA, 1067 bp, Homo sapiens
ctgtatacaggataatgtgtgtaggttatatgcaaatactataccatttgatataagagacttgaatatctgtggattttagtatccttagtgggtcccggaatcagtcccccccacgaatacccagggatagctgcactcacacataatgaatttatagtggaaattctatgaaatgtatatagagttgttataatatacctaggatgatcattggtatttcggaatagcttttagaatatgaccaagatacatgacatctactattatataaacctgtgtttgtttcagcatgtttttttcctatgttttgttccatgttagatgtcatgagtttgcaaagtataataagctatattccctgccttcaagtagcttaccatccatgtaccatttcccaaagtgtacatcattagcaggtaggtattcctcaaaaatagattattgtctctgattaagtttcagagatacctggattaatcaaaattgaaagtttttttttagaatagggttctcaaatgcatacattagggaattccagaaagcgactgtatgttgcaaggttttccaagctttgtcgacacactattttttttctcatgaaacttctgtggtgggatctgaggggaatggaggtggggaagagagtggcagtggtgtttttaggaagaagattaatgtaggagaggagtgggaggaacacctaggacagtagctgtgtacctggcctaggttcctcagtccagatggtagcaagtctgaagacagggagagacttcttccagaagatgaaattcatagaaacctgaggcaaattggtatactcaaaggagctttgtcagactggagagtctggggtgaattgggataaatatatagtagataagtatgtagaaaactaaagaaatgagaaacaaattattaattgcaagggaaacaaaatgttatgcaggaaaagaaaagtaattattgtttactgcttggttcagctctgaataccctatgtagttataatgacataagcctcaaatattgatctaaccaaagttaggattgtgttgagacat

SEQ ID NO: 5439 - DNA, 1914 bp, Homo sapiens
acccattgtgggttctgcatctgtggttctatcaactgtgtgtcaaaaatacttgagaaaaaaaaaaaagaatggttacgttcatactgaacatgcatagactttttccccttattttcccctaaacaatacagtgtgactatttatatagtatctacattgtattaggtgttttaaataatctagagatgatttaaagtacaggcctagcttgttttattgcactttgctaatactgcatttcttacaaattgaagatttgtggcaaccttgagtcgagccagtctatcagtgccatttttccaagagcatgtgcttatgttgtgcctctgtgtcacattttgggtaattcttgcagtatttcaactttttcgttattattataccggttatggtgacctatgatcagtgatctttgatgttactgttgtaattgttttggggcaccacgaaccattacccatgtgaggtgatgaacttaataaatgtgtatgttcttaatgatccagcaactggctgtacccctgtctctctcactcctgagacacaacaatattgaaattagtccagtcagtaaccctaaaatggcctctacatgttcaagtgaaaggaacaatcacacgtctctctggaaatgaaaagctagaaatgatgaagcatagtgaggaagctatgttgaaagccaagacaggcaaaaagctagtcctcttgagccaagtgaatgcaaagggaaatttcttgaaggaaatgaaaagtgctattccagtgaacccatgaatgataagaaagcgaaacagccgtattgctgataaggagaaagtttgagtggtctgggtagatcaaaccagccacaacatttccctaaaccaaagcctaatccagaggcaggccctaactctctttaattctatgaagagagatgagaaagctgcagaagaaaagttagaagctaacagaggttgattcatgaggtttaaggaaagaagccgtctccgtaacataaaaatgcaaagtgaagcaatcaatgttgatgtagaagctgcaacaatttatccagaagatctagcgaagatcattgatgaaggtggttacactaaacaatagattttcagtgtagacaaaacactcttctatttggtgaagaagatgttatccaggacttcatagctagagagagaagtcaatgcctgccttcaaagcttcaaaggacagtgactttcttggtcgtagctaatgcagctggtgactttaagttgaagtcagtgctcctttaccattccaaaaatcctaggacccttaagaattatggtaaatctgtattctgcctgtgctctatcagtggaaaaagagagcctggaagccagcacatctgttcatagcatggtttactattttaagcttactgtggagacctactgctcagaaagattcctttcaaaatattactgctcattgacagtggacctggtcacccaagagctctgatagagatggacaaggagatgaatgttgttttcatgcctgctaacacaacatttattctgcagcccaggtatcaaggactaatttcaactttcaagtcttattatttaagaaatacattttctaagggtatggctgctgccataggtagcaattcctctgatggccctgagcaaagtcagtgaaaaactttccggaaaggactcaccattctagatgccattaagaacattcatgaatcatgggaggaggtcagaatatcagcattaacaagagtttggaaaaagttgaatttcaaccctcatggatgactttgagggattcaagacttcaaagaagaaagtaactgcagatgtggtagaaatagcaagagaactagaattagcagtggagcctgaagatggaactgaattgttgcagtattatgataaa

SEQ ID NO: 5440 - DNA, 1411 bp, Homo sapiens
atgattaatggatgttaaagtagatgagctactcagtcgagctcctagaccctagggagtcaataaatagtcggttttcttcaccctttttttttttttttgagacagttttgctctgttgttgaggctggagtgcagagtgcagtggtgcgattatagctcactgcagccttgatctcctgggctcaaaggatcctcccttctaagcctcctgaggagctagggctacaggtgtgcaccattgtgtctggctaattttatttttttatagatacagggtttcactgtgttgcccaggctggtcttgaacccctggcctcaagagatcctctcacttcagcctcccatagcatgtgggattataggtgtgagctactgtgcccagctgttgttttcagttttactcttctgtggtatgtggtaagagggagcatttgttttctagagcctgcagcatgtgtgggtcagttgaaaatgtataaaaattttgagttacgcacggtggcttgtgcctgtaatcccaatactttgggaggctgaggagggaggactgcttgtgccaggagtttaagactagcctgggcaacatagtgagaccctgtccctaaaaatatgtaaaaaaaattttaaaataaaaattttgaaatgcaatttgtgtcttaaaattctgccttatttatttgcaacgtgtgtttcttgtcatgtatttgctgctgtatgctggtagaaaaagcatagagagtggactcaggcagtccatgctctagcctcctgttctactctgaactagatgtgtgacattgtaagtgctgctgcttcacttcgggtgttactcctgatttgcacagtgaaaagtgttttattacaagatgatttctagaagtttgtttctgttctgacattagatgacctgtgatatgtgaagcttaagacatcttttttcattactgggtttatacggggtgttgaggcttgtgatacatttactgttataaattcattttaatgtgtttggaggacttgagatgattggagattattagattgatagctgatgtttggctttattattggaaaatagttctagctacgaaacctgtttttgagtgaaagtatgctaggaatggccattgcttttcttcctacagagataagtgatctcttggtgttgtacacatgaagctctcacctttatttttaaagtcatggattttaccttggctcctataaactcttctcccctcccccatgtagctgtaagcattcctactcctaggatgatttggaatgtgtgtgtttcaaatcatgtttagtgattgtaaggctaatctcagcttaattatcactgccaaaggaatcctctgacccccagggccagatcatgttgtttgctttcatggtatatttttcc

SEQ ID NO: 5441 - DNA, 1032 bp, Homo sapiens
gaaacctacgcctgaactatagaagtgttagctctcttcctctgctctccttccagaactgcacagtcaagcctgtcctatccttctcctgtggaagactgaagataacagcatcttcagatactgataggctttctgctgagagtaccttaagtgaattctaccagtcgttaagccctgttttcccacacagatctttcagttagttcttttcaggggcttattcttaaatatgagcaaacaatctaacaccattggtcatctgggggaagactccaacattaaaaaaaaaaaaaagtagacatagagaggtggagagggagtgatacttggaacactgggagaaaacagataccataagggatcaaaagaaaactttaaaaatctccagtattatcagagaagacatgtatttccttccccacttaaatgatagtgaacacatataaaagcagaaatccatgagggtaaagagaacgagatgagagatgacagcaggcaaacaacgtcaactaaatattggaagctgagaacctggtgcgtgagtggtaacagaatttagcagagctgagaaagcagaaagtcctatggtgtgggtagttgtgcaaaaactggtattcttttaattaatgatgtgctttgctctatttggactgctgggttcttatttttgagcagtatgctctctcccagttgaagctgttaatgggctgtccaccaatggagaaatcagaatgattaaaatgtagttcttgtatttttatggttctcttaagcagtcatgcattatactcttcttcttgtgtctgagccaacatttcataggagtagataacacccatttctggtggcactgacagcagggttgaaaagaatgttataaaagaaaatatgaataacatttaacttaagaatatgttccaaattttgtttgtaaagtagttgtttaaaacttggtagttctttttgatataatgttataaatggcagttatcctagaccaaactttaaaatatgtttcattagcaatta

SEQ ID NO: 5442 - DNA, 1560 bp, Homo sapiens
ttgggtcataaatagcaagttttctctcccaataaagcaatgtctgagaatcccaagattctcatttagtagatctgggttgagacctagaagacagttaattcatttagccaccaaatgtgtattgagtgtcttcctattatatatttattaccatattgtgtaggtagtgttagaagacatcccaggtgcctactctgtaactggcggagagataataaacaaacaggataattttatatagtgctaagttctgtgaagaaagtataccatgatatgtgccagataattacctggcaggggaaaggagagagagagctttgcatagagtgatcttgggaggtgtcttttgaagagataactcttattttttatcttgcttttttttttaaaaaagtattttttaggttgtagtaaaatatatataacataaaatttaccattttaaccatttgtaagtgcacgtttcagcgacatcaagtacatgcacattgttttgcaaccattcaccaccatctgcctccagaacttttttcatgttgtgaaactgaaactctgcagccattaaacagtaattttttattttctctctcctctcagcccctaacaacaaccattctttctgccttcttaaatttgactgctttagtgcctcatgtaagtggatcgtacagtatttgtgtgactggcttatttcacttagcgtagtgttttccaggttcatccatgctgtggcacatgtccgcatctccttccttcttaaggctaaataacactccataatatggatgtaccacattttgtctgtccacctttgaactgagatctgaaaaatgagaaggggccatgcaagaactagaagaagaacgttacaagcagaggaaagaacatgtgcaaaggccctgagatagcaataaactggttggtggtctaggccagtgttgtcagaatatattaatagtagagaaaagtgcctggaaagaatggtattaaatgggatcagagatagacatacattggccgtattattttaggctttgaaagaccttggcttttaagtggagtgagaagctgcttattaggaagttttaagtgggggagtgacttaatctgatttccatgtaacagcaaaagcaaaaatcacccagactgctgtgtggacaagcatccttgtggattctaatgcaagtctgtgatcggactttgagaaatactaatttagtccttaagtcagtatcctgagatagctgatttcaaaagagctctctcagggcttctgaccaaaagtgacagattggctacacctgtacatctcttcttatttcctaatccctgcctaaatggaagaaagaaatcagagactgggagaggttacaacaggagacagaagctgctatacctctttcaaataagcagatggacaggtagtgactgactttgcagaggaatcacacagtacctgtaagtgcacaaaaatacctgtaagaaatgcagtactgtgtttgtccgaagctcccaagagtctcagcatttggaggcaccagatactaaggaagatag

SEQ ID NO: 5443 - DNA, 2194 bp, Homo sapiens
agattgctcaatgaacatgtttaagagaaggatgagaggatagcactctggagaatactgacatttaaaagcaagtaaaggaaatagaaacttggaaataagacagagaataagagctaaaaaaaaaggaactttaagttatagacagaattcagttacttggatccccccactccccaagaattgtcttcatccttttttaactagaaagaaatatttttcttttcactatttaataagtgccccaaagtgctagatagttttcctttgaaatatagtaaaagagcatttattgaaagcagcttgtttatgtgtgctttgtttaaaaattagagacattttattttttcttaagtaacagaaatcagactttcaaaaaagctctttaaacctagactaacttatttatgacaattttgtcatatatttgaaagttaattttaggaaaattacagagccttttaaccaccctatggccagacttcagtgttgttctttttatttctacctcatttcatgttgagtcttaacttcgctgtctctctttatcatcccctacccctagtctgaatgttgaagaatgctaaagtatattttattgcttcattgactaaaactatgtttctaaaactatgaatttgcttaatgagtcagcaactgtaactataattaacagtatagtttttacaaccatagttttgtggtaaatgtgcagttctcagaatttaaatgtaaacgttcaatgaaattaaacaaaacccaaatcttcatgcaataggtagtatatatgtattcagtaagggtcaccaaacattaattgaggttctattatggttaacttttctactttgtacttagggataaaaagatgagtaaaattgtttcctgcatttttccccacccattccctccccattttctttctttcctaccttccacagccccattgagtgtctacttaatgtgccaagcacacagtatataaagatataaagagctcaaggatgtaaagataaatgaggatctagtgcctgccctagttcagttatcccttaggaagacagaccagtcctatgtcagtcagctcagaaaagtgcaataactgttgaagccagggccacacccagtcttgtctgggttcactaccccactttccactcatactttagcgatgaacagaatttaagtcatctaaaaggaggagcaagattaaaacagtgaaggaggtatgatgagtaacagaaaggagctcattggtgactaatgaaagagcaactgctgtgttaaggggttgatgaccatattcgccagtgtggagttgaaggttaaggagtgaatgggaaatgagaaagtagacttcaaaaaagctggatgttgtggagaggaatagagaaaattagaggttgaacatgtagtaagagtgagtgaatattttttagaatggggagataagtgtgtttgtttgctgtctaggagtgagctatagaattgtccaggtgagatggaaagataacagagagaagatatgagaacaaaatcctgtaggaaattagataatatcaagaacataaatagaaggcctggcacaaagtctcatgcctatgatcccagcactttgggaggctgaggcaggcagattgcttgagcccaggagtttgagaccagcctgtaacatagcgagaccacatctctacaaaacaaaaaaaaaaaaaaaaaaaaaaaattaaaaattagccaggtgtagtggtgcatgcctgtagtcccagctatgtgggagatcaggaggctgaggtgggaggatcgcttgagtccaggaggtcaggctgcagtgagcagtggtcatgccactgcagcactccagtctgggtgacacagtgagaccctgtcttaaaaaaaaaaaaaaaaaaaagggcctggcacagtggctcacgcctgtaatcccagcactttgggaggcctgtaatcccagcactttgggaggccgaggcaggcggatcacgaggtcaggagatcgagaccatcctggctaacatggtgaaaccccgtctctactaaaaatacagaaaattagacgggtgtggtggtgggcgcctgtagtcccagctacttgggaggctgaggcagaagaatggcatgagcccaggaggtggagcttttagtgagccgagatcacaccactgcactccagcctggg

SEQ ID NO: 5444 - DNA, 1037 bp, Homo sapiens
gaaatatcatgaattcagtttcagggatttgaggggagggaggaagctagacttttggggaataagggaagagtgatgcttaaataccagatttaaaccattcatttgaaaaatctgtcagtgaaaagtaggagagcaataaagtgagcagcttggttaagtgaaatattttttttaagttagagaaaatttttgtatatgtgatggcagaggggaacgtgctagtgtggtaggaaatactatagctggcagagaaagaataagatggagtgaaggttgggaggagatgagaacataggtgatggggttaatctttgaaaggaggagaggcaaactcccagttggtccagagggaaggtgagcatgagggatgagcagagggaaggaagaattactgaggaacagaagaggaaaaaagagggaatttctctgtgatggttgtgatgttctctgtgaatttggagaaggcagaatcatcacggttttagaacttcctcttctatttatgtatcccgggagtgtgaatgaagaaatctctgcccacctaacataacctatagttggtgagtggtatggcagaagtttgaaaagccaagggagtaaagttgtggtatgttctaccattagaaaaatgttaatacaaacaaaatatcaggcaatgtaacactctaatactatttaaaaatgcagttattgtacagcatgatgactacagttaatgtatattatattcttttttgtttgttttttttttttgagatggagtcttgctctgtcacccaggctggagtgcagtggtgcgatctcagctcactacaagctccacctcccaggttcacgccgttctcctgcctcagcctcctgagtagctgggactacaggtgcctgccaccacgcccggctaattttttgtattttttagtagagacagggtttcactgtgttagccaggatggtctcgatcttctgacctcgtgatccatccgcctcggcctcccaaagtgctgggattacaggcgtgagccaccgcatccggc

SEQ ID NO: 5445 - DNA, 1014 bp, Homo sapiens
ggctccacccagttcgagcttcccggctgctttgtttacctactcaagcctcagcaatggcgggcgcccctccctcagccttgctgccgcgttgcagtttgatctcagactgctgtgctagcaacgagcgaggctctgtgggcataggaccctccgagccaggcatgggatataatctcctggtgtgccgtttgctaagtccgttggaaaagcgcagtattagggtgggagtgacccgattttccaggtgctgtttgtcaccccttcacttggctaggaaagggaattccctgacgccttgtgcttcccgggtgaggtgatgcctcaccctgctttggctcacgcttggtgcactgcaccccctgtcctgcacccactgtccgacaatccccattgagatgaacctggtacctcatttggaaatgcagaaatcacccgtcttctgtgtcgctcacactgggatctgtagactgtagcttttcctattcggccatcttggaactgctccctatttttctcatttataaatctgtgggatgattgttcccaatagccttttacctccattgatgatattgcctgaatcagtttttacgttatgaattatagggaaattgctttttaatggccatatgtaatccatatttgagatccatatttgcaaggaaagatgcattactaccactgaaagaacccactcttgccttttctttttaaaagttaatatattatttggatcatggatttgaaggtatttgagttccatgtatgcatattttccttaatgagtaattttgaaaaactgatttaatttaaaacaataagttaatgacagatctctcagatagttttagaactcctaacaatgagacacatcaaatagctatgtgatatttattgagaccctactaaggtacaaggaatcacactagataatacaatgtacttaacattaaaagttgtagtctgaaagtacttacccatttaagaagataagacacatatgcatgtaaa

SEQ ID NO: 5446 - DNA, 1400 bp, Homo sapiens
atacttaatctaaactaaatctcttcaagataagcccctctatcaatttactaatgtttacagtgattggaaagaagagaatattactttcccttttaactttttattttgaagatttaaaaatatatagaaaagctgaatgtattgtgttcatgagcacaaaaatatccttaacattttgtcacatttgctttacatatatttaaaaattttattttgtgacctgatctcactctgttgcttaggctggagtggatcaaagcttggtgcagcctctaactcctgggctcaagcaatcctcctgaatgagcctcccaggtagctgggactacaggtgtgcaccaccacctggctaatgttttaatttttaagagttggggtctcactagattgtccaggctaatcttgacctcctgggctcaagtgatcctcctgccttggcctccaaaaatgctgggaatacaggtgtgagtcactgtgcccagtccatatactctttaaaatttttaattgaatcatttgaatggaagctgtagatatcactttatctctaagttcttctagcatgaatttccaaggttaggctattcataatcacagtatcattaacacaactaagaaaaatcatatttcataattatgcctaatatggtagtccataaaagtttataaattttttaaaatccagggtccttacactatatttggttatgtcacctgagactgttttattctagaaaataaaaatctaacgttatattgctttctatgacactgattctaattttttttttattatgtactttttttcttttttttttatttccataggcgtttggggaacaggtggtatttggttacacaagtaagctctttagtggtgacttacgagattttggtacacccatcacccaagcaatatacactgaacccaattttgattctaatttttttgagggttttatatcacttgttttgtgaatatcccacattctgaatttgtccagcttttcctcattgttagattcaggttgaaccttttttggtgagaatactgcatacatgatacatacttaatcaagaaggtgactgctggatctcttcactgtaaagatatatttttctctttttttttatactttaagttctagggtacatgtgcacaacgtgcaggtttgttacatatgtatacatgtgccatgttggtgtgctgcacccattaactcgtcatttacattagatatatctcctaatgctatccctcccccctccccccaccccacaacaggccccggtgtgtgatgtcccccttcctatgtccaagtgttctcactgttcagttcccacctatgccacctatgagtgagaacatgcgatgtttggttttttgtgcttgcgat

SEQ ID NO: 5447 - DNA, 1030 bp, Homo sapiens
ggctaacatattgtctgcaatttcatgacagaccctggtgcagaaccacctagctaagtcactcctttcccacagaaactgtataataaaaccttattgtattgaaaatactaattttgggggtaattatagcaatagataatagagattttgagcagggcacggtggcacacagctgtaatcccagcactttgggaggctgaggtgggtggatcacttgagctcaggagttcgagatcagcctgggcaagatggtgaaacctcatctctacaacaacaacaacaacaacaactagctgggtgtggtggtgcacacctgtggtcccagctacttgggagactgaggtgggaggatcgctatctctaagttcttgagcctgggaggtgggggttgcagtgagctaagattgtgctaaaagtgacagaatgagatcctgccaaaaaaaaaaaaaagcaatatagattttggtatcagagtggttttgttttgttgtaacaaaaatgtagtactgtcttttgaatttggaactggctacaagcttgaaggattttgaaacattagtgaaagcatgtagagccttgagttgactgttagtagaagtttgagtagaagtagaagcctttgagaaggctttgctcgagggcttaaaggaaagtgagaaaaatattaacggaaacacgaggaaaggggatccttgttctgtggtggcagaaagtttagcaactctgtcatgtgcaataagatggaaaatagaaaaatgtaacctatgaatgaagtgatctagctaaggagatttcttatcagaatgttgaagaagctacctggtttcttcttgctacttatgtataaaatgtaaaaggagagagataagcaaaatgaaatactattaaagaaaaaagagcagggaactgtagggcttgaaaattcccagcctcttcgtatgatcattgatactaaaattaagaaatgggttctagaaaagatccaatctaggaccctcatgggaaaacttgatctacagatcaagct

SEQ ID NO: 5448 - DNA, 1034 bp, Homo sapiens
gatttttacacattgattttatatcctgagactttgctgaagttgcttattagcttaagaagcttttgggctgagatgatgggattttccagatatagggtcatgtcatctgcaaacaagacagtttgacttcctctcttcctgtttgaatacacttaatttctctcgcatgattgccttggccagaacttccaatactatgttaaataggaatagtgggagagggcatccttgtcttgtgccagttttcaagggaaatgtttccagcttttgcccattcagtaagatactggctgtgattttatcataaatggcttgtatttgagctatgttccataaatacctaatttattgagagtttttaacattaagggatgttgaattttattaaaggccttttctgagtcttttgagataatcatgtggttttgtttttagttctgttgatgtaatgaattatgtttattaatttgcatatgttgaaccagcattgcatcctgggaatgaagctgacttgatcgtggtgagtaagctttttgatgtgctgctggattcactttgccagcgttttattgaggatttttgcattaatgttcatcagggatattggctgaagttttctttttttgtttcatctctcctgggttttggtgtcaggttgttgctggcctcataaaataagttagggagaagtccctccttttcaattgttgggaatagtttcagaagaagtgatactagctcctctttgtacctctggtagaattcagctgtaaatccatctggtcctgggctttttttggttagtatgccatttattactgcctcaatttcagaacctgtattggtctattcctggattcagcttcttcctagttcagtcttgggagggtgtatgtgtccaggaatttatccatttcttctagattttctagtttatttgcatagaggggtttatagtattctctgatggtagtttgtgtttctgtggggtcagtggtgatgtcccctttatcattttttattgaatctat

SEQ ID NO: 5449 - DNA, 1069 bp, Homo sapiens
gttctcaatcagatacccaggagagacagtagcctttctagaggtcagattgaaaatttgacataccaacattctctaaaatttactcttgtcgggtattattctgaaatgtagccattttgtctggtcctaggagtactaggtttatgctcctttcttttttttttcttttttgagatgaagtctcactctgtcgcccaggatggagtgcagtggtgccatcttggctcagtgtaacctttgtctcccgggttcaagtgattctcctgcctcagcctcccaagtagctgggattacaggcacctgctacaacacctggctaatttttgtatttttagtagagatggggtttcgccatgttggctaggctgacctcgaactcttgacttcaggtgttctgcctgccttggcctcccaaagtgctgggtttacaggtgtgagccaccgcacctggctatgctcccttcttaaaaaaaagatagttttggtatcctgaagtgataatgaattatggggtacgtttggtaaattatttcaattagttttattccccttgtagaatccaaattcctgtttgtagccggtaatctgaggattgtgaatttttaatgtaacaagtcaattatataagggttttcattgttgtttttaagttacagtgtgcaatgaaacggatagtcacaggttttacagcttatgactccacctctaccaacccaaataatggtcagccaaaaatatccaaattacatagtttgaagtattaggtgttacagttacttggattgtcttaaagccacatattttaatggttattatcccttattttcttattcctctgtcactgactccttttaaaatactttatgatgcagatttgaatagttgtcattgtgatttttttaagttctgggattcatgtgcaggacatgcaggtttgttacataggtaaacgtgtgccatggtggtttgctgcacctgtcaacccatcatctaggtattaagcccaacatgcattagctatttatcctgatgctctttctcccctcatccctgacaggccacagtg

SEQ ID NO: 5450 - DNA, 1341 bp, Homo sapiens
tatttttcatcaaggggaagtggatcatcataaaggtcttcatccttgatgtcttcaagtcaagtaggctgaggaggaagagaaagggttggtattgctatctcaggagtggctgaggcagaagaagcaaatccaggtacaagtggagtcattcagttaaacccatgttattaagggtcagctgtacctatatatgtcatttgagtgtaatggttaagaggatgggactgaattccaaatcctggctttgccatttattagtgtctgtgggcacaatccttaatctgtcttaaatttctggtctgtaaaatggagatgataaaagtgcctactttatatgggtataggaatccaagctcataatgtgtgattagctcttatcagactgcatgggacatattaaatagtaaataactatttaataatctgtagaatattactagtttgacatcaactttactaatatttagtatttaactcacccattgtttacttctatatagacagtcgggatacttgcccttttaagttttgttgttgttgttgttgttgttgtttttaaaacattcttcagatgcttttacattgatcaaaaatcactgatgctgaccggaactcaaagtgataagctacttgctaactatcaatatcaatgttttcattatgatatttctctttggagaagaccagtgtaaaagaggagttgatcagtattcctttcctgtcaactgaccttcatgttgtactctcttcctcaggcttcatctttcttaatttaaaaattcatgtttgtctgtagtaattacaaaaattcattataggatttccaagttctaatagttgctttctagatttggtcttcattatgatactgctcctatatttttcaacactttttcttaaatgaaatagtactaaagcgacaagtacgtacatacatttttttcctctcactcaggattgggtaagaccaaatagtcatattttaattctttggttaaactttatgattaaaaatgcttgctgtgtaagaatactaatttccttatcttacacagttaggagctaagacatttccatctaaaattcctgggtcaagaaatagaggcttaagtgtatttttttaatgtggaatacaaaccagtagaaaagctaaaaatgaaaatgaaagtaacaaaaattgggaagaaagggcagagggtatcttaatttctcaatctttatagtaagaagtcatttgatgtggttaataggtgataaatcaagaaacatccacaatgccaaaaatattaaaagtggctgtttatgagaagtggaatggagaatgaggtcttgtgtata

SEQ ID NO: 5451 - DNA, 1029 bp, Homo sapiens
ttccaggacttcctggagatagcaaaatctgctgatgctcaaatcccttacataaaatggtgtagtatttgcatacaacctgcacacaccctcctgtatgctttaaatcatctttaaattacttacattacctaatccactgcaaatgccatgtaaagattctatgtaagtggttgttacactgtcctgtttagggaataatgacaagaaaaaagtctgtaagtgttcagtacagatgatttctttttcctgaatatttttgatctgtggttggttgaatccacagatgggaaacccacagatatggagggctgactgtattggtatcttactgtggaaatagctcagtttgtcaatgtttctcttacagcgtagtgcccagaagtgaatctgttactgcagatgtgatcggtgcagggaaaaagcacagtgagactgttagcctcttctcatagtctgtcactgtaggggccttcggtgcgattaaaggctgtagccactttttctcagttttactctttaagggaacttttattatgttttgattatataaatcatttataaagtcagtttattgtccagatgttaccagtttacattcctagcactaatatgtgaagggttctactttcttataccgtagccattgctgggtgttactctttctagtttttgccattgtattgctgttttattttacatttctttgttactgaggtttaacgttgcttaaatgaattattattcttgttcttagttaagttttaaatatgaggcctatccttaaacatgtataaattttatgttcttatttattggtaagagctttttgtgtattgagaatacctttatttgattaatcttttttgttgtgaatatttttctagtttgaatataccttttaatgttacggtatatttttgccttgtaaaattttttagttgttaagtagtttaatatgtcagacttttcccattcaaggagaccattgaggtcatacttacaaactcttcacctttttcctttgag

SEQ ID NO: 5452 - DNA, 1027 bp, Homo sapiens
tatctagtcttttttttttttttttttttttttttttttttttttttttttttagttttagggatgagtctttttatgttgctcaggctgatctccaactcctggccttcaggagtcctcatgcctcggcctcccaaaatgttgggattacaggcaggagccactgttggtggcctctctagtcttatatccattcatctgacagatttcaaaactgaggccatatttcaagttaggtatagagccaggattagtacctgagatttcttttttgctgatcttagatacttcagattttgtttctttcttgacgtttaggaatagattgaatttcttcaaaaaatattttgtatcttgttgggggggaggggctcagaagttttgggtggaaagatttaaaatcctctgagtatggaaaagggggagtatcttccaccttgtggaatcctcacactgtgtgagtaatattattcactgctctacttcccagtggagaatgcagagaagctgtacctcttgaacttgtgttttctctctttgagtaactgtttccatagtttctataccctttgacatagagaaactttctttagtttgtgttcgcattttataatcaatcacattaccttttgatgtgtgatagccctgcacctaccactaattttctgtgtttttggttatgctagtttttcggcttggcatgttttttcccctctgtctttttaagtgaaaaatctcctgtgtccttcaaagccaaattatttacccagatcatggtcttacaaaattagaatgatttcttttgtctgtataatattgcaacaatttcctgtcttgacctccttatgactttctattgccttgttattacatagatctgttatttctcctttccattgtaacctccttgacagcactgtgtctaatacaactttatattttgtacagtttgtaattttccttctgaaatacagttcaccattattttgagcacggtagtctcttaatcagtatgtgatacaaaaat

SEQ ID NO: 5453 - DNA, 1032 bp, Homo sapiens
ctctgatttctttttctgatcatatttcactggataggacctccagtacattgttgaataaaagtggtaagagtggatattttgctttattgctcatcttattgggaaagcatttattttaccacttaagtatcacattagctgttccttttctgttgctgccctttatcaggttgaaaaaattccctactattcctagttcggagagtttttatcatgagtggtggtcagttttttctaaagattttactgcttctattgaaatggtcatttgattttttccttttattctcttaatatggtgaattactttcattgctggaataaattccatttggtcatggtgtatttaaaaaaatatattaccaatttggacttactgatattttgctaagggttttttgcatttacaagagtattgatctgtaaatttcttttcagttttgatacagtggttatgctggattcataaaataggttgggaagcacttgtttctcataaggtggattgtattttttcttcagtgtttgacaaaatgtatcagtgaagccatgtgggttggagctttctttgtgggaagatttttgatgataaatgagatttctttagatacaaggctatccatattttctatttcctcttgtgtcatttttggtaaattgtattttttaaggatttccttttcatccaagatgttcgtctaagttactgggtgcaaagtttttaatattcccttatccttatttttatttttttagtagagccaagatttgctccattgcccaggctgaccttgacgtcctgggcacaagtgatcctcccaccttggcctccccgagtgctgggattacaggctcccttatcttttgaatgtctgtaagatcttagcgatatctccttattaaatcctgatattggtaaattatatacttgctctcttttttcctttgataatcttgctaggagtttattcattttatgaaatcttttttttttttttttttgagatggagtctcgctctgtcaccaag

SEQ ID NO: 5454 - DNA, 1031 bp, Homo sapiens
ttgatgaaaatgttccatgctcgtgttactttattctactttttgtattagtatctaacaaactgaactttcatgttgtattctctatgtgtaaccagttttggctttcaaataactttttcccttagttttctttgtactgactttgtcctttgaataatatttttcttatattccatgaaatggtttatttagatgaactacagtgtcggtatttggtaatgccaggataaagattttgtgtctatgagttgtctcacaagatagcttaattctgctgagcaaaatatactttagcaacataaagattgtgaacttggttatgctgtaagatgtgattcttgttatctagtcaaatttaacaagttgttacagaaaacaatttacatttttgagtgtttatctaagtccaggggtcttttcttctcctttattttgtgcatgcatgtgtttttttttgttcattttttattcacaaaatgactttagaaataagttataaaatgattaggagaaagaaaatgacagtatgatttcctgtttactacccagcagcaagctttttccatagagagtaaagagctgtggtagtgactgtgtaaaccacatggtacattagagaagctcactttgactgttgaggttatacatggagagtaaacataagaaaattaaatttattttctaatggtattgaaactctgagatttaactaatgtatttacaatactgtgaaattagcttttcttagagtttcaatgtattatttttgaaagtttcaaccaatagaaccacatggagcaaaccatcaaataagctttcatatacattttgaagttatttatagaattgtaaagttgctgttacacacacacttgctccttctcaatcaacaatcaagttttatgtattgattttgtaagttgaagtctcatgaaattcacttattaatgttagtttaaagattttctacatagatggtcaagttatctgcgaacatccacagttctgctttttcctttccaatcttt

SEQ ID NO: 5455 - DNA, 1113 bp, Homo sapiens
cacccaggctggaatgcagtggcatgatctcggctcactgcaacctccgcctcccgtgttcaagtgattcccctgcctcagcctcccgagtagctgggatgccaccatgccaggctaattttttgtattttcagtagagacgagatttcaccgtgttagccaggttggtgtcgatctcctgacttcgtgatctgcctgccttggcctcccaaagtgctgggattacaggcgtgagccaccgcacccggaccttttcctgtattttctgttttttttttttttttgagatggagtcatgttctccgtctcatcaacaacaacaacaaaaaattgatataataaagttataatatagttattactttgaatattagtcttttttcgtaagactatatgcatcaattgttgttatctccagatataatctgatttgtacttttaatgtgagtaagttgcttttcagtaaatatcttcttggaaaataaaaaaagggctgaaagataaatattcattattacgtaggataaatgctttcctaaccttggttattagtgatatattaatagtgatatcctattttttacacttttctggacagttgaaaatgataagtattaattgagataacacattaccatagtattgttggtgttagaaatggcaataaaagaaacatcacggagcaaacatcaagtaaagtattgtctgcgttttcctccttgatggatccaggacagctccttacaacttggttgcacatcagcataggaggcatctctgtatatattaaatacttactaaatgatcttactcaaagacgagcctgtaggtatgttctaggtgactctaaatctctaaattggatttcagcacttctcttaattttttcccttatagctagtggtaatatttgctatgaaggtacttagtgtattaataaagtaggaaatttagccagtttaaaaggtctaaattatagaattaaataaattgcaatagtattaattaagggcttattataatttattaactttcatttgcttaataaaatttcataaaaacctaagtagtcttttataaatgtggaaagctagttccttgataataagttaa

SEQ ID NO: 5456 - DNA, 1017 bp, Homo sapiens
agtaaatacctatcctgaaaagctgttgtcatagttaaatgtgattatggattattttttaaatgagccttattaagtcgtaacttacataataaaattaagcaatgtaaagtcataatttgatgagttttgccagagatacacagtagtgtaacaaacactctgaaaacgatatagtggttattttcattaacccgagaggttcctttgttctcccttgcagcccagtcctcatcccttaaccctggcaaccactttatctgctgttactataattttgcttttctagaatttcatataaatggaatcatgcagtacatagtttttttatggctgatttcttttacatagcataatactgttaatattcatccatgtcttgtatatcattagctttttttttatggttgagtagtagttcatggtctggatatatcacagtttatctgttaatcacttgttggacatttgggctgcttctagcttttggttagtacgaataaagagtctggacattagagtgcatgtctttgtgtaatgtgttttcatttgtcttgggtaataacttaggaatgatattgctgggtcatatggtaagtgtgtgtttaactttataagaagtatatgtttaacaaactgcccagctgttttccgatgtgcctgaccatttgtattgtcaagtgtaatttctttcaatgtcattctcctgttataaattacgaaagcattttcagatttcagtgctttataaaggcttttttgatttactttttaaacgtatttatattattctactttttttggagggggatggcaaatcacttgaacctttttgagttttactttactaatctctaaaatctgctttcacaagatggttttgagggttaaatgagatgatggttgtggatttattttgacagttctaacacaatgtaagctgttgctatctccacatatttatcaaaggtttaggatgattctttagtctgtttaattaattatatctttgaaata

SEQ ID NO: 5457 - DNA, 1292 bp, Homo sapiens
gtttctactaaaaatacaaaaattagcagggcgtggtggcgcacacctgtagtcccagctgcttgggaggctgaggcagaagaatcgcttgaacctgggaggtggaggttgcagtgagcagagatcgcgccactgtactccagcctggcgacagagtgagattccgtttcaaaaaaaaaaaaaacaaaaaatttacaattgcttctgaaattacagggatttagggcaattaactttcattctcttccctcttcacctcaaatacacatcaccaaacaaattttctctattatttgggtaggcgtgactggttttcttaagacttttttgttgcaacctcttaggttaaaagtttcactatcatttgaaattggtcacaagactagggaagtgctttcattatagaactatttaataaataagttccccagtttgaagagccagacttttatgtgaggtcaggccagttgaagacatttacaaagaattagttgtttgttattgctctgtgagttgcaagaatggaaaaaaaattctttcttcaatacttccttccaggctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggtaagtgctccgcaaaccaaaaataatacggttggtaagagtgctagcagtgagtggtgtcttagaagttgatcttttttctgatactgttaaactgtgtcatgctatgtctagtaagagagaaatgatatatttaacgtgtgttaggaatttgcttgttattaagggatttttttgtaattcttgattttgagcatttataatctagttaagttaggtttgactttctggtatgttgtgtgtagcgtgttacagaaagtgttgtatttttctgtggtgtctacaggttctgtaatctggagagatatctttagaatcatttaatatatgtaaaagtacgatcctatatgcatttaatcacatgtaaatatataaataagagaattaagccagtttgaatggttgtaggggaatggcttaaagtagaaaaggggaaagggttcacccgcaaactcatggattaatcccataaatttggtaagtaaagtcctgacgtaaaaggccaaatgaggacaaggattttttgtgtgtgtatgtttatgtttaatttcgtatttttatttttcatcatctagg

SEQ ID NO: 5458 - DNA, 1032 bp, Homo sapiens
ttacagggagatggtacttgaagatctttttgttttccttactagggttgaccccaatatctttgattggcttgaggttccagttttaaagtgagggaggacaaatattacatgaatgagactgttgaaatttagatgaatgtagggttttagttttcagttgtgtatttgcattgtggttttgcagcatgttttcttacagcgttttaaaaatagtccaaagtaatcctgcaaaaattgtgaaattattatttgtattcatttggttttctttccataattattactggagtgaattgttttccaatttaaaattaatttttggcttaataatcttgacatcgactctaaattgtatatgtcagagtactttaaggttttgctttggactttttaaaaattaatttcatagctgtaaaatattttaaataagattatatttaacaaatactggagtgtgaactgtgtgctggtttaattaaaaacttttaatatttacatttcattcagaaaatcactgtcagaaggaatctgttttcagaatcactgcaaatctaaataaacgtgttgattaaacttactagggaacaaatggacttagcatagagacttgtggaaagtaaggacttattttttaagctgtagcttttgatgtaaacatcagaaattttctcataaaaattcagtggaaatttccagctatctgggtttctttaaaatgaggaacctgttttacaaattgattttgtagaagtttagcctttacttaaactttgtgtattttcgtgaaaagatagctatgttttcttttgttattatatcttttagttcaagaatttgtccttgggaaggtaaggcaatcactgttaacaacttgttagttggatgcttagcatgatttgataggagcttgtctttatagtgtgattaagttttgaagtgttaaaaagaaaaatttaaaactatcttagatttgagcaacaaaatgcaagaactgaaaaaccattttcattttgagcaaatcagtcttgt

SEQ ID NO: 5459 - DNA, 1050 bp, Homo sapiens
tcgagaccaacctggccaacatggtgaaaccccatctctactaaaaatacaaaaaaaaagctggacgtggtggcacatgcctgtaatcccagctactgggaaggctgcgccaggagaattgctttaactcgggaggcagaagttgcagtgagctgagattgtgccactgcactccagcctgggcaacagtgcaagaccctgtctcaaaaaaaaaaaaaaaaaaaaaaaaaaagagaaatgtgggaatccgtaaacggagggctctgtctgaaaaaagtacataaaaataaaaataataaaagaaatgtgggaattggtaaatgggagctcattatactggttttttctacttttgatgtttacaaaatttcatcttttttttaactgtaacaaataagtctgtaaagactaatcgtgaagcagcactgtgatgtcaaagcacaaggcgcttgcaagcctgggagggggactcgagccctgtctagaggctggattttgaggagttttgggagcatcattgagctaacatgtggggactgggagggagcacttctgtggggtgaacgtaagaagaggtgggacaagggtgggtggtacaagtggaatacaacggggctgagggaggccaggctggagggcaatggtgctcaggttttatgctttaaaatacatctcattttattttattgtatttatttatttattttgagacggagtctcactctgtcgcccaggctggagtgcagtggcccaatctcagctcactgcaacctccgcctcctgagttcaagtgattctcctgcctcagcctcccgagtagctggaattacaggtgcctgccaccacaccgggctaatttttgtatttttagaagagatgggtttcaccatggtggctaggatggtctcaaactcctggcctcaagtgatccgcccaccttggcctcccaaagtgctgggattacaggcatgagccactgcacccggccagaaatatgtctcattttatagtacattgcttttccttttatattatagttataagactgta

SEQ ID NO: 5460 - DNA, 1032 bp, Homo sapiens
atctcggctcactgcaacctctgcctcctgggttcaagctattctcctacctcagcctcccgagtagctgggattagaggtgcgcgccaccacgcctggctaatttttgtatttttagtaagagacggggtttcaccatgttggccaggctggtctctcctgacctcttggtctgcccacctcagcctcccaaagtgctgggattacaggcatgagccagcatgcccggccaactgtcttttcttttaacttgcctatgtgcctttgaaatagaataaaggaaagatcattgttactttacagagtgcacatgatttgcataaatgcccaggaagatacaaagtaatatttttattccttaaagtaaatacgatgctcatctttaaatagaagataatagattacttctcaccctttctgaccctgtctttaattcttagtctgttttttttttatcctgtgacattgtctcattcacttctccctcttaataacaaatcctcatgtatctctaccaccacaaaaaatgttgtgtgtttttggggggttaaaaatggtttatggtttgtttgggttaaattacccttgagatttggagtttcctgaatatacactgggaaataattggtatagaaaatgggaaatctcactagaaaaaaatgtaagaaaaaatttttaaaaataattaagcctatttattaaagaacaaatataagatggcgagggagttaggcataacaacgtatggctgtatctagttatgtgaagtcattcttttaacagatggctttttccttgtatcgttttgttggcattgatggatatttgaaacataagaaaaagtgaagtgtgtgggatgtgtcctccgtgtaaaatctcttttgccttgtgcttcgtttccagcatgattcttgttttccaaattactagttgcccctcccagcatgatgtcaaatttagtaagcatatttgcttactgctcttggtcagcattttcttgaaatataaacagcagtgagtctaacaaaaatc

SEQ ID NO: 5461 - DNA, 1088 bp, Homo sapiens
gagtttggaaaatctagggattcaggattttcaagtatgtcaactcagatgtcccattcagtctcagggccccactttttcccaaacaaagctctgactttgccatagcaaacttgctggattgcagaattcagctttttctggagctttgcagtctgtatgattgaattctcatcttaatcattgtctttttctgctctctgctgtaggagatggaattttgtctaagttctgccagacaggtttcattatctttctccagttcgtgaatagcgttcatcaaaagccatccagttctgttgttccaccgtgctcgaatctcagtgcctcagatagaggctatccatactctatgtaccccagtggcagtcctcattgccagccagccagctagccagtgattctgcctcttagttctcattttagagctatcttcctctaaccattcctggtgccagctatcttagattgagttccctaggaaacagactccaatgtagagatttgcacataggcgggttagctcataagtgcactgagcaacaacatctgtgagggagtgggagaagcaggattaggcagagggagaaattgcactgcaatatagttgcaaaaaagccttcactgatcccatagggagctctggagctaacatagcccttgaaagttgtcccaaattaaggttaagtgcccaggttgtttctattcctacattgacaagtcaatggatatgggctgctggggggcagcagctccctttggtggaggacgagtgctgcagaggctctgaactgtgagtggttcagtaggcagagctcccacagctctcagtcttgagagaaatctgggcagagtaccatagcatccactgtattgactcaagtcaaagaaacttttctttagtacatgttcagtttccattaggggatacagagaaaatacgtagaataatgaagaaaatttcaagtagaaccctagatttctcagaagacagcaggtatgcaggccttctttctgtgaagttgctgtcatgcagatctacaatccctaatcaatagaatggaaattcaataagctttaaaactgga

SEQ ID NO: 5462 - DNA, 1062 bp, Homo sapiens
cttgtgttgccgtcactccaggttgctacaacactttaaatattcgtatgagggagtcatatttgttttacactaacaggaaactatgaaaataagtagatgagtttcagcattaaatttcttcataatccagtaagtgagtagctgctataaagagctgagtcagtaactgtacatgcattcaaggagcctctctgtataagcacttgcgttaaagctctgacctcgtttttatgtcattacagctaaaatgaataaaaagtaaaacactgagtctttgagagggcagttacagttcagatctgttagatacctataatatactcaaatgcagaattgtaacggtaattctgttttaaaatgtgttattcatgtgtctactatattttaatgtctgtttctgtttttagggacttacccttttgtaacctcttcaaattgtactgttggaggtgtttgtactggtttgggtatgccacctcaaaatgttggagaagtgtatggagttgtgaaagcttatacaactagagttggtattggtgcctttcctacagagcaagacaatgtaagcctattctaagtaaataatcaaaatgtattaaaaattcattcttcttttttttcttaatgaattattgtctcctgtgcctttcacttaatttgcaagattggtcagaacaacattttcttaaatacataattttggctggacgtggtggcccctgtctgtaatcccagtgctttgggaggcagaggcaggcagatcacttgagcccaggagttcaagatcagctggggcaacatgttgaaaccctgtcactacaaaaaatacaaacattagctgggtgtggtggcatgcacctgtagtcccagctactggggaagctgagtaggaggatcacttgagcccaggaagcagaggttgcagtgagctgagatggcaccatggcactccagccggcgcaacagagcgagactctgtctcaaaagataaaataaagtcaacaaaaataaacaaaaactatgtaattataatgatgccagaatataagagataatgaa

SEQ ID NO: 5463 - DNA, 1028 bp, Homo sapiens
tcagggagatgtgagaaagcaagcaaagtggctattacatgtaccaagtctcacaccaagcatagtataacattaatcatattaataaaacttaactataatagtaaattaaaaatttaaaaatgctgttaataaacttagctaaaggtgcacagttatgatggttttttttgtttgcagtatctaggctgtagaaagtgaaacagatattccaaggctgttctttcaaaacagtaatagtggaggcattaatgctccatgccatggtgaagtcttatgaaagtaattattctgattacagtaattgcttcctggggcctagaaaaaccaaggaaagcattagttctatgacaaggtactaaattaatttctgaaaaatatggttcacctgctttccatcaaccatttatttgtgtgttgtcagttgcttttttactttctttgagcatagaaaacaaaacatttacattcaaatgtctttttattcaaaagaaatgagaatggcgtactctaagatctcagtcttgtcatgactgatttgcaaaatcagggtttaaaacagcccttcagaactattctggcctctcaagtaactgagaaagactattgcttgggcaataaaatgggaacatgatgataaactaacccttatagctcagaattattgtttacataaagagtatttattctttttcattgctatatagtatccccttatatgaccatttcacacttttaaaaatccattcattctaccattgatgaaaatttgagttgtttccaatattgggatattacaaatactattaccctgagcattcttgtagatagatatcttttggtgtgcagtatactgatatggctttaaagatgttacttttatctaactgtgtggcactaagacagatactgcttactagatatttttaaatcacacatatttagcttctgaaatataactaattagtatgtacagcatcaaaacttttctactaacacaccagggaaacctttgatcataaaaagat

SEQ ID NO: 5464 - DNA, 1043 bp, Homo sapiens
tccctccctctctctctccctcccttccttccttccttccttctttgcttcctctttcttttctaatgtaagcatttaaaattacatgtgttcctctaacacatgtaattatgttagcgatattccgcaaatattatttttacaatcatttccattcagttcaaaataacataatttctattttaacttataagttgagtatgatgttcatgtttccaaatattggaagattttcatgatttctctctattatttataatttaattttattgtgaacagagaatatgtatgatcctaatctttgttgagacttcttttatggctcaggatgtggtctgttttggataatgtcttcatgcacttagaaagaatatgtgctctgctcttgttgagtagagtgttctttaaatgccaattaaatcaaattgtttgatagtgttgttcaaatcctatatcccaactgattttctatgtgtgtattctatcagttactcggaggagtgctgaacctccaacagtaattgtggatttgtctgtttctcttttcaagtcagtcagtttttgcttcatgcacattgaagctctgttaggtacatgtatgtttacaattctgattttgatgcattgaacctttcctcattatgaaatatcctctttggtattaacaaccatagctttttatgatcaacaggtttccctggtactgttagtaggaaagttttgatgctgtatatactaattagttacacttcagaagctaaatttgtattatgtgatttaaaagtatctaataagctatgattgttaataccacaatatcctttttatggtaatattccttattctgatatctactttgatattaatatagccactagagttgccttaagattactgtttgcatggtgtatcgctttccatcctctaataatccttagtgtatctgtgtctttagatttataatgtatttcttatagacaaaatgtaggtgggtcttgcattttattcattgtgacaatttcatcctttaattggaatgttta

SEQ ID NO: 5465 - DNA, 1025 bp, Homo sapiens
gaccatcctggctaacacggtgaaacccagtctctactaaaattacaaaaaaaaaattagccaggtgtggtggcgggtgcctgtagtcccaactacttgggaggctgaggcaggagaatggcagtgaacccgggaggtggagcttgcagtgagccgagatcacaccactgcactccagcctgggtgacagagcgagactctgtctcaaaaaaaaaaaaaaaaaaaaagaaattaagattttaaaactgctatacaaaatattcaattaaatatatctttttcccctttctaggactagaaggctgggaaaaaaggcttattatatctgacagagctcatattggtaaggtggatatattgcatttatttgtaactatctttttatctgaaatttatcaaatgaaagtatttagtaactaattttgtcttttatttttatttagcgtaagtaggatggattgtagtaattgagttctaaatacaaaaaatacttactaatttttttcttttttaacagtctaggctgaaatttacctgtttgaaaaaaaggttagctaagcaaatttataatacaagcagtatttcataagacatctctaattctatttaaaaataagccatatcaaaatgcaaagaacatttatttgtatacgtaatattcttgtaaaagtaagtgtaccgttttgcagatagagtgactctttgtgcctaaaatgtagtagttattgctttttaagtgattcagattttattcagactaacctaaatttcaaccactaccaataaatttgggattttcttctctgttatttttctctttcagaaccaatggagttgttaattagcagtgacatgatttaagagacaataaccagaaaagaaataagtaaaaaccacgtaggaaacttctctgtgattgatctgcactcttaaattgtatttaagtatgcgtgtgtcctgtggcagtagctgctctagttttaacactggcctctatttaaaaggcagcctcatcaagatactta

SEQ ID NO: 5466 - DNA, 1078 bp, Homo sapiens
aaaatctgaaatccaaaatgctcccaaaatctgaaactttttgaacacagacatgacaccacaagtggaaagttccatacccgacctcatgcagcgagtcacagtccaaacataggcacgcacacagtttattcagtgtttccaggggaaaaaaggccttctcccctttcagctttcatatatcttttccatgcacgcccagattcccccacaccagcgttcccacagagggcaataaagtggcatgtgtactagctggatgtgccaactgtggtaataaatgaaatatagaatacaggtggagactggaagcctgcttcgttgttgctgctgtttgccagctgatacagatactctggtgctgctgctgtactgcttacttaccctgaacacatttttcccactgtattggtggtatgtcatatttttgactgttaagtacttgtgtgtgaataagtgtaaggaaatgattactcatcagtagcatataaattcagagtcaagaatgttggtgttggtaaacaaccacagatggaggaggaagaggaggatggaggaggaagagaaggatggaggtagaggaggaggatgaaggaggaagaagagaaggacagaggtggaggaggatgaaggaggaagaagagaaggacagaggtagaggaggaggatgaaggaggaagagaaggaggaggaagaggaaacaaacttcgtttcatgcacaaaattatttaaaatattgtataaaattgcctcaattgatatgtaaggtgtatatgaaacataaatgaatttcatgtatatatttgagccccaccccccagagatctcattatttatatgcagatattccaaagtccaaaaaaaatctgaaatctgaaatattctggtatttggaataaaggagactcaacctgtaatacataattgaggaaaatcattagtatagttagtttccccttgaattagctcacatttaaaacactcaattactgttatagtatgttcaggtttgtttttttttttttttttttttttttttttggagacggagtctctctctgtcacccaggctgcagtg

SEQ ID NO: 5467 - DNA, 1034 bp, Homo sapiens
ccccaaaatatgcctctttggcatggtgacctaaaaggaagaagctgaggcaaaattaacagaagtagagagattgtttgggccaaacttgggggtggcagctgggcagcatagattcaagttgccctgaatatacagtctgatgagtagcggttacaagtggacttttaaagacaaagaagaggcagtttctgagttgtttctcaagaattgacattaaaacaacataaactattgattgattataccttgttctttgtatcacaaattccaggaacatgaagataaagggtaaagcagctagttaggaacaaaatggctttaaacaactaccgctaggcgtggatgtgtgggcagcaggactggtccgtactcacgtcttggtgggcctgcatacctgacatagctcagactgctctgagctacttttcttttctcatttccccactgttgatcaaaaagcttcccatgaaagtgtcggtgaccgatctctgctcaggtgagagtgatagacatccttcataactcggccctgggaaggcttattccgagatagttctcagtcaagcctctaatttatacaactgatgttgcttgttgaatcatctctagtcttcagaatttcatgcttttggttttctcagaagaagtaaaacaacgagaaatacatagtaaaaaaacctattcatttggagactcagtccaaattgtaggaaaataataaaaactcctaacaataggcagggttagaatagaataacaggtgtactatggttttcttctgaaacataacttttcccttcctgcagtccccgtttttcccaaaataaatcttactaggactgatgtacttgcaaataagtgttagtattatatttgggctgattatttgcataaagtacaagaatagtgatcagccatatagactcctttaggtcggcttcgctgaacctttcataaggaatttcaaaccagactcttaaaagcctcaaggctaagaagccaagccaaggattcactattagactgtacct

SEQ ID NO: 5468 - DNA, 1074 bp, Homo sapiens
gtgcagtggtgctatctcagctcactgcaagctttgcctcccgggttgacgccattctcccgcctcagcctcccaagtagctgggactacaggcgcccgccaccacgtctggctaattttattgtatttttagtacagatggggtttcactgtgtttgccaggatggtctcgatctcctgaccttaagatctgcctgcctcggcctcccaaagtgctgggattacaggcgtgagccaccacgcctggcccacataagctgtttttaaattggctttgatggaactctgttccatagaagaaatcttagataagactttggttttttggttacctctgtggcatacaatgattttctgtaacaattataattattaataacatatactaagtcatatcagaattataggaatttcctattattttggaacatatgccaataacacatttatacaaatacagcccaaagaaaagcaaacaccgtttcatatttgacaatgtttcctgtatgagttttgtaccaaataagccgaatttcacctttacattagtgtactattaatgttaaacccaattctttttttttcccctttttgagacagagtctggctctgttgcccaggctggagtgcagtggtgcaatcttggctcactgcaacctccacctcctaggttcaagcgtttctcttgcctcagcctcccgagtaactgggattacaggcacgtgccaccgtgcccagctaattttttgtatttttagtagagatggggtttcaccatgttggccaggctggtcttgaactcctgacctcaagtgatcctcccgccttggcttctcaaagtgttgggattacaggcgtgattcactgcacccagccaaacccaattcttaataaaaccctatagacacatttacccaattttaatgtttgaccctaaggtaagattctcataaactttttataaccctttacaatttttgttaaagagcagatcataagcagatttttgcttcaggaaaaacctgttgtgtttttttccaatgtttaatttatgcaaaaactgaataataccca

SEQ ID NO: 5469 - DNA, 1033 bp, Homo sapiens
agtggcatgtgcctgtaatcccagcttttggggagttttgggggtagctgaggcaggaggaagcattgcttgagtccaggagcttgaggatgcagtgagctatgattgtgccactgcactccagcttgggcgacagagcaagaccctgtctctaagctgaatctcatgggggcggaaatggtatcttattgctttaaacttttcctgattgctactgtggttgagcattcttccaaatgtttattgaccgttctttctctaagaattaactttgtatagcttttgtgtgtttaaaaatttggggacagcactttgggaagccaacgtgggcagatcacatgaggtcaggagtttgagaccagcctggccaacatggcgaaaccccgtctctactaaaaatacaaaaatcagccaggtatggtagtgtgcacctgcagtcccagctactcgggaggctgaggcaggagaattgcttgaacccaggaggcggaggttgcagtaagtcgactgtgccattacactccagcctgggcgacaaagtgagactctgtctcaaaataaataaataaaattggttgtgtatgtgattttcgtgttaaagtagctctttacaagcatagtttttagtccttatatatgtaacgaatattttctgcatgttcacttatttgttgtttttgtttatggggtcttttatttctcaaacgttttaactctttttttcttgcagagtcaaatatgtcaatatttccttttatggtgcttgatcttgtgtcttgcctaagtaggcattcttgactcataatgaaaacatactttcatgattttgaaaataattctatactccctttctcattcataattttgaatattttttcttctaaaaagaccaacttttggttttactattttttatttcattttctattttacattttaaaaaatttacctgatctattctattgtctttttttagctttttgaattgactacttcattcactttttctccgtcttttttggtttctaatgaa

SEQ ID NO: 5470 - DNA, 1047 bp, Homo sapiens
tttactataccaagaatttgggttttatccttaaagagataggatgggctgctacgactggatgttaggcagaggaatgaaaactgtccagtttacaggctggaaagggccagcggacaatagtggaaggtggattcaggagagtatggagacagggacaccagctagggaggctactggtgatggggaagaaatcttaacccttcatctcatcgtagtacaatcaagtcatccctcagcaattactcctatgttaaatgtgatgaatacaacgtgttaaagacaaggcacctgtcctcaacggagctttaatctctactattagcctttactaacaaattacagtgcagtgcccttagcagcaaaattttctcgccaaagattcagtattgttagcttatttcataatgacctgtagtaagtcattagtactactggtcccctcctccccctagttttggtcaattttgtcccggccacttagattaaaatgttggaggcttgggataaggactaggaacagttaaaatagtttcaagcccatgggtggcagagaagccagtgacacgtgctccgggcctaggagctccgcggagaacgtccttacccaccgcccacccgcggcgcgcgccccgccgacccccaggttaccttcctctcctcgggctcaccgggctccggcggggcggccatgaggactactccgcgactccacccgccctgcaccgccggggtcgcggaagcagaagcccggctggccgcgcccctccccgtcccgcccccacgcgccgccgcctcccgccctgttccgacgcgccggccgccattttagggaatgttcctaacgctccgcagtggccgcacggggccgggctgtcatgtcctttgttccgtcgaacgggtcacactttcttccaagctcggcacacagcctgcaggggcgggagagcggaaggagatgggttcggaaaacaaaccgactcctagattcctggcgaggtgggggcgtaaccgagccagacagccccgcttcccgcgccagccccc

SEQ ID NO: 5471 - DNA, 4813 bp, Homo sapiens
tatttaaagggacttgggcctgtggataccaaggaataactaaggtaaaactgagcataagtggcctgtccatattttgttaaatatcagattattgattagtgatcatcaacattttcccgcattcatgcagtgcggcctctgaaaacatggttgaacatcctatggaatttttttttttttttgagatggagtctcactctgtcacctaggctagagtgcaatggcgcgatcttggcttactgcaacctccgcctgccccacctcgggttcaagtgattctcctgcctcagcctcctgagtacctgggactacaggcatgcaccaccacgcccggctaatttttgtatttttagacgagacagggtttcaccctgttggccaggctggtctcaaactcctaacctcaggtgatccaactgcctcggcctcccaaagtgctgggattacaggtatgagccaccgtgcccagcagaattttttaactatttggttacgactaatttggataatgtagtgcatgcagctttgatttgtgccactaagagtgggcaaactgtcttcctttttgtgaatcagtaaaaattttccctcaacatgtgtttgacagttgtcattcactgctaagttaaggcatttggtaaaccacacagcctctgcatccttcctagcgacagccacaagaaaaggtgggcatgggagggaaaatgctcttgtgaattgaactggaggcaagctccacttttctttagaaaaagatgtagatcaaaataactaatattttcttccttgctcgatttctgtgccttccatggtacatcaaaataataggaccagtaatggccacaatcctgttgactgctgttaccttcgccccaatatttctttaagcatttcttaagcatctagcttgtgttttgttatatttaacagattttcttaaagtattgtatgaattaaaaccagaaataacttcattttcctagaaagggataatttctcccggagaataaatcctgaggatttagttagatgctgtgggtattgtattttaaataatattttaatgggagcagctgattgactttcaaatggattgtttacattaatagtaattctgcagttgttttactattgcatcagtctgccagacaagttccatgtgcatattttaattcagaactaattatacttaaaaatttaaaccctgcatacttccccaaaaatgtttagggcagttaaaaacaactcttttggaagatgactcgcattttaagaaatgagagaacactgtcaaatgatgaatgcatttaaaaaataatttgcaaagtgataaaagcccttagttttaaatcttacaatgacattagctcttacaagaactcagtaagtatttgctgttttttaatgggatagtaataaggttgaggtttttgttaagggacgtttacttatcatcaaactctatacttactactacaaggaaactccaagtacattaaacactatgttttataattctttgccacactgccaataaattctgttcacattttaaggatgacaagtccactatatgtaacacgtaagaatgctatcctggcagtagacacagggccagaataaactggcaagttttcattccacacaagtgtgggaaaaaaatgactacaacttaaactttatttacttgattgagagcttattgcacatgaaatgttttatgtggttgatcttaacttcgtttacattgacttctatgctcaagattgttcaattgctgctgctgccgttgtgttttctttcaggatcgaggtgggtaccttcatataatatcttctttttaatttcttctctggcaattctttcctggattctttgctttgcataattatacctacaatgaaaccttagaagaaaagaatatgaataaattgttaatataaagtcctacagaaattaatttatgaaatttctctaaatcacacaaaacttaaatacagatgactactaccctgagactgaaaaatatgttctaatttatagtgctatttttgggcagttttggtgtcagaatacctatcaacacattctttttttattaggaaaaaaaggatgtctacataacaatttgtaaagtgataaaatccattagtttttaagtcttctgatagcattggctattataagaaacaagtatttgctctcgtttttaacgggataataatgctatgtctacataaaatgatttctaccaccttaaatagctcactgtagaaattcatgtataaatggaaccatatagtacatacatatcatactcttaggtctggcaaatatttgaggttcatccatattttatattcactcatcagtagttgtaaacacattcttaaagtagcattttcagatatgaataagcagggatgaaataagtattagggtaagggaaatggttgaggctttcctaagtgaagtgtaaaaaccacagctttctttttaatgggatgtctaatatgcatttatctgttcaagcattttaagatttccatgaaaatgtcctgaaaaatcaagattcttcattgagggtgaggatctcccaatgggagactgctctgaaaagagcatgtgctttttgaattagataacctactataatcatggatgttcttgaatacttagcaaacataccagcatcccaaagtcaccaagataaaccctcctactccaacatcacatgatcttctaattctacctgtaaaaataagcataacaattaattagaatataattacgttatatacattactccacctagaaaaaaaaatagttcattatgtagagaaatgctttttttagtacatagagaaataaaaaatacagatactcactagtgaacaaaaaatgtccaaagccagccacaacagatcctaatgaaccatacaatattgaatgccgggcgcagggagtattttcaacatctaaaaatcctaggagcttaagggactagaatgaaaaaaaagaacctagattgagtaagaaagtatttcattttggggtgctttggcaaaaatgacaatacaccatttcttttcttgtagttgagggtttaaactagagtatgtgccacgtgacaacctaaatcagcttgcgttgtctttgtccacctttggtatgcagtctgaatctttaaatccgaaaaccttacaaattggaccggaaaacccttaagcagtagggtaacttggagctgtatcttaatttgctaatcaactgacttggaaataggataattcattttatgagctctttaaatgagtttatttgggaatatgcctatcattggaattgaaagcagcatagcttgcttcagtaactccaataatttgggaagcagaaatggaaaaagtaatttgagtcatgtttgcttatgtagtgccgtttaaaattcccctagtaattacctttcatattttattaactaggttaacatcaactgtggttgtaagagtaaatgtttcaccttaagataaacatgggcaatatattaaactctagtctgttttcttgcctgtgaagtgaggctgcacttgattatatttgattctttgttcgtaatacatgggaacgacagctaagtgtggtgaaaaacgcggggatccaaagagctggatttttatctcagatctgccgctaacttttgtatcctataggctacttttatttctatggtctcaatctataacatgaatgggttgggttaaatgactgaagttccttcaagtgctaaaattctttttctacagtcttcattggatttatgtatttcttattcctaatatgtttaactgggatgtctgtcactctagggcggcaagacagacatttaaaagtaacagtcacactgctgaactggcatttctgttaacacaaaagtttagaaaactcacggtaactgttacttgatttaagtgtatataaaattttcagtaaggctgcttttaaaaggaaccactgtccatttaaaggtttcatagttatcttcaatgggttagtattgtttggggcaggacattaaactagaagggattctataggatgaggtgatacctagaaggtaatatattgtaaggcaaaagagattagaagaaatggggaaaggatagtaaaaggcaagtcagattaaaggttgaaacatgaagatattctcaattgtatttctgcctatgtttgcttttttggctcaagcatctgttggaagagacaaaatgtgacttggttcataataaagcaagaattatttactctcggatcattctattccattttttccctctgtctggccccgttcccacccgcatgcctaacataggattgcttcaaagctttgcagtacagttcttcacattaccaagaggttgggggatttcatttagcaagacgactttttcctatcagcttgagagcccaggggacatatgatcatgtgggtagtgttatgcaggtgaggaatgctggacttagcgctccagtccaggactacctctaaactagactatttccccaaggatgggatgctggggccagaggattagtaccagtttgatctagtcttaggtgcaaagatgcaagtgtgagaccagcttgtaccacaggatagaattaagtattttctagtcccactctcagattctgatttacaatcactggaatctatgtttagaaaactctaggtggttttttctgatgactgtcatattggggaaacactgctttaggaaattttatttttttaaataaaagtaaatttgca

SEQ ID NO: 5472 - DNA, 1406 bp, Homo sapiens
agttttggttgtatcagtccagaatatgtaattttccatttccctgaaaaagacttcagaggaaatttattttccccactatacgctccagaatgtctttcggtgaaatgagagggcttgggctcttctgattctagacgtagctatcagagtttgcttaatgaaatatgggtctactcacaaataaagcaatttaatggtttcgaaagagtaggcaacttgtggtttcattaccatttctgttcatttgagaaaaatcataaaattacagaaaaggaaacattcatttcaaaaataagctttgaatttagatggtaaggcatatatgttttatttcacatgacttcagggtagaagtcaaatgaagaaacatttctatggaaacttaccctttaagaaaccagtatatgcaaagaatgattgataccccctgagggtgtgccatataataggtgactgataacatacaggatttaattcttagaataattaagaacagatatcacccattacattgacctacatttttctaaagtgaacaatagaaacctctctcagaattagtatttgcctattaatgtaatcagtgtagccttctcaacataaaaatgtccttattctagaacatggaagcgtacggcaaatgcaacggttgaaagcactgaaaaatatttgtaaaacatctgtagtgctcacattatgaactttaaatgtaatactttgaaaaccatcttcataatttttttgttctaacagcttcctttttaagaaaacattttaaaacattttaaaatggaacttaatgtgcaaaataagttgtgtaaaataccagtatttgggtggtggaggatattggtatattatattgacctgggttgatgactactggactattttaagatacctacttccaaaacttattttattctagaggaccactaaaaatcagaattacagcaatcattttaatttttctactttccttgttaaggtcttctgcttacccaaagaatagtgtatatcttaacatgacttttaaaggggtatcttgatccccatcacagatttttatctatgaatagaaggattgaaaccctatttgatccctagctctttgctgaaaagtgcataaacaggaatcctgaatttattatatagacctcctcgcattatataatcgaagcaaagggaaaccagcgatggagtagaggtacgtagactaaagagatgcttgcaaatgatggtacctagggatagtcacattttcttgttgccaaactcagacaatataatcacaagtccagagaagagctagttaattttaaattccccgaggtccttttactgagatggaaaagcacaaacagtcaaggaaaaccaaagagggaggggtgagggaaggggaa

SEQ ID NO: 5473 - DNA, 5543 bp, Homo sapiens
tgttttttctttaaaaacaaaattttctcttacagcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaatgctaatgctgtcctcaactgattattttatatacatatatatgatacatgaaactctgggatcagatgcttttagaagccatcatgcaagccagtcattgatgtcactgctacacaacactgctaacttgactgtagctatgtaataacattagatcccctaattgtaattatattgggtttgcacagaacactttaatcttcccctcaccaatgtgaagtgaggaatcaggagtcaaactgtagaactaaaatttgacttcagtctagcgtttccttggtgtttttaggttgctttggtaagtttaggtttgctatatttctgattgcttagaattttgttttagccctttaaaatcagatcataaatatgaattcatacttctaaggaattttcttgctataagctggagtttaggtgatgtataggttcagttgagacatttttggaacaggcaaatccttagttaacataagatatttaacagttgaagatagtgtcatggatttttatcttttttagcaagtaatgctaagaaccactggcctgagctactactcttcagtatacattattaggattgcatagacttactagaggaacagtttcaggttttgatgctaatcagtgttgtgtcctaaagttgtcctttgtgcctttaaaaagttttggatatatcttctagtttaaaattgcttattaaggaattcattttataattgcagtgggaaagtaatggtcaagtaacactaggtagactatcatgcctgtttagcccagagaatttggggggagagagaatagataaaaatggcacccagaaaaatgttaaaatctttagtcaagactagaattaatacaattgtctacacttgtatggcagaaataaccttataaagtgtttaaggaattcagagaagggaatgtaccaaataagcaacagggagaaaattaggtaagaagtaagatacgaacgagaaacctgatttattgctcatccttcccttgcctccctaatggcaagcaaaactctgaacatctgaaaaggatgtagttctggacaaatcctgactacccagaggaaactcactgtgagattgctgttgatttgaagggtgctttcactaaggttatattttaaagtagaataacacatgctgagtgtaaactggctttggattggtcagctgcagtagtacaaaaacagcatagaatttgagaaaactaaaactgctatgagatagctatgagaaaactaaaactgctatgagatagaaatgatgtaaaattatgtggaaagttttccctcatatactcacatacagcctttgaagggctctggctctgaccggttgatggccttgagcgagatgaaatcatgaaattgagtcaaatcaatttgacattgaaatgacaagaggaaactcttaaatacataaaaacaagctctcatttgcctaggatagatactgtcttaaaaataaagactgaacctagatgttctgagcactagcaacaaggtattttaacaagtttaaaggaattctctgaaaaagttataaaattattctaggaaacataaccataatagtgttttaagggactttcacctggggattttatattcatgaacagagtgtattctgtatttaaaatgtctcatttgtgggaattggatgacatgttttttgataaatttattcacaatataaattgactttttattctaggaccatgtgaataatgggttccattgcacaaatacaaatattttaatagcttcttaggcagtggtgtagacatcttggatataaataattgtagatcttgtatatttgatttttaaaaaactagaataaacagagaggcataaacatatcttagagtccaagtggtagtgtttagcattggatataataaatggatgttttacaaagtgtttccataattctcttcctatacataaatgtcttgttttcaaaagtggatggaacttggctgggtgtggtggctcacgcctgtaatcctagcactttgggaggccaaggcgggaggatcacttgagctcaggagtttgagaccatcctgggcaacatagtgagacctggtctcttgaaaaaaaaaaagtggatggaacttgtagcagagaattttatctacttctcaacctgcttcagaatacccatttgagatgttcccctggaaagatgaacacaatactgcatctgaagccatttcttcccacctaacattcttaaaatgattagagtctaaactttgtcattcattcctaattctggagctctgaggttgaggtgttcagagtttggtgaataattgggtttaagttttaacattttagtaataataaaagcaaacacatacatgttaaggcctgacaataggttgcaatacccatgcattgggactcatacccagcataaatggtgagggactgaacattagtgctttgagcaagaattggttaactacctgagatctctaaaacagtaatttgaattactaatacataaaccacaagtctcttcgaattgttaattgcctaaatttaccctaaaacttagttaacgctgcagtgcctttattaaagcttttttttgggggggggtgtgggcacagctactccataactttaaattttaaagcatgaaggtgatctagctagtgttagtgcttgagttggtagttacataggctgctcttgaatcgtcctgttttctttgcctagtattagcaccacaggtacatatttgtaaaataagcattaaaagtactttgtccagctaactcatgttggagtgacctttgtcttactaacctttgttactaaacttgttaattagaataagcccttgagaatttggaagtgagctatactactaatgtagtatatatctcttgagtgtgttggagtagatgaaaaaccaggggtccccaagggtatatttttgaaattgaacagaaacaattcatcttaatatttagttttcattatgtttagcttaatatgtgtgctagtttatttggcgtcacacttatgtcaatctcaagtcatgcagaaatagcacagtctcagaaaagaggttaggtgggaaatagatgatatgcttacattattgagcaggactatgctttcacatcctaaccaattgactaaaaatataaatgattgaagtaattttcattagttgccccaggagtctttaataatagttttaagggatagtagattggacatagatagatgggttattcataatggatattcataatggatattcataatgttaacctagaattattcagaaaatataacacctatgtagtagaatctattgattgtaagcctagtgttggtaggcaaacatgttgatgatgggccaggacatcagtaatcactacttggttaggcaagtaattaggacagggattgtaatcatgtcaatttgtagctacctaatttttattgattaggatactttatttttcatgccaggattcagcatatacttaggtcttgagcaggggctttgcttttaaagctgaatcctgggcataagaagctatgtactgtagttgaaagtgaagtaaatgtcaatgtaggctagtctctagagaaatgtcttctataaagattcagggtttttttgcaccattatgatcaccatactgtgccaatgacatagttactcatgagcatgtccagtctgtctacattaatgaaggataatgcagagatcacaggctggagagttacatctgacagagaagtgctgcactattggggcatattctttcctgctattcctttaacagttccattctgaaccttacaggaagtaaaataagttatgtctggtaaaatatacgttgcaaacacttaaagcattgccacaaattggtgacagccaagacatttttaaaaattttaaaacaccaagaatagacgtggctagtacagacaccagtttataagtgtgacattaatgctataaaagttaaagcatatatagagatacctaaagagttattggggcttatttaaatgtcaactaacaaaggaattttttgaggcagcttgtatcctg

SEQ ID NO: 5474 - DNA, 1576 bp, Homo sapiens
acaagttcaaggggaaattttaacttttgaatataggtggcaggttttaagaagcaaatggcagatactggaaaactgaacacactgttgcagagagccccccagtgtcttgggaaatttattgagattgctgcccgaaagaagcgaaattttattctggatcaggtacgctgtagctttgaaattgaaaaatattaactgataatttagatagattggtgtagaattaatgtttagggttgtaaacataaatttctttttttaaagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggcatggaattttaattctgttactgtgtgaaatcttctttttaaaagaatgtttttcctacatattctgcttgtgtaactatgttaaatctattaggacttaggcctcctgaaagttaacattttttccagcaatactgcttcaggaattaaaattgcagttgttacatatgcatatatgtttggtctgtttttatttttaggaaaatatgttactaaacctcaagaattgtcagctttaggattgtgaggattcgtggtgggtttctaaattaataatatgactttgtttcctgcaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggaggcaagttaattttgagtgttctgtatttagttcaggatcgaaacaagtgataattttatagtttggatgtagctgaagtttcttcctcattaatggtatactgtcacagtaactaaagtattcatgtgatttgatattaaatacacctaggttatgttaatggttagaattaaacatttcttttgtctttaaacaattatttttggagaaaaaggaacaatctagaggaatcctaagtcttctgtataagtagggtacaatatacaatgaaactaaaacagctcttgtcttttagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccaggtaatgattcaagatccctggaagcatgattgataactgtagcttagtctggaaaggtgtgagctttatgttggggtgtcttagtaatccgtaaggaacatgatagg

SEQ ID NO: 5475 - DNA, 3087 bp, Homo sapiens
ttgtggagacagtctcactctgttccctaggctggattgccgtggtgcgacctaggctcactgcaacctccgcgtcctgggttcaagcgattctccttgcttcagtctctcaagtagctcggactagaggcacacactaccacacctggctaatttttgtatttttaatagagatggggtttcaccacgtaggccaggctggtcgccaactcttgacctcaggtgatccactgtctcggcgtcccaaagtgctgggattacaggcatgagccactgtgcccagcctttttttttcctttttaaaatagtgacaaggtctcaccatgttgcccaggctggtcttgaactcctaagctcaagtgatctgcccgcctgagcctctcagaatgctggaattacaggtgcttcatactgctaagttatcaaaggtacttatttttgaagcttcctgtaaattaaaagaggagcttggaaccttcattttgttgtgacagttaatcacggttgttatgttagaacttgccatgcagagctaggcgattttttatttagggtacttcatttttatcaagcatttgaaagggccaccaaagagttaaaaataaaatttggttacattactgcttttgttggtgagaaaaacattaattgtatcctttaattggctttaagttaaagactgacaacatgaactttaaaaatattaagtattcttttaaatatgggtcaaataagtatttaactctttaaatttcaagttataagcacatcagtttaaagttcttacaaatattgggggtgggctagagtgtgccttctttgtatttatagctagaggaagattagcccgtggcgcaatgaaatatgcgagagttaaggggttacctccttggtgtattattttaattatttaatgatttgactttcaggttacagagaagatcccagtaaggcatttatatacaaaagatattgacatacatgaagttcgtattggctggtcactaactacaagtggaatgttacttggtaaagcttctttttgactgatgtgggctcatgaatgttcaggagggtctgatttcagtgttttttaactagagggcattctaagccttttgtctgtttttatctattctgttaatacttcagacaggtaatattagcacatagtaggcacaggctacattttagtttttgttcctttattagaagtttatgaccaatggttgaaataaaatcttacccgtgatatgcaaatcgtcaactaatttggtctctgcgtatatatccctcctaacttccatcaattctggtacagagatagaaaagtaatagtgtcagtgacaggtgattaggttatatgcttatttctcttgtagcctacatcttaagtagtaaaatagatgagtctttggactattttaaacatctacttcatgaagattaattattttcttaggtgaagaagaattttcttatgggtattctctaaaaggaataaaaacatgcaactgtgagactgaagattatggagaaaagtttgatgaaaatgatgtgattacatgttttgctgtaagttaaagctaactttctatgtataaatggcaaagttagtagctatatctaggaactttaaagaagctttactgaggtcagttttcaatatgagcaacaaaatacaccagtccctggattagtgtaaagacttcattcagcagttgaattgggaaaacacaggacatttttgaggaactcactaattcattttgactgaaaacagtgaacatgaaattgacctagaaaattcagtctagcttctaggtcagtattgtttctggttctggagatacgtgcttcatggtttacaaccatcagatttcttaactgtgtagcccttaaaggccacctaatagttctttaacctgtagcttccacaggataagctttgctcctaattttaattcttagttttttagaaagtttaaggaagcagattttaactgttgaatttttttctgtgtaacagaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagtaagggatttttttttttttaactgtggcatttgaatattgcttgcctggcacaaaatgacatttagaagaactagatgattagtctgtttcatttactttgtgctgtgcatattgctcttaagtaattgtttcccccttatgttgactgttaatctttccataaacaaatttttgtccgttagtgtaagggctatgaaaacttagatatttaaattggccttaacaatatttaaagaattattaggtggtgtctactgacagtgaaatgacatttcttttcttttcactaggttgtgatgatgattggcttgccaggagctggaaaaactacctgggttactaaacatgcagcagaaaatccagggaaatataacattcttggcacaaatactattatggataagatgatggtaagtaaaatgtttagggcctgatctcagtgtttaaaatagactgggagaggctgggcatggtggttcacgcctgtaatctcagcattttgagaggctgaggtggatggatcacctgaggtcaggagtttgagacccacctggccaacatggcgaagccccgttcctactaaaaatttaaaaattagctgggtgtggtagtgggttcctgtaatcccagctgctcgggaggttgaggcagggacaattacttgaacctgggaggcagaggttgcagtgagttgagatcgtgccattgtactccagtctgggcgacagagcaacactccgtctcagaaaaaaaaaaaaaagaaaagaaaaattatagaccgggaggtattc

SEQ ID NO: 5476 - DNA, 1054 bp, Homo sapiens
gcttagcttctcatgttttcttgtacaaattggctttattcagatttgtaagagtgtcaatgtaaaactctttcttactggaatatcctttacagaaggttgagatagtcatctgagcctttttaaaagaaaaaactgcaggtgaaaaaggagttagttgatgtgaaagttttagtgaaattctgggttgtataaataagttgctaggaattggcaaggtagtgaagtggtgactcacacaggtaatgtaattgttagattttttagcaaatcaggaatatgtcaatataagtacaatgttgaattcaaacaatctgttgaattaaattctgttgattagaataactctaatttaagaaaaattccaaactgtagatttatttttctctgatcagtaaaaagaaaatgagttccagcttgactttagctgttcaagtgagaagtctgaggaagtgcatgttaatgagccagtgacccataggtagctgggttaaagacactttggatttggataatccgggaagcaattaatccctaattgttgaacaggcagtcctgggtaaagaggacctaaaatgctgcactattaacagcattagacggccaggtttgtacttcatagttttaggctgtcttcttcacaagttttagaaaaagaatttaggagctagagccctggtgcaggatcaacagcagctcatactcctattttaaaataatttggtcgtggcctcccttcagttttaatgtggcactggtaaatctacctggttctggcatgcttcactttgatttcctgctatcctctactgcttgcctctaaatcaaggtaaagagcagagcaggtatgtattaatgtcacattgtcttgattattttaaatacttaaaatatacatgttaaaccttggtattagtttcacaggcagtttacttttcagtacataatttaacaggagtgacttggtgggagtggggctttaaactgaaaattggaacaacagcatgatgtggagaaaagttgtgcagcattaagaagtacatgcaaaaattaa

SEQ ID NO: 5477 - DNA, 2055 bp, Homo sapiens
gggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggtaagaagaaggcggaaggcggcggaggcggcggtcgccccggggctccggcggcgggtgagtgctgcgttgtacgttgcgcgcggcgggaggcccgcgcggggtggggaccgtgccccaggcctgccggagccccgcagggggagggagccccgggcgggagggcgccgcggtgagggtgggggagggggcgcggggaatcccagattagccgagaggcctcgggctcggggcgtgtgtgtgcgcgcgcgcgtgtgtgtgtgtgtgtgtgtgtgtgtcggcggtggcagcgcctccattatgtggctcgagagccggggggagctgcagctgccgctgtagggggaggagccgcgggcgggcggcgggagggagcccggtcggcccgcggtggcgccgtcgcgctgcgtgcgcgcggtgcgggcacatgtctcggggggaggggagaggccccaggtcccggggcgggcgcgctttggcggctcctcgccgctgtattgtgcaaggagcgcaggggctcggcgtgacgtcacttccggcgggaggagccgggcggggcggggcggggggcggaagatcagtacaatgcggccgcggggagcgcgggcccgcgggggaggggagcgccgccgcgccgggctcggcccctccccctctctgcgctctcttcgggatacacgtgggcttcgggcctgggccgcgcagtttttctttggctttctcgaatcatcgaggagactggcaaaattagtaatgtctttagactgcgtcactagcgccaatcgaattcgtagttgattgttctttgaattcacatttgagtcctcggttaaaacctcagttaaaaagcaggataaagtcgagctgctttggttctcggaacggaaaagcgtttttttgttgtttagaggcttggcctttatggggctcgtgtgtgttttaggggacggcaaaacagaacagaaaggcggagataaaaagaggggtgttaaaagaccacgagaagatcatggccgtggatattttgagtacattgaagagaacaagtatagcaggtataggatgctcacctagttttactcatcccttattcgttcgttgatcggaaagctgtatcaggagacaattctgtctttcagagccaaatctcctcagccacctgttgaagaagaagatgaacacttcgatgacacagtggtttgtcttgatacttgtaagtgaagctgtttctccccaattatgaaatgcggtgatggtggtttttttttttttttttttagaagtcttaatgcttaagtgcagcaaaacttgggttagtttttttaaaagcaggaagataatggtttacattcagaacctagtagtttaatatttagcacgtcatcagttgtattaagtggattattttacaggctctaggagtttcgtatttttatgacttgaaagttctcattcttaggaaatgtaaaattaatgccagtttttgactagctaacggaaacttgtaacactacctataatttagccttacaggcttctacaataaagtaattcatttttttgtggaattatattaagtgagctatttgggctagttaaatatttactaatgacttctcccattagcacacaagtatattccctattttaaaagattgtaatattactttttcaataactgctcttttgttctcaattccagttcagtagctgctgctttaaacataagttgatttcttccaaagacctgaggcagcag

SEQ ID NO: 5478 - DNA, 1041 bp, Homo sapiens
tcagaatccaaagaaacactgcccccaccaaaatttgagacccatttacttgcatcagtgacactgaacacccagctttgtttcatttggtgcagagaaaagtgggctgtgtgcctttcctccctgcccagactcccgtgtggtggcattgaagagtgtccttcatggggggacagctgggccacataccccggcggcagcatggaggccccagggacagtggcagcagacggcttagcctcaactaatagcaaacaggactttcaacctctttctcactggcaagttttcagggtttaagacgtattgtctttagaagcgagggactctgtgtgtgctccaagaatgggttactagtccagcaggaaagaacaatgagtacaggcaggactccttccttttttagtttggaaattaactcatctttagtcattttacagtctaaaatcctttttggaataagaaacctaaaaaacctaaaaacactcaatataatcagcagtggccaatgatatagacggctgtgtttgcattgaacaaatctgcagatttgtcagccttgccttctatccaaagaaggtggctggtttacaaggacatgagatacacacccaagtgggcacaactgcatttttggtcaatacaaacagaactctgagattttatcagaaagtctgagcagcaagcgtgagacttgtaggtgcgtataagactttttgaacctccaccctggatggtagatgcggctggactgaagtcactaccgccttataagaacataatagacttcaagttgaaggctaatttatgacaaaccaggccagattcctgcctgtctaattccccacgctgcgatgcctggctgtttaccccagcttctcatgagaggagccccttctccagctcaggggttcccacctttgtcaagacaggacacatctctgcatttgcatcttaatgctcccccatgttaagaatggcaactggcgaataaacaacgggcagagtgttctgattccaaatccggaagagatgaaagag

SEQ ID NO: 5479 - DNA, 1053 bp, Homo sapiens
ttttagttccatatgaatgttaacatagttttctaattctgtgaagaatatcagtggtagtttaatgggaatagcactgaatctgtaaattactttgggcagtatggtcattttcatgatactgattcttcctatccatgagcatggaatgtttttccatttgtttatgtagtttctgatttccctgagcagtggtttgtagttctccttgaagagttccttcacttcccttgttaactgtattgccaggcattttattctgtttgtagcaattgtgaatgggagttcattcatgagttggttctctgcatgcctgttgttggtgtataggagtgcgtgtgatttttgcacattgattttgtatcctgagaatttgctgaagttgcttatcagcttaagaaacttttaggctgagacagtggggttttctagatataggatcatgccatctgcaaacaaagactatctgacttcctctcttccttcttgaataccttttatttttttctcttgtctgattgctctggccagaacttccaatactatgttgaataggagtagttgagagagggcatcctgtcttgtgctgattttcaaggagaatgcttccagcttttgcccatttagtatgacattggctgtgggtttgtcatatatggctcttattattttgaagtatgttccttcaatacttagttattgagagtttttaacatgaagcgatgtttacttttgtcaaaggccttgtctgcatctattgagataaccatgtggtttttgtttttagttctgtttgtgtgatgaattacatttactgatttgtgtgtgttgaaccaaccttgcatcacagagatgaagcctacttgactgtggtggataaactttttgatgtgctgctggatttggtttgccagtattttattgaggatttttgcattgatgttcatcagggatagcgacctgacgttttcttttttcttttctttcttctttctttctttctttttcttttttttttttttttttttgtgacagagttttgctctcgttgcc

SEQ ID NO: 5480 - DNA, 1048 bp, Homo sapiens
gattccatgtctttgctattgtgaatagtgctgcagtcaacatatgcgtgcatgtgtctttatggtagaacaatttatattcctttgggtatatactgggtatatttgctgggtcaaatggtatttctgtttttaagtctttgaggaatcaccatgctgtcttccacaatggtcgaactaatttatattcccaccaacagtgtttaagtatttctttttctctacaacttctccagggtctgttatttttttactttttagtagtagccattctaactagtatgagatgtatttcactgtggttttgatttgcatttctctaatgattagtgatgttgagttttttttcatatgattgttggccacatgtatgtcttctttagaaaagtgtctgctcatgtcctctgcccactttttactggcgttcttttttcttataacttcaagttccttcttgatgctggatagtagaccttttcagatgcatagtttgccagtattttctcccattctgtaggttgtctgtttactctgttgacagtttcttttccttgtgtctatatttttgtgaacaatctttacatgtcttttgtctatttttctctcagggtttttggtcttttttcctcccttgatctttagttcttgtatattagggagatttcccttatctgtggtatttagtctctcagtttgtcatttatttttttactttgcttttgttttttgccctgagttcctttgaatagtatttccaaaaacattaagaactctactctaggccaggcatggtgccttatgcctgtaatcccagcactttgggaggtcatggtgggaggatcattttagtgcaggagttcaagaccagcttgggcagtatggcaaaactctgtctctacaaaatagacaaaaattagccgagtgtggtggcacacacctgtagtcccagctactcaggagtctgaggcaggagatcacttgagcccaggaggcagaggttgcagtgagccaagatcatgccactgcactccatctttggccacagagc

SEQ ID NO: 5481 - DNA, 1100 bp, Homo sapiens
gatcaaatgattttcaacatggatgccaagaccactcaatggaaaaatgacagtctcttcaacaaatagtgttggggaagctgcatatccacatgcaaaagaataaagttagaccctttcttaacaccatataaagtaactcaaaatggatcaaagacctaaacatatgagcaaaagcttctactagactcttagaagaacacattaaggaaaaagcctcatgacattgggcatagtgatgatttcttggatatggcaccaaagctacaggcaacaaaagaaaatataaacaaattggacttcaccaaaattaaacacttttgggcatcaaaggataccatcaacaaaataaaaagcaacccatagaatgggatatatacatacaagggaatattattcagccttaaaaaggaataaaattgtgacacatgctacacataaatgaaccttgaaggcattatgcaaagtgaaataagcctgacagagaagaacaaatatcatattattccacttatatgaggtacctagaatagtgaaatacctagagacagaagtagaacagtggttaccagagtgtgaagggaggaggggatgggaagctattgtttaatgggtacacagtttcagtacaagatgatgcaaaagttatggctatatggatagtagtaatggttgcacaacaatgtgaatgtacttaatgctactcaagagttaaaaatagttaaaatggtaactattagtgttttgtgtactttaccatattgtttttaaaaaaagaattaatagtggaaaactttgcaaatttggcaggcgacataaacctgtagatttaagaagctaagcaaaccccgaacagtataaaccgaaagcagttcacaccaagactgtggatcatactcaaacttctgaaaactaaagacaaaaaaaaaaaaagtcctaaaagcagcaagagaaaaatgacaacttacctgtacaggaaaaacaatttgaatgacagtgattttctcatcagaaaccacagaagccagatgaaagtagcatatttttttcaagtactgaaagaaaagaactgttaacccaaagcttgggttgcccttaga

SEQ ID NO: 5482 - DNA, 1042 bp, Homo sapiens
gtgttttgcaccttaagtcatggcctttcgtttttgacagactaattggaattgtgatgctttctgcagagccagtgggagaaagagaaaaaaatgctgagccttcccagcttcaacaggtggttgcagtatgtttggagctaatagaatggagcagtgatctagctgtcctaaaagagctaactgcagatgcggagactatggctgtggagtggagtcttgatgacactctgctctcctccacactcacatgagaatatgcaagagttttgtgcgtatcaaatttcattgatctggcctcactgattttgaatttatggtactgtagagagagagctgatactcacatttccagtgtctgtagatggaaaaaaattgtttcctgtgaaaatcataaatatgtaggaaattataggggaaatgctagcccattcatgctgcctttacagcatgctatccccgctaaaaagatagttgatcatagacagttctttactgttcattaaagtaggtcctggcagggtctctatttggcagtgtcctgtaaaccattactctgtgctgttgtacagggttacaagaaatcagtctccattttattaaaaaaaaaatctagaattccaaatctccattaatttggatgtttcatcatcccaattcgtcccaataaggttttattatattttatttttgataaaatattgaaacaagagactatttgattattggacataataccttaagttccaggtaatttcatcatctgagtcctgaaaagaaactcagacttcccaacccaagaagtctgctgtctttcacattgggccatacctgtacatatccttgacctttatatttgtaggcagcaccactgtcaatgttagtggtgtaggtacatcttaccaaaaagaagtgtggcctgtaagctgtggtttgggcgatcttgtgactgtttgcaactttgctctgaagacaactaactggatccaattaataaacaattgggagatagggttactaagatagagtgatcagaaaagtg

SEQ ID NO: 5483 - DNA, 1026 bp, Homo sapiens
tcagcattataaaagcaggttttttttttttttttgtcacatattccgggcagtaattaaaggcaacagagattgccaaatgtctaggaatggatcgtggaagcttcactgtgcggagaaggtggtttgacagttcttggaatgctgattcccccattatgaagaactatcactccatctccaagaatctgtcaagagcttccagctgacacttagcaaagtcaatacctttcagtcacgttattcaattaaggaaaatatgaaacaataagcttataaaaaaaggcacatgaaacttgaatatttctttacaggattcaacattatgttgtttattctaaggatacaaaggagaccaagatcataagtttatgaaaagcaacttgtccctctaagattccatataacttctaatggtcaaaagtgactcagtgaacccttagactcagatggcaaagagtgattagatgcaaactgtaactgagatactaaagaagaaatcctgagtgctcatctagataaatgtaggctcttactgtgtgttaaaaacaaaactatattacttataatcaggtgtcgtcttctcctcaactctcaaaaaaaaaaaaacaaaaaaaacattaaatcgatgaggagcttaaaactgatgatgtcttagaatcttagaaataagacaggggtggaatgcattgtcccaaacttaactgcccatggaaccctggagttccatggaacacactttgggaaagattgctccatcctgtttgctgcctgttcatttgatgtcggataaattcccagcctgaaggctgtcagggttgcagccattaaatttcagaaggattgtgctaggcagacatcttttattgagaagatctgaacccagagacactcattatataaacgagccccgaagggtgagacccagcctcttgaccaggcattattgagccaggctttaggttagatgagacagacagatcctttctggactgaatgtggtaaaagatgccccagacctgccca

SEQ ID NO: 5484 - DNA, 1072 bp, Homo sapiens
ctcagatccagtacctggccctggagtgcactggggagatgttgtcatatattgagctaaagagcacctgaagggcatgagatttattccccgtagtgccacagacttggtcacttttgtgtctattgtaaataaactatttgtgcaaaagcagagaacatgggagacagaactgtagattgagcagacaagaaaaaagaaaagcaaaaccatcaatacttgcagcaagtcttaaccatgtcggcacgaagagtgacagcatgatcgcagagattcggagcaatggctgaggcggcaaaggccacgctgatggtccttggcccagactgtgcattggaatcacctggggagcttagaaaagataccggtatctgcctgcccccaagagatgctgatatcatttgcctcgatggaacccggtctgtattcttaacagctcctgaggtgattctaagtatatacccaccttaccttactaggcccttacagcaaagaggagagacaaagctggaggaacaacaggtctgcagtttgagggaaagtcggagccctcagtatcccttaaagcatattcctgggatgtgtgtgtatgtgggcatgtctgtgggtatctgtgtgtttgcacactcttggtagcataggggaggaagtaagctctctgcagccctctggagtgaattaaagcctctgatacatattttaaaaagcacatccagagctatccagcttccactggtgatgaagacctgggactttctcatattaagtcctctgaatgaaggtctgggtaccccttgttcttgcacagagcaagagggatttgtaagtttgtttacctccggaaaagaaatccttgcgtattttagttggtaagcatttacaaaccttaaaatcttactttcagagtagtctcaaaagttaaatggaaagtaaaacagaaatggtaaaggcaaacagctagggctgtgtaattttggcccacaatgagtatgacccaaaatgaaaacaaaaactaatcaaaaggtaatcatttcctaaatcttctgtgactggcatcgtagcattcccttgg

SEQ ID NO: 5485 - DNA, 1081 bp, Homo sapiens
gtccatagtacatgctcaaagcctttaaaacatgacatgtttgaccttacctaactttggagttctataggtctctgccacacaaagttccactaacagctcactgttgggatatggaaagaggttaaatttcacaataactatcttggggctcactatttatatagtcattaactgcgccctctagtgacattgcatccttggaagaatgaagctggggaattggtggcattggtaagctacagggagtatgtaatgcagctccgtgtattagggatggtaggtgaccaaatgtggttccactttctctttccctgctctgagaagttgctgttgggcttcaggtagacatggttgatgtagaacacatgcatttcttcactctgtctttaaaacctgctgaaatgacactcagattgggctctttctgcatgttattgattgcataccttcagagcttaaaaggtagacgtgagagagcatactttgtacttagatccatcgaatatcacacaagctaagtggtttgtcagaaagtcagttaaatttgaatagctagaagaaacattaggcatctaggtcaatatcagcattttgcagagaggagaaatgacttgtgtcactcacaaatagagtgacgctggacaatccggcccagaaaatacaagtatcataattctggggcagtgctcttttgataaagcactgtgggtactgcccttggttgtggaagcaaggttaaaaggtaaataaaggtaaaataacatcaagagggaacttttaggcctatttatttatttacattatttttcttgagagatcacttccatttatgtattcattttcaaatacttaacatactatctttgtccaatttctcaagccctttagatggtagaattctagaaatataaacaggaaaaatagatattttgggttggctttactactgaataatttagtatatttaagtgtccatttaagaccctagactgacattggccagtgcttttacaacccacttgggtgagactccatgacaggtctatcatgtaagaagagactgaagcattagctgctg

SEQ ID NO: 5486 - DNA, 1029 bp, Homo sapiens
acaaatacctgcagtggaaacgggaagaaagggctgaatgtgagagtggcacagagatatgatttgattagcacatgaatttggaataaactaccactgttttaaaatttaatttgcgacagtcttgctgtgtcaccaaggctggacagtggctgcagtggtgctatattggctcactgcaacccctgcttcctgggggctcaagcgagccttccacctcagcttcctgagtagctgtgactgctggtgcctgccagcatgctcggctaatgttttagcattttctgtagagacagggtttcaccatgttgcccaggctggtctcaaacatctaggctcaagtaatctgcccgcctcagtctcccaaagtgctaagattacaggtgtgtgagccaccacacctggcctaccactttctttatcgtccccttttcttcctgtttttctttggcctgttccttactgcctctggctcatcttgatctgcaattttattggtataattgccatattgactcaggaaactagctaccaactacattttaactagcatctttaaaacgcttgtctgagaaagagtaacaatgtttactacaagcatttataccagggcaaatggtataaggactaaggagaaatacacttttcctaattacagtgttgaccccttaggacgctgagcatttgtaatttaattacatcagtgagttaatgtggaaaagtacctgatacacttcgtgttagtttcattttgcttccaagtattactttcactttcttctttaattttttgaagtaaagaggattatcagatttaaacaaagttacacaaaatcctttttaaaattaaaataatcattgttgaaaatcttgctgaagttctgttgtgtttctgtaggtacaatgagctaaacacgttttaatcttattcagcattgaacatgcaggcttcatttgtgaaaagtcctgtgtttgtttgaagaaccaggcacaagagtaatcacagaacatacttttgaaagtacatgt

SEQ ID NO: 5487 - DNA, 1022 bp, Homo sapiens
agaacaagatcctgtctcaaaaactcgaaatgtgattctattacagctgtgctattaaaactcccacctctttaaagatggaattgagcattacccaaaaactttaaagggagaatgtctctgggctatgtaaagagctacagttccacaaaccctcctaaaagaagaccccacgtgctcaaggtccccatgaccgtgggtctgcacccagagccaggctggagggagggctgggagactcgcctgcccaagcctggtttgaagacctgatgcatggaagcaacagttctttgagaggacaaaatagaaaaagagaaatagtatggaattctttctttctgcaacaagttctatgtaatcgtttcccaagttaaaggaccccttcttacttaactctaaccataaacaactttattggagccagaacttacacatgctttcagtattaacattaaaggatcattctcagaaagtctggcttttctgtttccttctttgcttttgttatggcaggatagattggactttttcttttagatctaaaaatctttttttcacttggtaccttgagcatttgtatttataaatgtttggtttctgacagctgttttgggttcagttgtataagggaacctttaaatttaaaccgctttgcaagtgtttattcctttaaaacatttctaatgtaaatgtatatacatagaaggattctgaaaggttcttcttagtcaggtttaatctgtcctgacagctcaatgctattgaattcttaaaatgaagatgtcctggttgtctgtgcagcccagggctcccagagggctctcaggtagctagttaaccaagggacacccagcagtggcagatcctcatcctctcaaaaagggcagagcttcgggacactggtctagcccagcaggcatccccttagcactgtgtgctgttggcactacctgtcctaaaacctcaatatttatttggcctcatgtttattctttgcagacttattgagcacctactataaa

SEQ ID NO: 5488 - DNA, 1034 bp, Homo sapiens
tgcgcataccctagacacagacgtcatggtgttccgcaccagcgacgtcgcctcagtgccaattcataaatcagaacttctctgagatgcaggtcatgttctggggccgacttcttcatggaaagcacagaggcatcttgctaaagaagaggaggagatggaggaagtgtaaagctggggctggtaaataagtccctctccctcccccacgttcccctcccataggctttgaactttctgtgtttctgtaggtgtccctagtttggatggggacactggaaagctagccagctcttgttctgttgttgcacttcatttgttttgggcttttaaatactgggcttggctttatttgttggagttacgcctctactttgcatttcataggtgaagttagaggcagtattgtgtcttctgtgagttaacattcaccagatagttactgaatttttactctgtgcctagtagtcttctaggctctgggaatgcattaggtaacttgatagatgtggtcctggcctaatgagtatgtgtctatttgttcagttttcaaggggttagagcacagtgtttaaaataacacctgtatcatgaattctattctatataaacccattagcattgcatggagaaaaggtccattcatcacaacacattatacccctaatcccagcccactggttggcaggtgtgtgccattgatctcaagagtctagggaagttatgagctgccctggacaatttgtcacccatcagccaacagctttttatttagcatcctctatgtggctagcaacatatagaaaatcgtttcagaatttatgccctgccaatgctcttttcattagagcagcacaatctgtggtctttttagtcagagaagatggcttctctatatgtatttatgaaattaaacaagaaacatttcttccattgggcattcgttgttaactgccaggaggattttaggtgttgggaagttaaatattataatgggtataaaactcagtccccaaactctaatgtgccaaaaa

SEQ ID NO: 5489 - DNA, 1044 bp, Homo sapiens
aacctacgtgggtccagcctggatatccctggactgttcctcaccacccgtgtctcccctgtcccgccccccgccgcccctccagcaccccagcccctccaacatcccagtccctccaactcgctcatcagttttaaggtagaatagcaaggcgggctcttcctacaaagtagatttttactttaacaactttaaaatccactttggggctttgggggaccatgacatataggttagatttcttttagcagtcaggacgtggttgtgctttcaacacaaacatcaaatcaccgtctttaatttttaaaaccaatcctaaaacagtgtagtagaattgcttcccaaatgtcaagatcccgccttttctcccctttcaatatctagctgtcttcggagtatataaaacccattcacagagcttgggaacaattaggttctcaaactccacatctcatatggaggccaattgaagatgaacatctttaaatgtcaagaggtgtgtgttctggcctgtaaccacggctccatatgtgtgctggttctgacaggggccctaaattcagtgacgacgtctggtaatgattgagagtgactgctgactggaggtttgaaggacctggcttcccccactttttctttctttatcccttttgcagttttcataggattctctgtttgtgagaggattctgcagtaagcaggtacttgtgttttgcttttataacatcactgtaagcgtgcccctttacatgcttaaactatgcccatatgactctctgcagaaaactggacctgtttcctaggccctgctgtattccagctgagaggaggcataggacataccaagggagttttgatttgcttatcctcacatcctctaatttaatgggtagccctttatagagacaggtgactatccgcattttagatgagcaaaccaatgttcagggaagttgcccaaggtcagagagctagttaattgagaaaccaggattgaaaatcaaatccagttccaagtacagcgttggctccaccatatgtgat

SEQ ID NO: 5490 - DNA, 1069 bp, Homo sapiens
ttccttttttgtgattcacgtgtactattcattttttcattttcatggtgaatttttggtcttttccttatcgatttataggtgttctttgtgacatcaacactttgttcaacattttacggatattttcgctaggatgtcacttgtctcttgacttcagttactaacaaattttacattttttacactggaatatgactatgtaggtttttttaaaaaatgccctgtgggtttcctgtcgtgggtatctttgcttatatcaaagctatataattattttcacatttttttttttttccttctgctacagggtctcactctgttgccaggctggagtacagtggtaggatcatggctcactgtagccttgacctcccttgactcaggcgatcctcctgtctcagccttctgagtagttaggattataggcacacaccaccatgcctggctgatttttttgtgttttttgtagagatgtagtttcatcatgttgcccaggatggtcttgaactcataggctcaaatgatctactccctcagcctcccaaaatgctgggattacaggcatgagccactgtgcccaggctggtgaataatttttaagattgagatatttagtctatctagaaattcttttgtgtatgctttgaggtaatacaatccagctttcttttttccacaggtggagatgcacatatgctaatgcctttttattatacaaatggttcttttccccactcaattgaaaagtcacaattgagtgatttaacacttggcttaaagttatcataacacttggcttttttctgtgctatctggttaattgttcaacttttctgtccctgttctagaatcattctcttttcttttctttttccccatggtttgtagtaagtttggtatctggcaagacaattccactcccactattcttttgcacacttttctttactgttctgtatggacattattgcaaatgagctttaaacttactttaccaagttggagaagaaaaaataccactggattctaattggaatatatggaattaaatgtatgtattaagttt

SEQ ID NO: 5491 - DNA, 1058 bp, Homo sapiens
caccatacatgttttttaaaaagatgatttttgaagagcaaatttaggttcacagcataattgagaggaaggtacagagttttctcatatccctcctgccctcctcccccacctccaacacaaaacacacagcctccctcattctcagcatcctctaccagagtgggacatttgtgacagctgatgaacctccatggactcttcattatcaccaaagttcagcttctgttagcgttcactcttggtgttgtacattccgtgtttggacagatgaatactgatatgtatttacctttatggcattatacagaggtgctctgtgcctcacctgttcatctctctctcaactctcatccctggcaaccgctgatctttttaccgtttccatagctttatcttttccagaatgctatataatcgggatcatacagccttttcacactgccttctttcgcttagtagtatgcatttaagattgctccgtgccttttcatggcttgataacatcacttacttttagtgctaaataattgtccattgtctggatgtgcaacaatttgattatccattcaccttctgaaggccatctgggttacttccaagtttggggagttatgaataaagctgctgtcagtatccacatgcagatttttgtgtggacataagtttttaactcctttgggtaaataacaaggagtaagatttctggattgtgtgatgagtatgtttagttctgtaagaaattgccaaactgtcttcccaagtggctgtaccattttgcgttcccatcagcagtgaacgagagttcctgttattccacatccttgccagcatttggtgttatcagtgttccggatttggccattctaatatgtgcgtagtggtatcttcttgttattttaatttgcatttccctgatgacatgtgatgtggagcatcttttcatatgcgtatttgccatctgtatccatcatacatttttaatgcaaaaactatatttgaggaacagcaatgcattttaagggagagagagtgggagggaggaaagaaggaaggaa

SEQ ID NO: 5492 - DNA, 1048 bp, Homo sapiens
ggagttcgagactggcgtagggaacatagcaaaaccctgtctctactaaaaatgcaaaaattagccaggcatggtggcatgcgcctgtaatcccagctactcgggaggctgaggcaggagaattgcttgaacctgggaggtggaacttgcagtgagctgataccataccactgcactctagtctgggcagcagaggaagactgttaagagagagagagagaaagggagggagagagggaggaagggaaggagagggaggggagaggaggggaggggagggaatgggagtgagggagggaaggaaggaagggaaggaagggaaggaaggaggaaaggaaggaagggcaggcccacaagtttggcccttggctgacatttagcaactgagatttcagcaagtgtttcccccttatctggtaagagtggctgacagtgcctaaactgtttgtgtcaacattatggtttatgctgatcccctgctgtccttccaggagtccaaaattagaggctgcctacaggcgattgaactccaataaagaccctgggtactgagtctctaatgggtttccctgactgggacatttctcacgttatcacagctttttgtaggaggagtgaagtgcctcccttgtgactccctgggggaaggcccttggaggctcccactctgtttccacagacttctccccatgtgcctttccccttgctgacttcgcttggtgttgtttccctgtaataaactgcagctgtgagtacgactgtgtgccgagccctgagagtctgcctagtagataactgaaactgaaggtggtcttgggctcttcctgatgcagtcagctgtggatgtagtggtacctctcatagcataaagaacgcaaaagtggtagcaggtttgggagtgggagcagtgatgcattctgctgtaagttttccaaggtagtcacttatattgctttactagggttattttgagctagcatttattattatatgttttctatttcaaaattaagttaccaggaaaatctaatttttttcaacatacctt

SEQ ID NO: 5493 - DNA, 1061 bp, Homo sapiens
aacataaatacctgtgagtaggttaagtacacacaaggagcagattacaaaagaatgaaaacttaagcaattagcaaggattttaaaacattgatctatcaggtgttctagaaagtatttgcttctacatttcgagtttagctcaaattttactgagcagcttaaacagcactgtctgcttttgcctctaggtcacaggtcattgtcaaattcatttataagatagtttcaatctgtacttatttagcagtgcagagaattttagacacactaccttttcactgtttgtaaaaaaaaatttgaaaaataagaattgtaatgtaaaaaatattggaagactaattcttaacctacatgaagaaacagttttcagcagctttctaaatgtcttgtttacatccaaattgttgagaagctcgttgccaatctgttaattcatgaaaattcaaccttttaggatgtccactaagctgccttttattagcccggtttgaatgactgtgttcgtacttgagatgagttgaactgaattgccttaaaaattcaaatctgtaatgaattcataaggagttttcatcccaaagttcaaattggtagggcctagtaataactttagacatttatgtggtgacgagcttttaatcttccttaaggtttttaaaactctgcatgtactgtccttcttctatgttctcttgtccttttagttggttttggtagaaattttataaggcaaattaatgaaagttatctcctgagtggcagtttacaacaaaaacagatgtaaaggagaaaaaaatgaaatgaaaatttggattaaagaagaaaaaagtctcatgttagtaacagatataacaaaaagagtgaactctacgtggctataagttccttgacagcaaggactttgcctttcttaggtggaatctattgacatgtagagaaggaatgttttacttaggaggttgtcaaggaatgtctgtcaagtaggggtagaaggaaggaattaacagggctttgagaacattctcacatttgaagtgctaataatttctggtgtgaat

SEQ ID NO: 5494 - DNA, 1070 bp, Homo sapiens
tacatgacagatgttcggagccttggtaatttgccatatggtagcaagtagtagttttcagaattcttagttctgtcatatacgaatacaccttcataagggtgtgtgactctgtgtttgagaaacagcactctctttgttgcttaggctggagtgcagtggtgcgaccttggctcttggcacactgcagcctcaaacacctgggctcaggtgatcctcctgcccccgcctcctgagtagctgggactacaagtgtgcatcaccattgctggctaattttttaaatttttttgtagagatgggatcttgccatgttgctcaggctagtctcaaactcctggcctcaagagattctcctgcctctgcctcccaaagtgctgggattacaggcatgagctacctttcctggccctgcattctttataagtgtgtctacttatctccaaagaatattggagattctttttttttttaattagtcttttcttcctgttcattctgcaagggatatttatatttgaaattttggagaatgagagtttttcctttaaaattgaactatttttgaataccactccagaggatgtaggtgttgtattaactgaagtttcattctgaacatggaaagtttaattatcttgtgatattttatttgattagaactctgtagtaatcgctttgctatattgtgatgctcttgtcacagatgatatgcccggtttctgtcattaacgctgcactcttttccctataatgacatcactgattactcattttagaaccagtttccagcatatgttcttcctacttcctgcaacagtcattttgtagttactggcctggagggtaagtctttatccttccattagacgggttcagtatgagctgctattaattttaggacatgaaagagagataatcaacactgctatttctctgggaatacactgaaaattaaatatgtagactaaaaactacactgtatcttaagtcaacttctgttcattttaacagacatttagatgaattttggactctttcatttttaaaagattacagttataatgaac

SEQ ID NO: 5495 - DNA, 1040 bp, Homo sapiens
aaaggaaatggcgctgaatgtcgaaaggtcagtccctcaaagatagtttcaccaaatgagaaaatagaaactctcacaaaaaagctgaggtcaaccatgctttactctattcttaatttctactttttttttttttactgtatttgatgaataaatttccttttacctcatgtaatgtttaggtgtaaatctttcattgttgtaaaggtgttaagtcaacaattacctattaaagctttcatgaccccaaaattgaactattcagaaatacaagtgcattaagacattatttttaaaggcttaattttttttagagcagttttagtttcatagcaaaattgagagattttgaagacacaaagattccccatctgtcccctgcctgcaccttgtcttccatcttgcatattttttgaaggatcgcaatgaacaagaatgggatcaacagtggggagggccacacacctgtaatcctagcacgtttggaggccgaggtgcgcagatcgctggagccctggagttcgagactagcttgagtaacatggcaaaaccccgaaaaatacaaaaaaattagcagggtgtggtggtgtgtgcttgtagttccagctacttgggaggctgaggtgggaggatcacctgagctggggaaagttgaggctgcagtgagctgtgatcgcaccactgcactccagcctgggcaacagagtgagaccccatctcaaagcaaaacaaaacaaaaccaaaaaagcacacaacacacacacacgcacaatggagctgactaatccagatactcctttcaccccctaaagggagaaaaagagtatctgagctctactgagtttctgttgtggcgagtatggaactttgaagtcagactgcctgggcttgagggccagccccactgctcactggctgtaccatgtagaacagctgttgtactctctctaaatcccagtttgttcatctatgaactgaggattcataatatttaccttgcaggcttttataataaaaattaaataagatttctatgtaaa

SEQ ID NO: 5496 - DNA, 1038 bp, Homo sapiens
catacacgtatgtgtgtgtgtgtgtgtctgagacaattgccagactcattttaattatgaagctttaaggtgattgatattgggatcacttttgcctctgcatcttaagcaaatttatgttctttgcctaatgacttctatatttgccagcatggacttatcttgagatgactcaggaatgttactggaagtgatagttgtttggaataatttgacgcatgtccctaagatggcttacttttgcccctctgtcattttagaacatacttaagctgtgcacactgggatagcttccagaagcttaaattttaggatttaattaggtcatacaatattaattaataaaaaactttttgaattgctttgtgttcgcaggtactgtgtctgatgctccacatagaaggatgaatgggaccaaaggtcctactctaaaccattcacagaggagtagtgagacctattagaaaggatttgaaacaaaagctttcaggtagatgactgaatcactgtagctcttcagcatattgtaacagaaaaagagccagtttttgaatttttatgagcatgttatagttttaaataatgtgattttcctgaactgtaatattgatgtaattctaagtcagagaagctgttttgcatttccagctcttcctgcctacttcagcactaaccaaggtaccaaacagcagcctcttcagcatatatgctaagttttttttttttttttagcttgactgggaacattttcttggggatgtaattttagtttggtgtgatatgcaaacaagcacactttaaaaatagatattatttagcattgaagtggaaattaaaaatgagtcattaaaagcggcaggggggggaagaaaatgtggtcaatcaatttcagttgcatataggtgtagatgcaaatggaaagctgcatggttatttaaccctctaaaagtcagagggtcttatgtctcctgttcagagatgctgcttatatttaaataatatgatggacatttgggaatagactagtggttcttaact

SEQ ID NO: 5497 - DNA, 1090 bp, Homo sapiens
ttcaaaataagtctttcattgcttccagctcgactctgcttccactgaacatagaactcaatcaccagggtttaaacagcaactagtgctgtattccaggagatgtgtttactaaatggaatcttgaatgtttttacattgctttatgaattctggactgtttaataaatttaaatgaagattttttttaaatgtgtttacgttggcatgttagtcatttactgcagaattttgagtacattcaggggggctgtggttctgtaaaggacttaccacagtttctagcacactgtacatgtttaatagacattatgctgctgttgcttttgttggctaccataactgtgaaggagagaattgaggacagtaaaatgaaagtaagtaatcataggaatgcaccatctgtcaaggtgtgcttaagacattaaaattcctttgaatatccgtacaaatgataaaatttgagaaataattgtttgtctttgttttaccattaggctttttggtagctgtatcctgtcgccctgttcaacatttgctcatatcgtgtggaattcaaatcctgctagatcttttgcagagtttccagttctgttgtgtgtatacagtgacagctgagttcagtatgggttgttagagagagttgatttccaagccagatacttttgggttcaagtgactgctcccttatgtattagctccatgtgaccctaagacatttagtgtcctatgaacctttctgagaattgttctgagttttcctgacagagtcaccagcttcaagaaaaacatagcagttgaacggataggtcacctgaatgaagcctgcccacttgggtagcccctgacaatacctctactgtcataagttatataagatagtaagtattgatcctaaagatggtcctgaattgccaaggaagatagactccactctgctaagccagtgaccgtgatgtgcatttgaaacgcatttccttccagctgggcttggtggctcagttctgtgatcccagcaactcaggaggcggagaggggaggatggcttaaggccaggagttcaagagcagcctgggcaacatagtgagac

SEQ ID NO: 5498 - DNA, 1603 bp, Homo sapiens
ctttaggctggtgtattttccttatcggagaacatggcatgctttcttgtcttgccctttatctatttctcccagataggtaagctccctgagggcagggataccctctaccttcttgcgattatatcctcaacaattggcacttcgatcagcctgtgaatactcaataactgtatattagaaaataatgactgagcctgctttaagagtgctttaaaagcattagggttgaatatgagttttgaagtcagacagacctggaataaaattccttcctctactccttaatatcggtaagactctttgacctttctaagtctcacttcctcatttgtatcagattcgatcttggattgtcactaattcaataatagctactaacatatattgaccacttagtttgtgccaggcattatgcttagcagtctacatggatggtttcatttaaccttcgtgatgtctgtgagatgaatgctgtttttttaattagctgcttttctcaggtcggaaagtcaatttaagaggcttacgctacttactgaatgttacacagctagaaagtgggctgagttcacactcggtcacctgattgccaagcctgtgctcttaagatctcaggttcattgaaggcagcaacatttggtgagtatatagcagttaatcaataatcaaaacaagtaaaatgtaagaacagcactttaaaacttgtctttaatccagtgaagctcagatgcctatattgccttttaattgtctaagcacttgcacaaaattatctaatatgatcccaacaattcagtattattagtcaaatttaatatgtaataattgggagaataaaagctatttattgagctattcgctgctgacactacatacattataactaatattcctgacagccttttgagttagatgttataccgctttcattttgcaaataagaaccagaagctcagagaagtttctgaacttgatcaaggtcacattgtagctcagattaaaatttgcatctgagccaggcatgtgtagtctcagtaactcaggaggctaaagcagaaggatcccatgagcccaggaggtcaaggctatagtttactatgattgagtgtgtgaatagccactgtactccagcctgagcaacacagtgagaccttgtctaaagaaagaagaaagacaaattcagattttcaagcctgtgttctttccactatacaaaactattaggatgctttcgtgaggcggtggggaagttgactttctggaagttttttgctatccagatccgggaaacccgattcgtgcttcctgaattagctctgttatatacattgcagagtaaattctgtgtccctagtcttctgtgaagtgggaacatggtgcctgtgtccaagtgttttatctctttccattaaagtcagcagttttccaaaggtcttgtttatgaaggttattagttatgcaaaatgggcctttatggatagttctatgaaatgattccaattaaaaagaagtgggtagattgccagttggtgtcagctaattaaattatgatatgctcctgtcattaacaaggactctgactggaggaaaaataaaaaga

SEQ ID NO: 5499 - DNA, 1051 bp, Homo sapiens
tgtgagagcttgctatagctctgtgtcaggaatttgggaacagtgttgctggtaatgtggaaatcatgagagacgtcatgtggggttagacagcagccaccttcatagctccctgcctttctcacttctcctagacctcttgattctctgattcctcgggaaactcaattacctttccttgattatgcagagcaatttaactctcaaacatccttcggctctgggcccacctttgcacattcagaagctcattaatgtttcagcaccgaggaactggcaggagctttgacatttcagtgttgtcttttctccctccccaggtatctcagagtgagaaggagcagtatagagatctgctttcccactaatatgaattttcaccccaaacctcagcatcagatgaagatagtcattttcagttttaatatttttttcttctatgcatattaggtaggcaaagaaagacatagagttctctctatctagaactttgaaataaatgaaaatattagaacaaataaacacttcctataaatgtgagtgaataggacagtaggtaataaccggaatggatttggaagaatggattctgtcagctcatactcagaggcatattgttaaagcagggatatgaagacagcagcagagtacaggggttacaggcatgaatttaggagtcagatcaagctgggttataattgtgtctcctctcattcctaatctgtgaatttagctgagtcaacttaacctactgagtttacttcattatttgtaaaataaaggtaatatcaccaggtaaagtggtgcactcctgtaatcccagctcctcaggaggctgaggcaggaagatctcttgggcctagtagttgaagaccagcctgggcagcatagcaagaccacatctgggaggtggtgtggagaaaaaaaaaagtactccccccactccaggacctggcgagccctcagtaccggtggctcccatttcactcacagtcttcctgggctgtgcttccgtcgtgttccctgcactcctacaccctggtcttctgtt

SEQ ID NO: 5500 - DNA, 1034 bp, Homo sapiens
gggattatcaattgcttttatttattcagtaggctgccatgtctagaatttatttagacaattgaaggggtaacttggtgcaactctggcttaaataataatgagttgttaaaggtttttgttttgtcctccttttaaacttataaactcttaaatgatgtttggattgtaagtgatggcatgtaatttaagaagacagcattgaagttgtaaatttgctcataattgagagattgtccctaacatactcctacatgtttctactgaagagaacagtatattagcagagtgtagtaaggtttaaatcacctgatttcttaatattatgaataggtggctcttgtgttttgaaaagatttaaccaagccataaataaaatcatagatctttataccctcaggccaaatataaatcacagtggttcctgtaatatccaaacagcaggcctaaaaacaatttaaagtttcttttccttttcctttgtgtttcaccaatttgggttaaagtctatagtttggggattcagacattatgtttgtatgttatacgtgcattcttttagttcaagagtggctagcctcatgagccgtctaaggggaagagccaatattaccagtgccattaacaaacggccagtataggctggtgtggtggctcacatctgtaatcccaacactttgggaggccgaggtgagcaggttgcttgagctcaggagtttcagaccagcctggacaacatggcaaaaccctgtctctgcaaaaaatacagtaatttgccaggcatgttggcacgcacctgtgggcccagctactcaggaggctgtggtaggagagttgcctgagcccgggaggtcaaggctgcagtgagctgtgatcttgcgccactgcattccagtctgggccacagcaagaccttgtctcaaaacaaacaaaagcctatataagcattaatctcattgcttcgaatatgttttcgtgttgctgagggtcagaccatgtaagtgttttccaatgttttaaagagtcaaatgtta

SEQ ID NO: 5501 - DNA, 1034 bp, Homo sapiens
atagaccaataacaggctctgaaattgaggcaataattaatagcttaccaaccaaaaaagttcaggaccagatggattcacagctgaattctaccagaggtacaaagaggagctgttaccattccttctgaaactattccaatcaatagaaaaagagggaatcctccctaactcattttatgaggccatcatcatcctgataccaaagcctggcagagacacaacaaaaaaaagataattttagaccaatatccatgatgaatattgatgcagaaatcctcaataaaatactggcaaaccgaatccagcagcacatcaaaaagcttatccactacgatcaagttggcttcatccctgggatgcaaggctggttcaacatacgcaaatcaataaacataatccatcatataaacagaaccaaaggcaaaagccatatgattatctcaatagatgcagaaaaggccttcgacaaaattcatcagcccttcatgctaaaaattctcaataaactaggcattgatgtgacgtatctctaaataataagaactgtttatgacaaacccacagccagtatcatactgaatgggcaaaaactggaagcattccctttgaaaactggcacaagacagggatgccctctctcaccactcctgttcaacatagtgttggaaattctggccagggcaatcaggcaggagaaagaaagaaagggtattcagttaggaaaagaggaagtcaaattgtccctgttagcagatgacatgagtgtatatttagaaaaccccattgtctcagtccaaaatctccttaagctcataagcaacttcagcaaagtctcaggatacaaaatcgatgtgcaaaaatcacaagcattcttatactccaataacagacaaacagagagccaaatcatgagtgatctcccattcaaaattgcttcaaagagaataaaatacctaggaatccaacttacaaggaatgtgaaggacctgttcaaggcgaaccacaaaccactgctcaatgaaataaaagag

SEQ ID NO: 5502 - DNA, 1882 bp, Homo sapiens
tggataaaaaagatcctggtgtagggaggccctttctgctttacacctaggcagatctccaggcatttggagcacctgcttatctggttcagcagcctgagccacgcaactcttcctgtgggacagtgggaccctctctgctctaagcccaggcaggtctgcaggcatttggagcacaagcttacttgggtcagtagcccgagctgctccatccttcccgtgcagagatcctcatatagggggactctctctgctccatgcccagacagatctccaggtattcagaacacctgcttgcctggttcagcagttcgagtcaccctaccccttttatgcagagatcttggttcagggggagcccactatactacacacctaggcagagctcttctggatttggagtttagggcatcccccattcctgtgtagagaagttgatgctgaagaggtttcccattcctgtgcagagaacttgatactgaggagctccatgcctaggcatacctctgggtgcttggtagccacccattggattctctgtcagtgctggtgcttgtgcctgtatcaggggacctttaggtggacctgaccagtctggccccatgcccttggggctgagcagggagctcagaccactatgcattctatgtatcagcccattgtctgaggcaacagagaacttctgccagtaaacaaggatcaagtatccagctacattggctgcaactggctcttacctataagcatcatctactggcatgtagattgaactgcacagcctgatacaaaacctaccagaagaactggtagaaacaaaaccaaaggcagagcaaagatagaagcaaaacaaatagatcttacccaaaataatctgtagtcatacccataggaagcaggggaaagggaaagagaaggaaaaaaaacccagtaacattatagaggaagaaaagagaaagaaacatcctacctacatgaaaataattacaaaaattagaagtgctagcatcttcagctgagaaagaatcagcacaagattactggcaccattaaaaatctgaatgtagtaacaccaccaaaggattgcacaagctttccagaaatggttcctaaccaaaatggaaactcagatatgacagataagtaattcaaagcatgaattgcaaggaagctcaatgagatccaagacaagactgaaaatcagcacaaagaagcttctaaagctatccagggaatgaaggaagagataaatatcttaaaaagaaatcaaccagttctggaattgaaaaactcacttaagaaatttaaaaatacaattcaaagttttattaatggtttggaccaagtagaagaaagaatttcagaacttgaagatcagtcttttgaattaacccagtcagacaaaaaggaagaaaaaataatttaataaaataaacagtctttgagaaatatgggattatgtaaagtgaccaaaactacaaattattggcattactgagagagaaggaaaaaaataagcaacctggaaaacaaatttgaggaattaaagaaaatttccctaagcttgctagagaggtagacatccagttacaagaaatcctgagaacacctgtgagatactatacaaaatgaacatcactaagtcatatagtcaccaaactgttcaaggtcggtgctaaagaaaaatatcttaaaggcagctagagaaaaaggtcagattttgtacaacaggagccctatcaggccaacagcagacttatcagcagaaactttacaagcaaagtgagttgggggggctattttcagcatttttaaagaaaagaaattgcaaccaagagtttcatgtcctgtcaaatgaagcttcataaatgaagaagaaataaaa

SEQ ID NO: 5503 - DNA, 1069 bp, Homo sapiens
gataatataaacctggacccaaatttctatgtaaatgtttattttatagagacaagtaaattaaccaaataattcagtgaatcttcattgagaacctaatatgacctaggtactgtgctaggtgtcagagaccggctatatggtttagtagaaagagaaatggtagacgctgtgccaagcatagtgcctggaacaagcagaaagtccataagaaatatatgttaactgaaaggaagaacaaaatggaaactgtgtctgtctgagtcacccaaattagtaatgtctgtgagtttatttcctcatctgaaatgaagggtaataaaacctacctcagaaggattgttgtcaagattaaacgagttaagatatgggaatatgtccagaactgtgtttggtacatattagatgtttaataattgttagtcatagtgcgaaaaataagtaacacattattcccattctcaagcaatgtcaagatttaaaatcggattcttatccaccatatcgttagacttcagttgccttgttcttctatttgctttattctgcctgagcttcactaacaatccacagggcttttggactctacaaagaaaacacacacacaaaaatatcatacactcttctatatctactcacatctgcactcaaatttaattctgttctgtgaaaaagaaaatcggcacaaagttattgcttaatactgtcaaatactttttaaaattagttgccctctgtaacaataggagagcatggaagaataaacaagcagcagaatgatgtcagagaaactttggccacagaaggagatcagtaggtattggaatttgaacagcttatttttcacttacttctatacacaatatggatcttacagatttattgtaacttttttctccgatttaagaattgccagaaataaagctgagtgacaagaaaaggatgtgtgtacatgagacagagggcgctgtttatgcccatctgtacagaatgtcattcgttttaaatatgattttcctctttttcctcacagaaagagaaaatggtatatttctccttctatgcaaca

SEQ ID NO: 5504 - DNA, 1032 bp, Homo sapiens
aactggatatagtggctcatgcctataatcctagcactttgagaggccaaggagggaggtttgcttgaggtcaggagttcaagacaagcatggacaagaaagtgagaccctgtctattacaaaaaaaaaaaatacaaaaattagctgggtatgttggcatactcccacatcctagctacttgggaggctgaggtgggatcacttgagcccaggtgtttgaggttacagtgagctatgctcacaccctggtactccagcctggtcaacagagaaagaccctgtctcgaaaaataataaagatacactgaccagaagcttcagtctgatccattgtcaataaagaacagtgcaagagcaattaatattttacaaaatcaaaaaagaaaagctagcaggattatttcattagcatgcttctcttcatatgcacctttgatttaaaaatcactctcctgtagttttttatttcttcacaattatcagttggaaactaaatttgttcatctcgtaataagactgattctgtatgcatcatagaattgcaaacattaagtaacaaagtccatgtaaagtgtttagaacatagcacttagtaaatagtggttattattgttgtcactatccccactgtctttctttgtagatatttactttcaccttttcttctatagcagagccactaacaggtaatagagaagtaactagttagatcttaggaatttaagaagcacttcaagatgtggacagaaaaggatttggttcagattgcatactcttaggctatggagatggtacctgcaattcccatagaatgtgtataaagcactgtattgcattagaggccatgggattacaaaagctattctttgtaagacatcttagaatgttgttgatgtgtgagaataaaatcatattgaaaaaatatagaaaagttaccgtctttcatcagttctaagatgcagggtctcaccatcttgcccaggctggtcgtgaacttctgggctgaagccatcctcctaccttggcttccca

SEQ ID NO: 5505 - DNA, 1022 bp, Homo sapiens
ccagtgttcatagcagcactattcacaatgactaaaatgtagaagcaaccctcatgtcatttatctgaaaacaaaatgtggtacatacatacatatcataaaatgtcattcagcattaaaaaggagggaaatgaagacacatgctacaacatggttgaaccttgaggacattatgctaagtgaaataagccagccacattaaagacaaatactatatgactccacttttatgagatacttagaggagtcaaaatcttagagccagaaagtagaatggtgattgccagaggctagaaagaaggagggaactggagttactgtttaatgaatttagagtttcagttctgcaagatgaaaagagttacagagatggatggtggtgatggtgcacaacattatgaatggatttagtaacactaaagtgtatacttaactatggttaagatagtaaattttttatgcatattttattgcaataaaaaatgaaaacagtttcaatctaggaggattttggatgcatctatgccttgagaaatgaatggtttgatgtaaatgcatggtagcaagaataaataattatgttaattcatataatatgttatatatagttttaaagaaaattctatcactgtcttcctatgggtagggctataatgtccagttctttcagggattaagagggtagggtctgaagttaatccttgtttgtcgtaatgttattaatttattcaaccaagacttaattgagaatgacctagcaaaagagacaatctgttcaaattaaccaacttgagtaccatttcaatttgaaaactctgtctctggtgttggaggtcattcttcaggaaccaacatggttcttgggaaggtaaacctcatgtacaaagtcactcaggaataatacttgaccgctgggtgtggtggtacacgcccggaatcccagcactttgggaggctgaggcaggaatatcacttgagtccaagagtttgagaccagcctgggcaacgtaggaagacagctt

SEQ ID NO: 5506 - DNA, 1816 bp, Homo sapiens
attcaaacatgggcatcagactccactagaaacattaaataacttgccagtgttaacacggctagtgaaaaacagagttagtattcaaacatgggcatcagactccactagagacattaaataacctgccagtgttaatacagctagtaaaaaacggagttagtattcaaacatgggcatcagactccactagaaacattaaataacttgccagtgttaatacagctagtaaaaaacagagttagtattcaaacttgggcatcagactccatatctttgttgttggccaggagcaggcaaactataagcctgggtgccagaatgagccatgccgttcttgtatgtatcatgtcttgtctattgttacagcagcagagctgagtagtttcggtagagatggtttggcctgtgaaggctgccctttacagaaaacagttgcctgcccctgctcttgcgcattgtattttgtcttcactgttcctgccttcttgtctggttctaaggaatgaaaggaggacaccagctcagatttcctaaaaatgtctttatatataatttttaaaaattctcaaaaaaaatctgcctataaaagtcaaaaggatgaaaatgaatgtagcaggaacaactgtgaggtgtcccagctacagtagtcattgagtttttttgcataaaaatacgattgtaaagatagattccataaaatgtgatgttctttgtcctggtactgaccccggtagagtgttgcctatgtttttggcttaacatttatagggcattatttgaaaaactgaattctgatccaagcagagatgaggggaacaaggctgagaccttaattactggctctctcttgtcagagaaaggtgctttttgtcatattcccatgggatttgattgaccttcggacggcctgtgtctgttaggaggcatttctatttctcaggtttgagggctagtcagtaaaatttggatgaatttggactggatagagggactcaacctgaattgtgaaaatcctgagttacagaatttttaaaagttctatgttgtagttatatataataatttagctattttaaagcacaaaacaaatacgtgcacttggagaatggagtccacagcattcagcaacagtggcctgaagcagagccccagataaaacactgggttgaatgtcagtgtgctgacatcagtgttttttattatatgactgtgttctttctataaaaatcaggcattgtgagaagcccagatgtgaagcttggaacaataaaaccaaaggaagaatacatcagaggtttgtaaaacttagataatatggaagtaattaaccattagactcacgatatgttctctaacagtaaccttgaaactccatgttttgtgtctaatgacttctaggacacataaagacaaaaggaaagaataatatgctttcagagcatgaagaacttgctttagagtccctgtgtcttttgactcgaatacacaggattattatatcatgcagttatgaatctgaggaaagtatgacatgatcgataggtctaattctaaaatatctgataaagaagttaataccaaaattagtgagtttcctaactttaaagtgaaataactagataaagaagaactaaatgcaaagctagcagaaggaaggaaataataaagattagaacagtgttaactgaaatagagaataggaaagcaataggagagattagtggccgggcgcagtggttcacgcctgtaatcccagcacttaaggaggccggtggaccacgaggccaggagttcgagaccagcctggccaaca

SEQ ID NO: 5507 - DNA, 1052 bp, Homo sapiens
aactcacagttgtcatgggctgtgaaagctggcaagtgctgcagtttttgtttatgactcggttgtgtcagtgggagacagaaattctaaaagatactgcaagcagatcctggtcgatttctgtgagtgctataagttctgggagaaatgatcttgggctttagatgttatcgctgtggcaattatatttcttctggtctcacagaagcaagtgtcattaagagctttaaatatttgaaattagaaccatatgagttattttgagacctctagttactgtaattaaacatacacaggtatatatgaatgaggacgttatttatgcatgagcaagggaagcttttccatggctctgattattggcaggcaggggtggtgaggaaggaaagcaagatggacacatctgacacatttaaagcccagtttagccagagtaaggattttgaggtcctttctctttgttcagattgcgagtcgatggtaggactttgggagggatgtagcaaaggggatgtaataatggcaatagctcatgctcatgaaacacataggttccaggtaaaatgctaagctctgtgcatatgatcactcactgttacactcttggcaatgttattatctctggcttaggaaagtagatgacatgcccaagattacatttgtagaactgtggtgtgaacccaagccaccctgagtccagatcccaaaagcttgaccactgttttattttctatggggggttacatgctccctcagtaagttttagatttttaaggtgccattgttgagcagaagaacctttagagctccttatttcttttgtggcttttcctgtctcagggaaggtgcaggcagaggaagttaaattccgatcactctgaaggaagaagtttgcagcagtggtaggatgatatagaaagtattgacagtgctgagaatctgggattatttattcttgtttggagtgagagactggatcttcagtttactttagataattaacaactgcaacaaaccaggttgatttattacattttctagttagattttgt

SEQ ID NO: 5508 - DNA, 1030 bp, Homo sapiens
aattgatattcatgaaattctaaaatgattgttgttttttaaaatgttattttaggctgggcactgtggctcacgcctataatccttgcactttgggaggccgaggcaagtggatcatttgatgccaggggatcaagaccagcctggccaacatggtgaaaccctgtctttactaaaaatacaaaaaattagccggtcctggtggcgcacaactgtaatcccagctactcgggaggctgagacatgagaactgcttgaacctagggggcggaggttgcaatagccgagattccgtcactgcactccaacatggatgatagagcaagactgtctcaaaaaaaaaaacaaaaaaaaagatttttttattatatcttgaggtcatatattttccaaagatataccactacagttttataatgatggtcaatggagaaaatttctccacttgaaatttagaattcaaaagtctgattatcaaatatttgagaggcagcagacctacgtactctttagttaataaatattgagtgtctggtatgtgccatgccctatactaggtggatatacaaagatgaacaaaaacagtgtctctgtattacatttatattggcaagtcattactacatacaaatttctaaaaatttttaaaaagaccttcagggagtctgtagaaaactagcactaattttctgagagtttgagtacagaactaatgtcagtcttgtgttatactcaggaattttcattgagtgaaaacttgaggaaataatttgtatgatgaattttaaagaaattgggacttccctaagacagtggaaaatatttgtttttaagaggcattgatgggagctgtgtggtgatttgtgatttgtcagattaaaaaaaaagtgctgtgtttacctatgtaacaaatctgcacatcctgcgcatgtatcctggaacttaaaaacaaaaatttaaacaaaagtgctggcaaagcaaggttttgttattatcctttattaagctttttgtgggatggaggttttac

SEQ ID NO: 5509 - DNA, 1033 bp, Homo sapiens
ctgtctgtgttgatagtttgggaattattttgagcagagtggctccctatatttatgatatatgggaatagtccctactgaggaagtctgtgtatccacttacccggggttgccctggattatggttgtggacctccattggtgagttcatggttactgttagatgcaggtaaaatctcctctagccactagcacccacgaacagtaacatttactgagcatttaccaagtgccatgcactgcaccaagcagtcgaattatcttataaaatgtccactgagatcagtgtcagtgagtggtagatttacatacactaccagtcatgcaaagaaaatatactatcaaagtaaattttttgaaaagttaaaacctgactctcacagaaatacaaaacgaaatgccaaagatgtattaacttattaatgaggaaaccaggcagagttaatgcaggtccagagtactgaaggaactgatctttaggcattagaataagattgctagattggagacaaaactggtgacgttctgcatgcactaaaaccacagtttttagagttatcctttctgctggacagaaatctataagctaacgttgtagtttcacactatctgtgctctaacagcaagtaacaaagtcaaatgcattggcattcttctagggaattaaataatccttgggtgaagctgtgaaacagtgctctagagtaatatgagaaggccacacagctccctaatctttttcttttttcatgttttggataattttaattaacaatcgctttttaagattattattttcttttgagacgaagttttgcttttgttgcccaggctggagtgcagtggcgcaatcttggctcactgcaacctccgcctcctgggttcaagcgattctcctgcctcaccctcccaagtagctgggattacaggtgcccgccaccacacccagctaattttttgtatttttagtagagacagggtttcaccatgttggccaagctggtctcaagttcctgaccttcaggtgatccac

SEQ ID NO: 5510 - DNA, 1048 bp, Homo sapiens
tttaattttaagttcaggggtacatgtgcaggactgttttataggtaaactcgtatcatgagggtttgtcgtacagattattttgtcaccaggtgttaagcctagtacctagtagtcatttttcagcctagtacccagtagtcgtttttcctgatcctctccctcctcccatcctccaccttcaagtgcgccccagtgtctgttgttcctctccgtgtgtccatgtgttctcattatgtagccctcccttacaagtgagaacatgcggtgtttggttttctattctatgttagtttactaaggataatgacctccagttccatccatgttcttgcaaaggataccatctccttttttatggctgcttagtattccccagtgcatatgtaccacattttaaaaattcagtctaccattgatgggcatttagggtgtccatgctttttctattgtgaatagtgctgcgatgaacatagatgtgcatgtgtcttcatgataaatgatttatattcctttgggtatgtgtcagtaatgggattgctgggtcaaatggtggctctgtttgtgggtctttgatgaatcgccacactgttttccacaatggttgaactaacctacactccgaccaacagtttgtaagcgttcctttttctctgcaacctcaccaacatgttattttttgagtttttaataatagccattctgactgctatgagatggtatctctttgtggttttgctttgcatttctctaatgatcagtgatgttgagctttttttcatacacttgttggctgcatgtaacattaaaatttaatgaaccagtacgctattgaagtatttccatttttttccactgtagggaacatcagtatacatctatctttgcatatgaaactggtttttacataggataaattagtagaaatgaagttgcagaaacagattttacatttttatatatgttgccaggttgtgctctaatatatattgcatttacactccaccaaccctatacaagaacactgcttgcttactcacagccttgc

SEQ ID NO: 5511 - DNA, 1144 bp, Homo sapiens
tgggcaacatgacaaaacccatctctacaaaaaatacaaaaattgtggtggctcatgcctgtggtcccagctacttgggaggctgaggtgggaggatcgctcgagcctgggaggtagaggttgcagtgagccgagaacgtgccactgcattgcagcctgggtaatagagcgagactcggtctcaaaaaaacgaaaaacaaacaaaccaaaaccaacaatacccacttaaatctcaaggtatgcagatttgaggtgtgatagtgtttaaccttcggaagtcttttaacctgctcatcattgtccttctgcctgtctcaccagtttgttttaaaagttatttgctgatttgtctctggttacctgttgaatgacaatatggtgctgccatggctttacttgcctgcctgtgtttctgagctcatcccatattttctatataccaacaaaaatcttcatctatgtgacctggttttacttcagattcgtcgtgtgcagtgcctaaactctgccttttcttccgcacagcatactgcttctccacctttgctgtcttctctcttgacgttgcaatctcctgagccagccgtgccaggaatatcaggaatacctctgattcttcccccaaacttctgtatgccctgcttatgctgcttttaaagatctcttgactctattgttttatttttatattgttttgtcactgtcccagttattattaaaatccttccgatctcacctaaatggcctctaactcatatccttgcctctcactgtttccctgagtctcaattcatttttatattttgccattagagataattgaaaaaaaacccagatttgatcatttaatctcttgcaaaaagatgtctgttgattccctactgcctttgtatgaaatcaaggcttttaagtatggcatttgaggaccctgcaagcttcatctcatgccacgttcctggagctggctgactgcttgcatagactgcaagcagcttgagggtcgtaaccattttcctagcacctggtgtagtgacaagtagattgcggagattcagtgagtgtatgcttttcctccatggcttgcattatgctttcagtccttcccattgttgcattgcctttatgcctccattccttcacgttg

SEQ ID NO: 5512 - DNA, 1056 bp, Homo sapiens
agacactggtacctgtcttacatcaacagatcaagggacaattggcggattgatcacaagtttcctagtgccgcactcctttgttttaattttttattctaccaagtactttaatgtgtactttcacattatcttctatagtagccctctgagttatgggtatcgtgcctttgtagatgagaaagtgcgtaaggtcacactatatttaagtaaaagagacagagctttaacatggctttcttcattccagagttcttattttctgcattccaccatactgcattctgtgttatattagttctctgttagagccctaattatggaccattataagccttagcaaaatccagaatgatggaaataagaatatttgataatattctctaatactaaagtattgctctaggcaaaactgtaaattatttaatcaggatttctgctatttttatccaggtggtacatcatgccttacatacctctgtccttcatatattcaaatctaaataaatgctggtagtttgagtgggaggagggtggattattcatgtcaaatgattctgtgctgatgttgccacaactgtatgtgaaaataaagataattgacatggaatttgcatggagttaaggtaccttttgaaatctgcattctacaatcttttagtactgcatattaaaacattaattattcaggagccctccagattgagtctttatcattttcaagccattattgggtgtgcttttccctatgattctatagatacatgcatttatagatttaaacattttctatgctataaactatatatgcagtgtataagaaaatactctttggccttattaacacctctttttcttttagtgatatttatttgaccttaacatttatacttgatattaatgacataggcaaataattttaaaatgttgtttttgaataaatacttgtcaagtaaaagaaaagcattagagctacatgtgaccagacttggcagtcatgggcgctatttcaagttttgattgacatttggttttcgttttgatgcttataggaaa

SEQ ID NO: 5513 - DNA, 1029 bp, Homo sapiens
ctttatctgaactttttagttcttattttctgtctttttgccttagaggtgatgctgtttattagtttagtcatgacctagttgtaaattatttcatggaaaagtctgcttaagtttactgacttaataagaactgataattgtttgtatgtgtgtacagaatgatgtagaaaatctggtaacacacaatctcagtgattttggttttaatgctttttcatatatgtgcgtacttatgttttgataggtgtttgatcttacattgcagacaaaatttggcagaatttaattgataacatatgcatcatatttagttgtcaaaagataaaacaatatgtatttgctctttgtcaaaatccaatgtaaggtaggaaatatctggtttaacagccagcattgaacacttgaaaattatccttcagaagtttactttgagattgtgctatttattttctctttaaaaaagatattaacaaactgactgaagataagaaagagggcctcaggcaactcgtaatgacatttcaacatttcatgagagaagaaatacaggatgcctctcagctgccacctgcctttgacctttttgaagcctttgcaaaagtaagtgttaagtttgctctttgctaattccatacatcaaccatttgctccttattttgttgttagttacaaaaatgtcgagaatcttgacaggaaattcaagacccttaatgccttatattacttccttatcatagtgagtagagcatgagagaatgtattgtgtgcattgagaagggtatgaatttttctgtttgattaatattcttgttattgcctgagtatgttcattgtgaattctcaaagtgtacccttggaagaaagagtatgctttcttttctcagaagaaaatagcatatcccattattttttgtgaatggacttgtttgccgttgcattgcattcattgagttttatggtggttgtttaagcatagagcctgtctttgaaatgaaaaatttattgaaatccatttcttttcttttc

SEQ ID NO: 5514 - DNA, 1047 bp, Homo sapiens
ctagatttaataagatttaggttcaataagcttaaacttaaaggctaaaactataaaaccgagaaaacataggagaaactctttggatatggggtacataaaatttcctatgtagaacacagaaagcactaagcctccaagaaaaattgataaattgattttcatcaaaattaaacccttcagctccttggaaagacaaactacagacatggagaaaatatttgagacctctctttccccctgtttccctccttttctctttctctccctccttctctctctctcaccccaaccaagaagttgtttccagaatttataaagaatacttataattcagtagtaagaaaactgagtaaaacaggtaaaagatttgaatagatactttaagaagatatacattaaaagataatcattgtcactggtcaccagataaatgaaaattaaaaccataatgagatattactacacacccactagaaagactaaaattaaaaggactgactttgtcaagtgctggcaaggtgatggagcaactggaactcttgttcactggtggtgagaaagtaaagcgttatcattgttttgggaaagtttagtagtttgtaataatgttaaaggtgtacttactgtatgacccagcagttctgctcctagttatttacctaagagttatgaaaacttacatctacaaaaacaacttgtacataaatgttcaatgttccaaacctggaaacaagtgaaatattcatccacaggtaaatgaataaagagatgcatactgtactattacttgtccattaagaggaacaaactactgatgcatgccgcaacgttagtgaatctcaaaacactgtactgagggaatgaagccagatgaaaagaagtaagactgttctaggctagacaaaactgatcttacaattatagagacaaaaccactgagttgcctgggatggaggacttgaatgtaaggggcacaagggaacttttggggagtactaacatctgtagcttaattttggtgttggttatatggagatatatgtg

SEQ ID NO: 5515 - DNA, 1033 bp, Homo sapiens
tgtgagccaccatgcctgggccttattttttagagtttaatatcatcagcttttttccatttgaaagactctccttggttacctagaaattttattttagctttcataaaaagctttgctttgaaagtgatcactgaattaatctaaggaaatatgagtcttaagatactgtgatgatgttcagctgcctcgaatactttttaaaaagttagtatagtgttcatgatgtatgaacagtttcttttgatttatgagcttcagattttgtgaattttatgaattttgagtgtgtctgaaaaagacagtggtaggaataaagtaatttctttccacatgaatctgtttttcagtgttttccgaagaaaacatatttgtatactgtataattcatagtggttttttttttatttgcctaggataatgaaataaagtacattgggtattttattacatggctgatattgtttctcttggctgctttgtttgttttgttttctcttagaaaaatatctcaagtcttgtatctcaactacagtagcctgaaaggggcaaggaattttctattggaaatggccaggaaactatactgcatcaaaagattgaagtcataaaatagcacaattaatgaccgataccaatcataatattgtttcttaaagttgtcttaacactgaaataattttaaaaaaatggttttggatccagacacagtggcatgtgccggtaatcccagttacttgggaggctcgggcgggaggactgcttgagcccaggagtttgagaccagcctgggcaacctaacaagacaccatttcaaaaaaaataaacaaacaaataaataatggctttgaaataaaatgttgaaatgcaagtagtagctggtatagctgcgaagaatatttgtaaaaggcacttaatatactgtttcagtgtcttaagttactatcctgctagactaagctttgtgaaggcaggcactgtttctgttctgtgcttattcctcactgcctatcacagtatgtgggtaaataaa

SEQ ID NO: 5516 - DNA, 1077 bp, Homo sapiens
tgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactattttaatgtttaatattagaagtcctttaggtctttaagtttggtgatagttctgtgaccagaaatatgtcagaggaacttagaaaactcagtgtgttccaatatgacatttgctttctgtagctagcttctttccttctttgtttacatacctggatggctgaatgatctagtcgccttgcttcttgtctactaacttctctctccttggtagtagttaaaaacacacactttcaaaggagttcagtggtttctaaaattatttttatggtatagtaaataggctctcaaatttacatagagttttattgtttataaaatattttatatatattttctttttaggatttctgtaaagtagagagggcagacattattttatcctgttgtagatgaacaaataatggcttctagttaatgtaatatggtggtgacatatatagaaacatatgattttcctctcagagttaaagtatcaaataatcagcactttactttattaggaagacactaagaatattcccacaaaggttgggaccattgtactggcagtattaacaaaagcacttgacaggaggaaacagttggaggcattgtaattggaaaatgatttctatctgcagctcatatgacattttacttaaaaaaaccctagtaaatcaatgataaaaccttactcaatgaacctcagaaaacattatgctaagtgaaagaagccggacataaaagaccgcatgtcatatgattcgttatgtaaaatatccacaacaggcaaatctatatagacagaaagtagattagtggctgtgtagggctgggaggtcgagatggggtagggatagggagtaactcctaatgggcctaaaggtttctttttggggtgatgaaactgttctaa

SEQ ID NO: 5517 - DNA, 1031 bp, Homo sapiens
aatacacacaaaatggagagagcagtacctgacagatagtatttgctgttgttactgttgtcattattatttctaaccaactctgaaacctgcccactatctgggttttcttttctttttaatgcaaatctgtttttttgttatttgcaactgaaaaacaccctaactcttacactggttagttaactctgagactaatttgaattcaacttaaagataagtattaagtaactagtttgacttccttcccactgcatactttacacagtaggttaaaggaactctaaaaatgtgaaaattactattgcatagaccaattttttccaggattgaacaaatcaatccgagggtgtttacaagagctaactgaactaccttccttcccccttactttaacaaataagcactaataatggtactggctgtcaattcctacattgtcaagaggtctaaaatttttttatatttgaacatttcattgagtagataagcagatattttcagttactttcagtcatgtagatatcccccattttcatgtctgtatttggaattcctctgtaataagttaaggatttaagaatcttttaaccttttaagcatacctctaaattctaaattcttcttctgctttactttttttttctcttgagacaagatctcactgtatcacctacgctggagtgcagtgacacagtcatggctcatcgcagcctcaacctcctgggctcaagccatcctcccacctcagcttcctgagcagctgggactataggcatgcctggctgatttttaaaatttttgtagagatggagtctccctgtgttgcccaggctagtcttgaactcctgggctcaagtgatcctcccaccttggcctcccaaagtgttgcgaatacaggcatgagccacgacacctggcctgcttaatctttcttaaatgtatgtatgctcacatttatttttttttattttttttttttttgagacggagtctcgctctgtcgcccaggctggagtgcagtggcggga

SEQ ID NO: 5518 - DNA, 1048 bp, Homo sapiens
gaccaacgtggtgaaaccttgtctctaataaatacaaaaaattagctgggtgtggtggcgggtgcctgtaatcccagctacttgggaagctgaggcaggagaatcgcttgaacccgggaggtggaggttgcagtgagccgagattgtgtcactgcacttcagtctgggcgagagtgaaaactctgtctcaaaaaaaaaaaaaaaaaagaaagaaactctggcaggacccttattccctatcgtccttttcccttctactgaatgaaagcagagaaaggacaaaacaatgaccattacctttggggctctggtgaaaaccctttacacctggggaaaatagaagtaatagaagtaaacctgcccttgggggcgggagcatgttgggtcacagattggaggagactaacgaagcaggacatctaaatacatctttaccttgtggaacagaaaaagaacatgatttaggcaagacacctgcctaaataactgatcattactcttcaaaagtatcaagtgtcaaagacaaggaaagacttaggaattatgacagatcggaggagactagggaggcaggaacctagatactttctatgtattactgtggtgatgtcaatgttaagggaagctgagtgaaggggtagatgggaatcctctgtgctattattgtgacttttatgtaagtgtaaaattattttaaaatcaaaggggaaaacattgtaggccccccttttaaactgctgcctgagatagtctataagaacaaagttcttgccttcaattattggagattgaaatttgtaacttttagttcactttaggaaaattaggttctttttttgtttaagtccatgtttccatgaaggaagattaggttctttttcaactttcttctattgttgtatagtttttttttttttcaaataagaaagaatggttcatagtttttctcccgacacatttcatagcctttatattttctctctcaagtgggtgaaggaaatttgaatatgtaactactacccactgaaagcttctggtttaataattt

SEQ ID NO: 5519 - DNA, 1005 bp, Homo sapiens
aaacacttttttttgagacaaggtctcactctgttacccaggctggagtgcagtggtgcgatcatggctcactgcagccttgacctcccaagcttaagtgatcctcccatcccatcctccctggtagctgggactataggggcacgccaccactcccagctaatttttctgtttttttagtagagatgtggtctcgccacgttgcacgggctggtcttcaactcctgggctcaagtaatccgcccacccccgcctaccagagtacttagtacttctagcacatttattgtgcttctagtgtgagaatatacaactgtcttttttttcttaagagtcagtctcacccattttaagtgtagaattcagtgactgtgagaggagagaagctaaaggcacactaaggaaagaaacaggccccatgctaaaatactttgagggttaccaaaggtgataattgttggtgtgcctatgagcgtttgtctcaggagataaaatgtgctgcttctgttctaaaaaatgggccatgtcattggcctcctgggaagtattttttattgtttccaaggtgaagatacatgagaaggcttctaggcttttacataaagtccacggaaacttgaattgttggactatacagtgaatcctttgaatccatggttttcacatctgtggatgcagccaggcttggattcaaaatatttggactgggtgtggtggtgtttgcctgtagtctcatttcctagggaggctcaaatgggaggattgcttgagcccaggagtttggggccagcctgggcaacatagcaagaccttgtctcttaaaaaaataaaaataaaaaattgggaacccccccccccgaaaataacaatgtggcaataaaaatagtacaaataaaaccaatacagcataacaactatttacatagcatagtcaggggtccccagagcccgggccgaggaccggtaccactcccatggcctgtcaggaaccaggccgcacagtag

SEQ ID NO: 5520 - DNA, 1055 bp, Homo sapiens
ttgatgagtacatgagagtgcattatgctttacttctttgtatgttttagtgttttgttacagaaaatgttcaattaaaagtactttaaatacgtgtgacagaaactcacacatggagtctcaggagcccgacttctctttttaaaatgaaagagcctgggtgtgttggctcactcctgtaatcccaacgctttgggaggccaaggcaggaggatcacttgaggccaggatggtcaacatggtgtgagaccctgtctttaaaacaaggcagacacaactctgtgaatgtaaaatggttgcattgtacactttaagtgggttacttttattgtttgcaaattatagctctatgaagctgttataaaaactaaaaagaaattaaaaaaagatccttgaacttcttttagtgatacctaaaaatacacaggctgaatccaaacaagggtcgggggagtagtttctgacccacctgatgctaaacaattttttcagtatttgttgcgatatttaatgtgagactttacatgccactgttgttggtactgaagatacagcagatatttaatgtgagactttacgtgccagccactgttgttggtactgaagatacagcagagaaccacaacagacaaaaatccctgctctgggctgggtgccgtgactcaagcctgtaatcctagcattttgggaggctgaggtgggaggattgcttgagcccaggagttcacgaccagcctgggcaatatattgagaccttggctctacaaaaattttaaaaactagctgagtgtggtggcacacacctgtagttccagctacttgggaggctgaggtgggaggatcacttgagtctaggaggcagaggttgcaatgagctgagattgcgccactgcactccagcgtgggtggcagagcaagaccctgtctcaaaaaaaaaaaaaaaaaaaaaaatcccgctttttgacacatgccaaacacatcacgtgcattttaacacctaatccacaatgcctagcaggatgccagtggcaagatgtaatctcaacaaaagtgta

SEQ ID NO: 5521 - DNA, 1059 bp, Homo sapiens
cttctttttaatgaaattacctgtgtaataactacctttaatataataatttttcggtcacagatcaaatacatggatttaattgtagtttggagcccaacttttaatgagcaggatttaatgaatgaggcacttgtggaagatcagtttattacgaggtcacatgattcatgtggccaccatgcataggaaatgctaaaagggagggccaggcgtggtggctcacacctgtaatcccagcactttgggaggctgaggcatgcagatcacctgaggttgggagttcgagaccagcctgacaaacatggaggaaccctgtctctactaaaaatacaaaattagccgggcttggtggtgcatgcctgtaatcccagctactggggaggctgaagcaggagaatcacttgaacccaggaggcagaggttgtggtgagctgaggtcgcgtcattgcactccagcctgggcaacaagagtgaaactccatctcaaaaaaaaaaaaaaaagatctgagtggagcctaagttagacactgggcatggttttctgcagtagggtgaaattgcttgtaactatttttcttgtattttgagacttctgtttttttacattttctttctatagatgaacacattctttgattgtctcctggttgtttagggtggtgctcactctttcaggtactcagaacattgtatcttttatcacatttaccaccttgtattttaactttttttttttccagacagagtcttgctctgttgcccaggctggagtgcagtggtgcaatctcggctcactgcaacctccacctcctgggttcaagtgattctcttgccttagcctcctgagtagctgggacgagtagctgggattacaggtgcgcaccaccatgcctggctaatttttgtattttaagtagagatggggtttggctatattggccaggctggtttcaaactcctggcttcaagtgatccactcgcttggcctcccagagtgctgggattacaggcgtgagctaccatgcccaaccatatttcaactatttgaaccagtaa

SEQ ID NO: 5522 - DNA, 1052 bp, Homo sapiens
actctcactttggtgctttcccttgtcttatcctctttatgagttatgtgagttggggcaaactacttaacagctctgaactttgttttcttaatcttgaaccctgcctcttcagattatcctcagaattaaaagagataaaacatgtggaagtattttgtgtataacaggtactcatacttaatacgtgttctttccttgctctacttagttctcattgattgatctttttaaaagaccatttatttatttaatttgagacagggtctcactctgttgcccaggctggggtgcagtggcatgatcatggctcactgcagccttgacttcccagactcaaacgatcctcccacctcagcctccagaatagctgggaacacaggtgcctgccactatacctggctaattttttaattgtttgtagaaacagagtctcactgtgttgcccagactgatctcctgggctcaagcagtcctctccccttggcctcccaaagtgctgggagtataggtgtgagccattgagtccagccctcagcgattggtcggtggaatttaggtattattatataatttaggtcttaatttggttattaggttttattagttatttgccctgtggtcttagccttcttgaggacggagaccttgtcttatttttctgtgaatcccaagaccctagttcattgctaagtacacaaggatgttcaataaatgtctcagtgactgaaatttgcaggattatcagagcactctgtctgcagataacatctgagacattttctgagtattttttgaaactgactccttctcttgattattattaccactcttagttggtactactgattatggaagctagtaagattagggtcactggctgaattattagtatcaaatctataattctgtgtagtcaccagaaatagtatgtcacagcgaatgtttataggtggttatttaattcatctatgaaaatgacttaagtcaggcacagtggctcacgcctatactgccagcactttgggaggtcaaggtgagatcacttgagc

SEQ ID NO: 5523 - DNA, 1578 bp, Homo sapiens
aaggtttaagggtcagtagagtagaagaggctagtggagacaaggaagcacttacctctgtgaaaataatgtaaaaagacgttactgggtttacggctgattttgtaaaatatggttagcaccaggcgtaagtgaattgctgcagtgttacagactcttccttggaggccctgaaggtcaagcaactagcaaaatcatttcaaagagcagaaccttgaacgatggcttgaagtaggatttgcaacttcctgggcagtggctaatgggtctaggatttgaaataaggtggaagaattgataataatgtggtttgggaaaggactttatggatgtgactacatttttctttttaagtgggagtcataattcctgtttcttctactgcttccttttcttctgtaacgaggtttgggaaagggctttatggctgagccctggtgaaaacatttggtccatgtgaatgccacagcagagggcgttcttaatcagacaggatgacctgctttgtggatagcagtaagttgttcttcagacagcctggtgcttgctcaaaaggctcaagaacagagcaaccatggggacggggatagaggctggtgcctggaactcaacaatacagacttcccctcatgatagccatgtggcttctgctggtacagagtgcccagtttgctgccagtagtaactggtcctgattccccaaatggcaacacatcttcaggaccagccagccaccttgtgtcgggttattatggtagaactttttgtcatggaggagtcagttggaatatcaatttttttcctgtacttggatttgtcttccctgtgtgtaataccaccatctctaagatccactgagaatctttgatagagctgtgatattccccacaaggttgcctctgaccttcccagaaagaattagagcaatgggctaatgcttgtggttttgactgtttatgtttgccgatttcctcattggaagactattggtgggatgtagaccaagtctgccttctatcgaaaaagccaaaaaggctaaataccttctcaacctcccttgcagctagggtgcgggcagtgacctaagttcggtcaatctaagatgctctctgaggactttgaataaaagccagtatcacaaagaagaatggttgagagaatcactctccagcaacaaccagtttcccaaggagcagcagcagcagcagggcccagtgtctgtggtgatggtagtgcagaatccagcattatcaggcaacagaagcgatacagtccccagccccagcccctgctcttaacatactctggcatttaaggcagctggtgttatagaccagtggttctcagaccttttagtctcaggacccctttatccttttacaaattatcaaaatggatttgatagggatttaaaaaacgttattgagagtgctgatgatgttttgtttatgtgggttttatctatttatatttattgcataaaaattaaaactaagttttgaaaatacctatttaaacataaatttaaggcagggcgtggtggctcacacctgtaattccagcactttgggaggccga

SEQ ID NO: 5524 - DNA, 1033 bp, Homo sapiens
gggcagcggggggacagaggtagggaaaacagattgtgagaaatatgtgttctgatctttcttggctggctaaagttctagggttagggtggggatgttaaatgggttgaggggacggtcagcagtagaaggccttttgctctgctccttatgtggaatcttgagaggagatgttatgcaggttagtgataggccaacacgggcctatagcacagcagtggtagaaggaagtggctagatagttgagtttgtggtaccaggggattctgaaatgctctcataccactgtgaaggaggtggaggagcttattggcctggtggaacagctggcgtcatgacaaaagactgtgtgactatagactgaatgtcaggatcacagactccagggatgagagccagcatgacatcctaaaagatgagatgggaccagttcagccataggacctgattacctccttgcagcagagaccagtgaggatccagagaaacaacacagatccaaggtcttcttgccactatttcttctaggatgtccgataagaccttggagggaaatctacccgaaagcagccatttaaaccagcccgggtaaggagttaaacaaagtctgagtattaactggaagagattgagatattgtttgacaagttttaaatttcctggatatttattagagtagatattcatgaggaatattagattaattatagaaaaaatggcgcatattcaggagacagattagatgagttatagaagataaagcaggctgggcatggtggctcatgcctgtagtcccagcactttgggaggtcgaggcaggtggatcgcttgagcccataagttcaagatgagcctgtgcgacatggcaaaaccctgtctctactaaaaatacaaataattacctgggtgcatgcctgtagtcccagctactcagaaggctgaggtgggagaatcaattgagcccaggaggtggaggttgcagtgagtggtgatcacgccactgcactccagcctgggtgacagagtgagaccc

SEQ ID NO: 5525 - DNA, 1064 bp, Homo sapiens
tgatatctgatatcaactctatttttcttttttttaagaatcatatgcttatatatacacctactgtgtacccacaaaaaacatttttatatatacacctactgtgtacccacagaaaacatttttatatatacacctactgtgtacccacaaaaaacatttttatatatacacctactgtgtacccacaaaaaacatttttttaaagaatcatgctcgaaaagcagaatttgatagaactcttgactatcccagtagctgaagtaacatgaactgtgattttatttcaagggtttgtaaatgatattcttgaaataacaaatgcaaacatctgtagagcacttaccacctaccctgccacacattgttctgcttctttcatcctcagaacaactttgagatagatgctactattaaccctattttatagaaactgatgcacagacaggtttaagttacttgattctggtctcacagtaagtccagaagctgggatttactccggcagactggttaaactgaactgtgctcgtctgtaattatattgataattgcttttaatatgggggccctatagttaaaaaaaaaaaaaaaagtctgtgtggtaaatgcttttaattccttattttaaaccaattgttgtttaaaccatttttatttttctatggaatatcttcctgttagcttttcactctgttacccaggctggagtgcagtggcacaatcatggctcactgtagcctcagcttcccaggctcaggtgatcctcctgcctcagcctcccacgtagctgacaccacaggcgtgcaccaccacattggctaatcttttaaaaattttttgtagagacagggctctcactttgttgatcaggctagtcttgaactcctggccttaagccgtcctcctacctcagcctcccaaagtgctggaattacaattgtgagccactgcacctggcactttctccttttgtggagatgaacttttctgttcctttggctggaacaagtagttcaaaatgaggtggctagaaagattttctcttttttgaaaataaaaaa

SEQ ID NO: 5526 - DNA, 1039 bp, Homo sapiens
ataagtatatgccatattaaatataatttatgttttaaaaggcacacagccaagggtcatcaaaaacctgtgtgcttcaagttaaaacatgtattaaaattctttaaccagtctcttatctttaattcatttaggtgattgaacaagaaaagcttgaagctcaagattcaggagaagaggctaggaatctttcatttaatgagttatatccctctggaacacttaagcttcagtacaattttgatactattgaccaacagttttgtgacttagctgataacaaagacactgctgaatgtgacattgctgaagtagatggggaactttttgtggctcaaagcaactttaccttgatattggaaggtgaagaaggagaagttgagccaggtgattttgcatcatctgatgtgttacctaaagcagctaacacagcaactgaagaaaaacttgtatgcagtggggaaaatgataatcatggacaaattgcaaatttgccatctgccgtaactagtgaccaaaagtcccaaaaagtagacactttaccatatgtgcctgaacctattaaagtagcaattgcagaaaatttactagatgtaattaaagacacaagaagtaaagaaattacttcagatacaatggaacagtccattcatgaaacaatacctttagtgagccaaaacataatgtgtcccactaaattggtcaaatctgcatttaagactgctcaggaaacaagcacaatgactatgaatgtcagccaggttgatgacgtggtttcctccaaaactcgtacgagaggtcaacgtatccaaaacgtgaatgtcaaatcagcacaacaggaagcatcagcagatgttgctactcctaagatgccagggcagtcagtcaggaagaaaactaggaaggcaaaagaaatttctgaagcttctgaaaacatctattctgatgtcagaggactatctcagaaccagcaaatacctcaaaattctgttacgcctaggagaggaaggagaaagaaagaagttaatcaggacatact

SEQ ID NO: 5527 - DNA, 1027 bp, Homo sapiens
cattatgcctggctcttactgtatattcttatacttaatcttttgcaatttttgctggtgtttctgtagactgtattctttgcattgggatcattgggtcaagacctatatttaattataatttttatagatatgctcaagtgaaccttcaagataatcctgtcggtggggtatgagttgaacactggcattaaaaaaaataaaaataaataaataacagtaaaaaaattctcctacctgattctggaagacttctgtgtaagaaacactccttcatttaaatgatcttatggcccacaaaggacatcttagcacctctgcatggtgtctgagactgccaaatttaactcaggttctccaatctgatcttgctgcaaatcaaccaaaaaacatctactaccaagctctactcttcccttcctcatggacacagcgtgcttgtttccatctatagatctcagtctttcgcacgcttcccactgagtgtcacttcttaaaaacctgatgttcctctgtcacaccacaccaaccattcagctctatccaggccacattagttttttgtcttctttgaatttttgtctactttgcttttttattattttatatctaaaaagcagcataaaattctttaaacgtgtcattttactgacattcttagcaagattattatgcagtacttagtattcaacaaatttttaaagtacttttcaattatttataaagatactttacaaagtatctttgaaattctacatgtagatttcttgttttgtacatttaaatagctttttctaaaactaaactttgataaatactgctttcaggtgtatggttgaagcctggaattttttgcggcaacattgcaataggttgaatatagaggagttactgaagcacatgtatgaagtctgtcaggaaatgggcttgatggaagatttactgaagttaccatttacagacactgagcaggtaattacttaccgatgtaaacttgtcagaaattcaagataaattggtagtttac

SEQ ID NO: 5528 - DNA, 1041 bp, Homo sapiens
atttttatatttttagaaattagttattttacctcagctgtgttatacatgaaccaattaccacttctgtgtcagcactctgaaagttacattttcttggttctctttggttaaatagcatgtacttctacggataagagggtaagatctacaaatttcaggcagaagaaaagaagtttaataatagattgattagacacagaaccttaacagtaatgaattagcaagtgcttgttgaaataatctggcttagcaaaaatgtttagatagcttaatctagaatcaatactgagattttttatgagatcaaaattgtagtttcaataagatttactgtaagaacaaaataaagaagctaaatgtggtaactgttgaataaatgggttaagagttctagtactgggttggaaaccagcatataaatttttttttcatttgcatgtacctctcactgtttagtgatgttaaagtgttgctacttaatcactaatgcttacgtcagaaaggcaggtgttggaactttggaagaaacatgtttggaaggtttttttcctccttttgattccaggtgtccttctttaattcatccagagcatgtttctctgatttgccaggttctaatttcctttacctttgccatatagtaaacaaacactaataaatagtttaatttctaaaccttatttctcttaagttggaaaaagtctcaattttccagtccccagaaaactagcacattaaggctcctatacattaaatacagaaataaaaacaaccactcaaaatgctatttgtgagatagcttgtattcagatttaagaaatgtttaaaaataattactagtcctgtaaatagagaatgacttcagggttgctagaaagtcagagaacactgttgaaagtgcaggtgatagtttttattgaaacatcttaggagaaagctgcttaaatttttgaactgataattttgcaaaaggcagccatgtttattgcccaggagattatgtaacagcatactttacacttcatttttatcagaagg

SEQ ID NO: 5529 - DNA, 1399 bp, Homo sapiens
gcatgtaggtttgcagtaatgtgctatcatttagagtctacaaagctggggagggaggagacatgcttagctgtgtgtctggcacaaacttgggaaaacaagaagcatgaatgaatgaatgactgtataagatccactgaaggttttatccctttgttttataggcagtacttgatatgtacctattagacggcgttactgaagcagccaaacactctattgtatccttttaagttttatccagtgtttcatgtattactaaaattataaaatttcaagagtagtggaaacctgacatatctaattgcaaggttgaattttggttttgttttcttaagaagaggtgttaacccaggatctgttgtttgggctcagatggcctgtgatcaacctaaaactatatgaaaaattttgttttttatttgtttttctaggtatagggtacttggcttttatcagacacttaaatgtgtccaagacactcaaaaagttaacaacagttgctctaaaatactaccaccaagtggtcactatcaatggcattaacctctgtgctggaaatgaatacattataagttagcgtgatactaccttaggcattatttgagtcctatagtctttgtgataatatttttgtgctaatgttagttacttagtctaaaaatgtataattccatttataatttataagctagatgatgtttgattaagctgccatcttttgctagatctttagaaatttgcgtatatctttgtttcttgtatttactgagctactgacttcataaaaatacgctttatctcctttgtggtgctgataataaaatactgagaatgaatgaagttggtgcgggactggttgtacccacatttactaaaactatcttctcattgctgactctccatgatggctttctaaacactaaaaacaggcatttcaagtctcttttaatgctacattttgttgctacctattgtaaatatatacgtaggaggtttttgttgttgtattttattgtccttaatccgctttttaaaagaccatttatttgctacttgatattatgtattcctttcccaacaaaacagacactcccattgaatctttcccaactgtatttgccatttcttggggccaagttaaacttattcaggggttttggttgatagatcataatgactatgaggtaagtctattcacttacagcataaactttcatgaattactagaattttagaaaatacacataatttaaatttggtattaaaagatatgatacagtctactaaaaatagttgaggaaggacccagtttaatcagtacctttaccaagcactattttagaaggcaagaatataaagataattcagaaccccaggtttcttactgtttaaagaa

SEQ ID NO: 5530 - DNA, 1480 bp, Homo sapiens
ctttttatggaacattaatcaaagaagtaggcttgataggcttttgtttcatagtgtattttgtggttataggtgtaaggctaattaaaatgcttatattcgtaattaaaactcccttcaagtcaatatggtggcgttaaaacatccttcatttcagaggtcagtaatcagtaggtgcacaaggataattttataacgaaagtctctggattgtgatcagaaccatttctcaattttgagaattggaagcagttggactttatagcacaaaaaattaagctttagggtttaatgcaaaataaattttattgattacaaaagtaatttatgattacaactgtttaggcttcactgaaatacaccaaggtaggaaatgaagttccaaacatacagcataaatattgttctgcagcttccccagacttaaccggtttcttatacatctttccacatcagaacacatagggcttacccatttcttttgagtaaatttgtagtatcccattgtgtgaactgtttgttgtggcaaaatctaatctcttctctgaaaaagacatcagaagcagaagtgatttgggggtgggggccctgttctaggacagtgtgatatgatttttccccctttataacaatgagagaatctgctcttgcacagtggttatattaatatatgagtctgagtttttaaatttttttattgaagatttcagacatcttcagatagttagaagaatacaagagttcccataaacccatcacccaaattcaagttaattttcaacatttgctatatgtgtgtctgtttagttcattcccctttcctcctttccctcttttcttctgtgttagtttaaagcaaatagggatattttattacataatcataatgccaataacacttctttggtatagtgtgttatctagactataatcaaattgatgtgattatccaaagcatctttttacatttggattgtttggattggaattcaaatacagtctgcacattaattgcatttgacagttaagtctcaagtctccttgaacgtacagcaatcctctttctgtcctctctgtttttatttttagtgccattgacttgctgaagttatctgatagaatgttccacattttggaattaactgtgctttcatgtggtatcattttcgattttctgcaaattaaattagctctggttatagatgaaggtttagtattttggcaaggtagtttggaagtgctgagtacttcatattgtatcacatcaggagacacatagtgtctagtagtttcaattagtgatcagtggattcacatggtgacagcatgatccttcctttttaaagtctgtcatcaactttaaactagtggttctcagcagggggtgaattttgtcctccaggagatgtttggcaatgttagaagacatttttgattgttactgctggtgctacttgctactagtagttagagactaatg

SEQ ID NO: 5531 - DNA, 1050 bp, Homo sapiens
tctttttatgcttctcctttttcataggtacagatacatctttttttttttttgagacggggtcttgctctgttgcccaggctggagtgcagtggcacaatcttggctcactgcaacctccgtctcccaggttcaagcgattctcctgcctcagcctcctgagtagctgggattacaggcgcacgccaccacacccggctaatttttgtatttttagtagagacggggtttcaccatattggccaggctggtcttgaacttctgacctcgtgatccgcccgccttggcctcccagagtgctgggattacaggcgtgagccaccgcgcccggctggtacagatatattttaagaggaagcaaaacgttgtgtctttcacgcctacctttaatattttcagggacttttctttcttcccagaatgaagtgtaacttccctcggttagctcaaaggtctctacaataagtatatgctactgtctatcctcatatgttaacaaattttatgcttttgctattccagaatcgtcatcaatcctggactcattctgtggaagagatgtttccactctgatgtttctttgctcatgtccttcatcctggagtgccatctttccttttttaaatactcaaatttcaggtcctccttctaaatccaatgttttcactgtatttttatttttatttttatttttttgagacggagtctcactttgtagcccaagctagagtgcaatggcgtgatcttggctcactgcaaccttcgcctccagggctcaagcgattcttgtgcctcagcctcccgagtagctgggactacaggaacgcgccgccacactcggctaattttttgtattttagtagagacggggtttcaccatgttgcccagggtgatctcgaactcctgagctcagacgatctgcccacctcggccaaccaaagtgctgggattacaggcgtgaaccaccgcacccagcccactgtactcttttatttccccttatcccacttttttactgggatctcacagcatatgtacctctattgtag

SEQ ID NO: 5532 - DNA, 1027 bp, Homo sapiens
accagcctggccaagatggtgaaagcccgtttctactaaaaataaaaaaaaaaaaattagctgggcgtggtggcaggcgcctgtaatcccagctacttgggaggctgaggcaggagaatcacttgaacccgggaggcagaggttgtagtgagccgagatcgtgccactacactccagcctgggcaacagagcgagactccgactcaaaacaaacaagcaaacaaacaaaaacagctgagtgtggtggctcatgcttgtaatcccagtgactctggaggctgaggcaggagaatcacttgaggccaagagttcacaacccagcctgggcaatatagggagaccctgtctctacaaaaaaattttaaaaattagccaagcatggtggtgcatgcctgtagtcccagctatttgggaggctgaggcaggaggatcacttgatccaggtgtttgaggttgcagtgagctatgatagcaccactgcactccagcctgggcaacagagtgagaccctgaatctaaaaaaaaaaacccgtgaatgccgactatatgctaggtgctttgctaaacaccgaggaaaaaaagatgacaaagacttttttttttttttttttttttgagatggaatcttactctgtcacccaggctggagtgcagtggcacgatgtcggctcactgcaacctccacctcccgggttcaagtgattctcctgcctcagcctcctgagtagctgggactacaaggcactcgccaccacacccggctaatttttgtatatttagtagagatggggtttcaccatttgggccaggctggtcttgaactcctgaccttatgttccacccgcctcggcctcccaaagtgctgggattataggcgtgagccaccacacccggccaacaaagacttttttttttgtcctaacaaagctcacagtgtagtcgggaaaataatttataaaaagtaattagaacatagcgtgatggatgctgtaatggacccttgttgtatttcctatttcaaggcacc

SEQ ID NO: 5533 - DNA, 1027 bp, Homo sapiens; identical to SEQ ID NO: 5532

SEQ ID NO: 5534 - DNA, 1035 bp, Homo sapiens
agagacaaacattcaaaccatagcaatatttgtctccagtcctttggcatagagttcctaaaaccctttaatttcctgagtaataggggcgttaggagaatcttttgttctgatatttggtctttgatcttggttcctgacacagagatcctgatcacttggaatttcctgggtaatagtagcgtctttttttctcatggggcacctcttggtgggctcctggatagggctggtcaccagaaagaccaagccatgattagaaacttggaactttcagctcagctccccatcctccatgaaggggagaggggcggaaacctgagttagtaattggtggtgcctatgtgatgaagcctccatgaaaatccctgaactgtggggtttggagagcttccgggctgctgaacacgcggaggtgctggaagggcgatgcaccctggagggggcgtggaagccacctgccccctcccccatacctggcccaatgcatctctcccatctggctgtccatctgtatcctttgtaatatccttcctaataaacaggtgaacataaataaagtggttttctgagttctgtgatccatcctagcaaattatcaaatccaaggagggcaccatgggaactccagtgtacagcctgtcagtcaggaacacgggtcacagcctggggcttgtgactggcatctaaagtaggggcagtcttgtgggactaagtccttaagctgtgcaatctgactctaactccaggtacatagtgtcaggattgagttaaattgtagatcacccagctggtgttggagaattggtcggtgtggggaaaactccacacacattttagcaaccggagaggaagtattctctgacaagtatgactgtagaagagaaagcagttggtttttcctattatacacaactccatttaaaatcgcaataacccccgcacctgctctggcactgccagccttcttccctgccggattattctccatagcacttgtcttgtcatctagcgtagaatttacttgtttgttcg

SEQ ID NO: 5535 - DNA, 1035 bp, Homo sapiens; identical to SEQ ID NO: 5534

SEQ ID NO: 5536 - DNA, 1032 bp, Homo sapiens
aaatgctctttttagactgtttgaacttaatttgttttaataagacattgttttaatgtctttggaccgttgtacattaagtgatgcgtatcctaccaccaacgttaacctatctcaccttagttacggttgtaggtaacaaatggtaacaatacaatagtgggtaacatggtggaatagtatctctaatgatcccttctcccagtggcattaaacttcaaataatttgaaaaatattgttcccacacgttacaccttcattctgtttgctctttttgtaatgacagtgtcattattaaggctataataaagcctatataggattataatcaaagaccgtgtatttctgaatcttgaaggactattcacaaaattttatttacattttccttttaacatgtggcttttctggcctgcaaaacatatacatgcttttagttttggtttacatggagataaatacataaatatactactctaaggataaatgttaggtgtaagacagttatgaagcaagtaatgtgtttgaagtaagtgcatacctgttttcagaataagagaaaaatgttggaaccaaacataatttcaaaagtatggataatttattagcaaactagaaacctcaaaaatgtcgaaggcaaatctgttttctctgctttgtattgaaggcatttctctaaaatcttattttgcagaatttccacatgaaattcctgtttttacttttatgttgctcatgctagagctaacgtataattttcttgttccaaaattcatgaagaatttcttatgtgatcttctcagggattataataatgattttatgaaacttattggtgcttaaaaaataatctgaagatgtgaataattccacagtgagtgtattaattttcattgtacttaattagtacatttccatttttccattattagagaacactattcgagccaactttttttgttattgtttctttcacttaattgagtaattgagtttattgactctattgggcaatttgttcagataaacac

SEQ ID NO: 5537 - DNA, 1090 bp, Homo sapiens
atgagatagatggcaacacaataacagtgggggacttcaatactccactgacagcactagacaggtcaagacagaaagccaacaaaaaaatcaatggtcttgactatatcatagaacagatggacttaacagatatttacagaatattctactcaacaattgcagtgtatgcattctgttcatcagcacatggaacattcttgaagatacaccatatgataggccacaaaacaagtctcaataaatttaagaaaatcaaaatcatatcaagtacactcttagaccacaatggagtataattggaaatcaactccaaaaggaacactcaaaaccatgcaaatacatggaaattaaataatctgctcctgaatgactgactgttgggtcaacaatgaaatcaagatagaagtttaaacactttttgaacagaatgatagtagtgacacaacctatcaaaacctctgagatacagcaaaggtagtgctaagacaaaagtttgtatcattaaatgcctacattaaaaagtctgaacgagtacaaatagaccatctaaggtcacacctgaaagaactagaggaacaatagcaaaccaaatccaaacccagcagaataaaagaactaacaaagatcagagcaaaactaaatgaaattgaaacaaacaaaaaatacaaaagataaatgaaacaaaaagctggttctttgaaaagataaacaaaattgatataccattagtgagattaaccaagaaaagaagagagaaaatctaaataagctcaattagaaatgaaacaggagggccaggcatggtggctcatgcctgtaatcccagcactttgggaagccgaggtgggcaggtcgtgaggtcaggagtttgagaccagctaaaaatacaaaaattagctgggcatggtgacacattcctgtaattccaggtactcaagaggctgaggcaggggaatcacttaacccggcaggtggaggttgcagtgagctgagattgcaccactgcactccagcctggatgacagagtgagactccatctcaaaaaaaaaaaaaaaaaagaaatgaaacaggaggtattacaaacaa

SEQ ID NO: 5538 - DNA, 1029 bp, Homo sapiens
agattgaaaatttttgcatctctgattatgagatttttttttctgttgttttcttttgtaatgtattcctgtagttttggtagttagggcagtgttgtctgcatagcatgaattaggaagtgtgtactctgcttctgttttctggaagagcgtatagagaatctgtgtcagttcttcaaatgtttggtggaattcactagtgtgatcatctgggtcttcagccttgtccttccttttttggacagttattactttattgatccaattttaaaaatacgtatagacctattcatgtctgctcatctctccttgtgtgagtttttggaggttttttcaaaggattggttcattttatctgacttaccaatctagtggtcatggagttgttcataatgttcactgtggtttttttttttttttttaactgtctgtaggattagtagtaatgatggaacctcttttatttctgatgaacattttggtcttttgtctttctcccttgtttggtctggctataggtttatcaattatattgatgtttatggagaaccagattttgttattgttgattttctgtattgacttcttgtttgcagctttcctgatgttttctatcagtgttgcttgtctgagcttgacttaggtttatcttcctggcttttttctagtttcttaaaatggaaggttgaattattggttttagatctttcttttctagcacatgccctccatgctttaaatttcttccaagcaccacttgtactgcatttcacaaagtatctgaagatgtattttatttaatttcctttgaagtatttaaattttccttgagacttgtctttgacctgtttgttatttagaactttgcagtttaatcttcaattatttggatgtttttcaagtatatttctgttatcgatttctagtttaattccaattatgttcttagggcatattttatatgttcactagttttattttgttttagtttttaatttttgtgggtacatactaggtgtatatatttat

SEQ ID NO: 5539 - DNA, 1035 bp, Homo sapiens
gccaagccacaatttatagccagcattcaagtgggagagaagcccacactttcagaacattgagagggagcatgactgcaactgtcagaaaatataggggagccacatgaccaagcaagagcctaccaactaaccagtatgcctaagcaccacctactggatcacatcccgaagttccaacaccaaaaacaccttgctagcattcccctctgtgagaccaaagacaagtcagctacaaatgaagaccctgcacaaagccttggctctgcgaagacatccagaaaaaaaagtgtactgactgtactcaatctacactgcagttacaggaacacccacctgcagacatgagaaagaaccaatgaaagaactccagtaactcaaatggccagagtgttgtatgtcctccagatgaccacaccagtttttcaacaagggttcttactcaggctgagctggctggaatgacaaatggaatttagaatatggataggaattaagatcatcaagattcaggaaaatgcaaaacccaatccaaaaaaactaagaatcactggagctgaaagacaagataactgatataaaaaagagcctgatggttctgacagagcagaaaaacacactacaagaatttcataatgcagtcacaagtattaacagcagaatagaccaagtggaggaaagactctcagaacatgaagactggctctctgaaataagacagtcagaaaaattaaaaagaataaaaaataacaaaacttctgagcaatatggtattttgtaaagtggccaaatctatgaattattggcatccctgaaagggatgggaagaaagcaaacaagttggaaaacattctaggatatcatccacgaaaacttccccaaccttggtagagaggccagcagtcacattcagggaaaccagagaacccctgcaagattctacacaataaaatcatccccaagacacacaataatcagattttccatggtcaaaataaaagaaagactgttaaaggcagctatacagggcaggtc

SEQ ID NO: 5540 - DNA, 1034 bp, Homo sapiens
tcttctaaaaatacaaaaattagccaagcatggtggtaggcgcctgtaatcccagctactcgggaggctgaagcaggagaatcgcttgaacccaggagacagaggttgcactgtgccgagaatgcaccactgcactccagcttgggcgacaggagtgaaactccgtcaaaaaaaaaaaaaacagaagtttttaataagagcctgttctctgaagagactgactataaccaggctgtggattgaatctgaatccatgtctaatgctgagggcagcactgcagccagacttgtggttcttggtgaaaggtgatctttttgtctcacagtgtgggaggcccccgaccgttctcaatagaatgacttcaccgaccttttgactcactttggaaggtattgttaataccttgtcactgctcacaccatcaacataaaaactgactccagacacaccatgtgtcccttgaaactaatctctgtcaccttttcaaatttcagaaccatttgcactctgacaacgttgtgtcttttatcatcaaatctactaaaaattggctgattttaccatcttttccttctcctgatccatatgttacaatttgttgactgaatgtaattctttctaaaaaggaataatctctttttgactgcctccaggataagaatgaaatggttgagagctgtagagatctgtttcccaaatttgagattccacactgactacctgaaaagatgcatctcactggccaggcgcagtggcccacgcctgtaatcccagcactttgggaggccgaggcgggtggatcacaaggtcaggagttcgagaccggcctggccaatatggtgaaaccccggttctactaaaaatacaaaaattagccaggcatggtggcgaacgcctgtagtcccagctactcaggaggctgaggcaggagaattgcttgaacctgggaggcggaggttgcattgagctgagatcgggccactgcactccagcctgggagacagagcgagactctgtctcaaaaaaaaaaaaa

SEQ ID NO: 5541 - DNA, 1027 bp, Homo sapiens
tggcacaatctcagttcactgtaagctctgcctcccaggttcacgccattctcctgcctcagcctcctgagtagctgggactacaggtgcctgccaccatgcccagctaattttttgtatttttagtagagatggggtttcaccgtgttagccaggatggtctcaatctcctgacctcgtgatccgcccgcttcagcctcccaaagtgctgggattacaggcgtgagccaccacgcccagctgaggcaagacttctgtaagtattcttcaagcagtagtacaagagttaaatatgtattcttcttttttaagctggtaaataaatttcctttttctacccattttaaagtgtgttggttatatgggtaaattgaaatgtatttcttttccttttttcttgcatagccattttaaaaaatattttttaaatatttaaagtataaaatatttttaaaattttttaaaaattttgtgggttacacagtagatgtgtgaaatgtatttgtaggtttaacttctgtgtagtttaattattttgttattaattggccattgataaatgagtctattttctttgctaatagagttgctgtcaatttgtaagtatgtaaagtttattatagagtatattctcacgtgaattattattttcatctgttgttctttacattgtcattatttttggctatttgcataggtaacattggtttaaggagagagacctgtgatcgaacagtgtcttgtgtctaatctgagaaagaaagcatccagtcttatcatcatgtatgatgttagctgagggtttttaaaataaattccttaaagcaggttgagaaagtttcctgctgttcattattattgaatatttcattgtcaagtgttgttgaagtttttctcatggtttttgtgcatctattggaatgatcttgtggtttttcaaatttattctgttaacatggtatatcacattaattgactttctaaaataagaaattgggtctaactttgtcacccaggctggtctcaa

SEQ ID NO: 5542 - DNA, 1042 bp, Homo sapiens
gtcgttagctagttattatgcagacttgtttgtatgcttgctttatagtgtcactggtctatgtacttacgtgtgtttttgtggtggctgttaatgatctttccatatttagcactacctttaggaactcttataaggcagatctagtgggaacaaattctcttagtagttgcttgtctgaaaatgattatgaagcttcttttggctggatgggaaattcatggttggaatttcttttccttaagaatgctgaatataaactctgataatgcacaataaattttctggacattagagaaaaattactggactgtagattgtggtaaagttcaaattactggaaatagcaatggagtatatccactgccttggccttcatttctgcgtatttatttggtgtggtaatcaccacttgagattctctaatttttgttcttctaaagaatgtggactattatttactattattattatagtaatatgccatattatttggctgttttattaccaagaaaatggatctctttccataaatggtcttttttcttgttatgtatcttttgcttttttttcccattttttaatcatgttttcattcatttttactgtgcacactaatttcttttatattgcatgtattgcagatttttattttactgttttttgtcttttaattctcctaattttaatatatttgaatttgtcagtctctattgtttgctccttttctcctattcatatgtcaaaaaaaaccttgtctgtgacttctgcaagtggtctatttatactttttacttttgaatatatgacaaattgattattgtccaactaatagaggtcaatgcaattcatttttttcccaattaaataccggttagctttgttccatgtttaaagtgcttgatacttccttcactatcctacaatgcctcctctgttattagtcagctttccatatcaattccagctaattaaagactatatgcctttctcttggcctagttctttatctctctgcttatactacactgccctgaatatt

SEQ ID NO: 5543 - DNA, 2176 bp, Homo sapiens
ttaatgaaattttaatttaattcttattttgtttattcctataatataaaagtactatctaaccttgtatgttgatcttgtggcattgatgaacttctatattagctcaagtaggtttttatttatttattactttattttattttattttattattatttttttttgagacagagtctcactctgtcacccaggctggagtgcagtggccggatctcggctcactacaagctctgcctcctgggttcacgccattctcctgcctcaacctcccgagtagctgggactacaggcgcctgccactgtgcccggctaattttttgtatttttagtagagacagggtttcaccatattagccaggatggtctcgatctcctgaccttgttatctgcccgcctcgacctcccaaagtgctgggattacaggcgtgagtcaccatgcccagcctcaagtaggtttttaatgaatttcttatacttttaaaatacaacattatggcaataaaagactattccacttcttttctaatctggagattgtattgatttttctagtgtaattttctggctcatacctccagtacaatggtgaatagtggtataagtagaaattctcgtcctgttttcaaacttgcagataaagcccctagtcattcaccattaagtatattagcttttggtgtggagtttttcatcttggctcactgcagcctcaacctcttaagctcaagtgatcctcccaccttaactgcctgagtagttgggacaataggcatgcaccaccatgcccagataattttttttttaatattttgtaaagatggggattccctatattgtccagaatggtcttgaactcctggctttatgcagtctttccacctcagcctcccaaagttctgggttacaggtgtgagccactgcgccgggccaattttggtttttcatggaggacttttagcaggtctcaaaagttttcttctaatagttttcttggtgttctatcattcataggtgttgaatttaccaaactttttctatttcaagtattacatttttactttgttcaagtaatattgtatcatattaaatgaacattgcattgtgaaaataccctgcttagtcatggtatgtaatcatccttatacctttttgtattctttttttaaatatttctgagaatttctgtgtctaaatttaaataggatgttgtttcgtaatcatcttgtgattcttttgtctcctttgggtattattggctaatagatgaattaagaaatgttacctcttctactgcttgaagtttttgtgagaaattgatgtttttcattaagtgttgatgaaatgtacaacttaagcagtttataacagctattctatctaaaaagatataatttttttgttctatggatataagtatattctattatatatataatgaaacaattcataggatgttttttcagtttacttttgtaatccatctctatcggtattttttatttcatagtatgtcatgaacaattattctaggcacttgacatggaataatttgaaaaaatagagaatgagtcccgtactacaatcaataaataactcaaaattttttccatttttaggatgaagaatatgaatatagttctgttacgtaatatttgtgtttactgtgtgagacaaatgagttactgaatgtaaaaataattagtaaaactgccctttgattttggaatgtatgaagcaggcaaatgcccctaccttctatttttatcaatatttagataaggcagacaaataaattttaataagatatacagaataatcttgtatttgaagaatgctatgaaaaaagatagtttggaggagtagttagtatttggctcatataatgtgttaggtaactattctaagccattaaacatttgtatgcttaatacctaagagtttaaagtgaagaaatcaaagattcattgaaaaagaaaaattaaattttaaaaaaattctatttttaattgaaaaataatagttgtatatatctgtctacagtgtaatattttgatatatgtttatgttgtaaaatgattaaatcaagttaatgtttataacctcatataatttttgtggtgaaaacatggaaaatagtctttatagcagttttgaaatacacattgtagtcacc

SEQ ID NO: 5544 - DNA, 1022 bp, Homo sapiens
ctgtttgtgtttatcctatttgaaatgtgttgagcttcttaattttttttttttacatttgagaatttgtcagggtttctcattttcttaatttcatgtctgttttcctgttttactcattgggcattattcaaatggttatctcagatttttcaggtaacttatacatctccatttctttagggttgatttctggatatttatttatttatttatttatttatttatttatttatttattttttttttgattgagccatgttaccctaatgtatatgttgcaatctttggttgagatttgggcactaaaagccatctgtcaaaatctttataaaatggctttgtcctggataatctgataccaagtgacttgggctagggtttccatgagcctctcaaacctattctcaggatgtatgttctctggaattttgtgtttaatttccagttaaagaggtttacccttgtttcttctttctttcttcttctctaatcaattatttgctaaatctgttgtctgtctgtagtactgcagcctctctgctgctataacaattatttacctttggtctcagcagaaccaacctttgaattaaaggttggttctattctaccactattcctttcagcactttgtgtcatgggagacagaaactagtctttggaaattccatcaaaagtatgggcatatgtgccactactgtctctattgaaggagaagctaggagttgggagtttattcctgaagtcattatgctgtgtttaggagaagaaagagttgtggtgggtaaatgtaacaagctttccttccccttgtctatggcttttaatatggtttctagagttctcacaaaggcattttgttcagtatatttttgttatattatgttcatcaaaaaatcagggcctgtagtattttattatgctatctcgctaatgtgtttggtataatttcatatattagctttttaaattatattcatctaagtccagtaagttggataatatgttattttaatttt

SEQ ID NO: 5545 - DNA, 1069 bp, Homo sapiens
tttaagtaagtgccccccagcgattctaaggtgagatcagagtcaaccttgagggctcccagatacagtcacgagacttgggttccaaaaggaggtcagagggcctgctcttcggtttgataagggtaggtcaccaagatccatatttcctttgctgtaccagaaattgctggagttcatggcaggggagatcacctgaaggcaggaaatttttggtctttatgtggtagctcatttttcctctcctgtgataaagaataggggagtattcccttttctgcactgcagggccttctgcctctaggtgtgctggttgcaggtgaaagggttgtgttgacacctttaaagacatattctcaaatgcaggtgtgatttgtccagataatctcacctgagaaggaatcccagagaagaaggaagaagaggaagaaatggctggttctcaggtgaatgtgtctgggttcaggggatgtgtctcctcttttcttctgggatgttatgtgtttagaacttgcaaacctttatttctgtacttctgatgtacctgcctaatgtgtttcttcccaactaccttccccccttcccccctcctttcttatgattgataaggaactctgtaaaatccttcctcctgtgtaccagaaccttctctccattccctccttccaggcttcttatatgtcatgaccaaatcttaccattaatgtatgatgggcagtattcagatgttctgtgacatatcaacatgggaaagtgtggatccccaggattatccgtggggatggggctgggtcttgggatgtcagtgaagaaggggatcatgtaccgtttagatttcatccacatgctccatcatctctatgcagaacagaattaagaaaagagacatttaaagaggatggcattcattgcctggaataacttaaagttctgaaaagagaataattagaagacatttgctgtctaggatgctaaagaaacactattgaaataccctattgcagattaaagaaccagggaaacagctatagcttgaactttgcataaaactgatgtttctggccaggca

SEQ ID NO: 5546 - DNA, 1021 bp, Homo sapiens
ctgtgagggagaagcggcttcatgcctttgctggcagttgccattccttggtgtgtggaagcgtcacccagtctctgccttcatctccacatggcactcttgctgtgtgcgtgtctgtctccaaacctccctttgtttaaggacaccagtcatatcggattagagcccatcccaccgactccagtataacctcatctgtatccgcagcaaccgtttaccaataaggtcacattctgaggtactagaggttgggacttcaacatcggaatttgaaagggacagcattcagcccatgactccagataaacgtgaggtatgctatatcattcctaatttacagatgagtcaatacaaacttgagtgagcttgctcacaattccatcaaaggcagggttcagacccaagtttcagcatttagggcaggtgtcctctgcatggaagaatcatactcaatagccgtaaacgctgacaaattccccttcctccctgccttctgatgggggctgggcaggccagctggagctgtgtctcctgctgggattccggactgagagtgacagcaggtagtgaaacctcaagcaatttaaaacatggtattgttcctggaagactggttatgttggctagggtcagcaagagagggcatcaaggctgtagtctagcagtgatttaatctgcaagtcaaaccagacgggtattttgtattattcatatgtcacatcctaccaacagacagtaagtcaggcaaggctcctggtgctccttgtcactcacgtaattttcacatcaggaaaactctgggctgggtgcagtggctcacacctgtaatcctagcactttgggaaaccaaggtgggtggattgcctagctcagtgacaccagcctgggccacatggcaaaaccccgtctgtaccaaaaatgcaaaaaattagctgggtgtggtgttgacgtttgcggtcccagctactctggaggctgaggtgggaggattgcttgagtctgggaggcagaagttgcagta

SEQ ID NO: 5547 - DNA, 1067 bp, Homo sapiens
gggcaccgagcgcagccctttgaggtgcctcacctgtctagtcttcccatctgcctggtacaggggtgctgtgaggacactggggtgtggggaggtgctggggctcagcagcagcagtttccagccctccttcaggctgtgtcgccagcacttgcacccatgatctccatgccatggtgcttcgaagcatctgctccttcaggaggaaatagctttgtacagaatcatcagcagctccacaccttcttcccctttgggacctagagctggcatgaagcagacaaggttttgacacaccatccccacctggaacaagcgttcagagacttggtgtggtgcagtagctcctgtaccatctctaccctgtaggctctgcacaagctgtttgtgcaggatgtgcggagtgtgcaggagcctgtggtgatgactatagaaaacccaccacagaaagtgggaataaatatggggctgggggaagtgcttgtctctggccatagagtgggtggagtagaacccggatctacgtcgattctgtctagcgtcagagctcatgtttgtggagttggcccattttgccttcaggttcattcactcagcagacacttattgagtggccaccccctgccagtccccaggacggagcccagggccgcccccagatcgtagcctggcatctattcggatagcaccctcccaggtagtgctgtaggtgcaaaacaaatcaatttttccatttcctcctctggaaagactctccaagtctccagccattccaggtagaagaaagaaggaaacgtgaggagctgcaggtgccagagttccaggcctgcccacagacggtggtgcctcaaaacacctacccaggtaaagaagggtcagggaggtatgggtttgtccctgtgtgtctgtggtgtgtcgcatgaatgtatgtatgcatgtgtggcataggggatggttgtgttgaatgcatgtgtgcgtgcatacacatgtggtatatgtggtgtgctgcatgtgtgagtgtgtgcattcatgggtgcacctgtgtgttgggggcatgtgggtgtgtg

SEQ ID NO: 5548 - DNA, 1161 bp, Homo sapiens
aggctgaggtgggagaactgcttgagcccaagcatttgagaccagcttgagtaacatagcaagacctcatctttacaaaaataaaaaattagccaggcgtggtggctcactcctgtagtcccagctacttgggaggctgagcaggaggattgcttgagccccaaaggttgaggctgcagtgagctgtggttgtgccactgcactccagccggggtgacagagtgagaccctgtctaaaacaatataaagataaaaatagaaattaaaatcaggtttttgacacattcccatggtccatgattcaaagtttatgaaaaaaatctccctgttacacctaaccccagagtcccaggaacctcttgagaagcagctaaccttcggaactcctagacgccctgcacttggtggccatccggattccatcatgcacaggtgttttcctgcaacaacacactttgaagagaattccttctcagtacagagaggccgtcattctttctgtgcgtgtaggatcatcccttgtgaggtttctgtagcttacttaatccgctgtcttcttgatgtgtgtcaaggttttcagtatttattagatcaatgcttcagtgaagcagcttttgtagactacgttgcacatgtgcaacataaacttgagaaatccctgcacggaagggtgggcatgttggtaacgtgcaacaacataaactttaggaatctctgcattgaggggcgagcacgctggtgacctctggacattgcccagcagcgcaccataggagtggtggatgtgcagcctccccagcactgaggaggaagacctgtttctccacatccttggccacccagccaggtagctgccatgtggattttgccaaacaagatagggatgaggtggatccaagagcagaaataacaaagcagtgtgtccactggcgcctggacctggggtagtcggtctcctttctgtctcttctatctgcatgtgttgctttgggctcttccctcagccccagcttccacaccacccccctcccctagtgctatggtctgaatgtttttgtgttcccctccccacagctttgacatgttgaaatgctagcccccaagctgctggcattaagaggtggggcactggggagatgatcaggttataagggcaaatcc

SEQ ID NO: 5549 - DNA, 1090 bp, Homo sapiens
agggcgcaggcctttgttctgactgcttctgtctgcctgcctcccacccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggttaggggccgggagaagggcttgggggagggtacccaggcagcagcccctagcctcctctccagggcctgtcctgctgctcttttccaccctcaggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtaggtaggggatggcagggggtgagagccagagggaagagggaccacagggtgacccagaaacaccctcctttcaaagggagccctgagtaagtttgggaagggtggggtgagttggggagcacagggtagtttgatggaggcaacctctgggtggggaagggagcaatgtctcaggatctagtgtgtctaggttctgaagaatgataaattggactggggctgaggttgccctggggtttgagggaacagggctccctgggtatggctctccagggtaagaggaggagacttcccagttcagcctgactgcttcccccacccctccaggtcctgagcctt

SEQ ID NO: 5550 - DNA, 1062 bp, Homo sapiens
attggcatacattctatttatatcagtaacatctacagaatgtttattgtatgttatagaaatggcaattcaaagcatttaaaaagcaaagattacatactttattatatttgagtctcattattcatcatagttatgcagtgaattgatgaatgctgacctgttgtcctaggggaaatagagtttggtccctgtgagcctctggtcacaacacttttataaaccaaagtgccatttgcattagatgggtttatttgccagtgtcgttgtaaaacaagccagtttcttccacataacccattccctgtgtaacctttagcaaatattaaaaaatttcttttgcagcctcctgatctgcagaagctgccttgccttcaaatttaacggtttcatgccatatcaccttttgaacatgagacagccagcactagccaagaagggtttaacgttttcctgaccctgtgtaaagagaccatgaatttctttggctttcagcttcacaacattgctgttcaccacacttactgtttaattgatcgtcatcccatgaatccacaaagttagccacttttctataacttcatcacatgctatagatgttactgtagcacttttgggaatggcctcatacacagattagcacattttctcttcatttttctggatatatcatattgttgaatcattgacattgaactcaaggccagtagcactataattcatacctgaacaaaagctcgtctaatacatacacatgtatggtgttatagtgtctctgtaaggcacatcacagccttcttgcacttaggaacactagcacttcagcattacacttgggggccaccataaacggcaaaatcacaacaaaaagcagaaaaaagcaaaaaacctggtgtcatagatgtcgagacggatgcctgttattacagtatgagaattgaaacaagaaggcagagcatggtcacggaggccccagctgggagtgtgcatgctgaatgactcagttttcagctgctccatgcatgtctgaggtcatatgatgtcagaacaccatgagggttg

SEQ ID NO: 5551 - DNA, 1088 bp, Homo sapiens
tagctgactgtactccactgtatggatgccccataccgtattcagccagttccttattgatttactattacagatagggctatgataaatgattttatgtatacatcattttgtgatttttgccagtgagattggtgggtcaaagagtaaatgtatatgtaattttggtgattattgccatgttcccctctctagagatggtgacattttgtgttcccaccagtagcgtatgagaatccctatttccctgcagcctgtagagcagagtacattgccaggcttttagagttttgctagtctaataagtagaaatgatatattacatgtaatctaaaaattgctctgctctaatgatgagataaattaagcatcttttaataaatttataggccttttgcattactttttgtgttttctgcttgtccatatcgtttgctcatttttttaaattggattttggggcgtattctgaaatttcagaggttctttacatattagggatattagctctgaatttataagttgcaaatatttcttacacttttgcctattcaatttgtcacttatatttttactttgtttaccgtgtatttgggatgtgcaaagagtttacttttgcttattttggggttttgtgtttgtttgcttgtttgtttctactctttggttttaaaggaatctactcatattttcatctaatacttgattttgattttctgatttttgattgtatttttcattcattcttttgagttttctggatatataatcatatcataggtgccatctgcaaatagaagatgttttacctcttttttccagttctgattcctctgattgccttctcttatgtaattgcattggtaaatacccccaaagcagtattgagtaagaagggatatagtgaggatccttaactgtttccttattttagcacaaaatcttctaatatttctccattaagtaaaatgatggctttgaagctgatatgtatacaggcgtaccctggatatattgtgggtttggttccagaccaccacaacaaagtgaatatcacagcaaagtgagttacacaaatttttttggct

SEQ ID NO: 5552 - DNA, 1034 bp, Homo sapiens
gtaggtttgttgatttttaacaaatgtattgctctggtgtgggatgttgataataggggaggctgtgcatgtgcatttgtggggccagggagtatgtgggagctctgtattttccactcaattttgctgtgaacttaaaattgctctaaaaaataaagtttactaatcataattttaaaaaagtaattctccccagcactttgcgaggcctaggtgggcggatcacctgaggtcaggagttcaagaccagcctggccaacatggcgaaaccccatctctactaaaaatacaaaaattacccagctgtggtggcgcacgcctgtaatcctagctacaacgggaggctgatgcaggagaatcacttgaacctgggaggtggaggttgcagtgagccgaaatcacaccattgcactccagcctgggtgacaagagcgaaactccgcctcaaaaaataaaaaacaaaaataaaaaactacaaaatataattgcgtatttttctgatttgagtgtagaaggacttctgatcacaaaagcaatgataaaggaatacatagctagatttcagtaaaattgtatttagtgtttattaagaggcaaagagaaaagcattgtatggataaacctaatataaaaattaatatataaatgggaaaatggtatgaatagacaatgaaaaataatttaaaagtgctaatacactttggggaaaagtaataatatttgatgcaaatatttgaaaacattttatgcagtatactgataaaaaacctgaacctaccaccagaagtaaaaatcgaacctatttggtgttttgaattttcacactgtgctcctccatctctcttccctgcaccctcaactgttcttgttaactattgtgtttatcgtttccttaaagcagttttcacaaatatgtatatatcaccaagcaacttcttgtttaattttgcttattcttaagtttttttctgacgtgttttctcctttattctcccttttgccctcaccccagtttgtgtagaagtagtgtggat

SEQ ID NO: 5553 - DNA, 1034 bp, Homo sapiens
atttttatctttgctttaaactgccaattatcttttaaagaaattaagaaagggaaaaattggcttttacattttcctacatatttaccattttgcagagttcctcatctctttctgctgaaattttacctcagcgagaagtagtgtctcccttgtctgaatttttatagcacatattgtggaccatttatatgtcatatatgaccttacagttagttccatgtatatgtcaaatttcctctgccagttttagattattttcttggcaagggtcgccgtttatacagttttaactacttcattgtgtctagcacagtgccttagataaagtggacacctgtatatatttttaactatgtaagaatgagtgaaactttgttcatttatctgagtatttatataatctcacaggattgagttgtattattacagttcaccattagatgtcactttctgacatatgttaaatccttaccaatgaattccttccattaaggcatattggattctgaaagttggtgctccaacacaagtgcacttaaacagataaatttttgtacatttaaaagtgattactgtctaaaatggaagtgttcctaagttataatttttatattttcattatgtataaatttatacagaactaactgattttcctaaagttttctttagaacttgaatactggtattgtttttgaattatttgctctgtggagcagcttggaactattagaagtaatagtgtgagaatattcaggaatacctttaaacatgttcaaaatgtattctgatggtggtgtaattctgaaagacatcttattttaggagcctgactgacccagttttctcaggttttgatagcaactatatagtttatttgtgtttgcctgagaaaggaggggaactgagtaggctgtgaagaaacacagaggtagagaaaaaggagattcctgtggctgtcttggccagtcatggaacacagcaaagtgcttccctccctcattctctaaacttaaaagataggaaagggcagg

SEQ ID NO: 5554 - DNA, 1029 bp, Homo sapiens
cacttgggaaggccgaggtgggcagatcacttgagaccagcctgggcaacatggtgaaaccccatctctacaaaaaatacaaaaattagccgggcgtggtggtgtgtgcctgaaaccccagctacttgagaggctcaggcagaagaatctcttgaacccaggaggcagagatcaaaatgagctgagattgtgccactgcactccagcctgggcgacagagcgagactcactctcaaagaatcaagaattctttcttcccaattacatcttacattgttgtaagaaatagagtagtattataggacagaaagcatgtaggtatgccagatgccgaataatggatgtcacgagaaacacagatagatgtatccattaaatatatccccagaaagggagaaattgaaaacgaaataatagggtatttgggagaagggatggtggtgctgtgtaaagtctgaaagatgaggaaactaagaagttaaataacttgaagccacatgaccagtgggtggcacagaccccagatgtgaatcccgacacgcctcatccaagccgtttccaaaactgactctgcacctaatggggatttttctgaaggtgcacttgctgacataatggataataatgcacacaatacacaggaaggaaattagaatgtttaggtatcaaatgtaggctagtctccctgggttcttcctccagggctctcaacagccgtcagatctgcatgtgtctatctacagaactttcatatttatactgacctgttgtcaagtgtttgtttacatccagaaggtctctcatcttccttgcctcactgtgggtgtctgttcatggtactactgttagttcaccaacccagcttggaactttagctttacttttttcactcttctcttctcccatgaccaaagagttcaaccatggtatatggacccttgcactagaacattctttgggggaggtgtacatggtgggatgtttaacagcatcccaggcctctgtctgccagtagtaccttctgccctt

SEQ ID NO: 5555 - DNA, 1149 bp, Homo sapiens
atttttgattttttttcctaaagattgagaaataacagcaaatttttaggctgatgggaatagtcaggtggagggaagaatttctagtgctgagttcctgagcaacaggaagggtacatgcagggtcgggggctggtcattgctgggtcccacagctctaccactgcactgagagcgaggtgggtgggagccgtgactgtcggcacccgcatcccttctgatgcctgttttctcagaggactaaatagacagggcccctggccaggagagggaactggggaggagacactgcaggcgtggagggagagggaaagaaattgttcttcaagtggtagggatgaaaaactgctggccccaagtgaccgtggtgtgcttttgtttgttacaggatattcatccgttctatgctgatttgatgaatattctctacgacaaggatcattacaagttggctctggggcaaataaatattgccaaaaatttagtggacaagtaaggtacttttttctgtagtgtcttttaagttatcgaaagtggaaaaaataatattttttattttttacagtgttgctaaagattatgtgcgactgatgaagtatggcgactctctctaccgctgcaaacagctgaagcgtgcggccctgggacggatgtgcacagtgatcaagaggcagaagcagagtttggagtatttggagcaaggtgcttgtcacgcatccgcgggaaccgtgctagcatcctgctgagaggatgcgtccttgttgaggacttgagatgtctgtttttcttgtattttggagatgacagggtcagttattcttcctagctttacctatgagaaacagtaataggctggtttttattgaaaataaatacttacaaatcaatagcactgataagaaaatttatatatttcatatttaataggtaaggcatacacaaaaaagtcacgagaaaatactgaaaagtataaaaactaaggtggctcatagtttattattgacttttttatttttaaaaacacttgtatttaataggactttctgaattaatgtactaggattctgttgaaacaattacttgcttattgtgtgtattcttacatgacaaattattttgactcattcggttttgttttctctcctgcat

SEQ ID NO: 5556 - DNA, 1067 bp, Homo sapiens
tgtctggacactgccagacatgctgttggccccacctgtcacctaatgaattaaaacgtgggcttagaagggctgaggaatatgattcttaccagagccaaacttgggagatagcaattgaatatactatgtgtatactattactttctgcaactattttctccatcacttttgcattacaaaagttggagtaagatgaatatcaccataggcctggactgtaactaagttgaaaagaaaatttaaagcaaatcttaaactttgaatttcttaatttttcaatttgaacttttcctagtgcgtcagcatttatcccgtttgccaaccattgatccgaataccaggaccctgcttttgtgtgggtacccaaatgttgggaagtccagcttcatcaacaaggttggtctggtttttatcgtaaagcaaatcatctgactattttacgtcagtgttactgtattctggcggcgtgggattcaggatggccttgtaggtcagtgttaactgtattctgactgcgtgggattcaggacggccttggtaataatttcggcctccgagttggtccttgagtaaaacactgccctggtctgcaggagttcccggtgcctgagcacgccgagctcctcttggtgaggatttactttgtctgtatctacatttatattactattacagaagccattactttttgttcttgtgtgtgtcctataatttctaaggaatttgagacatgtaagtgcatttttgttgacaactggggaggttttcttgggtgttgttggcctgtcctggagtggctatgccagcggggctccggtggcaggtgacactcacccagctggggtcttcccgtctgcagctgcatctgagtgatctgttaccttggttgctgtgtcagctttcacatgaaatcgtatgtggtctagtagagggacggtgccgagtcgctctttccctgggtgagctcactgactaggataagtgtaacatttaagggactcggtcatttgttgcttcaggaaagtttggctgagtttcagggactcaggaagaggcaaagcaac

SEQ ID NO: 5557 - DNA, 1080 bp, Homo sapiens
ggtcccgttgcatcccagctgtagggtgggttgctggcggcccagtgtgttttttttggtttgtttgtttgtttgtttgttttaagacggagtctcgctctgtcccccaggctggagtgcagtggcgtgatctctgctcaatgcaagctccacctcccaggttcacaccattctcctgcctcagcctcccgagtagctgggactacaggcggccgccaccacgcctggctaattttttatatttttagcagagacagggtttcaccatgttagccagggtgaccttgacctcctgacctcatgatccacccgcctcggcctcccaaaggctgggattacaggcatgagccaccgcgcctggcccctggtgttttctttgggctgtatttcatcgtcttgcgtttttctgctccccagggtgcctgttactcctgtgatgccctctggagctccccctcagttattaacatgtagttgttcgttattctgattgcctttgttgtgggggacagatgtgaggggctactagtcggccatctttttgatgtcatttgtgttttcttgatcatagaagaatatgaagaaaataactgtttttaggatatgtctgttttttaagactttgaaacaaccacagatgttcacatttgcagcctccatttgcagaactgtacagtttgttccatagggaactggaaatgaataatacatctctcgttttttctttgcattcccagaaaatatttacagatttgcagtctgaaggattccctgtaatagagaccagcaccctgactgaggaaggtgttattaaagttaaaacagaggtcagtgctgccttaagtcaggtattagtctttttactgtctcttgtttgattcaagtcagttgtggggagaaaatagttttctttctagacattgttaacacttggagccctcgcagtagcgaggcgggtggcgtgcgagagtggggcgtgaagacagacccttctaagacccactttgccccccgtggacagtgggttgtgaggggatgctttgctcttctcaccccaaacaactttaccctaaagcagct

SEQ ID NO: 5558 - DNA, 1140 bp, Homo sapiens
tggatcttcagagtaagggccagagtgtgatcattattataaaatgccaattggacgtgaagtatttcagaaaatgggggaaagactttaataagtaataaaagtgtttcagcctatttgtcaacttttaatttcttgaagattaaaagttgcatcctgagggccaggtgcagtggctcacgcctgtaatcacagcactttggatcccttatgcccaggagtttgagaccaacctgggcaacatggcagaaccccgtctctacaaaaaatacaaagattagccgggtgtggtggcatgtgcctgtagttccagtgacacgggaggctgaggtgggaggatcacttgaccctaggaggacaaggctgcagtgggcagaaattgtacctctgccctccagcctggacgacagagtgagactctgtctcaaagaaaggtgcatgctgatagcactcagtgggggttcttccattgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgtttcctgttgttttgggatggtggggtgatttctgtagctttctccacgtgtgggtgttgaatgaggctgatgtgttgatgctgctgcatgtggaattgcacgtcgtgctctcttctgcagtggagtcgttgatttgccgtcagtcacaactcattttgcgcacgtagtacttgaagatattaaaaactgctgtaaacgtaaccaccttttttttaactttagagtactgggatttaatgaatttgtctgaaaaacatgataagataccagaaatctgggaaggccataatatagctgattatattgatccagccatcatgaaggtttgtgtcactttttaaattgcggattgttttcctttttattatagtagtattgctggaagatagcagcatggcttcggctcagctgggcctgtccgcttcattctgcacccctccatcctgactctgccccctgtaccacttccccaccctgagactctggtggagatactggccctggctgggct

SEQ ID NO: 5559 - DNA, 1021 bp, Homo sapiens
gtgtgtctgccgggagcattggaagtgaaggaggcggtctctgcacatttttagccttggaatttaattgttttaaaaaaaggaaatggtgcacaggggttactgacttgctggcggctggcgttcacgtggtctccattttcttcacagaaccctccctgtgaggtaaatggcacataggcagggcccaggtgggtctggaccagggcaatcgctctcctctgagtcagggaaacaaagctcccatacacactctgccacactcactgactcaggggttttctcattgttaattttgcttcattacaactccatttttaaagaaattggaagaattagaaaaagaagaagagctgagaacagctgctggagagtatgacagtgtatctgagagtgaagacgaagagatgctggaaatccgacagctggcaaagcaaattcgagagaaaaagaagttgaaaattctggagtccaaagaaaagaatacacagggacccaggatgccgcgaactgctaagaaggcaagtttgtgtctttccaaagcagtgtgatctagtttttgaaaattggattcctgtgtgatcattgctaaataacaacttttcaacccatttatggccataagattgcacattcttgttttattggtgtatggatttgcaagatcgctcacgtattgatcttttatattctttactgcgtcctttcttggtgactttcagcttcgagtttggcactactctagatccagtcattttgcagttgtacagattaaaactgtaacttatggttcacagacgttcaaggctatcagtgaacattttcctcttcttttttctctctctcttttttttaggggggagatggagtcttgctgtgtctcccaggctggagtgcaatggcgccatcttggctcactgcagcctccacctcgcgggttcaagcaattctcctgcctcagcctcccgagtagctgggattacaggcacctgccactacgcctggctaacttttgtatttt

SEQ ID NO: 5560 - DNA, 1028 bp, Homo sapiens
atgtaaccagagaagtcacttgacattcaggatgcctctcagtgggtcttcctgtttgaatacactgttttcacatggtggcaagtgactggttatggcggacttggacatttttgtacttctccaggtggggctcagccatctctgggaggagagaggttggcgcactgcctttgtctgaggccacctcactaacctcagctttagtgtctcacctctgatggagacggtcactctctcccccgtgttgcggtgaagaatggacagacgtggaggatacgctgattcttcccacagcaactgctctgttaatgttagttttcgtgggatttaattgagctatccaaaaacatgaaagcggggcccaataaaaattacaacttctaaaataagtatattataattgttgcaaaatatgtatacatatatattgccttgaagtttttttcaacatttcatcaaactaatttaaagctaatatttctttttatccttctcaggttcagaggacagttttggagaaggagatgcgtagtcttggtgttgacatggacgataaagacgatgtgagtgtgggggcggttcatgtgtttatgtggctggatacacctttttaataaagaaaactggccgggcgtggtggctcatgcctgtaatcccagcactttgggaggccaaggcgggcagatcatgatgtcaggggttcgagaccagcctggccaacatggtgaaacccagtctgtactaaaaaaaatacaaaaaattagccgggcgtggtggcgtgtgcctgtaatcccagttactcaggatgctgaggcaggagaattgcttgaacttgggaggcagagattgcagtgagctgagatcgtgcccctgtactccagcctgggcgacagagtgagactccatctcaaaaaaaagaaagaaagaaaccagggttttggaaagccgtgggaacgtgggaaattacagcaaaaagaaatgagagcttccagtttttctcttttgagattcgctggccctgggac

SEQ ID NO: 5561 - DNA, 1040 bp, Homo sapiens
tttactttgtgttaaacaacaacagtatggccgggcgcggcagctcatgcctgtaatcccagcactttgggaggccgaggcaggcggatcacgaggtcaggagatcgagaccatcctggctaacacggtgaaaccccgtctctactaaaaatacaaaaaattagctgggtgtggtggcgggcgcctgtagtcccaactacttgggaggctgaggcaggagaatggcttgaacccgggaggcggagcttgcagtgagccaagatcgcaccactgcactccagcctggtcgacagcgagactccatctcaaaaaaaaaaaaaaaataccaggtctggtttttgaaattctttctccgtattaaacaccaaaacttaacatatagtttactttgtgttaaacaacaacagtatgttttaaagcaagtatgtctttatttgtaagcatattactgaaacgatcaaatgaacagaagtggataaacgtcgagtcacttggctgagaccatacgcatcttccgtactgcttgtattaggatgcaagattgaatgtgtcttttttttaaaaatgcagccttgtgttgcactctgaaataagtgatttaaaaagaaaaacatgatacagagatcccatcctgaccttggaggcttggataaagctgtggggagacagcctcatggtccagccaggctagtccgcctgcttcaggactctcaagatctccccaagactttcaggatcagctgctgttaatcaaacaagtgcttataaaatggaaattgggacaaaggaaatgttaaatttcctccctgcaaccaggcagatgagaaatatggaaataaggaaaagggaaaatgaagatatgacaaagttgatgaaaaggttgaaatagtgatttatacatgatgggcaatcaagtgccccttttgccctgttttttggagagggtgtatcattgcctcaatggtgcgtctgcctgcactgagggcattacacatggctgactcgacctccctgcctctcacactctgtgtattttgtga

SEQ ID NO: 5562 - DNA, 1048 bp, Homo sapiens
agttggccgtcgagtgaaggaaatggtgatgctggtggcccctttccggcagtcaagttccctatcaaggacattcagttctcggaaagtggtgaaggcacatgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacactatttaacgaactggaaccaacgagaaaatacggtattactgaagactgcacttccttgaacagagtgctcttctcagcaaatcggaaatgcctacacaaatcgctttacaagaaagactgtttcaaagcagcacctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaacactaatattaaaggaaaagagaaagaaaggccatcatatatttttctgaatgtcatataaacacaggttaataatgatgctgcttccccatctgcagttgtaccactctgcatccccacagggaccccaagaacgctgccagccggctgctcagcactatctgggtcatcatttctcctacaggtttcacagctggccttttatcacagtcatgctcctgaaggccaagctcaacgttccgctctaaattcttgacctctgagatcctctgcagcacttgatactcaatcctttttccagtgtacttttcttctctggtttttggccccaacctaacttttcatcctgcttttctacaccagcttctgtaatctctagaatgtgctcccattgccatcctgaattgtttttcccactgcctgtctctgcatagttgctcaagattgccaca

SEQ ID NO: 5563 - DNA, 1033 bp, Homo sapiens
ggcggaggttgcagtgagccgagattgagccactgcactccagcctgggcgacagcgagactctgtctcaaaaaaacaaaaaaacaaacagtgttttactggggtggtggacaccctaaatagcctgtcttgatgactgtgttgtatacctggcacaaaatttctcatgtatgacaaattttcataaaagagtaatgacaataccaaatgctggtgaggatgtggataactgaatctctcatgtgttcctgatgataatgtagaatgaaacagccaccctggaaaatactgatagtttgacactcttagaaaaaaaccacaaaaactaaacatgattaaacataagcaattctgtttccaggtatacccaagagaaataaaagtatacacatacaagaaatttgcactttaaccttcataataacctaaaatatggaaacaaccaaatgtctgtcagttgtatttggcaataaaagggaatacattaccactatgctacaacatagatggactttgaaatcgttgtgctaagtgaaagaagctggttgtcacagaccagagcgtatgttgtatgattccatttttatgaaatggccagaacaggcagattcatatggagagaaagtaaattagtggttgcctagggctagctgggaagtgggtgggagaaatgaggagtgagggcaaataggtgtggggcttcgttttggggtgataaaaatgtacagttgattgtggtaatgatcgcacaacttcctgagtatactgagagccattgaattgtgcactttaaataggtgtcttacatggtgtgtgaatcgtatatcaagattttttttaaagctaaatatacatttaccctgtgactgagcagccttattcttgggctgtttatccaaaagaaatgagaacttaggttcacataaaaccctgtatattattgttcatggcaactttattagtaatagtaaaaaaattggaaagaatatatatatatatatatattttttttttttttttttgcagcaggtga

SEQ ID NO: 5564 - DNA, 1056 bp, Homo sapiens
agatgaacctctgtgatgtgctgtgacttgagctgtcctgggagcactgcacacacagttgtgttgggccctccctaataaggaggaggcagtgcagcctgtggacggccaggtccctgcagaaatggcgtgggaggctccttccagcactactggatgaaatgaggctccttaggtggaaagcagttttgttttctgaagcttttgccggccagtgttgactctgatttgcttagcagttctaattttcaattttaacacaaactctaatctgttaaaatctgtgttcatcttgaatcattatagcttttgggcaaacgtcttgtgttttaaaatttgcatctgtgagttttgcttgacatccacagtgttgataaggaagcgtttgggtggcgtagtggaaacagacttagaccaacagaatgactgtcacatgtgagttaggttacactgagttactcgtttaacttcctcagccttctttttcttctttgaggggttcaccccgtggctgctcctggctctttgctgtgctccctccagagccgttttcccagccacgtgcagtgctgtcacccatcaccccctgccttcaaggtgacgtaccgagtacccccctgctgcagcctgtctgggggcctctgccagccttgtgagcctcgggccccccgtcccgactgagctgcacgtgccaccctgaacttgctgtctctgggtgttcctttccttgtgccacccgtctcaggaaacgtccctgtcacccagtgctttagaccaaacacctttccaccgtctgaacgcctgtattgttctcttactgcctgtggaaatcaccctgtcagccactcctgcagcagagggcgcttcagttctttcttcccaccctgctccaggccgccctccctgcacttctctcatctcctgtccgtctcccccgttgttttctggggctgccataacaaagtgccacaggcagggtgacttctgaacaacagatccgtgttctaaacaacagatccgtgttcccacagtcctggaggctggaagcccgagatg

SEQ ID NO: 5565 - DNA, 1092 bp, Homo sapiens
gatgccgtggtttccagttgggcagtttccccccaggagacagtgtttgttgtcacccctggggaggggtctgctctagtttctaatgtgcctgggcagggcggctgctacatccacaggccaggatgctgcaccacagggaagggccccgaccagacatcaggtcctagcgggggaataagtgtcagcaatccacaccgcagctgtgggcaccacgaccaggcctttgagaatgcagacgtgaaaacggtcgccgccgcatcatcctgactgtgttccggggtctcggtgtcagagcgtgttgccaggtgttgttgacgcaccttgattctcagtagctttgctgtactttgatgttatatttttaaaaaccttgtcttaatgcagtggaacttagacgtaattaggactcagctggtgtccactaaatgaggaggattttcataaatgggctttgtgactgcgtggtgcttctctcatccagggccgcatagagcatgaaatcccatgtcacggtacagcttcagtggctgggacaactggcatttaactggactccagagttccaagcaattttgatggactggacctcgatgagggtagatgtggaaaccaagcttttggtccacattaaattagtgatttgtgacgacaagaggacacttccttcatggataggtggaaattcacatgcttatcatctcgtaggtatctcagctgcttcagtgcggggtgaggcgggttttgagcccctgtacagagtgagtgaccccagtttttgtgccctgggagacagtgtaggggtcaagcctgtgtctctctgagaaggcactgcccctgcgtctcaggatctgcccactctgccctgaagtcagaccatgccttcctgggtgggccactcatgcccagctgcatggcgagcatggggacccaccccagccctgagccaggcaggacgcgcagccccctggccgttgctgaagacagcagtggatcatgcctggattgtgtgcccttagctcacggggaaagtaaggtttttatcacattctttttactgaactttgccagtgagcaaagaggtgattgaat

SEQ ID NO: 5566 - DNA, 1049 bp, Homo sapiens
gaccagggctgtggctgtggtggtggctgaggctgaggctgaggcccaggccgtggctgtggctgaggctgaggctgctgcggtctcagcaggtggagagtctgggagggttcttgcttgagcagatagtggctccttcacgctggcgaggccactgcctaagctgcattggcgctgggagtatcttcacacccagaaaggcagaccatttctccactggttacttaactttctcaccttcctccttaaatagcctgcgattattgtctaaatttcataatgttacatcttcagtgaatttaaaagttcatgctctattagtatcaagaatccagatagaaatgcttacacattgctgtgatttcaccaaaacgccagggcactggtctcccttactatccataggtttactgtttttccctaataacttagaatttaaaaaactatgctaaaatttgggaacacctgaatttattatatgtaacatatacaattcatcttatagtgggaagaagctgaaaatgaaattagccaaaagtcttgtgtgattttttttttttaattaaaaaatttttttttgtgacagggtctcactgtgttgtctaggctggtctcgaacttctaagctaaagcagttgctcacctttgcctcccaaagtgctaggattataggcttgagccaccgcgcctggccaaaagtcttgtgtaatttaaaattaattttagtagaatatcttttattaagcagcttttggtcaaaatgaaaatgaactaagcaggtctttggagatgcaggagctctgtgtggaagtcaagctagagtttcctggggcctgttggtttgtgggctgagtggagaatagtgaggagcttccttgggtatctggtcatggaggcttctctgaggttagtcaaggcaccaggaagtggtggggagagtttccagtgagcagagtgccataagcaaaaacaaggtgagcttggcacacttcaggtgctgagatcagagtgaccagagtgcaggtgaaatgtggtggccccggggggct

SEQ ID NO: 5567 - DNA, 1044 bp, Homo sapiens
cccctcctccggacgctgcccctgccccacctgtggcgctcccgtcatctctagagcccccaaccagagtcctccagcccacccgcgaggctcgcgcacctgcgatgcggccccactagcagggacccgcccacctgtggcgctacccctgcctctgccgcctcccgcaccgctagcgcggcccccacctacgacgacccccgcgtagatgctcctgcccacacccgccccagccccggcccctgcccctagccgcgcccgcgccccctcccccgcagcccctcccatacgctcgggccccgcccgtcaccgcccattggcgctggggccgggcgggggcgcgggcggggcggcggttccgagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtgcgcgcccccctcccggcggcgagggagggacggacggacggagctggggagaaccgggcgaaggcgatggggtgaccggagagaagaggggggaagcgatgggggggacccggggaaaggtggcgaagcgatggggagaaccggggagaagagcggggaagcgatggggagaaccgggaagaagcccgcgcccggaagcggcaggggtacctgcggggcggcatgagccggcgaggcagccccggggtccttgcccggtggggcgggggaggaagggacatggcggtaggaacctccatccggaagatcagtgagttttccaccttcggttttgttttaaatggaacctggcagagggagtcgcctgaagcgccctcgggggtcgttctgcctctgagctgtaggacggggccgggcgtcccctccgaagcgtgggtacagcgcgatcacttcctaagtgcccccccgccccccaactccgccgcacgccacc

SEQ ID NO: 5568 - DNA, 1032 bp, Homo sapiens
atcacagtctttcatagctagttactaactcacaagatgaaaatgagaaaaatgtaaattctagcaccccatgtttatagtcggcctgtgtgtgccatccacctggcgctctctcagactgagaggagataaattagctggtgtctttcccagggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggtgagtggacacctgctcctctgtcctgcgggttttcgccctgtttcagagctttggaaccgacaggtttccctcttcactgtggcagaagtacctcttctcacagatcttacaggtcaccatctcaggactttttaggatctcaaaaaacaacagcaatgatcgtaagaatgctagtaatttaaccttaccatgtgccaggcacccttcgacctttcacacagatagctttatggaatcctcacgacagccatctaagccaggttttagatcatcccatttacagatgaggaatcaaacggccactcagccgtggggcgagccgggtccccagcagcctgggacactagcatccgcctttcagccctcacactgtgtccctccagctcgctggggtcctttaaaactgaagttgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgaggtcccgccactgcactccagcctgggcgacagagcgagact

SEQ ID NO: 5569 - DNA, 1056 bp, Homo sapiens
ccgctgagggtccctctgtggaccctgaagggagagggaccgatatgtgaacatggcagctgttttctccagagccctgtttactgacggccgaacagtgtgaatcctgagaaggtttggatttgggtctgaactgggctcgtctggccatagaagaacatgagctggtggcgtcctcaggaaatcagggtgtgaggcaactggacgtggatggctccgggtccccccggccactgtcctgaagccgccggaggctgaggacgcatgggagtgagcgtctcttccctgtccggccacaccctctgtgactggtgactcatggcatggccctgggcagcatttaggtttgaggtctgtagatggctccagtatactggcttctattgttcagaaaatttggtgattctcatgggggcaggggtggtgattttgccccaggggatgtttgcaacgtccagggaggtttctggttagaagtgggaaaagggatgctcccagcatctggggctggagacaagggacgctgcggaacgtccctcagagcacagggtgggctccataataggagtctggctcaggatgtcgccgtgttgtgcttcggaagccctgggcggggctgatgtggtgaagcctcatcttctctggacacgtgcgtcctcgtcctctctcatgatttccttcttgccagcattgatgcttagcccctcagaatctatgcggtgctggtgagtggtcctccgggcagagcagaaggaatgagatacctcagagccggtgtgacacgttctcaggatacggctgcagggagtttcagtccgaccctttcattccttagcactggcccattactccgtcctgtaagctcgataaggtcacatcagaagcacagtaagctgctgccacgctgccgtcagctgccgcgaaggtggcagtgaccacagcctcgtgactgattcacagcctggctgcgcttggtcttgagaattttatgttttgctgggcagggtctcccccgtattgaagcttcccttcccttttttggagactgaaggaagg

SEQ ID NO: 5570 - DNA, 1050 bp, Homo sapiens
tgcaaaaaaataccatgctctcaaagttacatgaaaatagaactcttccaaattccacagaattgcaaatactactatcatataaaagctacttgaactctacagtatattgacagagtgtatattttttcctttcagctgtaaatcctgaacttattctagttaaagtaacagcaggtaccattatattaatactaactatatcccaggcatgtatgctgccttgcagatattctttcttttattccttacgataaacctgcaaaggaaggttttatggaggaggaagcagaagacgcaagtgggtcagctgcccaggaccgcctgggagcgagtgtgagtgctgacccggcggcaccagaagccaggcctgcctgagcccaatgccaagagaccctgatcgccaggcttcacctctggccacccacagaccgccctgtagaatctgccagggattctcaggacatgactggggaaaggcatcaggactctgtgtgaagaaggacaagtgacttcagcaaacattttcttgttaagtactgatgaatacatcaatgtcactgacaataagatgctgaaaataaacaatcatttttaaactttattcatgctcacacatctgagggcataaggccaactgaaggtataggactgagctgccagatgtttcctcaaagcatcacataattttataagaaactgcacttttactctggtcttcagcaagctcacctttacagatacctcagttacggaccatgtgcttttggaagcaatataactacttgccctcaatctatttgcacttctagcacaaaattagcctgctttcttccccatctcctacaacttttaataggcttaaaatattttcttagtttgttagaacacttgacatttacaataaattctataacctttaccaagcactctatcttgaagtttctacaagtaagaaatacctaaaaactatacttaatagaatgaatcataaaatatttagaaacaaatcacacatgcacctcatattatcaccatttaacaagtgtt

SEQ ID NO: 5571 - DNA, 1033 bp, Homo sapiens
gaggattaagctagatgaggaatgaaaattaaatttggtaatgagaagagagtattgatcttagatggtttccaagaatggttacaatatcgaacttagagtgttttgcaacaggttgagaagagaatgtgcgatttgttcagaaaataatgtgagtgccaacactaggaatatggaaatggaaaaatactcttgttactatttaagatttataatctagtggggaagaaagataagtaggttaataattattataatatgtgataaaagttattatagtgatatacacagaatgccgtagattaaaaggaacacttaatcctgactggagagaataggaaatgatttcctattgtaatccctgagtctttaaggaccagtttagagagcagatgtaaatggatgatttcaggcagagaagcatgtagaaaggccctgaagcaaatgagtctgatgagttctgggtatatattctattttattactatattaacagtgatatttgtatagaggagaggaaaccaatatggggagaaggaggaggtagtcatgagagatgatgctaaagaggtaagcgccacatcatgaagagaccttgtatgccttgacagagtttgggttttatcttcatggtaatggggaaatactgaaagactttaaatgagccaatggcatgacatatttgcattttaaaagatcagtttgccttccatgagaaaaataagcaacattttggagtcatctcactcttcatattttatgaaaactattccccaaaaatgtgcacatatacataaacatttcaggagatttgtggacccagctgtgtataccaaattaaaatttccaagtttagctgatggattggtaggaaatcagtctgcagtagtctaaatgaaaaaatgattgttcgaatctgatagctggcaatgggattggtgaagagaagtttcactgcaacaggaagacaagaaagaatagagagaaataacacaattttgtgggatagactcttaagaaagaataaattccc

SEQ ID NO: 5572 - DNA, 1047 bp, Homo sapiens
ttttgcctgtttgtagtccaaataagacacatacattatgattaactatatctcttttttttttttttgagacagagtctcgctcttttgcccaggctggagtgcagtggcgcgatctctgctcactgcaagctccgcctcccgggttcacaccattctcctgcctcagcctcccaagtagctgggattacaggtgcccgccaccacgcccggctaattttttgtattttcagtagagacggggtttcaccgtgttagccaggatggtctcgatctcctgacctcgtgatccgcctgcctcggcctcccaaagtgctgggattacaggcgtgagccaccgcgcccggccttaactatatctcttaagtctcttttagttcattggtttcccctctaactattttcttggaattttttgttgttgaagaaacatgtcatgcaggattttcctatagatctttttatagcctgaatatttatgattgcatccccatggtatcattgactatgttcctctattccctgtatttctgacaagttggtaattagatctagagagctgatccagtgtgggttttttgggccatgtacttacctcaaaaagtatgtaatgcctttctgtgatgctctcaaaatggatgctcattgcctacatgcatttttttcttggtggttgcaaagtgatgacatgtctttatcagacctctgtttattaactggaatacatctgtaaagagaaaattcaccttgtcggccatttgattactctgaagttctgatttataataaaagcagaacaagtgcttgattcttttcctttgtcagttttcaacaataacgaattctattcattagcattctctgaaagtaagtaatgatttttttttctccttagtattatgaactcatgcatataaatacttgttttacatggattcagttttttttaaattttgttttgtagaaaagacagggtctcactatgttggccaggaaggcctcaaattcctagtctcaagcagtgctcctacctcggcctcccaaagt

SEQ ID NO: 5573 - DNA, 1031 bp, Homo sapiens
caggtgtaaggggtgaaatttcagggactcccacttagctattcccaccatggtgctgagaacattatgaaagttctgtcagctgctttttcaaatcttttaaagcaattagccaaagccagtaaacactacaatcattacaattaccactgcccctctcttgttcatttgccaccactactatgtaaggcattgcctcactactctgtgtctcatccctattcatacctgtagtccttatcaccattttactagtgagtgagtctgtttcagagtcccatcctgtgtttctgatctctaggaccaatctcagtgtccatattttagcctgggttctccctccagaaatcagagcctaaaacgaggactcattgacaggtgtctttcttgaggtatgatcccagggaacaagctggagaagtgaaagagaggaggcccgtgcagtgtctaattaagctgtcactactgtgggcagtggggtagatctctctggaaccctctgaagagctgtgtaaaacacaccacagacttctcctctcaacggactgaagaggggagcttttatcctgcagcttctgtgctccgttagtcaacaagtggcctttcgggtgtccatcccacacacccgtggctacacatgtgcatgtgccacacagcagcatccaagaagcccagggtggaaggcaagagatacacagtgcagctgaggcaagggactgtggggtcactcctgtggggagccagttgctatggcaatgtcaaattgggctgagaaaacaggaggctgggcacaagacacaatatccttttgtctttagtttggggccttaagctgaagttcagggaaaaatgggaggaatcccattcaacagcttgttacagaagactaagtggtcttacgttatactggaagttattcgttacctgagataaaaagtcaccactaacagtgctgataccccatttgattggctatttgtgttgtcatcgcacaaaagaaccattgttttgacaataccaaacttattagc

SEQ ID NO: 5574 - DNA, 2920 bp, Homo sapiens
atgtcgagttattttagcaatatatttcagtcacttaaaaacacaagtttcctatttagcgtttgtttcccatttctccagaaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaaggtaaaatgcaggccttcaataatttaaagaaatagaagctcagaactgaagtgaatttagttttgcctttaagaattctagagatgaaatggctccattgtcctatacttgttacatccattgagttgtccaggccttcccagctcgaacacccgcaggtgtatctaagaaataatgcataggcttaatgtattcacattgacataaataaattgccataaattgacagtcacgttaagattgtatgaccactttgtctagaataaacctttttttagcctgatttcttttttttttccaattttttttttcagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgaattatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatatttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttcgtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactattaaaaaaaaaaaaagcacacacataatcaccctgaaggtttcttgcctggtggctatgttgggggcatttggcaaaatatgctggtgtggcaaaggaggtagtggtaagcctcataaaagttagtaaaaattgtagttcaacctttgaaatcattgatgaatcagcgaaaggtaggtaagtcttgtgttaggaaatcttttaagaacatggtgtaatcagacacagcaattgtattgaaaataactgaacacctgttactttctggataggatagtaagggtagtagtggcaaaggatcctgattaatttcagattttaatgtaagtacctcaggttcttgtctttggaaattcacattcataagtgtatattacaccaatgattgtgatctgcaacaccagaaagcaagatttctaatcatttccagaggtgttgtatagaatagttattccagagttaccttgatcagcttctgaagtttaagaag

SEQ ID NO: 5575 - DNA, 1034 bp, Homo sapiens
gttgaggtcaggagtttgagaccagccaggttaacacggtgaaacgcctttactaaaaatacaaaaattagctaggcgtggcggcccatacctgtaattccagctactcagaaggctgaggcaggggaatcgcttgaaaccaggaggcagaggttgcagtgagcccagattgtgccactgcactctgtctcaaaaaaaaaaaaaaagccatattcattatgactttttaattttgtgacatgtataaatacattttttattatctacatagtaaatttaaaaagctgcatcaaactgtagccggtgaggctgcataaatgatgtgggacgaagagttataataacttgagatcactgtagtgaaaagaacgtgtattttagattagacctgagattgatagatatccttactaggggcttgcgggtaggacacttaaggaaattggagcttggagtgagctttgtaaaataatactaaaaccatcctcctagtggggttactgtgtgacgtccaagaactcgggggcagttggcttgctgtcctgtgctccgttctgacgactgagcccgcccaggtctgcagggtcctggggtcctgcgggttctgtagggttccctggtgtgtggagtccctacccgctacaagctccgttgggtctacggagtgtgcggggatctcccagccctgttggctgtacgggctcagtggggtttgcagggatcccctcgttctgtggggtccgtgggcgccgagtcagggccatgcccctgggctccgctcgcggagccggcgtcgcccttgttgactttcaaaaggcgccgccggccccgcgccctacacgctcagcacgccctgcgcggagttccccgctctggcgcactggccttggctggcgggagggggccggaggggctgccggcggagcagagacacagccaccctccccaacacaccatgaggtgagtcggggaggggcctaggtctcccacatgctgttgtgggaagctctgacccccgctgtgcctggggcggg

SEQ ID NO: 5576 - DNA, 2549 bp, Homo sapiens
cacattgactttgcgcttcaagtatttgcaggttattaccttagtttttactccctttgtgcgtgccgtgattatcttggtttaaactcgtatgtggcaagaaattttttaatgaatgtttaagtttctgtgaaaattgtgtatttctcaaattgtattttttggcttttaatagggtcactttgttttctgggtctctgttttgacttacgggaaatgctatttgttttctctacattttcttcatttaaaaaaaacctgtaacttcaggagttcaagaccaacctgggcaacctcatccctggaggaggggggaacccccacaaaaccacaactataactggctgctacttaggactacaggagatcttttttccaaagtggaaatagctttatttcacccagattatgtttatttaaaatttcagataatatataaagctgtaaaaagtaaagcaaaaactacctgtacttgtcccatccaaagataacttcatagaatatttgattatctactgtggtgctaggagctctgttggaccctggggactttggtgaacagacaatgcctgcctctataaaccttacattctgctggggaaaatagacctctcccaacccaccaaaaagtaaatttataataattccatgttctaatgctttaaagaaaacacttgcagcagggtaatccgaggtttatctgagtggatgacttaaatagatgtcactaaaggaacagaaagagctcaaccatgggaggaatggggagaaaaaaaaaagaattctggtcagaaataacagcatgcacaaaggccttaaaagaggaaaaagctataaaaagaaaaatccatgtagctgccactcagtagtaagtcagggaaaagtagagcaagatgaggtataggaaattggcagggaccaaattttacttgtccatggccaggagggtgtgttttgtgttctgagggcagtgagagggtactgaggggctttaattagaaataaagtgatctggaaaactaattgattaatttgttaagtaaatatttattgaaaccctactgtataacaggcactgttctgagcactggcatacaacaatgaaaaggacaaagccctgtattcatgaaactaatctagtggttggaggacaatcagataaacaagaaaaaataccagatattgataagtgtgcagaagatgaccattgtttaaattgtggtttatattctttaagatatggtatattacacatatacttcttttggaactttctcctgaataatttatggtaggacatttttcactgttactaaatagttttctttgggggcatcttaatttgtttttggattaagtatggtaaaaaatagcatgcataaatgaagaaatactgtgcagcaacaaaaatttgcatgttacaaagcatctggtgaacgttatatagtaacttccttttgacagtctgacatgtggctctcctacccccatcccagaccccagctgcccctttgtggttttttattttgacctattagtatggttaaatttatggatttactatttattgaaccatttttgcatcttggaatgagccctaattgatctgttattattttaatgtcctgatggatttactttgccaatgcatatatttaggatttttatatcaatattcataagagatcagtctatagttgttgttttttaatgtgttttgtctagttttggtattcgcatctgattgctttgtaaaaacaattgagaagtttcatttctttttctgagtttcggaacagattaaatagccaagtattatttattcttcagttaccaaattcatatttactaaacactatgtgctaggaattggactggatgctgagtaatcagtagtaaacaaaacagatatggttcctgccgtgatattgcttggctcattaaggaaaatgacattaatgaagaaactacacatatgtaattataaatcatgcaagaaaaggacaggatgctttgagataatatcattgaagatctttagattgtgctttttatgcatttgagtaaatgactattgagtacatacatatacactaacagctaattatttaaattagtatgtattgatttggtgtgtaattagggctgtggtgggtgcattagtaaaatgaggtcttcataattacacaaaatataaaataatggcaatagtagctaccattgtaggaggtagctgcatcattttttaatggtagaaattaagacaggttaagtagacacttttagtctaacatgttcaattgtatacactctttggaagtctctcttaagattatagtaaaagaataaggatataaatccacaaagatcaagaggaggtgagaggaagatatagctgaaatcagtatttgggaaactagaaaggagatgggcaagtaataaatgatttcatgaattagagaatgctgaaagctgaagagaggtaacccagcaaggagcaagcagattctttccacagaatctggaaaagttttaggaattgggggtat

SEQ ID NO: 5577 - DNA, 1047 bp, Homo sapiens
ggatggggtgggaatagaagggttggttgatggtctttatcattttgataccctggaaccccttctccactcccacacacccagacaactactctctcctctaccttgacggaagactgaaggtttatacccaggagactaggaggctccagatggttaaggtgggggtgaagcacctaaatgaaaatgaggattgagtgaaagtcaggtcaacatgctgaacctagagcggttgtctttttttgattggcttccaaactatcaggcttacgtgcccctcaacaaaacattaacggattcttagctggggaaacttaccagcccatggcacagtatttaacagatatgaactatggaaattcacccgattgaacagttggatccatcagatcacctggagagtacagccgctggtcaggaagcattgttcacgtaccacagcttctagtcaacttttatttcattttttgagacagggcctcactctgtcacccagattgaagtgcagtagcgccatcataactcactatagcgttgaactcctgggctcaagccatcctcccacctcagcctcctgggtagccgggaatacaggcgtatgcccccacgtccagctgatatttttattttttgtagagatggggtctcactatgttgccaggctggtcttcaactcctgggcttgtgatcttcctgccttggcttcccaaagtactgggattacaggtgtgagccactggtgcctggccctagtcagcttttaaatgcctcacatttgagtataaatgtacagccaagggtcgcctgccatagaatgaaagtctctaatgaaaaagagaccaagtaggaaataaaaggagctgagtataaatagatttacttcagggaacagaagaaacttcaacaaataaaactagtatctttaaagagaagatattacatctgtgaaagatgaaaaagtttatataaaaaaaactgctgcgacagaagaaatttcttaaaaatttaatacaaggtttagataataaagctgaagaattctcccca

SEQ ID NO: 5578 - DNA, 1046 bp, Homo sapiens
cttacatacctataacaactaactctaccacttatttaatagttgtaggtatattctgttttcttaagtaggttttgataaattatttctggaaaattcccctgttttctctatgatttcaattttttctataaaaattgtttctattacccttataatttatagtacatataaatcacactcctttttatttgtaatgttggttttcagtgccttgttttgtccttgattaatttgactaaagatatatcaatattttttgtcaaaaagctaatcttttttcagctattttttcttcggtttaattaatatctgatcttctctttttatttcctcctcttatttgctttgggtttactgtgttgttccattttctgagttcttgaattgaccgtagcttattgattctttaaatgtttttcttttgtagtgtatacatttgaaatgaacagtttcttatagctattttagataatatcttaagcttagatcatgttactctttaacttatgaaccatttatatgtaggatttttaaaatttaaatttccaaacatgaggcttttgagattaactttttatggttacattgtcattttacttgattttggtcagagatcagttgttttttagtactcttggaatttcctttgtggccaaattcataaccattaggttttgttttggggctttcagctcaacttcattgaggtctaattttcatacaataaaatgaacataatttaagtatatagttcagtgaattttggtaaatgtatataccatgtgatgactacaccaataaaaatagtgtgtgtccatcaccccagaaagttcccttgtgcataccccacttgtagtcaattttcctattcctgccccctgctgtaggcaactaatgaaatgctttttatcactatagattaattttgctgcttcttgaactgtatatgtatagaattttacagtatgtactcttgtgtctgatgacttttgcccagtttaatgttttgagatgcatgcatatatcagttttactttttttaa

SEQ ID NO: 5579 - DNA, 1034 bp, Homo sapiens
aaaacacgtatgttcctctgttgtgattgaatttaacctttctcacatgctctttattcatcacttaagccctaagggatatacttaatgctttataggcaagcacttttcaagttttaccgtcttagatttttaggtttctttgtggtatagccccctcttcattttcatagtctggtaatcttgaatgtttaaataaagcttgagcattgctcagcagttatgagaccattcattcataaagtgtttgtattgtttggtgcactgattggactctcaaatgaaagtgtattttgtaaagaagggagagcgtcaaatttctagatgaaattttcatctgtctcctcatttactgaacaggaaacttgtgctttcttgagagtgtaattgatgtcattatgaacccatgaaagatttaagattagctatgattttccaacaactttgtttttaacatacctctgctaaccataaaatcactgcttttatgcatatactgctatatattgaagaatactggcctaaagtggaagcatttttaaccataaataaatagttctggaaataaaaatatatataagcaaaaaataatttggtacttgttcctcctccttcgttttaaatcattggctttatttatagctatatagggaacagtattccccacactggtgttaatgaagtgttctctgaccatgtatttgggaaaccctgtattagtgtttttaattgcaccatctcttcagttttcagttcattattgtgcattatgatgctcaaaaatgaggacgtatgtaacttaaatctgtgcctacctattaatgacttacagaatttagagaagttgataatcacagtcttcatttccagagttactttttaaaatatttctttcagtgtaaacaatgtgtttctcaaatattggtctataggtaattcaattttgaaactttcttgcttttttataaatatcaaatataaagttcccaaaattattgtttctaaagaaatcttgatttgtgtttaggctagca

SEQ ID NO: 5580 - DNA, 1034 bp, Homo sapiens
ggtaagtccgtaaagcaaaaagaatcttaaaaaaaaatcttcttttacaagatgaagtgaggtttcattagttttataagatatgtatattaaaagccagtttcattaaatgtcaaacagttcataatgtttagatttctaactttaaacatatgaatgagatttgagtctaaaacttaacagtatttttcagtgtcaagagattggtattgtcttgagaatctcttctaaattgtcacaatggcaataagaatagaaaatagagctgaccgaacttggcaactatggaatgtgaggggtaagagaggaaataatcaaatataagcttttaaacttacactacagtgataattattaatagaaaagaggtacataagaagagaagcagattggtagagaagctgatgagttaaaaataaaaatattatctaattgtcaagaacaatgaattagcactaacttttttgaagattcagtttcttcatgtgtaaaacagattaaactactttatagagttgttgagaggattcagtgagactggaaagtgtttagcccaggagtttgcacctagtaagttctcagtaaatggacagtactacttttatgagttgaatttgagaaaaagtgagattttcataagtgtttctgaaagatagcctataggtcataaatatagttgggaaagggatcagaactagatttggggctagggttgtgggagtggggtgtgaattgaagctaagacattgttagtgggatggcatggaaagagaagatggcaaaaacagaacttttgggtcattaatgggaccagggtgtggggaggtacagcgaggatagaacgaggaattgtcaagagcagtctgttacctggagacttaggaaatagagtttcacggaaagcagaaagatctcacgaagaggggtattttttattagtgccaggtgctatgtagaatgtggagatcagaactgagaaagattatcgggcttcatggctagattcctgctgaccttttttttttttaaaaaaa

SEQ ID NO: 5581 - DNA, 1026 bp, Homo sapiens
tatatatatataaatataaacatacacattgcattatttgcttcatttgtttaattttttttctggagaatctgaaagtaaattacaaataaccactgcagcttacatctcaaaaaaaaaaaaaaaaaagacgttttcctacattgctacaatcttacgatttcattgctgatgtttgagaggctggcttcagtagagtggtggaagtagaaactggatttttcctgacaaatacacattcttcaaaaacacatacactggggttgatagtaaaattaacactactacttgtatgtcttttgtaatttttggcttgactagaactggataattttgtgtataataatactttcaattaataatagtttttaaagcttattgatcttttatatcttcatgagcaccctgtggtctttgtgtctgtgacccaggcccaccctccctacctgagtgacttattcttacctggaacccaagcttctgaccacagaattagcgctctcttccactgtatcagttttctcactcattgtctcttatgtttcgaaagagttgcctcagttgaggaatagccctgaagcctgtcctttcttcctcgtttttcactgctgctgccttgttggaatcctcctctcctgtctcaactatcacagtagctttctttctaattggtcttcttgcttctactttctcctgtctgatgggcaatctgctgcttaatctatattttatacttttacaggtgtatacatttccaaatactccgactgtcttcattcaagaccatggtatcatgggaaatctggttatgttgtaatttttaatataattaaggtaaagcttaaatgtgctgttacgtgatttccttttaaagtttaaggttatctacctttgatattctctgtagatattagttgaacatagttctcaccaaagttagctatccaaattcaggaaaagcaaaactatttttccttttctttaaaaagaaaactttgattcatttactagattgtaaactttttt

SEQ ID NO: 5582 - DNA, 1040 bp, Homo sapiens
ttgtcctcttttacattacagtcaccaaagagccattcagtgaccgtaacataaaagatggtgggctatagtttttcttttaaggaaatggctctcttaaatttagggtgattcgtatatttctttgatattgtgataaaaactatggatatttgtctcagacgcccaaatgtccaaaatttttgagtccatttttaagggttcatggataatcaaaactatttttggccttaagataattgtttttctaagaagtatagttcttaatacagttactgttaggggacacatatctgcatccttgttagactacttctaaatgaatcctagagtaaaggttattgctattcgaaggcatctgattagttttaatattttcattctagggaaaagtcaagtttgtgtctgagaattatacaactaactatactaagccatcttctggctatgattgccacgtgtctgaaaatactaacaaggtttctaacaagacgagtcattttcgtgcctttgaactgagtcaggtatagttacctgtgaatgagtaacacccaagatatatttctgactctaatgtgttaaatttcagggctcggtggggttgagaaaaacttggtacatatgcagttccatagtgctaccctgataatacttatttttcctctttcagtattacttttacgaactttcaggcaacaccgttattgaacgacccagacagatctgtccttatgtaattgtagcttttcgatacagggaatctaaaactatggcaccaccagctcataaaagcatgtaagtaattatgtgcatgctttgttttactgaatttgttccttttactcttgtaaacatgttctttttctttctttttctgctagacttgaacgcagtgaaaatggtaagaaatagttcattgattcttttaggttttttttttcttgagtaaatgtttcatcataaataatcagtttcttttttaccttcatttcttcagttctcatgtctccatggaaagggaaattaattgttcaagaccg

SEQ ID NO: 5583 - DNA, 1050 bp, Homo sapiens
gagtccactgaagactctaatagaggggaacaaaagagaggaagaatttattttcatctgtatttcttgttgccctggaacttgattattttctgttattttccatttcttaagatgcatagaaagaagtattctattggatggtatcttgcagtctttttagattcagcgttttgggataattttcatgtaaatatgagcttaagatgctacttataggtttgattcatcgtgagtttataatgactacatggtaacatattggctgtttaggcagtggtatgaaatgtcagctgtctcagtgaaaaaaataagtcttttctgattgatctgccatgttcttgagcactgttctaaaactaacctttcatgttctggttattttatatagacccaacagggccaagattatttcagctaaggaacttgaagtttctgatactggggacagaattaccctgattcccataacatttgcagaattttttcttttcttgaggtcaatattcactaatgagtatgggtagagggagaagagagggattgcagaatattccttcagttgaatttttcctttttatttaaggcaatcatcaaatgcttagaagatcgagggtttttcattttacttacatcatcagccttactatcagaaccaggtatggagaactgttttgggaaaaaatatttttcattatgtttacttttgctttataagatcaacaacctaacttttcttcttctgattctcattctgcatagattttggaggcaagcagatgggtctgcatgggttacatttatttcgttcacccctgtcaacaggtgaggatacaatggtttccagctcactctgtctgttggatatatttagtcctcatctgacttgacctctcagcagcacgtgacactgttgactgttttttcctcttaaatacctcttttcttaacatcactggttcacccttcttgacctcccttgtaggtttatgcttccctctgagcctcagtcccatatctccacttgtctactgacattgccactgagat

SEQ ID NO: 5584 - DNA, 1025 bp, Homo sapiens
ctctcagcacataaagccaagaaatatacatatgtacatacgtatatctacatctctatttatgtataaaaagcaaaaacagaggagttcacactcatccccaattctagtccagtactgccaggtttgtgctagcctccttctccatgtgtggagctcccttctctgaggttgactctgtttatcctcagtgttttgacttattgtccctcccaagtccccctcccccatcctcctcccaaccccaggtataatgagacccctcactgaggcactaatcctgacctcccgaaactccctgacctgagcgcgggccagctgccctccccctacccttgcagcagaaagctccattcagatgtcagcagtcctgtttagtatctacctcagagccccaacatgtgcaggtgggggggatgttgcttttttgtcatgattcttatagtctaatgggacaaggaaaacactgattaaaagagtcacacaaataaatgtgaaatgaaagtgatggtaaatgtgacgcaggtgccacgaggacgcattgagggtgattggcctggccggggaggtctttgctcaggaagtgctgcagcacagaaagcagagcataggggcctgcaggccgcgtgcaaaactggacgtgccgtgtgtcggttccacacatgaggggcctgcaggccacgtgcaggccgtgtgtcggctccacatgcccactgggtctgtctcagacttcacttacatcacttctgctgatttcctgcgctaactccagaatgtcacgtggcgagtccatgggggctggattactgagtaacgagttacttagtaatgaaggacacgtgtcccttattgtcacagtgtcccctgggtgcagggtcacaagaccacttctcatctggagtactaaggccactgcagaaaccacagagctgcataaagatttcttggtctgccctgctcttctcatatggaggtgtgtagctggcaaacaccacagggaacagcctccttgtgccagagggctg

SEQ ID NO: 5585 - DNA, 1060 bp, Homo sapiens
ataaataggaattcctaaattatcactaaatgaagtaaccatctactaaaattacctattttatctaatgtgcattttcacttgctgttaacttggatcgtcagtacagaacataatgtaaccttagaatgcataggcgttttccccattagagcatcccgcttataaaatatttcttgttcgtattattttaagaagttctttatcaattttgtgtttcttcaggtgactcaactacagcctgcctggatatggatgatgccaataaaaaattagtattttccctttggaaaacttgtgaacatgtgaatacacatgtgaacagtcttacatttgaaaaaccaatgttctacaacttggaaagttttcattttttatattttgctgaaatatgtcacagtggcattgcagttgtctgttagctttgggttgcagtgctagatattgttttaaattattttcattttaaacaagatgccttctaagctattgagcttattaaaaataattttacatgtttacttagttggagcaaaaataagtctattttaacaaatagctttgtttttgcatgctaatgtcagaaaggcatacgatgcacattatgctctgttttaaaggttttaccacccttgtaaaaactataatcttaaatggttttatttgctgttacacaaacaacactacataaaacattttttcctaaatggtacaaatttataaactatcatttttcacttacggtatttgtaaatactacactacaaaaatcagctttctgagaaagaaataatcatttatttatgatattgaaaatttctacagtaaacactcaaaaccaagcaaaaaacatttgtaagatacacggtatctatttggagcaacggtttttgtaactaatgtgtttcattttttaaataaagacaactaaaaataatctctttctgcaatgatttttatagcagaaattgacttatctggagtgttctagcaatttttaggtcatttagcagaacagtaagcttccagaggaaacctacacttctatcctttgggcctg

SEQ ID NO: 5586 - DNA, 1037 bp, Homo sapiens
ccccctcccgggttcaagcaattctcctgcctcagcctcccgagtagctgggattacaggcgtgtgccaccatgctcggctaatttttttgtatttttagtagagacggggtttcaccatgttggccaggctggtctttaaactcctggcctcaagtaattcacccagctcggcctcccaaatgctgggattacaggcgtgagccaccgtgcctagccaggttggaatatttgaacccaggataattggttacttcattggtgttgcacattcgattctgcctcttgtgtcttctctatgaaccttctttgctctgtatccccctttggataactaaatgataatgtatgtgaatctgtcccgcagctcctgtgattttctgggcaaaagcttggtctagaggggcgggatctgaacagtaagctaatggatggagctgtttcctgggtcttgctgttttccggttgggctgctcatttctttcgtgcagacttttggaggttgtggtctggcctttacagtcacgtcacatgtagtcgtcattggcaccgacttgctccttggctgcccttccttttcctcctgtttttcatgggtatgctgttgagcatgcccattggtacactgatcatttgacaggtttcgtgatttgtgagtgtgtgtagacaccactattggtattagatttagaattctaattttgggtttgttgacatcatctttttgctgcttatctcattcctctatccctcctaggctgattttatttggaaactgaatttggattccatctttgcctttctggctgtgaaattacctacttttagaaagcatctcaaatcttatatctgtaactgtcattcacatgccttttgaagaccagtctcagatttcagaggacctcctggagcataaacatggtattccacagataacttaaagccagaaattatttttaaaactaggactttcagcctccctctcactccgggggaaaaagtgattaaaacacaaacactgtttctcttttattcctt

SEQ ID NO: 5587 - DNA, 1050 bp, Homo sapiens
tccaatttctttttttgaagcccaatttctttatcattatgtgtaaggacctttgtagtctgtggctccaaattccttttccagccttatctcctgtcattcctcatcagggaacctcttgttttgatgaagcccagctttcctgccactctagtgcattgttaatgcctctgtatttttgcacacattgtttccttccgccttactgaatcccatgattctttcaagactcaactcttcgtgaagcctttttcaacttgcctaactctatttatgtttctttactatcataacacttcatgcatgcatttatgtagttgttatattactttatctttagtaacttgtgtttgttttggtagctgccttatgggtaggcttattcacttttgtatcactaatgtctaaaatagcatttaacaccaaggataccataagacaaagctctcatggagtttaaaatgaatctgggacatagcagatacgtaaaagtagttgtggaatgaattgactgtagaaaaagcctttcaaatatataaaattatattctagaccataagtagtgatctttctcttgtttttcaaacattcctttctttctttaggaaaaacatagaacggaaagcccagcccatccttgttggctgtcatacacgagtgctgtctccaagggagtcacaggtgtctcagatgtgagaggatcccggggagattgagcttactgcctgggaacttttggatttctggagaagcaggctgtggtagcctggctctgcgtcagtgaatacctgggaaaggagctggagctctattttgcttgctttctgcattcgtttcttttagagctaatggggacacaatattttgaagtttttccatttcgggtctacagcatttagtggtattttccttatagttatgttttccaaatacttctcaatttctttggttctgacatttcacaatgattttaaaaaaatgtaatatggaaattaaacttgaggttttcagaagctgctttcaaggtgtctagatacagagtgaagaatg

SEQ ID NO: 5588 - DNA, 1057 bp, Homo sapiens
gggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattct

SEQ ID NO: 5589 - DNA, 1110 bp, Homo sapiens
cgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtca

SEQ ID NO: 5590 - DNA, 1049 bp, Homo sapiens
aataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctcca

SEQ ID NO: 5591 - DNA, 1035 bp, Homo sapiens
tgaatttttctcacttttcatacttttatctactttagtcttttaccagttatgcttcctaccccctctacccctgcaacttcatagttgattgtgacaggatttggatatcttctggtcaagaggaagtcatcccaggttcaggtctctaaattggttcatctgtgatgaacatttatttcctttgttatcacagaaggcgtaaagacagacatgaagcaagtgggtttgcaaggagaccagatccagattctgatgaagatgaagattatgagcgagagaggaggaaaagaagtaaggcatgaacaaatatgtcttaaacatatataaatactggaagtgcaattccactatgtgctttttcttttcagtttgataaatagttcatttgacattgatttgggtaattttctttctggaatcccagcaatacacatttgcgtcacagttttaatttatattgggttttcatatgtattttcctttgagcttcacaaccactttctaacatttatttattggatactttgggactagcttaaaatctattcctgcactgtctttacctgcagcacagtccagttggccgatgctgaatccactctgttgtttctcttaggggggaagcatagttaacattgagtgtgtctgttttgggcattgtgacacatttcatatccgctatcttagttaatccccaaatgtttggtttttattaacttcttttggaattcagtatataggttgaatatttgtaggtctcatttttccagcttataaattgactgccctttttaataaggaggcatgctttccatactaaggacatttgtttttttttcttaaacaccagcaggaactagatagctttgaatgagaagactttgtttgaccttgtagctcatgatagggaggtagtggcatgcccatcatatgtatagttgttgacagattgatgttcttattttaatgtgattagtagcagatttccagtaatcaccctgaatttttttaactgaacttattagagctaat

SEQ ID NO: 5592 - DNA, 1633 bp, Homo sapiens
gcagtctcttggtaaatgatgcctagttggtgttttattttcatttaatttttacagtctgttctgtgttgagggaattcaggaaagagacaaacatatgttagcattttaatcagggaattaagtttgagtcagcctagctgaacttcctttgctaaagaaagaagaaaacttttctggcagccccgttcatgcacagcttaggatacatcacgagcctgacaggtgagtgccagaaaccaacagttgtcccgacttgtgaggttatctgaagtaaggcagccggtggctggattagtaactgcatattcccctgggcccgtgaccttgaacgtttgctccaagtcaactcacctataggaattatcactcacatgccctgtcagccctttgggaagtgagatgagcaaaaattgcaagtaatggtggaggctcaaaacatccagatgctattgtaaaaacatgccaaagcaaagcagaggcttttattgcagataaggctgtgttttcgctcagagaccaattgtgtagatgcctaggacataaatggtggggatcgctattgaaattaaattaattattgtaagtaggactcagttctgtaacacatctaatgatatgctgctcagttctgtaacacatctaatggtatgttttgatacagatgcatccaagaagtcagattcaaatccgctgactgaaatacttaagtgtcctactaaagtggtcttactaagggtaagaagctgaggaaagcaagctctctgcctgcctagatttgtgtgtgtcaccccagcctaccctgctccccctaaaagttaaaactgaaaatgatacttttgcaaataatactttgggcagatcccacgtaaggctgattttagatttttcactaatgtgtaagtctctttgctaagtacagtgtttaagactgcagtgagtaattaaatatttgaaattgctagagcttcagatagtttatacattttggtgcttgcatagatgcttttgtaactctttacaggcttaatatatgttttagtgttttaagaaatactaacttttgggtactttggggatgaaatttttcattatgtcgtttgggattgagaacatttaccatcactaagtcatatttatatacctctgctaggtgtttgtaagttatacttggtacttgaatttgtttatttttgtgtttaaagaacatggttggtgcgggagaggtggatgaagacttggaagttgaaaccaaggaagaatgtgaaaaatatggcaaagttggaaaatgtgtgatatttgaagtaagagtgttttcttttgatgtttataacacaagttgtaattggcacattacaaaacattttctacaaacaggacagggtatgctataagtaacattcttactgcagaaggtgacaggcgttggttatttgtacttctcttgctcaattattacagttttaaacataaagacaatgatttcaagttttatttgatgaagaaacaggaatgcttcatgattgaggatcagtatgatgactgaagaccttgattctagcgtgctcagtagtttagttccttagacatgcctttggtttcagtcatttggtgagtatttagtgcctctcac

SEQ ID NO: 5593 - DNA, 1009 bp, Homo sapiens
ttagtgatcaggaaaatgcagattgagaccaaaatgaagacacgtttcactctgtgtgcccggtagaaatgaggaagcctgatggctttcagtgttgacagaatgtggaccacaaaagcccctcacacattgctggtgggccgataagtggtacaaatgccttggaggcagtttggtcttttctttggtgtaaagttgaaattcacatacttcggctaggtgcggtagctcacgcctgtaatcctagcactttgggaggcctaggcaggcggatcacctgaggtcaggagttcaagaccagcctggtcgacatggtgaaaccccatctctactaaaaatacaaaaagtcagccaggcatgatggcatacacctgtagtcccagctactccagagactgaggcaagagaatcgcttgaacctaagaggcggaggctgcagtgagctgaaatcgcagcgccactgctctctagcctgggtgacaaagcaagactccatctcaaaaaaaaaaaaagaaattcacctactcgaaaccagcaataccgttcctagtattgctgatgttcacacaatcatgttcatagcagcactctcatagaaaaacctttacacagcacaaatgcactttgacaggaggataaattattcttagtatattcacacaaggcaatattataaataagctacactcaaatagacagcaactctcaatattgttgatgactattaaaaaatcccaaaacaggccaggcgctgtggctctcacttgtaatcccagcactttgagagacggaggtaggcagatcccttgaggtcaggagttcgagatcagcctgcccaacatggtgaaaccctgtttctactagaaatacaaaaattagccaggcgtggcggtgggcacctgtaatcccagctacttgggaggctgagaagggagaatcgcttgaacaagggaggtggaggttgcagtgagaggagatcgcgccactgcactccaacctgggtaacaga

SEQ ID NO: 5594 - DNA, 1050 bp, Homo sapiens
caggccgcagatgaggaaacagactaggagggatttaggcatctggactctgcggggcggcccgggcgcgcagcccgtttccctgtgggttgagggcgcgggagaagtgggcggcccaccccaccccgcgcgtggatgcggggctggggcaggtccgcggtggaggcgccgccagtgagcacccggggaccgctcctagcccccagtgtgggacacagactccctgaggacctcgtatgcgttgggtctgtggctccatccgaatcttcatgaacagggcctgcggtgaatttggggagagtgagtgagcgggtgaagggtcaggaaataagtcacaggaggcatggttgaagaattggggatgtttaacccagacatggcaggactgggcacacttgacccctgtctggaagtatttgaaagacttctgaagggggccagcccctccacacctgtgggtgtttctcgtcaggtgggaggagatactgagaaaagaaataagacacaaagtataaagaacagtgggcccaggggactggcactcagcatacgaaggacccgcactggtggccgtctctgagttccctcagtattgatcattatttttactatcttggcgaggggagtgtagcagggcaacaggtggggagaaggtcagcagggaaacatgtgagcaaaggaatctgtatcatgaataagttcaaggaaaggtactgtgccctgatgtgcacataggctaagtttatgtttccctttactcagacatctcagtgtagcaaagagtaacagagcagtattgctgccagcatatcgcctacagccacagggcggttttctcctatctcagaatagaacgaatgggattggtctgctttacaccgagacattccattcccagggatgagcaggagacagaaggcttcctcttatctcaactgcaaagaggccccctctctttcactacttctcagtacagaccctttacgggtgtctggctggggcacggtcaggtctttcccttcccaggaggccatatctcaggctgtctca

SEQ ID NO: 5595 - DNA, 1263 bp, Homo sapiens
ctccaaagcccttgccttttctcgatgcgtctatttttttgtaaatgttttagttcagaggtacatgtgcaggtttgttatataagtaaactcgtttgttgtagattatttcatcacctaggtataagcctagtacccagtattttattttcttttttctttgtctttgtttttttttttgagacagaacctcactctgtcgcccagactgaagtgcagtggtgctatctccgctcactgcaacctctgcctcccgggttcaagcgattctcttccctcagcctcgtgagtagctgggattacaggcgtggatcaccaggctcaactttttttttttttttttttgagacgaagtctcactctgtcatccaggctggagtgcagtggcacgatcccggctcactgcaacttccgcctcctgggttcaagcgattctcctgcttcagcctccccagtagctgggattacaggtgccccgccaccacgcccagctaatttttgtgatttttagtagagataggctttctccatgttggccaggctggcctcgaacacctgagctcaggtgatccgcccgcctcggtctcccagagtgctgggattaaggtgtgagctaccgtggtagagatggggtttcgtcattttggccaggttggtctcaaactactgacctcaagtgatccacccgccttaggctcccaaagtgctgggattacagacatgagccaccgcccggcttagtatttttttttttctgagcctcttcctccttccactcaatgcatctattttagtggaatgggttcctttgtgaacaatgatgttgcagttattcatgaagtaataaagtgtttgtgtattgattgatttctttggactggagggtttgcccagccctgttgagctttgtcattgtctacctcaggggaagagggagattgtcgctggtcagaggagaatgccagggcttctctcagacggaggcagcctcccatctcaccgcaagtcggatcttgagtagcacctgtttcggcccattgcccctttaacaaggggcccaggtgcccttggacttgctagaagaataatcatgactttgagtttaacaaatgtggtcacagtattccactgcagtccacctttcccacttctcctagcccttcttcttctttttttttttttttttttttatttgagacagagtttggctcttgttgcctaggctagagtgcaatggtgcgatctcagctcaccgaaacctct

SEQ ID NO: 5596 - DNA, 1061 bp, Homo sapiens
tggggcactttcaggtacacagagtgttggcaataacagtaaatatcctgaggtggggagcacttggatttgcctggcatggattgcgtgtttgtaggtgggaactcatccgagtgtggggaccacagtgctgttgtcatccccgtatgacagatggcacagctggggcaccgcaggcgccaactagcccggatctctcactgaccagcgctagggctgcaataggaacctggctggctggctccagggcccgggctcttatccgggaacagtgttgttcttatttgcctagatcaacaaagtcactgtagagaaagacaaaaacaaaacaaaatccaaaccaagtaagccaaaaaaagcttagcctggggacccagttctacatttggtggtggtcataaaagaggctacccaaatggcccgtaagcatagaaagcacttcaacctccctaattattcaagagatgcaaattaaagccacggtgagatactactccacacctgttttagttagagtggctaacaagaaaaagaccacatgttggggagactgtgactcacaccaactctcatatcagagtagaaatccatacaatcatcttggcagcatttaccagagccaagcatctgcacacagaaggatccaggaagcccccgccttggcgtagacgcatgcactcaaggtgcacagaagaatgttcactgcggcaccccaacgggtgagagcccccaaacggaaagaatgcaacgttccatcagtgtggagaagtcaagtgtggtgttcgtgcagtggaatactacagaaggatgaagaagaaccagctattgcaggaagggacacggtggaagaatcttatggggaaaatgctgagggaaggaaaccaggccaagtaaaacagatagaaagttcaagaccctgcagatcgtctgtatccgatgtcaagacatgggttcccttgaggtggtgatgggagggggcacgggggtttctgtagcgacctggttgatgggtgggggttgcataggcatgctttcctgtgaggatcgtcgagctgtgcatt

SEQ ID NO: 5597 - DNA, 1642 bp, Homo sapiens
gacatggtggtgggtgcctgtaatcccagctacttgggaggctgaggcaggagaattgcttgaaccagggaggtgggggttgcagtgagctgagattgcaccactgcactccagcctgggccacagagtgatactccgtctcagaaaaaaaagtgaaaaggcaagggcctttttgtcctatctcacttcgccttactgccagtagtagcttggtatttaaatagtgtaacaggtgcagtgtggtttatattacgctgtctcatgtacagtaagtgatgagatgggagaagtttagacaactgctctaggctgcgtctctacaaattactcatttcacgttgggcaggtctttcgttgtcagcaaatggaaagtcaaattaaatgtatttgtcattatctttcagcattggtgtttgaaatattagtgatgtcttgattcattgtttattcaaaatagaatttttagctgccatgggtttaaaaaaggtaagaattttgctcagaagtgtgcaccttccgaaactgaggatcatccttttgaggtgaatgtgcagaattattagcatttatacttctcatgaactttaacatttctgagttttagctgttttgaaataattccagacttaatagaaaagttgcagaaatagtgcaaagtgttccatagcactctcacctagattctgcaagtgttaccatttgactcctctatcattctctccctctccatttctatctatctatctatctatctatctatccatccatccatttacctacctacatatatatatatatatatctgcctcataaagaggaagagaaaatatatttatatggatatatgtgtgtacgtgtgcgtgtgtgtgtgtctgaagacagagagaaatatatgtcgtgcccagcccctatttttttttctgaaccatttgagagttagacgcagacatgatgcccttttgtccctaagtacttcagggtgtatttcctcaaaacgagcacagtatcatgattgaaatcaggatatcaacactgatacagttctgttatctaatatgcaaacttcaagtctcaccaattttcccactactgctctttacctttagcaaaatcaagaacaacatttagagtgattcaaggtttcatccaggctcacaagcctttcatctagtgtgtcctcaatctttgctgcctctcatggcctttgtatttttgaaaagtgcaggcactgatttttttttaaacattttttttcaaaagtttaaaatgcgataaaaatgtgtgacacaaaatctaccatcttaatcatttttaaatgtgtacagttcagtagtgttagatgtattcacgccattgtgcaatagatctctagaaccttttcatcttataaaactgaaactctgcacccaataaacaacaattcctaatttcccccaccgcctgcccctgacgtcccccgttctgctttctgtttctgtgaatctcttgtagtgaccttgtgtaagtggaatcatacggtgtttttctttctatatctggcctgcttcgcttagcaaaaagtccttaaggttgacctctggtgtagctctgacggatttccttccttttaatttttttttttttttttttttttttagacgga

SEQ ID NO: 5598 - DNA, 1036 bp, Homo sapiens
catacctggctaatttttgtatttttatagagatggggtttcaccacattggtcagtctggtcttgaactcctgagctaaagtgatctgcctgcctcagcctcccaaagtgctgggattacaggcgtgagccactgcgctcgcctcctgttcctttttcatccacgctttggaagaagatggtgtcagggtcatagaagacccttagagaggagacatggggtggggtggtttaggcattagtagtggccatgtttcccctaccctgaatggggctttgcccagggctgttccatcgggtttatctgggcctcacagacgtctagagttttcttcatcttgttgtgtctgggtctgcacaatactgaggaattgtctggcaagaaacaaagctactcatgttctaggacatagttccatggctaagcatgaaaacaagcaagatccaagtgttcaagggcccctgcaaccctgacatgcctcctaggtggctggccatgtctgcatggggtcactgcggcccaggactcagactttcctctagaagttggttttggcagtgtacccagggagactgagtcaccaagcaaactggtaagagaatgcagataaacgtggttcacttccaggaggatcacaactgccagcagagagtattcggggggctccccgcagaattctcttgggggagaaggtaggtgggagttaggggccattgtgtgtggcgaggcagagaagggagaattcgggctactgtcctggctgctctggcagagccaaggtggtgtgatacgtgagtttctcagtccattttccattcacttattctcatggcagatggtgatctcctttggggaggtgaggcccgtcactacttaatgtggcaaggttgcgggttccaacatcctgctctttttctactctacccctccccttgttttcaagactttgagaggaattttccagaatcaagctttctggctctccttcctcttttgctttcataaggacaaacactattcgggggagagggcggg

SEQ ID NO: 5599 - DNA, 1055 bp, Homo sapiens
ctgcagcctctgcctcccaggttcaagcgattgtcctgcctcagcctcccaagtagctaggattataggtccccgccaccatgcccagctaatttttgtacttttagtagttttaccatgttggtcaggctggtctcgaactcctgaactcagatgatccacccacctcggcttctcaaagttctaggattacaggtgtgagccacagcacctggccttacagtacattttctatgtttagatatacaaatacctaccattgtgttacagttgcctacagtattctgtagagtcacatgctgtacaggtttgtaccctaggagcaacaggctataccatgtaacctagatgtgtagtaggctctgccatctaggtttgtgtaagttcactctgtgatgtttgcacaatgacggaattgcttagtgatgcatttctcagaacatatccccatcattagccaacacatgactgtatttcttttcttcttcttttgcttgaccaataaattaggacatcttaaaacttttgagaaatacacaaaaagctcaagccatcctccacatcttttattttttttttaaggaagataaaacatattcattattccttaagtggaagtgaatcctcataaaggtcttcctctctgtcgtcttcatgttgagtagactgggaaggaggaagagggggctggtcttgctgtctcaggggtggcagaggcaggagaaagtaggtgtacctgtgtgattcaaatgtgttgttcaaggtcaactgtatatggttggctctcacgatctaatattttacataggaatcttatatctctgtctgtcataaataaaatgaacttaaaatttccttttcttttactttttgttttaccaatcaaggttatgctagcctcagaaatgactagagttgcttttattcttttctattttctggaacaatttacttagataaatcatctgaggtcaggagttcaagaccagactggccaacatggtgaaatgctgtctctactaaagatacaaaaaaaattagccaagcatggtggc

SEQ ID NO: 5600 - DNA, 1032 bp, Homo sapiens
agttacatccgtcccggcgcgggcggcggttccccaccaaaagcaacccagatcttccccgcacgcctctgacctgactgcacgactgtcacaagtcgcgagctggtgcaaactgcgagggccgggaaaggagacggggcacgcatgcaccaaaaagtggggaggcagagctgcagggtgtgcaggataacggagtgaattttaggagtctgcctaataaggggccgcccccaatagttttccctcgacttaggtaatgaattgcagatcgaaatgggtctagttttattcattcttctactcggggcgataaaggtttattgaatggtgtacatggtgagtgtgaaaaccagatgccagctgcccccagccccagtccacttcagtccagctccccggggctttcccgccccctcctcgtacccagcaccgcgggcctctcaaggttcccagtctttgggctaggggaggggagcaaggctcagttcaagtccaggtttctaagggattcagcaaagtggacaaggacgaggtgaggtgggaggatcagggaagcctcctccccgcgggtcgcccgggtcgtggcgggggatgggctcacgggtattatcagggagcagcctggcccatgtccttacctggactgcgcctgccccacagcgcgtgttaggaatgcagagtattggggctccatggccctaaaggagctgcattggtaggatgcactttaagcagcttcccaagggattcggctgcggggtccacggtctacactgggcaggactgcgtctctgctctcctcccggccagcacagttgaggtgaggggccggaattagtcggggaagctgtgccagacgtcccgaggggacaacgggacgaggggataacagcagccaggacccttcagcagggctgggcgcgctccaggcccggggcagggcggcgggagctggtgcaccgccgtcgccggcccgcagggggagctcgcaggctgcttcccggctcgcccaccctcctccccacgtggaag

SEQ ID NO: 5601 - DNA, 1033 bp, Homo sapiens
aagttgccatgatcagtggagcaaaggagggggtattagtactggtcaggccagtgcaggtttgtaagcaacaggtaaaagacagccttttaaagcaccaaactttgttttttgagacagggtctcactgtcacccaggctggagtgcaatggtgcaatcacgtctcattgaagccttgaactcctgggctcaagcaatcctgtctcagcctcctgagtagctgggactaggggcatgtgctactgcgcccagctaatttttaaaaatatttttgcacaaacggggtctctctatgttgcccaagctggtctcgaattcctggcctcaagcaatgcccccttggcctcccaaagtgctgggattacaggtgtaagccagggtacctggccttttttttttttttttttttttgcctcttaaaaacagtggaatgagacaaactgccagcttgtctttgctcaggatttagacaccatgggaaattgagtctgaagaaaggttgatgtggcactcaaatacggatagaaagactttcatctcagtagcgagttacgccggctgctggtgttctagcttaaggaagctgggtgggtgatgtcctagagaaatccctgccttatccctgggtagcccctacagtttatttactggggatgcattctgtgttagggtttgagtcagtgggggatacaggctgtgcgggctgctgcctgtctgtctgtgcattgcacaccatcagagaggttagtaacttaatctatccgggagagcaggagtaggaacccgggggtgccagcctctcactgtccaggtgggggattcaccatccatctggctgctgctttccataactggctccttgtgtcactgtatcccacggctgagtgttcaccagccagccttcagttttcttttggcttcctgtgtatgtttgcctgcagggaacgggccccagtaggcagtctccgttgtacactaatggtactgcgggcttgtagacagccagggcttagcccaaaggcactactcagc

SEQ ID NO: 5602 - DNA, 1032 bp, Homo sapiens
gcgcaggctgcagtgcaatgcatgcactcactgcaacctccacctcccaggttcaagcgattctcctgcctcagcctcctgagtagctgggattatacgcatgtgctaccacaccctggctaattttgtatttttagtagagatggggttttgccatgttggtcaggctggtcttgaactcctgacctcaggtgatccacctgcctcggcctcccaaagtgctgggattacaggcgtgagccaccacgcctggccgtgtctcatttctaactgtgggtgtacaatttcaatttcagaggagatgccctacctgaaatgccctcttcacaccgtcctgaaactgacgcctgtcgcttatggtgagtagcaacccctgccaagccctgtccccctgaaggtggccacagtagcttcttgtggccgtgggctgtaagcggtgctgtccctttaacagcagcttcctctgcccccatcccacgccctccaggctgccgtgtggaatccatctacctgaacgtggagtccgtctgcacacaccgggagaggtcagaggtgagtggaggccccaagcctcatcctggccatcatcacacgatagccctagtgggtgatgggcgctcaggaggccccggggccgcttgcctgcaggtgctggcctgtctggggccatgggcctgctggctgccttcctcagcacctctttgttcctgcctgtctgttctgtggcttctggggccttctcattttctttcttcctgtgtcctcttcctcccatttctgctgagctcgagatatgaatattagtgaggaagatacattctctctttttttttatttgagacagggtctcagtctgttccccaggctggagtgcggtggcgcagtcacggctcactgcagcctcaacctcctgggttcaagtgatcctcccgcctcagcctcccgcgtagctgagactacaggtgcgcaccaccatgcccagctaattttaatttattcatttttttagataatggggtctcactgtgttgc

SEQ ID NO: 5603 - DNA, 1124 bp, Homo sapiens
aagcagcatattccccgtgcctgattgcggcaaaagcaaccactctcttgtctgccagagactgcagtataatttgaacgttattcctaaaagcacagcccagagtttgtttctgcagcgttcgcaatgattctggaaggtgtttactagcctgtgataagaatctcttcttacgtaaactagccagagtgaagtctgttctttgccagtaaacttttaccctaattggtgtgattattctcaagaaaatgggcaatctggattgtcaatcttatcagattacgtgtgaaagcaacaaggatattttgccttcagaatatgggttacctgtttttaactgtgccagaaagcttaatttaaaataatatgatgagctcagggttgagattttcttttaaagaaacaggcagaggaccacagcacttccctgcgtgtgctcatgtcttgtaggcatggggctgatgcagctggcaatcaggcatggtctgtcctcatgggctgctgaattacagcacaggttctgcctttccagccttcccattctcgtgtgtgtgtgtgtgtgtgtgtgaaaataggacaattctgggaaagagaggattggaaagaggatgtttgggcagattcaaaccccagagaggctttgtcagccacagaagcaagccctcctcccctaaggcttaatgcaaacatctcacctgggtgatttctaacagggatcacgcttctcacacaggaccattctctcatggcctccagactcttgatttctctatccctcgtaactccagagccatatcccagcaaggctcagggggtaaatacggtcttacctgggaggagaatgcttacagactcaatgaattacaagatgttgccaatgaataccagcagaaaccagagaagcataggtgagaatgaatttttaaggtcataaaccaggaagaaaggaacgcaattttaggtgaggctgaatttctcaaattaggggcacttaccagagattctggattcaatgtaccagctcaaataagagagagtgattctaaacgttttctgggaaggttggctgaagcttgccctcaggaagtagctgaccagactcaaggactctgagactccagagt

SEQ ID NO: 5604 - DNA, 1029 bp, Homo sapiens
actcgggcttagttttcggttttctaaaggattaggaatgggatgtggataattcagtatcatttatgaaatctttttttggaatttaaacaattgtaagccaagctttctgagttacagggctagtttcagatttggttttacataaatctataaaccattgcatgttgggaaggtccaggaattttttaatcattatgttttttaatcattatgttttctatatcagtaccaaaagatagtatagccatccctcagtatctgcagtggattggttccagtactcactctcacctcccccaggataccaaaatctgaagatcctcaagtccctgaaataaaatagcacagtactacatataaaaaatgcacatcctctcgtatacttttaatcatctctagttataatgctatgtaaattgttgttgtattggtttttgtttttattattttatcattatttttgtcttttttccaaatattttacatcggctgttggttgaatccatggatactgagggccaactatatactgctttcctcaagaaaatttcttagttgttgaaaaactttaatgtttatgaaaaaaaggttaagataatgggaattttattcaaaaagttattaagttgaatacccactatgtgcacagtacagtgctagacacagtgttaaggatgtgattctctcttttaaggcacttatattctaataggataagaaacatacaagtaattgtgattagataaaacgtgtagtaagttctttttgactcgttccttcttacctcctgctaatcagttaccatgctctttaagttttaccttctaactatctcttgaatcttcccccttctttatgcccacttaatgcagatccttgtcatttctctcctgggttcaaaaaggtaattatttgagtgccccttaagtgtcaggccctgtgctagacactgaggatacagtggtaacagtatttgccttcagagagctcagtcttcacagtaaaggcagacactaaataagaagt

SEQ ID NO: 5605 - DNA, 1080 bp, Homo sapiens
gtggtaagtatttttgcatgatgtactcaaggtatcaagtttaacaattgactttttttcattggaaagcatatgtgattaactagcatggattgcttcttgacctgcttgttttgtgtttgtctttttcttctaatataataaccagggattaatgaaaatcaagttccatcctcagacaagaggtaaagttcacacattcttcccatgtctgttcagaaaagaaacctattcagatataagttaagctaatttagtaatcctagaattgtcctctgagagatttagatggatgggccacttcacagtagcagccaactcacgggagcacctgggcaacgctagtggacttttttgtagtgagtgtgttgatcatagaaaatgtagatataaggaaataaactttgaggatagagaattaacattattttgagatattatatataggttgtgaagagtggtggttgtcacactttatggtctctggaccccttaatgtctgattcatgtagcagaagccagctagattttcatctgtctctattcattttgttgtgatgtcatggatcatgtggcctctggaaaactctactgtatactcgagaatgagaatataacaggcaaaataacattatcatgaaaatagttttgacctcatgaaccccatgaaaggttccccagaccaaaattttagaatcactggtatagggtaacactttattgtgtaaattcagttctctgtaccccacttaaatatgtattattatctcttgacattattttcccaaaaaatgctgtttgatttcttacttgttctgtactttgtttttcaggtaaagaaggaaaattcagccagttgattttgtttttagcttactgctgcctttgtccgaagaaactgttcctccattatttgaattactgaagacagcaagatatttgtaaattatcttaaaataaacaacttaaaataaaatcattgtttttcttatatataagaacaatagatatagtttttgaaatgagatgatactaaaacatttaaaaatattaatatgctactattaaaattttttagta

SEQ ID NO: 5606 - DNA, 1408 bp, Homo sapiens
tgtctttttatgactggcttacttcacttagtatgatgtcttcagggttcattcatgttgtagcctgtgtcgggatttcgttgtgtgtttcgttgtgtgtttaaggcagaataatatatgtacattccacatttgtttatccattcactcactgatggacatttgggttgtttcaaccttttggctcttgtgattaatgccgctatgaacatcgatgtgcaaatctctgttcaaattcttgctttcaggtgtttttttttgggtctgtaccttgaagtagaattgctggatcatatagtaattgtctatttaatttttgaggaagcaccacactgttttccacagtggctgtaccatctaagcttcctatcagcagtgcccaagggttccaatttcttgcaattcatttcttagaatcggttctactttaatagcattttgaagtgttacctatttgtctcaggaagtatgtttaaatttggcataagttgttgtacagtctgtgtgtcagggttgcctcatctgaaaaactggacagctactggacctaagtggtagggatttgttgtgaattggtggctcatcatttaggtgctctggatcttagctgcagtgggttctactgaatgatactaacacaccgacagcccagaaccaaaactaggactttgatcataatctacacttaactatttggtccttcttgtcttatttttatagcatgcaaatattccataataaaattctcttaaagtgctatggttatcatatttaaatactagcaaggaaatgtaactaagataacaggtttagattaggtagtgaagaagtatgaaaaacaatttagtgttttttttgttttgttttgtgttgttttgatactgacttctggctgaaattactatattactatagatttttgggtttcttttctgggttatttgaagcaaaaaaagaaactcatttagttttatgcaaacaatataaattataaacattttaaaaggaaaataacaaatcttgagaacactacttttcactttttatctaacacatgtggattaagaaggaaaaatattgctgatttgtaatatatgcatatggtttataaggatgcagtaagtggtaggcagtacagtaagatgcttgtcaaaacgttctcctcttcataagaaaaggatataaaatgcaattctttggttaccatttaaaaatataaccatacaagaccatttcttgtcatttacaatctgaaatatttttttttcatgggtacagcatgttagaaagttcctggtattctgattagtggtgcaaagtgaggtacagaggtgaacccctttgataatgatgctgttcaccatgctctttattttccttttatttccttaagagccacagacaggcc

SEQ ID NO: 5607 - DNA, 1025 bp, Homo sapiens
gcatggtggtgcacgcttgtagtcccagctatcagagtctgtggtgggaggatcagttgagcccaggggtcaaggctgcagtgagctatgatcacaccacagcactccagcctgagtgacagcgagaccctgtctcaaaaaaaaataaaacacatgacagcgaatattagttctcgtcccctttttcttttcttgctcttaaataatttacttttgaattgaaatacaatatacattagtgaagtcacgctataaggggaatcggtgtcaagctgcattcagtggcacacccatagtcctagctacttggaaggccaaggcaggaagatcgcttgagcccaggagtttgaggctgtagtgcgcaatgattgagcctgtgaatgcccactgcacttcagcctgggcaacatagcaggaccctgtctctgaaaaaaagagacgaatcaatgtaaagtagtgttaccatcacgtgctgaggatctgagggaacagacttactagctgggctggataggtacttgactgaggagctgtgtgattatccgcagtgtgaagatgacagatgaggagatgatgtggaaggagttattgcctgctttatctgattatatgtttagaagtgagacctctttgaaaatattttatacatgcatatttttgcttggactgttacagttctgatggctggtacccagtgtgttttatccaagaacattctctccccagcttgccatacatattttcagattcacaccaataccatatttttttgcttcctattttattgtgctgaggaatgtctgaaaatagtacagcgtactatgccaaagtcattgttggttctcacagtgtggtctctagatcactggtcaatgggggtcttctgggggggtctgttgattggttcaaaatatttgcataagaaagaaatataggctgggcgcagtggctcacacctgtaatcccagcactttgggaggccgaggtgggcggatcacttgaggtcaggagttcaagacgagcct

SEQ ID NO: 5608 - DNA, 2419 bp, Homo sapiens
tccctccctccaaaaataaccaaccactgtcctgactttgtaggaattactccttagctttatagttttatcagccaaatgcgtatccctagacacattaatttaatgttcttcacacatgcacacctttttcactttacatgtcttttttttttttttttttttttttttttgagaaggagtcttgctctgtcacccaggctggagtgcagtggcgcaatctcggctcactgcaaactccacctcctgggttcaagcgattctcctgcctcagcctcccgagtagctgcaattacaggtgcatgccactgtggctggctaatttttgtatttttagtagagacggggtttcaccatgttggccaggctggtctggaactcctgacctcaagtgatccgccagcctcggcctcccaaagtgctgggattccaggcgtgagccaccccgcccaaccatgtcatttaccttttagtttgtgactctccttccattcctttctttgtcttacagtttatttgttagaaatctgggttgtttgatctgcagagtgccccacagttggatgttgcgcattgtgcactcataatgcagctcaatgtgtttctcaaaattggcagcaagaatctgaggcttgaccagatttaggtttggcaagatatcagctgatgatgtccagttttcacttttgttggtgttagcagtgctgatgctcagtgcctagatccattaattcattaggggttacaaagtaatgataatactatcactttgtttttatttcattctttagttgaaataactttataagaaaatccttttcctcatccactatttagtaacttaatggcatagtttatatagggaaagcagggttaacgcttgatttttttcatatggtatattcccagttttcatgagaataaattggttccttgttatccttagcaggtgactagtttcatttaatactctatcattgtgaactcacagatttaaacatacttgacggatttcattcattactttttttttttgagatggagtctcactccatcgccgaggctggagtgcagtggctcaatcttggctcactgcaacctctgcctcccaggttcaagggattctcctgcctcagcctctccagtagctgggattacaggcatgtgccaccacgcccggctaatttttgtatttttagtagaggcgaggtttcaccatgttggccaggctggtcttgatctcctgatcttgtgatcctcctgcctcggcctcccaaagtgctgggattacaggagtgagctaccgtgcccggcctcattacagttttttacccatattgtagctttaattgttgcatctttggccagtggcagcttcttcactcttgcttctgagtccttttgacacatgacccgaattggctttggtgacgtcctcaccttctggtatatcaaaatgttctagactcagcatgtatagtcatgttctatgcttggtataaattatctgtccaggaaaccctggtttcttggaaagtagtatttcttttctttttttaattttaattttttttaattataaaatttcaggttacatttgtatatatctggggggtgcaaagcgatgttatgttttataaatacaatgtggaataattaagtcaagctagttaacatacctgtcacctcaaatgcctatcgttttttgtggagagaacatttaaaacttactctcttaatgattttcaaatgtgtaatacattattatttttctttttcaccatgctgtgcaatgtatcaaaaaaagtactcctcctgtcagattgaggctttgtaccctttgcctatcatctctgtatccccacatccccacatcccctgccccagcctctgtaaccactgttctactctctgcttcttggaatttggttcttttcgtccacatataagtgagaacatgtggtatgtctccttctgtgcctggcttacttcacttagcagaattgtttgaattccatctatgttgtcacaaatgacaaaatttccttctttttttaaaggctgaataataatactttttaatttttatgggtacacagtaagtataaatatttatggagtacataagaattttaataaaagcacaccacaatgtgtagtaattacatcagactaaattggatatttaccacctgaagcatttatcatttctttcttatttatttatttatttttgagacagtctcgcactgtcacccaggctggagtgcagtggtgtgatctcagctcactgcaagctccatctcctaggttcaagtttaagtgattcttgtgccccaccctccccagtagttgggattacaggtgcccaccaccacacccggctaatttttgtgtttttagtagagatgcgatttca

SEQ ID NO: 5609 - DNA, 1030 bp, Homo sapiens
ccatttccacgttttcttttttctttcttttttttttttttgagacggagtttcgctcttgttgcccaggctggagtacaatggcacaacctccggctccctggttcaagtgattctcctgtctcagcctcccgagtacctgggattagaggcatgagctaccaagcccagctaattttgtattttcagtagagacggggtttctccatgttggtcaaactggtcttgaactcccgaccttgggtgatctgcccaccttggcctcccaaagtgctgggattacaggcgtgagccactgcacccggcccatttccacattttcttaccacgaatacacctgtgttatccatctcagttggtggcaccatctctactcagtcacctaagctagaaacatgagaattagcattgacctcttctctcattctccttcattccctatctctaattctgctaattttctttcttaaaaaatttccaaaatattattgcatcacttcctttgtttaaacctttatctcttgtctgaactgtccttatcctctaaacgaaactattagacaaaaaattaacacatcccacattataaaacactttgttggctctccaactgcttacagttaccaaaaatacctatggagaggagttttcttttttgcatcaaaatgaaaagagctttggttgagtgtgatggctcatgcctataatcccagcacttgggaggccaaggcaggaggatcgtttgagcccaggaatttgagaccagcctggacaacatagtgagaccttgtttctataaaaaatttaaaaatctggccaggcgtggtggctcacacctgtgatcccagcactttgggaggccaaggtgggcaaattgcttgaagtcaggagttcaagaccagcctggccaacagggtgaaatcctgtctctactaaaaatacaaaatttagctggacatggtggcatgggcctgtagtcccagctactcgggaggctgaggcaggagaattgcttgaaccagggaggtgg

SEQ ID NO: 5610 - DNA, 1056 bp, Homo sapiens
gcttctataaagagaaacttcctatcatctactatttggtttcctggtggtagagtttgtatatgaaaagctggatgaatgcttgatcccttttcttcattcatcagttttcaaaataatgaatttgtttcctaccttcttccaatagtcaccaactagttgtgcatatgttttttgaaagtatcattatgatctcatggatttaaacagatttgatagatattagtccatttattatccattgatgttcaaattgtcccatctttggcatatgagaccagtggtgtgttggagctggctcatacccatttttgagagtgagttggcaaatgttgtttaatattcagtcagtttataggctggttgttaaacacagcctttatttaaaaaaatcatataaacttataattaaataaattatactagaagcaaaggtgctcaaactccatcactttctagttatcttatttttgaggttaagtttattgtagagttgggtgaaaatactatataactgtgcctctgaacacctcccaactccacatgtgggggcattacattggcggcttgaaattggccattgtaggagtgtttacatcacagcagtcagcaaatgctacagatcatggcatgatttattgtcttttttattgtctagacgtcaggaggtggtggtgaaaaatgtagattaaacttcaaaatgtatagtatctgtagctgttccattgtaagtagtaccaaaaatggtataaaaatgaggaaatattcttcaactgttatctgattcagcaaagaagttgctcacatcattgacacgtgaaattctcacataccccttccttgttttgctttagattaaactagaggtcagcaaactgcctggcctgcagcctgattctgtaaataaagttttattggaacacatctctttccatattatgggtgactgctttggcactacaatggcggagatgagatgtgacagagactgtatatcccaaaagcctaaaatagttaccatctggtcctttaagtgtgctcttctgtagtctaaac

SEQ ID NO: 5611 - DNA, 1100 bp, Homo sapiens
cactgccttagaatttttctgtgttctacctattcttccctcccttaccccaacctgtggcaactactgatcattttattgtctccatagttttacttttttcagaaattaattgacagatatcatcattatatgttattactgtgtacaacatggcattttgaagtatataggcactgtggaatggttaactctaacaaatgcattgtgtcacatagttaactctttgtggtaagggcacttaacatccactctctacattttaaaaaaatactacagtatattattcttaaccgtagtcacattgctatacaacagatctcttgaaatgtgttcctcctatctaagcgtaataatgtgtccttcatgtacaggtttctgtgtagactcgtgttttcatttttcttgggtaaatgtccaggagtagaatggtggggttatacggcttgtttgtctttttattattcagctgtgaaagttctttacctatcctggtcatcagttttttatcatctatttgttttccaaatatttcctctcagcctgtggtttgctttttcattttattaacattatctttcaagaagtaaatgtttcagttttaaggaaatatagtttatctttttttttttcctttttatgttttgtactctttgtgccctaagaaatctttgcctagcctaagatcacaaaggtttttgtcctgtgttatcttctagaagttttatagttttaggttttgggtggctggggtgggtggctgggagaatgaatgtcaaaggatccctgcaccatttgttgaattccattgctatgggagaagcttggtagaaatgccggtggatttgtggatagagtgatgggttgaggagggagtcctcaccagtggtgactcatgggaagcttcagagggaagtgagtggggcctgggggtcaggagcttcaggagtggagagggcagggaatagtggttcagaaagtaggggccgggcatggtggctcatgcctgtaatcccagcactctgggaggccgaggcgggcggatcatgaggtcaggagatcaagaccatcctggcttacacagtgaaaccctgtagaga

SEQ ID NO: 5612 - DNA, 1058 bp, Homo sapiens
ttggattcataattaattcagagtgtaaaacaatacatcgtagaacaattccctattttgcttgttaatctaaagatttcacattatattctacttattttaaaaataaaaaatattctagaagatagtaactttagaaaaattttaaaatgtagataaaaaatgtttacagataagataaaagaaagatgtcacatataatcccatgaagaataatccttcctgacttctaccgtgtgtgtgtgtgtctgtgtgtgtgtgtctgtgtgtgtgtggagtggaggcaggagtgtagagacgcacacacacatacacacacataaatacatacgtacatagatgttgatttctttttccaaaatgagatcacaccatatattctgtgctctgatttgggttttctccccagcttattttattgtgaaggtctttccatgtctgttaacttatcctcatgggagcatagtgttgcattacctgtgtgtgccatcatgaatttacatagttccctgttgtgacatttagattgtgtagaatttttcactattttaacagtgcttttattaacattcttaatcacacacatccatttgcgttttctcataatttccttaagagaaattcctggaagaactgctgtgttgattgtcacctttttaagcttttgatacatatttcagttgccctccagaaaggctgtcccagcatgcacccctgcagcagcacggactgcctccttccctgtgcctgcatctgcagtgcatattatcctttttgatctttggcagactggtgaaaaatagttctgtcttgcatgcctttgattaccaatgaatatatttatgtttataaactatttgtactttttccattataaattgctctttaaaaattctttgcctcttttatcacgcctgacccctgggttttggttggcccagagattactgaactactttcgaccccaagttttgcatatttaaatttatttttagggatttcaggtgagcatctttaaaaaaattagataattaggagaaatgaaaacggcttgtatt

SEQ ID NO: 5613 - DNA, 1034 bp, Homo sapiens
acagaaaccagctgtgcatgagagggagtgagctttgtggcaggactgaatctagagagaatggtgggaggtaactgtggaacggccgatggatttgagagggaggcaggggccagttcctatggggccttataggccatgatatggaatggacttgggatttttttctaatctaaaaggagttttggtcaaggatgcagcatggtctaatttctcttttaacaagtgcgcttggcctgctctctggagaataggtcgggttctgaggccgtcaccggttgggggaatgggggtttgccccaccaaggtggccgtgaaagcctaacaagcagttgtgctactggactagatacggggtgcgaggagaagagaggaaatgaggaaagatgggaatgaagaaggaaatacttttgaagttatataagatgaaaactgaaaatggaccattggatttggcaagagagaggccactgtggaccttgacaagagcaatttgagtgtatggttggggcaaaagtctgactggagaagaccgaggagaggagtggaaggtaggaaggagcaacaggtacaggcactttcagtgtttagacatgacaaagagcaaacacaggaaggtagctgggccggggcatttgttagttctgttttgtttttaggattcggatattatggcatatttgtatgctcatggatggttagtgtggggataagtggaagaacagaggccttgagtacattggctgacttgggaagaggtagttctggttgtttttactaatgaaatgcgtaaaacaagaaacagttaaggactgggagtggggaaaggagaaggggcgtgatgaaggtttgaagagagacgagaatgtatgaaatggtcttcatgaagagtgggagagagaatgatccagggaagaggtgggattgccaggcagtgctgtgggcccatttggaatgtatgtttctgtgtttaaagagggtccaatgcagtgccacatgtagacttagagtaagggaagagtgggatttgacca

SEQ ID NO: 5614 - DNA, 1022 bp, Homo sapiens
aggcatattataaagtaggttacactgtgtagttgaaagcattgtgcttatgtcaaaattttcatctccacagaagaattttttttaagtgttctgcatttgcccctactgttagaactggagtcttgaagagaatatttattcttttgttgcaaagcaaaattagcagaaacttgaatttaatgtaataacagtattttaggtttggtttttaagggaggtttttgccttccagactgttctctatccacttagaaggatttaatttctaaatattagaaaatgttttatacaaagacaggtcttcaactatactgtactatagttatactataactagaattatgaaaatctcttcatttgtgttaattgagagaagtagtttattttttttgttgttttttttttggtaatagtcttctaaaatctattaatagactaccattatcaattcagttctttacagttaaggaatgattgtgtgaagtaagatacatacaaggaagtagtacctctggatggtaggattatggatgtttttgtttttgtttgttttttgagatagggtctggctttgtcaactaggctggagtgctcctgatcttggctcactgcagcctccatctcctggcttcaagtgatcttcctgtctcagcctccaggttagctgagactacaggcgtgtgccaccacacccggctaatttttgtgattttatagacaaactcctggactcaagtgacctactcacctcaacatcccaaagtgctgggattgcacgtgtgagccaccgtgcctggccctatatattttttaatgttcacattgcttatctgtataaaatataataaggttacattatttaatcaacattaccaataaataagaatatggagtactctttctgctcattttagatctaggctttaattttacagtggttctaaagtggtaagatggaaaaaaaaaatgtccaggcatgacaagaaaagagaacagtaagagtaggtccaagtaagaaa

SEQ ID NO: 5615 - DNA, 1035 bp, Homo sapiens
tctgaagagatctacttgtatttatttcttgcaaaaaaaaaatccaccatattaccatagccaggccctattatgctattgtaatcatagttgaaccaagaagagtgattaacgatagcaatttattgtatctgaggaggagagaaaataggagatgttgtcgttatcataaatcatatcataaataaccaaaaagaagcactcagaatgcttgtgtggtgtcagcagccagccctttcagacacgttagcccaggatgtagccatagaaaccccaaagtcatattgttatcttagtcttgctgcagttatgtgatacaacagtattaacatatagattaggccatttataatactaggtgtcatttcaggttggcttgcttatatagcattttagttttttattgtgcagaatgttagtgaaatagtacttttttacaggtcactgtgtatctaggaatttataatgcatcatattcactctactattaatttcttgtgttattgattggttgtaatgtatgaattgtcattgcctaattgtcttgtctttgctagtaatttcattttttaagtaaacaggtttattttaaaaatacatacccacttacacatgttgagttgtgttttaagggtctaatttctgttacattatagacaggacaattttaaaatattttataaggagatgtcaatggaattattttttagcctcatttagtactagaagatataatgatgaagtggattatgattgtttttgacgccatgcccttcttttccttcccagcatcgagtgcctgttttcctattatttcctgactgccccagcctcttctcctcagagtagcttcccagctgggcctgaccctgaccttcctggtagtaataccccgtgttctacactcacctaatcctcaacattccatcacgttgtttcacttcggttccattttcccagtcttctcacttcaaaaagtagggtagagttgttcatttgttagtttcatggtcttaaaaatattttcacagcaac

SEQ ID NO: 5616 - DNA, 1031 bp, Homo sapiens
gtcccacgtactcaggaggctgaggcttcacttgagcctgggaaatcgaggctacagtgagtcgtgatcatgccactgcacaccagcttgggcaataggagtgagaacctgtctcaaaaaaaaataaaaaaagaacttagaattatcttacacatactgttcagcagcttatcccctcccctctaacagatcatgaacatttttccatgtctgtatgacatggtatttcattttactgttgtatcatcatttatcttgccagtcaccagttttcaaacatttaagttgtcaaaggttttgctataacaaataaagaaacaacatcctcatatatagatttttgtttattcagtgttactaggtcaaagaatgtaaacatttaaaatgtttaagagattattatgccaaattatcttctaaaaggctataccaattaaaattctcaccagccgtacatgaggatgaaatgaccctatatttaagaagaattagtgaaatcctattgttctaaaattgagcaagactctgggcaactagtagtgaatttatatgaaaagctagatccattcttctccctcgtgggcctgtgagttcatttcatagaaatcctttcttctttgggggaagctattggttgaagaatagttaacatctttattcaggctattcccagatctcttctgaaatctgtaggtccttggtgctggctccgtctcaggtgagtttttcttcattaagtgcactactcatgtgaacataatactacagagaattgccttctctgtgatagtgtttgtgctttggagtacatgtatcaaattcatctgtgaaggaacctgggaaatattatgaatttagtcataatatttataagtaacttatgtttgtaagtaatgtttataagtaaccaatttttaaaaacagtttttaaggccaatatatttgatgttgttactgctattaaatcaaggttatcagggctgggtagggtagctcatgcctataatcccagcactgcgggaggatcgctt

SEQ ID NO: 5617 - DNA, 1145 bp, Homo sapiens
tcagctgtcacctgtttcttctttgagaggaattgttcttttttccctctagctgcctttcagatttttcctctctatctatgatattttatagcttcactttgatgtgcctagatatagatttatttttatttatcttgcctagggtgtgttgggcttcataaatctgtggattggtatctttcgtcagttctgtaaaagtctcaggtactctttgttaacattcgtctctgccccatttttcttctagaattatgatcaaacatgcactaattagaccttttattgtattctctttgcttcttaggctatgctctgaaaatttattttgtcctaatactcagtttatagttctgtcttgtttccaatctgttgttaaatccctcctttcaattttaaatctcagttactgtattttttaatttctagaaggtctgtttggttcttttcaaatccactagatcaagtcactctctgtgacttcctacgacctatatttctagcctttgccttttattatttttttaacattgtaagcaaagttgttttatagttgataattcttgtatctgtggtctttgtctcttcatactagctgttatttcttaacagttttccctgatcccaccttacttcctcatagatttgattatctttgattatgtgctgcttattttttttaaagataattatctgtattaatatgagacctagattttaagatacttcccctcaggattgtgctgtgtgcctgggcacattgcaagtccaaattactttaaagtatcctagaacaccagaggtgaaaattcatgccattctcgtgcatctttaccttatgggtatagcccattgggaatccttagtgtcgggagggagttctattacaccttccacttcgggcagatcctgggctttgacattcgtcctcttcatcataaccaaatatcagacttgcctaatgcgtaaatgcccttggggtaaagcatctgtgttctgcttacctctcagggttcctgcttttccctttagctttggttccatcacttgtgtgttcaaccagtatgggaaactgcctctagaagcagtgttttaaaattttagtctaaccataaaaatagagaatgcttaccctctggatataa

SEQ ID NO: 5618 - DNA, 1058 bp, Homo sapiens
cacgctgcatttttattcagttggtgtcattacttgcatgaagaaaaaccccacacaaaatactttggctttaaaaataaatcgatctatcaccaattccatttctaaacaaagtaattgagtcaaaagagagctagggattctctgatattgatttaactgtattattagacagggtttggtgaagattttgatgtctccttaggcgtgtccatttcagagtgggcatctcttctctgatcggctccaggtatcttgcctccgctgtctctctacagatcctatatagaaagcaatcgtgaaaatcacttgtcttttagggatgagatgagcagccttgaaaccgagctcccaaagctccggtttgaaaaacttcagagggagtactctgggagcccagtgaccatgagatcagttttcagggtttttttccagggtgacattcactccgactgcctgagcaggactgtctctatttagttgatatgttttagctaatccaattattttcagactgctgcacgcgacagttgcattgtttatcctgagccaggaactttaatagagtccggatgcggttaggctgacagaagaacccagacctgcatgttcagtacatgaaagtaggcaggagggagagggaggcaggctagctggtggagtcaaaaagaaagcaagaggccgggagagctggaggcacaaagtggccacggtgcctggcaggggctgggcttgggggtggagggaaggattaagaagtggggtgcagcttgactcagaaacacaggctggggagctgaatcgaaagagagcagacctatgcattttgaggttgtgatgggatttcttttctttttcttttttttttaaagttctcttttctggtaaggctatgaggttggggagagctcgtggtatctgaggccggcgtagtggtttgtgcggggggaggggacagagtgacttttccaagatactctggtttctttaccctcatttccgtgtttgatttctccccctcttgtgcacactttctgccttaagtttagtcttttctt

SEQ ID NO: 5619 - DNA, 1749 bp, Homo sapiens
ctcgctgtggccctggtgcagtgaatgaaactagagtcttactacgatcccttattctcccttaggtcctgggactgtggtctatatacatttatcagcaattcaatccaagttctattttcactttggggaatttgcttgctgactacagtagagatagagattcgtgattaaaatctggaaggcttgggcttataagctattaggttattagcattagggtttattagctatccagtcatcagcactgcctatgaaattatttttgggctgtaatttatggatttcaaagaactttcatgttacttgattacatttgagcctgagatagtcccatgatgtagacagggcagaaattatttttatttcagttttacttgagggagttatgactcagaaaagcaagtcgcttgcacaaggtaacgtggctgagaaagtataagagtcagggcccatttcagagtcaggaggctttcctgggaagttggcagtgtcagaactaagaggagaaccaggggaaagggaatgctctctttttttagagtataacaaaattgtaacaaattgtgtgtgtgtatatttcatccctatattcgtggaagtataggaattataggagattaactagctatatgtttttttgaatagttagctgggatgagatatgatctcacttgtgtctgatcacatatatatatatttctgaagaacatgaatttctcaaatcaaagtaaagctgaggaatcctctccatggctcacttctacctcctcaatcttaatgagcttggtcttcatggctgggctccagtgaatgggagacagaaacttcctcatcctcaagagtggtttttctgtcttctctggtttaccaggaatttgtaaaaggaggcgattgatgtgtattgaacaataagagataataatctattaacattgtcatcacgttgcgttttgctctgcccttccagacatctctacatggatgccataagctctttcttcttatctaggtgttgagataactgcctacctcggtatcagcatctctcagtggtgttgtgactggttatctggggttgtgtggctactggtgtaactagatattatatttagatacctggctatgtatagctagatatcggcatcagagctgtgtatctggacattatcttggtgaagatttgatgtgggagtagattcctgtcatctctgtaggctgcatctttatcttgatgataactttgaagaaggaacctggagatgttcctctggcagtgacctttctgggctctcctgccatcggtcacgttgccttcctgggcttggggaaaataaggtctcagctccagtgtggggctttgtttccttctccaggtgacctctcccagctcagcttcgggaagctgggtgttggctgctctcagcaggttggccatttgaattcttcctttcttagctgtgattttctggctttgggaacagacaggtaaaacccagagccaagggttctccacccttgagaactgtggcggaaggcgatgctttcagcccgggaagtcaggaatggccaggacactgacattcactccttgagtctgtttgccaccctcccctgggaacatggccagatgtggagtttgctcttccgggcagatgtctgctgttggggttaatctgcttctgcctccctgtggggagtaacttctgtttactttgtaaagtttcctttcttgattctgggccccca

SEQ ID NO: 5620 - DNA, 1159 bp, Homo sapiens
gggcggggaccgggcggggtctgggggtccgggtgaggactgagcggagcgcggcgtgacggggaccgggcggggaccggcgagcgggcacggggtccgggcggggtgcgcgcgtgcgagtgtgcacgcttgtgtcatttgaaatgcggggctgacggagctctggtggccggggggaaagagctcttcttaccaaattacccgctcatctgatttaatatttgcaaagatcctttcctaaggtgggagaggggaagcggagacaaggaagggcggggggataattataaagcgtgaaactagccaggtgtactttattgcagaaattagaggtaatttttacgtaatcatggtttgtctgatatgcagtctgtaatttaataattaatgtgattctggttgttttacatgtcgtcaaactaaggtagagcgtttattggaaagaagtagagagctgggattcctgaagaaaggaaagtatgtctaatttttagctggcttgataggaaagtttttattagctcggaggggtcagtaggatctatttgtatttcaggcatgttaggaaaaggaaacctaaaaagagagaaaagattgccagagtgggaacaaaaggtctgtgtcctttttcgacattttaagttttctctgatcaggcgagaaattggatagcggatctaagctgtaattaatctaatccagtgagaaaaaaatggattggtatggtaagagtgcgtgtaaaatgtttcctgttctacccactgtaggacttaacatccctattctgtctggcaccttatggtactctgcagtattgaggttattccaggctttatgatccatttccctggcaactaactttcccctgccatgctagattctttttctagcatgttaagtgttatgagttaagagattcttgagaaactctgcagtggccaattatttgagctgcaaggacctccccaccaaaaaaaaggaggggggtggaggagggggatgatagaatctgttatgcaaattgtcttttgagtcaatattaagaatgttaatttgcttgtacacgatcaggttcatcttttccgtattctgttttggtagttttctccgagatgtgaatcatgattagtaacatttccacgatatttgttttaagaga

SEQ ID NO: 5621 - DNA, 1784 bp, Homo sapiens
agcgcttcatttgctccattgttgactcaatcacagtggcacctcctcacacaagtcctctatttccaccctgtgaaacaaacacaatttgatttagatcgaagcatgataggcaaagttgagaaagttggttgaggtgcatgccttcttggggcaggtgcgattgcatccctgggacattatatgtctttacatctcccagctccacatagggcttagccaaaaaaaaaaaaaaaaaaaaaaaaattgcttccaggggccacccactacatcatgggctctttctttgtccttagaacctggctttggtaccagaaaaccatcctggtcaattttactcttgtagacacaagatgagacccagtttctaatttcagcttaaaccccttgaaattgttaaagagaatctagctggatggggtgactcagtgcctttcatcctagctactcaggaagctgaggtgggggaatcgcttgaggccaggagtttgaggccagcctgtccctaaaaaaataaaaataagagaatctgacatgttatatcttagtattttgttcattgttgagtagcattttaaaatctaaggaactgtttaatgaaatagatgttccttggttttggatggaaaactaatgagaggaagaatttatgatggcatcgttgttttgtttttaaggcatgaaatttacaatctacgtggtatctcacgatgttgtaactcactttccaggccccagtagagtccaaactcttggaaaatttaaagaaaaattattgtgatggctttatccaaaatagaagcagaataaataattgacgaaggttgctcaggaaacctatagaccattcctgattctctggtgtctgtgtctgacaggatgatatgtcaccaaataaatgtttattgggtcataattaaattgtgaacagttaatgtatatatagtgaattagatgttccccaatatgtatgttgtgttaccttttctaacataaatgataaactcaaatgtatgttgggttttggacagactattttgtactgtaatacaaagattaccaattaggtattaacattcatggagttaaaataactttggggtccaggtgaaaagctttctgagtaatacagtgcatcgacaagggtgttttcattgtttgtgtaaatgattgttacagcttttgaagcaaagcctctacagtgaaaattctgaggcatagacattcctcatcaaatatcactgtccagtggtgaggtgtgagggcaactcaatttgtacatctcatgaattctttctgtgaatcacaaatactgtctcaatgttcagggcattttttttttttttttttttagacagttttgctcttgttgcccaggctggagtgcaatggcaccatctcggcgcaccgcaacttccaccccccaggttcaagcgattctcgtgcctcagcttcccgagtacctgggattacaggcatgcgccaccacacccggctaattttgtatttttagtagagtcagggtttctctatgttggtcaggctggtctcagcctcccgacctcaggtgatccgcccacctcagccttccaaagtgctgggattacaggcgtaagccaccatgcctggcctcagggcacatttttgacaggttatttgttgaggcatctgactaactgcctgggcttttgatagcatggattcttagccaatcagcaaaatttattttaagaaaggtaattagactagaaccaaagtaaatttagcttttaaagttatctaat

SEQ ID NO: 5622 - DNA, 1009 bp, Homo sapiens
tgtacagaattttaattatggagcctagaactctgagccaccaggagaaacctatttaatgtatcttctatgtagcgacgcacttccaagcagttccttgttgttctggtctggttggtcgctctgtttttcctgtgtaatggtttttgttgttgttccttggttcaacaaatgcttttaaatgcctgcttatgtgcccgttaccatcctaggtgctgggaaaactctgcatcctcaaagttatatccccactcatggaaatgattttttatttccctttgattttgtgagttcttctcttccaactgatttcaccttctacctttcaggtgtttttccattcaatattttgaatattttttcaaattatcaaaaatattcaatattttcaatatttttccattattcagggctgcattaagcctctgtttagctccatctctgtgataggttgttctctggccagctgctgttctatggcctcctgccatgaatatcttactttggttgggctgctataactaaatgccatagactggacgacttaaacaactaatgtttatttctcaaggttttggagactacggagtccaacatcaaggtgctgacacatttggttcttggtgagggctctcttcctggcttgcagagggctgccttctagctgtaccctcacatggttcaaaaaagttgtagtgtccttttttcttcttaaaagagcactaattccatcacgggagctccgcccttgtgactacaactcaatctacttcccaaaggccccacttcctaacaccatcatgttgggggttaggactttaacatacgcattttagggggacacagtcagtccatgataaacagtggtggtatcaagatgtagagtaagatcccgagagagagagggagacactacctaaggcaagacttagggaaatggtagtacagtatcgaaacccactggctatgaataatggtgttggtgtctaaacacacatgcctcaggatt

SEQ ID NO: 5623 - DNA, 1131 bp, Homo sapiens
tggtggaaacaaacgcaagtgaatatgcggctcttgtgttcagggtcttgttgggcagccagaggaatgcatggacacaagattggctgtgtttttgaacaaatgtgggttagaggtagatgctatgcttaggtccttactgggttgaaagaaggcgtgtgccagagcacaattaagtgtgctgtacaaaatgctacattagagttaaacaggctttggggtgctgagtggtgaatgtcatttggaaaggctgaagatgatgtcttagaatttcacttgggcttcaagaaagatggacagtatattaatgggcagagtcaagggtggagttgagcgagaaaaatgataatcatgcacttaaattcacagttggtataattcccaaagactcatttctgtttttaaattgaaaatgaaaataccactttaaaaaaactagtcaatttactattgatatagaattctaagattttacctgataattagtaaaagtccctaggaaagagaataaaagaaaaaaaaacccacggtctcattttctaaggtctgcccagagaatgtgaaaattactgtctagagaatacagaccccgcaacaaagaggtcattatcgtcaaactgctaaggtcatcagtatatacgcttttaaataaacccaatgatcctcttaatatcattacggaaattctaggcactaacacattaaaagtatccttttgggatgttctgctattactgtatttttcaaaggctttggtttctgaaaatttctacaaatactctggctttattagttgataatacaatgatattctcagtatttgaatttactcgtttggcttttctttcatttacgtaaaatattgagaatatggcagtgattttatatttaatcatcatgctgttcttccccctaagttaacaaaaagaagaagtataaccttaaggtttagtagatactgtcgttgaagacattggaaatcattttccagttctttacagacaagaaaactagacccaaagtaaagtgctgtggtcagcagcacatcattgttcagtggctggcctgggtctagaagccagaccttttaactcctaatttgatgttcaccttttataccataatcctgtt

SEQ ID NO: 5624 - DNA, 1028 bp, Homo sapiens
aaaataaattcacagaagtagcaatagcttttacttaagccttccttccagtccatggcaaaaataggacttcagtggatttcaagatacttgcccgactgtgctaattctaaagtaatcaattaaaagagaaaggcattagctggttcttctttgtataagaaacaaatttaaacatctaagcaattctcagttcataaggtaactttacttttcctatataaacagtttctgctatagctgaagatagaacaaatgcatatgctattgaatcttttagcaagttacatggctctaaaattggacttcttttcaggcatcgcaagcagaccattgtctgtagctttcatggagatgtgtgtgatttgtccttgaaactcggggccctgttctcctcccactaccaagttcagccatgctggtggcttcagacagcgtccttggaactcttgacttttacatccttatctcaagccctgcttttttcttgaatgccagtaattttggattggaaatctcttcctaggcaaccaaattcaatgtaaaatggagctcatttccccctttctttctccatggaagtcttataaaactcaaccaagcatgccttggaatcatgcctcactcctttttctctctcattccccacagctcatgaaaccctcagccctgtcagttttttctttctcaatttaaaaattttcctttcttttcatcgtttatggacagaccacttctcccttgcacagttggaacaacctcttcagccaccttctacctctacacaaaagttactgatgtttctaaaacctgagtctcatcttgttactccctattcagaattctccagtgcctctcctttgcctaatggttaatgcatcaacttctcagcaagtcctaagggtgcctcacaatgcggctgcaatctcccttttccaacctcttgttgagtgacttctgtacattcttcaccccagctagtcacccatttatcagaattcgaaaaaaatccacgctttgccagagcc

SEQ ID NO: 5625 - DNA, 1044 bp, Homo sapiens
ttggaaacgcagcactgcaatgagcattttattgaattctttcaaaactggaattacagaacgtccagcaaggcccttttgggagaagggttataaggttggaagataatcagctcagcctctcccactctgagtaccattcggttaggatgtactctccacccttttccatcctgctacctgcctctgaagtgggagctgtcatttggaagtgatttgaaatacttggatgagataataatatgtggcatttattaatggagtgcttttttactcaggggctcagactttctgggccttctaatgtgttaatctacatcttcttcccactgcctggttttacttacttttaaaaacttctgtgattaaaataggcaaatcgaccaaacaaaactgttgaacaacttccctgttcactaggttaggtcatctagtgatatttaaaagtaaagtagcttcatagagtggattctgttgcgaggcctttgttactgataagtgtttgtcagttgtagttaaaaatgattcataagaaaaagcttagtttttctttgatctgcattcaataaaatgtgtctcatagactgagaaatttttcttcctcccaacatagcccaccagttctagaggaaggctattgtcagtcacaaagaggatttatgtttctttttttttccctaatgggtaactgttgttgcttatggattggagaggattctaaatgcttgtctgtctgatatgaaggcagtctctcttttcacataggcaacgtgccctatgtcgtacaggttagagatgaaatacgattgaaatcatgtggatgcatcttcctgtgctatgtctttcctacaggcagagtgccccaagttcacgttggatacgccgaaactcagcgtgtttccacaggcaatttaagaacaaatcaatacctcagacagtaatacgtcttagaaagagatttctcatataagcaatggaagttttatcttttgaatttggttgacttataataatcaaatgtttggaggaggagagacctattct

SEQ ID NO: 5626 - DNA, 1025 bp, Homo sapiens
caggtcttgagcgctagtgccacagctgggtgtgctgataacttggcaaaatcagttggtggttttcgagctgtggagagaagagtgcctggtgagttcagcgaagttggttggatgtccagtggtggtcccttcacttgttaaattcagtgaagaaagagaccctgtgctccttttgatgacatggccaagaaaattatcagaatttgtcaaaagaaactttgaacaaaggtattaggtagcgtctattaaaaattcatcagtaagttgtttatgtcagtcggagaagtacactgaacatcatagtagaataatttattcattcgttaaccaacacttacacaacacctaaactatggtagatactattttgaacggcttacagatactattatatttaatccacatgacagtcatatgatttaagtggtatgatcaccctctttttagcgataaggaaacttgggcacagttaagtcatgtgcccaggatcacacagctggtaatggcagaactttcacgtgaacctgagcggtctggcttcagaatccacactcaagccactatgctgtgctgcttctgagtaatacaaggcaatgatttgtaaatcacagtgacaaccagtgataacctattttattcctttatatcatcccgctctactcacatcttttaggctcattaaaggatttagttgaatgccaaatgtgtggacttagaagaactggctttgaattccgacatttactggctgtgtggctttggaatagtcacctttctgagttgctttcttcattcaacgggtgtaacaatataaatcctgctgatttcacaaaagtcaaaatgttttgccctgtagaaattggttaggtatcattcgaaaaagccagtggctctccaggaatgaagatgctcaaggaggccttgctgtctacctgtgctaccagctttcctgtgctctgcagcagctctagaggccactcctttagacctaggtccatcttgaggtgttgttatacagcctc

SEQ ID NO: 5627 - DNA, 1027 bp, Homo sapiens
gtcactgcgaaactggaccaagtttggacagaaagaaaagaactttgtgacacctcattcaagaccttgaacattaggttgtagaagctactaaacaatgaggaatataagagcagtgacaacgcattgttcatcattgtgttctgaacacagtgcatgacaccaagtaggttctcaggaaacagttgttaaataaaaaaaaaaaatctggtgggaaagattaaataatgggactatagcaaggtgtcagatagcatcagctatacaagtctgtgttgtctttctagagagactgtgacttacaaaattatccttttaacttcccaccctttcaacttgtcaccttttaaccttttcactcagaatcctaaaggatgttcttgaacaaaacataaaaatctgctttatttcttagtaatcttttctcccaaaaaaggaaatttttccttcagttactttctgtagcatctttccttgaactgtgctgtagttcacaattccatagtctcaacttgtgtcttcagaatgcatcaaacttacataactcttgtcacagttgtcagtttctctgacctgctaaaatttcagtagcacctgtttggctgtggaataggcaaggatggctgtggactctggcaatcccattagagttatccagcaccccagcatcgagggaggtggtgggctccatcaatccaggtaccatgagcttggctgtggcgctgatttctctaaagctcataatcttccacggtcagacttagcaagtggagctcttccttccagaagcaaaaacagattccctggaccacattacaagaaaaaattttacgaccaagtgaagtcatgtatttctgaatgtcagctaaagcctcatttagagccgttggctcatgcctaattttcccaagaaactggcaatttaattttttttgctgttgttcaggttgacccaccacatttaagccattctagaggggcctttcacctgtcccctcttaaatatagatagatatttttgaatatt

SEQ ID NO: 5628 - DNA, 1059 bp, Homo sapiens
actaaagtttacttctggattcatgatacattactgactgaaaaaacaaactcccaaaagggaacaactcattcattgctcccatgtactccacccatcgcccttatttctcccggacaagatgacaaaaacaatcacaggtagggaaaaacccagcaggatacttagtcagcattaacccaaacaaagccgaagagtttaggcagagtcagttgttgcattgaatgacagcaaattagatggtacacaaatctcgacatttgatacgccactgtgtgaaaaccagagtaacatctcagctcatccctgaggaatgagccagtctgatgagctaagtttgcagtacagttgaaagcttctcctttaaggcaccatttctctttgttgtctcattttgaaggaatgcttcttacaacaagttatatatttcccggcctccttaagcagaatttattgagcttaatgtgaccccttggatgagacaagcttgtgattatacaaatgaataattgcgctgtgctgccgtccttgggaatggctagggaacacatctgagcccctgctgcgagtgggcttttcaccacgaggctgcttcagaccctggtgtctgccctcatcatgacatgggcctgcctattgcagagcctcccttttgtttgctcctcgtcttctcctgcaggtttgaaatgcaggtgatcaggctgtggaaaaccaacatgagagatcttggaggagtgggttgaagagttctccagagacctcaaagggcatgagcatccggatgggaagtttgtgacatacgtttctgtctgctctaagatcatttttttctttatgctgactattcacaaatattggagtttgaaggcatttttgggaaaaagaaaaatacacttgaatgtaataaatacatatccctcttcacaagtggattctgttttctctctaaacaactaccgtcattaatatgacataattagctcccatggactgtcaacttttgattttccagatcagtggaaggagacagtggcgtccttaatctcaagtgcgttcaca

SEQ ID NO: 5629 - DNA, 1027 bp, Homo sapiens
cggggtcggtgcggatgaaacagtaacagcctcccaccccaaattactgcttgccctgtgctaagtcccagggttctttcgtttgtacagggtcaagttatcttccatctagtcaaacagcattgtgtttttacatcaagaatgttggagaaagttaatatttctcccactgcatttaacattgaaagtgcaaatttggaaaataggatttgtctccttccttaaaaagatgagcaataacaaagaaacataataaaggctcaaatgtggtctcctaatgagagatcatggctttaggggaaggtaaacaccctggtgtggatgcacacccacgaacctagatagatggctctgtacttttagtctgtgatttgggtcatggcctttcagaattttgcacaaaagcattccaagagtgatatgccgttacttcttctgtattgtctgatagaatcatttgggagtgcatgttctgctgtattatgtatactgtatctttgtgtatgggtgatcttttccggaggtggccttgtggtgttatctgaagctgtgttttcatattttgaaaaaagatattttcaattttatttaatatgcaaaaaacttttttcttgattgagcttctgttttccccccattttgttggggttttatttttttgtttgtttgtttttgtttgttttttgcaatgctgcatctcccaaagcatgctgggagctaagtgatcattatgcgtcatgttttgtgggcaactttttttatagtgaatcaaaaggtgggtgcaaaggggggaaggagtgtgcatggcattgtcattcagtgtttactgtacttttctgacttgtgataccagcattgcaaagcctattgtctttttcgaacattgatcttgactttgatattcctaacatatcttatataatcactgtgttttcctttcagtgcaatgcatttttaagacactcacaaccccctacctgaaggcaagctcaggtgaaaatcgggcatgataggcgataatgagcag

SEQ ID NO: 5630 - DNA, 1009 bp, Homo sapiens
agttacggtaactgctagactacagagagagataattagtcacgctatgttggtttcaatagatctaacacctggttgttaaaaagagtaaattgattaattgttttaaggcagcagtgttagtgagtttccccagtgtttatgtttcttaatagagattggacatgaatatggatttacagccccagctctggggaccttcagtccatcagtagggagtagcaaccaaccctggaaatgcagagtaaactgaatttgtccccagtttaatgagggagttactttgctctcaccgtctccactttgcccttgtgtgttcatccgcagctcctgcagcaggccacctcctccagcaacctgggtgcgttcagcggcattcaacaaatggcaggtaagtcaggaagcacgcctctccttttgaccgtgctattgtcagaatttggggttggttccgagggcaaagacaagaagcaggggaagagaaccaagaatgatgatcagacttgttagctttctgtctttggtgttaacgttggaaccgcctgctctgaagtgtctctgttatttcttaggttacctacccaccttcgctgtgcatgaccgctatagaatgaaggggctgagaaatcctgattggcatctatatcaacaaatgattatatcaacgactctctagtcatttgttgtttttataaataagattgattactgggggctttccatccagattcctatatctagggcagccaaatgattgacagccctctaaaattttaataatagacagtcaataaaaatgttctgacctccgtaatgaaagccaggattgcaggcctatctttgatgcagtttgcagccccttgataacgacagacaattaacagggtgcctttttaccgtagtgccccagttgacagaatcatgcatcagaagcttttatgtgaaagtggaatctttgttctggagaaaatcaaagtgtgactgtatttgaaagccagctcgttgaagg

SEQ ID NO: 5631 - DNA, 1025 bp, Homo sapiens
cctctcctgtgaaggccagttgaggattcctgacccgctgcagaagtcgcctcaccagttctgtgagcgcccctcctcggaagactccatgcctggaacgcccaagaaacagccagccctcatctccctcagctcatatttatgcccttttgtgccgcttttaactttcacatggtgctcatatgggtgggggagagtcaggagaggaaaagcgagggcagcttaggagcacgcacctctccagccagcagggccaagatctccatcctgcccttgctgcctgtgtttactgggaaaggataggtggacgggcagagcttggcttcctcggtctttgcccagcttctacatccactgcattcatctccaaggctaacgcccaggagagtcattcctctcaaagtcatgagactcaggctaccttctttccttgccttgactcactgccagtcatttctaataaagatgattattagactgtgtgttaagagatttggcaaatcaaaactggctggaaaactaggcaaatgatagagaaatcggagcagcattactgctacatccattattgtcaattgttacaattttttagaatgcacagagcacccttttttccttctcacagcctgtccgtacctgagaaaatacggccacccaagaaaaacccatgccaagattatctgtccccattctgcccactgtcaccttcagccccatgaaaaggtgactgaaatgcatatgccaaggggcagtggcacctgtgactcacagaagactgtcagtggaaaggaagccattcgtaaccagcatctttggaaatcaggaaaatctgaaggatgattgctttcctgaaaggcactccagcacttgacatttatccatctgtttgtttgttcaactaaatgcttagcctacctgttgttaaagtattcctaagaagggactttggaaactaagactcaagggataccttactctgactttttttttcctccttaggtccagagggggcaaacctctttatt

SEQ ID NO: 5632 - DNA, 1175 bp, Homo sapiens
tcaacttagcagcttaacaacaacacaaatttatgatgatacaactttggaggtcaaaagtctacaatagggctcactgggctgaaattgagatgtaggcatagttgttttgaaaagattactttgcaacttgagtaatcttttcaaaacaaaaatctgactatttaatgtggagaaaaagtcttaaacttctgatggaagaataaactggtaagatactccttggatagaaacttggcactacttagtaaagttgaatattctcttacttatattttttatataatttccataatttaaagataccttttaggccaggtgcggtggctcatgcctgtaatcccagcatgttgggaggccaaagcaggcggatcacttgaggccaggagtttgagaccagcctggccaacacggtgaaaccctgtctctactaaaaataccaaaattagccaggtgtggtggcaggcgcctgtagtcccagctactcaggagtctgaggcacaagaatcgctcgaacccaggaggcagaggttgcagtgagcagagatcatgccactgcactccagcctgggtgacagagagagactctgtctcaaaaaaagaaagaaagaaagatactttttaatgccaatttcttcaaaaaaaaaaaaagtctaagattgttcactgcactgctgtttataatagtaaaaacctggaaacaagattgttcactgtaggccaggtgtggtggctaatgcctgtaatcccagtgctttggaaggctgaggtgggaggatcgcttgaggctgggagttcaagttcaacctgggcaacatagcgagaccctgtccctacaaaagaaaataaaaataaaaattagccaagaatgatggcgcatgcctgtagctaagacaagaggatcacttgagcccaagaaatcaaagctgcagtgagctatgatagcactactgcactctagcctgggggacagagcaagaccctgtctctaaataaaacaaacaaataagagccacctcttcaacatacacaaatttcaagaacaatgttgagccaagaaccaagtggcatagtgatacatacagtatgtggtcctttgcttaaagtttaaaaacctgtttaaacaaaaaaccaataccacataatatacatatggacccacaaataagtagtaa

SEQ ID NO: 5633 - DNA, 1032 bp, Homo sapiens
gctggaaagaggagcgatgcttttaggaaggtctgagcgtgtttgaatctgtggttgccgggggtgggggagttgcccattaattcattcaggaatatttgtagactgaccacctacagcgcgcagagccgtgactggtcgtccagcatacagtcatttctagataacagccacatggcccaaactgattaaaaccagatcaagcaagccttcatcggcagctgaagagatacctggccttggttccaaagttcttagacacccaaggcgcccagagttggcactgtgtgttgatttggaagatcatctcagataactccaggagtggagcctggaaacctgaagggggagagaggaagggcctgcgtagagcagagctgagaacaggggagcctctagaacttagaagttcaagtgcatcttatctgcagtgttgtggggcagctgccggtggcacagaggccattcgggaggtgccaggggaatcctaggagcatcccagaacctgagctctttcctttgacggtgaaggccatcgttgcgtttcactttcctttgcacttggtggcttgcttcctaggtgcctctgtgctctaagaagagggccttgcaactccgcccctgattgactgcagccgtccccgctccactctgaggggtctcctggccaccataggaaagcctgtgttcatggaggcactgccctctgcacgggttatgtccagccagtggcatcaacagcctctgtctgcggaactcacagtgaaggtgccgctttccataatgcccttgtcccctttctagactggcagcattcatcttgaaacctaagagtattttaagaaagttggtgctaggtttctaatctgtgcattcaggattggcagggaaggactgtatggggagagcattctgccttgtcggacagggatgggagagctcttcgtgaacgtgtctcttcggactaggtattgccagagactgtagcactgtgaagagttcatgctgtttatcttttttattatagtcaaa

SEQ ID NO: 5634 - DNA, 1053 bp, Homo sapiens
atgctgaagagaagctaccaagtgcttcctttaagtgaaaagatgtgaaagttctgaacttggagaagaaaaaaaaatcaaatgctgaggtcgctgagacctactgtaagaacaaatcatcttctgtctgtgaaggtgtgaagaaggaaaaagaaatttatattagttttgctgtcacacttcatacgttcaagttatgaccactgtgtgacaagtgcttagggacatttgtaggtagaagacatgaacacgagctccgattgctggcagacgggttgggattggtgctgtctgcagatccaagcatccactgagggtcttggaacataccccctcagagaagggagaactgcagcaatataggtacatggggttgtcttcagacccagcctggacctgtttttgtgaagtgtttgcaatggcaatgagttgcgtaacatagacatactaagcaagattggttctacatcacttggttaaggggaataatttttccattcacgttcagaactaccaaagacagtaatgaccttgtgatttggttgaagctgtctgtagggaatccaagtcttataagacacgatttctttccctcacatttcctcggtgcaaaacctaatagtagaatgtgagaaacttcatattatttgttccagcttagattcttcagtaaagtgcgttgggttaaccgttccctggttagttttgagctgaactgtgatgctagaaaaggttaccttcggggtttttcctcttcctgttcgtacacccttgcggtcttcggacttccctcctgaattgccccggggtttctaggtggtgcctgtcttttcttccctcattagatcataacttatctgcctgtatcatctcctgacatactgggtctttcaaaggctccaaggtgctgaaatgacctgataaatcatttctttaacctccaggaaacctttcctttctgtgttggtagcagccagactcaggtgccctccggtgagtgaggcgggcgggtgtctattttagaacaatcaggtcatgcccccgacacacact

SEQ ID NO: 5635 - DNA, 1043 bp, Homo sapiens
tggcttccagggtccggcccgtcggccaatcaggcgcgggggcgttgtctgggggcggggctccggccgcctctgacgagtcccggatttaccagggccggtgggatcccctcgggctcccgccttagcatgctggccgggacatctggtgaacatggcctctgctactgcggcagcagcacgacggggcctcggccgggctctccctctcttctggcgtggctaccagaccgagcggggcgtttacggctaccggccgaggaagcccgagagccgcgagccccagggcgccctggagcgccccccaggtcggggatggggcccgggcggtgggagcgggggctgggacgcagaagcctcccctggccgatttgcggtggggtgtcggggtcggggaaccggctgccggcctgaacgcgcggccggtggggaggagggggaggtgaggggagcagagggtaggtgtgggtgctcagtgttggggtcatcccccgtccatcctctgtaactgaggatctttgaggtccacgcttgggtggtcttcccatcttgctggtccggacctggtttcggaagggcttttctttcctttgttggaaacgtgtgagaaactctttttttctttctctttttgtttccttttttttttttttttttttttgagacggagtctcgctctgtggcccaggctggagtgcagtgctgcgaccacagctccctgcagcctcgaactcctgggctcaggctatccttccacctcagcgtcccgagtagctggggacacagagggatgaccacgcccagcttttttttttttttttttttttttttcatttttagtagagatggggtcccaccatgttgcccaggctggtcttgaactcttgagctcaagctgatcctgcagcctcggcctcccaatgtgttgggattacaggctgagccactgcacccagcctagaaaaccagctctttaatgaggcggagctgtgggagaagtaaagttttaaggtctcccaaggatacatttccaggaccatctc

SEQ ID NO: 5636 - DNA, 1011 bp, Homo sapiens
caacttgacctcatctttcttcttgggccttcctgaaagtgacaagatacaatgaacatacgctcctgagctacaggcttcaagggcatgtagtctgcctcagtcctgtcctacaggacaaaaaccaaatgttttgtcctgtagcataacactgcccatcagctttctaggtggaaatacctgtgtccttggtacccattgcctggctgctaatccaatgccatatatatttttaggctctgttagggcagcaacccacctctggtaccaaattctgtattagattggaagagttcaggtgctgtgatatacaaagagaagggatatcttctttccttccccttacggtcatgacccagaagttgcatacattgctgctacgttcccattgtccaaaacttagtcacatggccaccaggttatggggaaggctgggaggtggctctttgttctgggtggccatatactgggctctctattactatcaaagagagggttcagaatggaagttaggaatcgtagcagtctctgccacagaggtatagtaatctgagatgagcaatccacctttatctttttcacctcatatttcacatcaaatctttttagtttttattttttaaattttatttattaggccgggcgcggtggctcatgcctgtaatccctgcactttgggaggccgaggtgggcggatcaccaggtcaggagttcaaaactagcctggccaacatggtgaaacctcgtctctagcaaaaatacaaaaattagctgggtgtggtgcagacgtggggccaggcacagtgactcacgcctgtaatccccgcactttgggaggccgagacagacagatcacttgagacagggtcttgccatgttgcccaggctggtctcgaactcctgtcctcaggtgaaatgcttgcctcggccccctaaagtgttgggattataggcgcgagccaccgtgtccagccccaaataatttatacttcctaaggaatgaaaagaggg

SEQ ID NO: 5637 - DNA, 1045 bp, Homo sapiens
agagacagggtttcaccatgtgggccaggctgatcacaaactcctgacctcaggtgatgaggtcaccttggcccgccttggcctcccaaagtgctgggattacaggcatgagccactgtgcccggccattcattaagtctggatgctttttcatcaatcattcttctacaatattattttttaatggctgtcggcaatttgagatgagttaatgccattgcttgttcctcagaggatgggtttataaagagagaactaatgatagggagatgtcaatgaagaatgaggagggcctacgtttgtcttcaagattggagggtgcgggtgagggccactgagtaccttcacgtcgtactcatgctctctagggacagccaagttctgattaaacccaggagtgtgaggaacgttcagagaggtttgtttttcatgaaacagagtgccagaggtctcggtggaaggaggtggagacagagagggaaggggttggagatagggttggtggaagaagaaacctgcccgaagaaatggtagtctgagggagcatgtgttgccagggtgaatggaggacgtgcctgacatgagagaggacttcctctttctgctggtgccaaactgctacatgcctcatgttctttgtggcaaggagggttattttgtgccaacttctgtgtcagtattctagtgtatcattagcagcctggctagtgagtacttagaaatagaagcagtgggccagtcacagtggctcatgcctgtaatctcagcactttgggaggccgaggcgggtggatcacctgaggtcaggagttggagaccagcctggccaacatggtgaaacctcttctctactaaaaatacaaaaattagccaggtgtggtggcacgtgcctgtaatcccagctactccggagactgagatgggagaattgcctgaacctgggaaacagaggttgcaatgagccatgatcgtgccgctgcactccagcctgggcaacagagcaagactccacctcagaaaaaaaaaacaaaaccaacaaaaaccc

SEQ ID NO: 5638 - DNA, 2040 bp, Homo sapiens
gatcatctttgacacattcatctctggaggttggtgtcagcgtatagggtgggtacaggtgggggtccctgcgtggccccagcctcgtggggacaaatgaatgaaaaggggccactgctgccttgagactcccgtgtgcggcggcgcctccagggagttggggtcaccctgttatgacgggagtgtggccactgtcaggttaatgtgttactgggacaaaaacccaagctctctctcagcaggagcactggtgccacccagcacctgtgctcaggggtcagtagggccatgaaaacccgctccagtgtctgaaagcttccgaagcagtacctgctcaccgtaaaaattagaagtaattgaagtaaacgtctaagtcttctccccagaccctgaatcccattttccagggatgcccactcttgggttttgaatacctgccttaaatctttcctatagttatgcttctctgtaacattttcactgggaggaagaaaagtgcctgagggcctggacttctgacttgtccagagactgttctgtcgtgcccaccaccccctgtttcaagacagtggcctgtgttgtcagctgggctgtgagagctgcccattctttttcttttctttttttttttttttgagacggagtctcgctctgtcacccaggctggagtgcagtggtgcgatctcggctcactgcaagctccgcctactgggtttgcacgattctcctgcctcagcctcccgagtagctgggactacataggcgctggtcaccacgcccggctaattttttgtatttttagtagagatggggtttcaccgtgtcagccgggatggtctcgttctcctgacctcatgatccacccacctcagcctcccaaagtggtgggattacgggtgtgagccactgtgcccggccgggagctgcccattcttgtaagagtggtgcctgcggtggtattggagcggcatgtgctgtccaggaagctgggaacgttcccctttgagtttgtcttccactcgtaaaagcccagggcctgtgccgtgataggttatggctttcttttttgagacggtgtctcactctgtccctcaggctggtgtgcagtggcatgatctcaggacactgcaacctctatctcccggggtcaagtgattctcccacctcagcctcccgagtagctgggactacagacatgtgccactacagctggctaatttttgtatttttagtagagacggggtttcaccatgttggccaggctggtctcgaacacctgacctcaagtgatctatccgcctcagcctcccaaagtgctgggattacaggtgtgagccaccgtgcctagcccatgataggttttcattcaatgaaatggacatttccctaagtatagcataacagttctagaaggtgcatgtaatgaaagcagttttggggggccaggcagaaaactaacattgatttccccagctgagtcgtgtcaggccactttgtccccgcttcgtagagctcttactccccacgtggtacttttccaggagaggccaagtggctcctacaaagcggcatcgtcatcctccttccacatggctacgatggggctgggccagaccactcatcctgtcgaatagagcgtttcctgcaggtaagggtaacgtcttccggagtcaatgaatcattttcctgcttcctagagcttttctacctcctgcggatagcttaacgcccacctaactgtaacacagcttagtatttgagtgaaacagatttgatgcaatgtcaattttctttggaaacgtaatgcctcaggtataattgtatcacggttttatggcaattaaagttctcttgtgccaggatcagcagttcttataccaggctgatcatcagaatcccccagagagcttttttatttttatttttttttgagatggggtctcgctctgttgcccaggctggagtgcagtggtgcgatcttggctcactgcaacctctgcctcttgggttcaagcgattctcctggctcaccctccaagt

SEQ ID NO: 5639 - DNA, 1072 bp, Homo sapiens
ctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgtctccccaacactagcaaatctaggtcctactaaatacaaatctctgggtggatgatcttctagtactgtatttttaaattaaggagttttagttataatgaaattgatttgtagtct

SEQ ID NO: 5640 - DNA, 1040 bp, Homo sapiens
aaaaaataaaatcttgtcatttgtagcaacatggatggaactggaagtcatcatgttacgtgaagtaagtcaagcacagaaagacaaaacttggatattctcactcacatgggagcttaaaaagtggattttggccaggcgcggtagctcatgcctgtaatcccagccccttgggaggccaaggcgggtggatcacctgagctcaggagtttgagaccagcctggccaagagggtgaaaccctgtctctactaaaaatacaaaaaattagccgggcgtggtagcggatgcctgtaaatcccagctactggggaggctgaggcaggagaattgcttgaacccaggaggcagaggttgcagtgagctgagatcatgccatttcactccagccaaggtgacaagagcaagactccatctcaaaaaaaaaaaaaaaaaagtggatctcatgaagatagagagtagatcggtggtatcagaggtcgggaggggaaggggtggggtgatgaaaagaagtagattaatgggtacaaatatatggttggatagaagaaataagacctactgttagatggatcggtaggtgaccatagtttaatcagtaggtgaccatagtttacaatatctactatacattgtgaaatagctagaggagaattcaaatggttctatcataaagaaaagacaaatatttaaggtgatggatatcccaaatacaccaatttgatatttacaaattatatgaatgtattaaattatcacatgcaccttgaaagtatgtacatctagcattcatcaattaaaaaaccccaaaagctcttactctatagaaatagtaattcattgtcattttatttaaatctgataaagcacaatctaaagcagactcctttcctcactgctaattgcaattttatttatttatttatttatttagagacggagtctcactctgtcccccaggctggagtgcactggcacgattacggctcactgcagccgcgaattcctgggctcaagtgatcgtcccatctcagcctccca

SEQ ID NO: 5641 - DNA, 1085 bp, Homo sapiens
gcctgggtaacagagtaagactctgcctccaaaaaaaaagggagtccagtgtgtgagccaatcggggagctcagctggagctgagcctgaagcctcaagcagcattgttcatctgggaaattgtggctgaggatgctggacagtgagagtagcaaggggtacaaccagtcgtgaggtttcttacatttaggaacagtggttgcctcttttttggaaacacttttttcaggcgatcctcccacttcagcctcctgagtagctgggactactggtgcgtgccacaatgcctggctaatttttgtagttttgtagaggtgaggttttgccatgttgcctaggctggtcttgaactcctgggttcatgccatcctccctcaaagtgctgggattacaggtgtgagccactgcacccagcctggacatactttaaatcgatggcagatttttttttgatgtttttaggttataaaggtaatattgatttattattttaaaaatgcactagcaatttatatacagatttatatgaagctgaaaagaaaagtgtcacttctgaggggagctctggaggatttggtagattggtgactatcaattgaggccttttctttgcacatacattcacttacatatatctatatacttcttataactgaaaagtaagatgtcctgtatatactattctgctactttgtttacttaatatcttacatgagctattaatggccatgttattattccattataaggatacgctgtgatttatttgatcattcattcaacaaatacttactgagttcatattgtgtgtcagcctttgtgcaaggtgccgagattagagcagtgaacaagacaatgtcccagttgtcatggagttgatatttgctgtttggggaggtacctggggtggggaaggtgctctaggaaggtgatctttgaagacagctgcaggaagtgagagaggaggccacatgaagacctgagggaggcatattctagggaagagccagtgcaaaggccctgaggtgagcctgtgcttggtgtgttcaaagatcattgaggaggggccaggcgcaggggctcat

SEQ ID NO: 5642 - DNA, 1047 bp, Homo sapiens
ttgtttccactttttatgaataatgctgttgtgaacatatttgtacaaattttgtgctgctcagctgtcttccaggttggctgctgtagtccacattcccaccagcagtgtatgaggttccactgctgcctgtcctcgccagcactagctctggctttttaatttcagccatcctgatggatgcgaagtggggcacaatcacagctcaccgcagcctcttgggctcaagcgatcctccccgcctcaacctccagagtagcttgggaccacaggtgtgtgccaccacggccagctagcttttttttttttttttttttttttttatctgagatggggcctcactttgtcacccaggctggagtgcagtggcaccgtcttggctcactgcaacctcgacctcctgggatcaagcgattctcctgtctcagcctccctagtagcagggattacaggcacgcaccaccatgcccggctaatttttgtatttttagtagagatgggtttccccatgttggccaggctcgtcttgaacttctgatctaatcatccacccgccttggcctcccaaagtgttgggattacaggcatgagccaccatgcctggtgggatccagattccttcttttgcttgggggcatcctgttgtcccagcatcatttgttgaaaaggcactagtatttttccttaaactttttatttatttagaacacagactgcagagtagtatgatggatctccagctccagttgtcaccatcttgctgttcttgtttcacctatcactgcctctaatcttttttgagtattttaaatcccatttttcagttttccaggtgattctaatgtgcagccaaaggttgaattactgaaatggatcctcaaaatcttatgacataaatttgttcatacctactcttcattccacaagagggaacgaaaggttactcatttaaaaatcttaaacattttaatatttaaatctgtccaggaatctcatgtcctgtaagattacatattgtctttcttggctgttgactggttcctggaa

SEQ ID NO: 5643 - DNA, 1046 bp, Homo sapiens
ggggccccatctctacaaaaaaataagaaattagctgggcgtgttggcacacacctgtagtcccagctgctcaggaggctgacacacaaggatggcttgaacccaggaattggaggctgcagtgagctatgatcatgcctctgcactccagcctgggcaacagagcaagaccttgtctcaaaaaaaaaaaaaaaaaagtatcaggtattctgataagtaatgtatttggggtttaattaatcactgtgagctggggtcatccagaaagtgtttacagtaaggtgatacttgaactgagcccacacactgggtctgacgcaggtggtacctcccttccaggcactaatcctcattgtttcttcttggtcacgagttctttcctgaccttgtctcccttaaggctgaatagtaaaatgagttgagcatccctaattagaaaatctgaaatctgtccagatgggtgctgagatagtgacatttttgctttctgaatattgtataaaattacctttgagccatgtgtataagatgtatgtgacactgacacataaatgatttttttaaattttttaatttttagtttttgtgggtacatagtgtacatatttatggggaacaagagatgttttgatccaggaatgcaatgtgacattagcacatcgtggagaaaggggtgtccatcccctcaagcatttattcattaagttgcaaacaatccaattacagtctttatttttagatgtacagttattattgactatagtcactctattgttctgtcaagtagtaggtctgtggtcgggtgctgtggctcatgcctgtaattccagcacttttggaggctcaggtgggcagatcacctgaggtcaggagttcaagaccagcctggcccaacatggtgaaaccccgtctcaactaaaactacaaaaattagctgggcatggtggcaggcgcctgtaatctcagctgctcaggaggctgaggcaagagaatcacctgaacctggaagatggaggctgcagtgagccgagatcgtgccactgcac

SEQ ID NO: 5644 - DNA, 1047 bp, Homo sapiens
cccgatagggggcagcaatcctctttacagggtataaatgaaaattaatgactgcgtggagaatctgttaatgtttttgtttttttatgtctcttgagggccctacttccccctctcttacttacctttttttctttcttatgtccataagctcctgtgatagtgacctaggctcaaggcaggacataatgacatcaggcttaagttcctgtttaacagcagtatttctattcacttccgggtcgaaacaaacacagaacgttttggtcactagcttatataaaatatgcattttaaaaatcatccaaacaggaaagaacgttttaccttgactaaggttcacattttgagttttgcttgttttaaaacttgtctggaaatagcagtgtttaaatacagtttgccacatcatttatttttcattctctccgtggctttggggaataccatatggctaagactcttcctgcaagtggaagggcttctagctcttcaagtagggatgttatttctgacaactagagtattgctacaggtgatattccacctgtctattttctcttgatgaatgctggttttatgtcggtgtacagagaaccattcactccttcctcacatcctcagaagcctagtgacttgtgtcatttcagctttgcaggctttgattgtctggaaaatgccatttaagcagctgattattttatttctctttttggtaaatgtactttatcactgattttatttagctgggttcagaaattctgatagtaatttgtattctaaattctgtttttaacaccctaaactataaccttgagattttgatcttgttttatatatatactgtgatgatattgacgtgcccaatgatttcttctctctctgtaggcaccagaatttcctgagtttgccactaaagtccaggaagctatcaattccctcgggggcagtgtctttcctaagcttaattggagtgccccaagggtaggaacacataagtaattctcttactgtttgaatattctttgttttgctgtttatttcatt

SEQ ID NO: 5645 - DNA, 1026 bp, Homo sapiens
aaattatatctgctatgatttacaatttctctacttgccaagactgggctctgtggcagatttgacttaaaataagatgaatcatgcttcaaggctcattagattttatgctttctattataagctttactcattgcattctaccagatcagtgattgatgcccgtttcactagtactttgctcagtgactcccatctttcccatagaaccagtctataacggggaactggttgagatgatattggcgtttggtttgaatttttaaatataggggcttatggttggggaacagagaacagtaaagcaaagttatataaataaaacattgcaggatgcctttttatgtttgaagttttgaggtttagaagcatgaagtcctcagggtcatttatattctgctgtctttgattaaaatgtactttaattttcaaaaggagatttacattgtgaaatattagttcattaataactgactttttttctcctttacagttgtgttcgatatatacagagacagtagggtaagtaaaaactctttctgatatgctttaatataagagctggttttataagcaggcagagcatgcctttgttatgtgtgtgaaggatccatgctcaaaaaatattttgtctgggtgcagcagctcatgcctgtattcccagcactttgggaggcttaggcagggagatcatttgagctcaggagttcgagactagcctgggcaacatagtgagccctcatctctactaaaaattaaaaaaaaattagcccaggccaggcacagtggctcacacctgtaaccccagcactttgggaggccgaggtgggaggatcacttgaggtcaggagttcaagatcagcctcggcaacatggtgaaactccgtctctactaaaaatacaaaaaaatgagccaggcatggtggtgggtgcctgaaatcccagctactcaggaggcagagattgcagtgagcggagatcacgccattgtgctgcagcctgggcaacagagcgagactctgcctc

SEQ ID NO: 5646 - DNA, 1033 bp, Homo sapiens
gaggctgaggcgggagaatggcgtgaacccgggaggcggagcttgcagtgagccgagatcgcgccactgcactccagcctgggctacagagcgagactccgtctcaaaaaaaaaaaaaaaaaaattattattattatttttagtcaactaaaagtgactcaaagtttgagttacttttatctttagacagaagaggattagtttattttttaaatcttaaaagtgatgaaaacttctgtaaggaaaaagttaaagtgacttactagtaaagttacttactgctgacttaatgaagaattactagagcagagatttcactgtccaagacatgtcatctttattaagaagtttaggtcactaaatgctgtttggtgctgagtgctctttgacattgtgaagaagctagcagatgcgttttcccgtgtcacctacacacaagcagaatatttctcattctctctccgtgcttagatcagcctcattgtaagtgagacagtcatttgaatctgaatcacctttggacatcttcgaatcatctttggacaaaaagatatggcccatatgatcatgtcccagaataactgttaactgttcatttaactcttacgtcaaaagacatcactatattttcacctctttgtcttcaaagatgatggtgtctgttaagagttactagaaagaggggctttaggccattgttgtggctcacgcctgtattttcagcattttgggaggctgaggtgggaggatggcttgagcccaggagtttgagatcagcctgggcttaacataatgagacctcgtctctacataaaaattagccaggtgtggtggtttgtgcctgtagccccagctactcccgggagctgagttgggaggatcgcttgagactgggaggttgaggctgcagtgagccatgatcatacatgtcatgcctagcagtgaacaccaggttgtgtctggtcttctgcagtctgccatggtgaataatcccgtacgtgtgtcatttcacacgctgcaggtgaatctacag

SEQ ID NO: 5647 - DNA, 1056 bp, Homo sapiens
ctccagccaaaataacctattcccgcaacaggcggtcgtggcgtggcctctgtacgtgagagccgtcgttcttgttaagtggtccgcttttcctgccaacaccaccctcctcccagggcatctctgttatccctcaggtgcccaggtcctttgggaagcatttccagccttccctcgcacatgtaggcaggctctcctgtgtgcctctccgctctcacagttccctgttcttgcctctcttgaagcaaaataccctgcacattgccattgttggatggcttttggttctgttttggggaagtggagatgtgtgttctgctcaagcctgagctcttggaaggagtcgattttgtgttacgatcttcatgcccagtgcctaacacagtgtctggtccctagagcttgatcggggcagggagacagtcagctggtacaaggacagttagtccgactgctctttgcttattggattgcctcaaagcagaattaacttctcaggctgtttgtgcttgagatgtcacatgaaaacatgttatggccgggcgtggtggctcacacctgtaatctcagcactttaggaggctgaggcaggcaggtcacctgagatcaggagctcaagaccagcctggccaacatggtgaaaccccgtctctactaaaaatacaaaagttagtcaggcacagtggcaggcgcctgtaatcccagctacttgggaggctgaggcaggagaaccacttgagcccaggaggaggaggttgcaatgagctgagatcgcgcgactgtactccagcctgggcaacagggcgagactctgtctcaaaaaaaaaaagttataaaatcctgatcctgatcctcctagtttatagaagttacagctgggttttttttaatttacttaaactctttttttttgtactagaggatagcttctgagctacagagtacactaccaattaacagtggtggtttgttttcatttaaaaatgtgttttgggctgggtacagtggctcacgcctgtaatctcagcactttgggaggcctaggcgggcagatca

SEQ ID NO: 5648 - DNA, 1100 bp, Homo sapiens
gtgcccgtgtgctgggaggctctggaaacgggcaagcacacagccttgggcttctgggctcccctggggagggatttctgaatttgaaggtgaaattctcagagggactttgaggtacctcctcttttgaggtcaggagttcgagagcagcctggccaacgtggtgaaacctcgtctctactaaaaatacagaaaattagctgggtgtggtgctgtgcacctgtagtcccagctactccggaggccgaggcaggagaatcgcttgaatgctggaggtggagattgcagtgagctgagattgtgccactgcactccagcctgggtgacacagtgagactccatttcaaaaaaaaaaaaaaaaaaaaaagaaaaggtgaagataacaaacttcagtgtccttattgattagtaaaatgagatttgggaagtgggagtttgggtagagcttgttcccagagaagctaatgatgactgtgtctcaagtacaaatttctggttcgaacttggccactgaatggacagtaattaggtttgctggtgccaggtggagatttgtgtgctctcaggggaggatttcaagggttaacttgttgagttttcctttggctgggtctctgtaaatctctttaatctttcctttccccaaataaatctccttaaatccccttcaatctctctcctcctgcttctcctcctctctcctctgggagggcttaggcatgggtccagcggagatttgtcacattactggtcaacttgcccaccggggatatgttttctttttttactttttaagtttttattttattttctgagacagagtcttgctctgtcgcccaggctggagcgcagtggtccagtctcggctcactgcaacctctgccacccgagttcaagcgattctcctgcctcagcctcctgagtagctgggattacaggtgtttgctttttttttttgagacggagtctcactctgtcacccagcctggagtgcagtggcgtgatcttggctcactgcaacctccgcctcccgggttcaagtgattctcctgcctcagcctcccgagtaggtaggactacaggcgcgtactaccacgccc

SEQ ID NO: 5649 - DNA, 1844 bp, Homo sapiens
ttgcagtgagccgagattgcgccactgcagtccgcagtccggcctgggcgacagagcgagactccgtctcaaaaaaaaaaaaaaaataaaataaaatgtttattgtccgggcacagtggctcatgcctgtactcccagctacttgggaggctgaagcaggaggttcacttgaggtcaggagttccaggctcctgggagatggcacagttccaggctatagtgagccatgatggcactgctatactctagcctgggtcaaacagcaagaccctattaaaaaaaaaaaagtttgttgggtaaatgaatggataagtggaaggaaaggagcataggctttgattagattcatgaagttcaaatcctaactgtgtcattcaggacctatgaggccttgggtgagttacatcatctttctgagtttctcttctctcacatttaagtgggggtaacagtacctacctttccagcttgttgtgaggttttgttgcaataacaagaataatagtaaggactgtaggctgagcacagtggttcacacctgtaatcctagcactttgggaggcccaaatcattccactgcactccagcctgggtggcagagtaagaccctgtctcaaaaaaaaaaaaaaagaaagagtataacacatgctgcgattacaggtgctaaatgaaaggacgttgactttatttatttatttatttattttgagatggagtcttgctctgtctcccaggctggggtgcagtggcgcgatttcggctcactgcaacctctgtctcctgagttcaagcgattctcctgcctcaggctcccgagtagctgggactacaggcatgcaccaccaagcctggctaattttttgtattttatagagatgggttttcactatgttgaccagaatgatctcaatctcctgacctcgtgctctgcccacctctgtctcccaaagtgctgggattacaggtgtgagccaccacacccagccaggattttggacaattgagagacagattccagcttttgttattgcaacaaaacctcacaacaagctggaaaggtaggtactgttacccccacttaaatatgagagacgagaaactcaggaagatgatgtaccttgccaaagggctcataggtcctgaatgacatagttaggatttgaactttaaaacaacaacaacaaaaccatcagataggatggattgagtctactccatgccaggcactaagaaagtgttggtaaacaaaacgtggttcttgtcctgagggaactttttggggagacagaaaaacatgtaattacagttcagtgtgactgtgtatcggtaggaaggtgcacatatgaagctgaaaagagggtcatctcatcgggatgggggctcagggacagtgagctgggctgttgcctaagaaagttccagaagtcagaaattacatagcattgctcagtgagtatataatgagttgctatgtgtcaaagaggacgccggcttctgtaggataaaggaatatatagttttaataatatatttaaatagcattatgttggccaggcgtggcggctcacgcctgtattcccagcactttgagaggcccaggtgggtgcgtcgcttggggtcaggaggtcaagaccagcctggccaacatggtgaaaccccgtctctacaaatacaaaaattagctgagtgtggtggcgcgtgcctataatcccagctactcgggaggctgaggcaggggaattgcttgaacctgggaggcgaaggttgcagtgagctgagatcacgtcattgcactccagtctgagtaacagagtgagactctgtctcaaaaaaaaaaaagcatt

SEQ ID NO: 5650 - DNA, 1082 bp, Homo sapiens
tcttcaggcttcaaggagaggtgctcagtgcaggagactcagcttctgcccagcaccacagggtcgagggcttggagcatccaggtggtttcatccaggcctgagtgagaacgtgacctagttactgtgcctctctgcacgttggcagaataaacagaccttgcttccttccctactcacagcaagcagaattctgctgagcctctcggaggctggagggccggttttagtaacgtgccctttcctggttggcgaccgtccagttattttgggtgaatgttaatggccgtgagtttgaaagttgtagttagatgaaaacgccctctctggacacagtgtccttgtcacctactgtctgaaggtgcttcctttttggggaataggattgagagcaaaatggtcacaaaatctgtggctttggattgtcatttgattttttttttttgatgccttctgtctgcatttaggtcagtggaagggatgaattcatcataggcacttgtagtagaacatctccttgagcctcaaagagaaggctatttttcctgtgggtcatctttgtgctgtgcatgggaggtcctgccccatggggcaaggtgagtttaacttttggaggtggctggtgatcttggggggaatttaatttgaggacatgtgcatgaccaataaactgttctggaggaatgaatagtcctgtgtctcccatatttttaccttttataaagcgcttgtactgcacggtgtccttattctaggctgatgcaaaattttcatactgcatttgctagtgatttgcaccagtggccgaagaactataaagtagttgtctctattttttaaaaattaaaaaaaaagatggggtcttgctccattgcctagactggtctcaaactcctggcctcaagtgatcctcctgtctcagcttcctaattgctgggattataggaacgagccactttgctcaaccttagtttctgttttattcagaatggaaggaatttctcatataagtagaattctagagctagaagagacattgtatctctagctctgtctctgtctttatctctgtcactatatct

SEQ ID NO: 5651 - DNA, 1034 bp, Homo sapiens
tgtattgactcaatgcccacattactaagcgcccgtctttaaaaattagccacagtctagcacgtataaacagataggacaattaacacctgaaattgtcttgttatataagtgaaaccagtgaaacgtcattaatcaagaccctcatacatttggaatgccaagtgacagtcaacagggttagaccgaagttggctggagccagtatctatgagacaggagtttgttgagcaaacccgtgatatcagcatgacatggtcatattgtttaatctgctttacaagaacaaacacttagctttaatattggcatgcgttgttaaacatttattacaagtacttcttatcaggaccaacgagacttctgcttagcaataatttgccagccctttaaagttgtttatgaatttcagagcacttaaatggcgtttttatgtgaaggttttgaaatcgacgggagaaagggcaaatgcgagcatctgatttgtttgtaccagtgctgcttggaagaggactgggctttgaggagacactcagcatttcttgtcgcgtgtaggattgaatgggtgcatcaatcaaatggtgctgggattagcggttggcttgttgggaagaaaacagctcattgtgtttctcagtggcagttccattggcaccacagccaagatgatctttccttgctcaggtttgtgctgtgcactccggacattcagcttccctgactcctaccccgtggaagtttgtttctgacttgtttccagatacccctggggaaacagctccctccctggttcaggaccgtcatgtcgcgccaaacaccaaaacaaattccaggtattagaaagttcagtgtaaaaacccataaaacaagaagaaaatactagttaatatctggcaaaagctttttattgttattgtttttttaattaagctgttggccagatgtggtggctcatgcctgtaatcccagcactttgggaggctgaagtggatcatttgagctcaggagttcgagaccagcctgggcaacatagg

SEQ ID NO: 5652 - DNA, 1037 bp, Homo sapiens
accggagggagggctctgactagcactgggcggtggagagaagcagaactcacttgccatactctgtgtcagtttccagcaagagtgaagttctgtttttccggtgggttctgccctttccttatcagttcagctgagcttactccagggcttcccctttgctcccagctttccagggcatgttctgccaaaaatgagctttgccttgggtgtgtctgattgtgttgttggtagactccctaaaaaccttccggtgctagcgatgctgtagacggctgagacccatggaggtggttgttaattgtcactgggggcccggggtcacactgcttgggcctgcatcccagtttaatggtgggactttggacaaggttcctcaagcccccgaagcctctctgtcctcatctgtaaaatggggacagtggcagtacttgtctctcatagaacatccatgggaggaacttacctcagtgcctggcatatagcaagttttcaaaaaatattagctgttaatattatttttattacctagacgcaggatgatggaccctatgaccttctgagtcttcttccatctgtgtgtgtatgtaagacagaaaaagagactgagagagagagagagagacaaagaacaggagaactacactgtggatttgggtgatgctccagggaggtttgaacagactgtcaatgtcatgttttgaagagagcaaggaattttggggatactgctgtgccagagaaaacaggttcgagagaaagaaaacagaggcgggatcccttacagagcaagaggtaaccaggagttgtttaggtggcatccagccaggggaattgctcagggttctgcagagggcagcctctggggctccggctggggtggggagatggcttggccctgggctgttggcctgggaactggggttcagccacagttgagttccaagcctcctagtgtttcctctacctcctggctccttcagaaatgagggctgggggaggcccgaggctggccatctggggagctgtgtaagcaa

SEQ ID NO: 5653 - DNA, 1058 bp, Homo sapiens
gttcccaagagaaaggagggagaaggagctgggctggtgccctccatcccctcctggccagctgggtaagtctgttctcttgccttgggaggaggaagaggtaggagggcctggaggagattcctctgtagacattgggaacctgctccatcttcactcttgccctcttcttgggacctggtatccccagggacccagtgccctggctccatttgaggatttccaccctggggcagctcttttcctgtctcagcttcacagactaatttatttagagggggcgagagaaatgagataaattctgataatagtggcacttaataaatattaattgtcattcatatacatgatatgcatttcttgaactggtaaatctttcaaagaatttattttacaatttctctcaaactctgaatatttgtggagtaaatgaatataccaatcctttgttgcattgggaggcagagacttgaggatggttatgtgtttgtgtgtgtgtgtgtgtgttggagagtgggtcagagacgaagtgggacagggagctaaggcttctggaagattccctgggggatgtccatgttctcagtgtcccgggggctactctggccgatgggccttcgaccaccggggtcccaggaaccagagcaacagagacattggggatctgaagcagcacatgtgctgggggccgcctccttttccaagtggccaatagccccttaattgagggagaggaaccatccaggttcagaggcaaagcccacttgagagggaaggaggagagtctcgtggagcaggcgagtcaggtgggcgatgtttgcggatccctttgcaagcctgttttcacagtgttttcaggtgtgttctgagagcagcgtatggaacccgacaatgacctttgttcacattaatggagcagatgattgcattgcattttttgggttcttaaaaaaatggtaatatgtattattgtaaactgaatttacaatatttatacaattatttatattgatttatattgtataaatatacagtgtccagtttttctcacatctagc

SEQ ID NO: 5654 - DNA, 1039 bp, Homo sapiens
gttcacggtttgggggataagccaggctgtccaagaagccatggtgtcttcctccgtgactcatttctctacaggtgtacgcacatttttctaggtagaaaagtaaacttgtggaaagaagttttcacgcaggtgttcagtgttctttctaatgagttcttgctgggtttagagccaagtgataatgcagctatttactttaaaatggtttgaattgcatatccacaaatccacaccagatttgctgcctgtgaacgtgtggtttctttttgttgatgtcgtcgtttgtttaatcctggtaggacctcttccagggcaaagccacttggtacagcaacggggtgggcagccctaaagcacggcagagtgcaaatttcagagagtgcctcgaatttcgagcttgaatcagaatggtcaagatacctgggattatgttaaaacttaggaggcaaatctgtttgtgggctctgtttttgactggttccatgttctgttggattcagaacatggcacattgtaggtgggggccacttttactgagctttcctttaaatatgtctatagagtggttagaagtttgatttgttctgggacccactctcagttaggcctgcccgccctcccaccttgcctgcctgtctgctttcctgccttcctgccctccttccctccctccctccctctctccctgtttccttccctccctccctccctccctccctctccccctctctccctctttccttcccttcccttcctgcccctcccttcccttccttcccctcccttcccctcccctacccttctccgtccccccttcccgtcccatcccccacccctccccctcccctccacctcctctccccacccctcccccctcctctccccctcccctcctctccccctcctctcccctcctctccttctcccctccccttcccctcctgctcctcttcccctcaccctcccctccccttcctttcctttccttccttcctcttttctctctccttttctttcattttctctctctctctcc

SEQ ID NO: 5655 - DNA, 1097 bp, Homo sapiens
caatgtatctggactaaaatatgcccctccctcccttccttccttttttttttttttttttttaatatagctttaatgggagactggagcctgctgtttctcaccccttgtctcccgggtgacagtatttggtgtacaaagctagtgactctgcaattgttgaattagctacagattaactcctctgagaacttggtttccgatgagagtgaaacatgtactttgtatgcagaactcttactcttcaaacaggacttattaactagaagaaacttcactttgtacttgaaaaatggaatgtaaatcataaaagattgtaccatttaagccccactagaaagagaaaaacagaagtcatggagaaccacatcctgttcatatggaccccagcctaagaagaatgcaggagtgtgtggagagggtcctatggggaaccccaggaatggccaatggtgggaaattaggttctgggaaatgtgtgtattgttttgaaaagtattattttacctggagaaattgaacaactgacatcagctaacatatatttattattgtgttgaatggccagcattctgtgggggcattgtgcttttttcctttattttattttcataggtttgggggaacaggtggtgtttggctacatgaataagttctttagtggtgatttctgagattttggtgcacccatcatctgagcagtgtacactgtacccagtgtgcagtgttttatcccttacccatccccaccctttcccccaagtctccagagtccattgtgtcattcttatgcctttgcatcctcatagcttagctcccacttatgagtgagaacatacgatgtttggttttccattcctgagttacttcacttagtattatggtctccagttccatccaggttgctgcaaatgccattatttcattcctttttatggctgagtagtattccatggtatatatataccacgatttccttatccactcgttgattgatgggcatttgagctggttccatatttttgcaattgtgaattgtgctgctataaacatgcatgtgcaagtatgttttttgtacaatgacttctttttttctg

SEQ ID NO: 5656 - DNA, 1050 bp, Homo sapiens
ataccaattaaaagagactgttagagtggatttaaaaaaaataaataaatgaaacaagactaggccaggcacggtggctcacgcctgtaatcccaacaatttgggaggccaaggcaggtggatcatgaggtcaggaattcaagaccagcctggccaacatagtgaaaccctgtctctactaaaaatacaaaaattagccaggcatggtggtgcacacctgcagtcccagctactggggaggctaaggcaggagaatcatttgaacttgggaggcagaggttgtggttagccaagatcacgccactgcactccagcctgggcaacagagtgagactccatctcaaaaaaaaaaaaacaaaaaacaaaaaacaagacccaactataagtcgttgacaagaaactcacttttaatataaagacatatataaattaaaaagatggaggaagatatgttatactaacactaatcaaaacaaacctggagtagataacattaatttcagacaaagacgtctcagagcaaagaaaattaccaaggataaagagggacattacataatgataaaggggtcagttctccaagaagacacaacaatcctgagtgtgtttgcacctaacaatggaatgtcaagacgcatgaggcaaaaattgatagaactgcaaggaaaaatagatgaattcactagtatagttggtattatggactaaaatgtttcccccagaattgatatgttgaagccctaaccccagtgtgatgatatttggagatgggacatttgagagttaattatgtttaggtaaggtcacgagggtggggccttgatgatggagtgagtgcccttacaggaagacacaccagagagccctcccttcctccctctctgtgtgcatgcaccaaggaaaagccatgtgaggacacagcaagaagcaaccatctgcaacccaaggaaagagccctcacccagggtgtgaccctgcccacaccctgatctctgatatctagtctccagagttgtgaaaaataaattcctgttgtttgagccacccaga

SEQ ID NO: 5657 - DNA, 1039 bp, Homo sapiens
ggatacatttaagatagcctgttataataggaatatattccaagctcaatccaattaaaagctatattcaaatcttggacttttttctaactttattttaatttttttaattatctatactctgtatcactactccattgcatctccatcattacatctggataatcccagggcagaacagtactccttactgtgagactggattgcttttagcacagtccatttgaggaaccaagtgaaaccctctaaaactctgaaaccttgtcagtgtaaatatcagccaacaactaaaactgctaagctcttaaagtatatattattagcagaggagaacaagtgttgccaacatacaataaaagtgtattataaggctgggcgtggtagctcacacctgctatcccaacactttgggaggccaaggcaggaggattgcttgaagtcaggagctcgagactagctggggtaacatagtgagacctcatctctacaaaaagtaaattagctggacacagtggtgtgcacctgtagtcctagctacctgggggtgctgaggcaggaagttcgcttgagcccaggagttcaagactgcagtgagctatgatcataccactgcactccagcctgggcaacagaacaagaccttgtttccacaaacaagaagtgtcttgtaaagagttggtattctccaaaactgaagaatgtatttatatcttaattacatctgagacagactctaagaaacagaatacagcagtagaagctgtggttctcattgagggggctgcaggcttccttctcaaggtagagaattgcccccacctgagatgctactgcctgccccagccatggcccacttgaagctccctatgggtaatgaaccatgttgctgctggtgggcatttattgcacatgtgaatcagaattgagatagaagagacttaaactactcagcaaaagcttctgagtggcttttaaatttaagggatcacagaattgtttgggtctctttgtcattgttaaatgtgaacctcaggcctta

SEQ ID NO: 5658 - DNA, 1078 bp, Homo sapiens
acatttaatagacttgctagttaagcatcccaaatctgaaaatcccaaatctgaaatgctgcagtatttcctttgagtgtcatgtttgtgctcaaaagttttagattttggagctttttttttttttttttttttttaatctattaactcattgttacagaaaaaaccctgggctgtatagaagaacctttccctagctgggcatggtggcttacacctgtaatcccagcacttagggaggctgagggtggcagattgcttgagctcaggagtttgagaccagcctgggcaacaggacaaaaccccatctctacagaaacaaaatttagcccggtgtggtgacatgcgcctctagttccagctgcttggtaggctgagtggggaagtcaaggctgcagcgggccaagattgtgccactgcgctccatcctggacaacagagcaagaccctatctcaaaaaaaaaaaaaagtttcctcagaactgagaaggatccaaaagccaaagaatgactcggacttatatgtaaggcacccctggatggcagcaagattgtttgggagatctgcttatttgtctatttttgctttggttacctgtgctttcgtgttactactcaacaaatcttagccaagaccaatgtcctagagagtttccccaatgttttcttttagtaatctcatagctttgggtcttagatttaagtctttaatcttttttttgagacagtcttgctctgttccctggctgtagtacagtatcgtgatctcagctcactgcaacctctgcctcccgagttcaagtgattctcttgcctctcagcctcccgagtagctcagactacaagcacgcaccacagtgcctggctaatttttgtatttttagtagaaaccgccatgctggccaggctggtctcaaactcctgacctcaggtgatccacctgcctcggcctcccaaagtgctgggattacaggcgtgagccacggtgcccagcctcttgaatacattttgagttgatttttgtatatggcgagagatagggatctagtttcattctcctgcatatggatatccagttt

SEQ ID NO: 5659 - DNA, 1004 bp, Homo sapiens
ggtaggggtggggtagggaaacttgttattttattttacttatttttttgagacagagtcttgctctgtcacccaggctggagtgcagtggcgcaatcttggctcactgcaacctccacctcgtgggctcaagcaatcctcccacttcagcctcccgagcagctgggattacaggtgggcgccaccgtgcctggctaatttttgtatttttagtagagaaggggtttcaccatgttgcccaggctggtctcaaactcctggcctcaagtgatccacctgcctcagcctcccaaagtgctgggattacaggcatgagccactgtgcccagcctaatcctaccttccttatcaacctttatgaaatgctttcatgcaaatccaacatatgtgttttatttttcttaacctgtcattggtagcgtagggattaaatgtgtaatcacaggccactggaacaggtaagtacacagtgatctgaactagcaaacaaaaacaaccgtgtccttcaaggagaacctggttgatctaaagttaataatcttcacaatagattttttttttctttttactgtgcctttttctgtttagaggaaataaatggctttctaaagaaaatcatctttgtctcgagtttcgttaaaataaattttccctttccaaacatcaaaaggaaatctgaagtattttagataccaaccatcctgaatagcaaatgaggaacttctgaataatgggtgtggaattttccccaaagggaacttcaacattcaaagcttcaggcggactgatggataacaaacttgacaggaagagatcgcatggattgggtttctgtgtagaaactggtgatgacagaagtaaagcttgatgtttgtagcaggtgaaatcatacctaatgacattttagaaaatctggagcacaaatctatgtgcgtaagtatatctctagtagcaacccattaggtgtaaaatagacttctctgatcccatggctagagatttgg

SEQ ID NO: 5660 - DNA, 1085 bp, Homo sapiens
aaaacatgggaccattgaatgaaactttatagtccttaaatgttgctgaacttttgctgtcttgcaatagaatttgaatgtaaatattattactggtataactcaaatgttatttttcttgcatttcaaagcttgcttttatcttccaagaagtgtaaattttagtatttgtcatctctcaggacagatacaattaataggaaatagaagtttgaagaaacagagatggcacatcatagcaaactaagttcaaaacagaataaccccagtgcatcaaggttaaggtgggacagtggtttgtgatgccagggagagtggggaaattgtgatgatgctggtagacctgggcagactgtgttcccagccacacccgccaacagaggaggaaggtgctggtactgatgtccccacccgagagtctgtcctggccttggttttccacagtgagggctcgttctaatgttgcacaatgtcatactcagatatcactgtgacctgttactatgctttagaacccgagaggcctctgttcacatggcagcatgtgtgagtggatgctcccggagcaggtggagtggtggcgctggatagcggtaagagcgggggctccaaaggcagaacttccagcttcacatctcagctctgcacctgctcgctgtatgactttagcaagcaactggatctttctaagcgtcagcttcgttgtcttaaatggtagttggtaataatagtccatgcttcgtagcatcacttttgtgttcaagcagaatgctgagcacactggcaaataataagagctcgtaaatattagttgttgtgtcactgttgtcattagagggaagccagagtccctttcaggagccctgtgtttaggggcagtgtgtcctcacaaaacaataacagtaataatgatggtgttagcagcaacagcagtaatcatggaaacgttgattaagcatttactgtatctgaaccctgcggctgttcctgctttcagccacttctgcattgagaagggccggggatgtggtggaagctagatgtcaccaagtagggggatgtagattcacagcggtctattctgg

SEQ ID NO: 5661 - DNA, 1203 bp, Homo sapiens
gttccacagggctgtgaccattcgagggaagcacattcaaagatgtagatcccctcagagaagttttccatttccctgaagttaaagatcttcaaatgactgcaaataacatgaggatatatagaaaaatgcccttccccaatttccaaatcgtgaaaatttggctcagcaggtaagtatttctgtttgtagttgtttataaaacagtgaagacataccttttaaaatcaatcacagtccttagataaattcctcccattcttcctccccagactcctatccattaagagttgtgtctctgaattcaaatttcataaaacactgagttcccttcagaagtaaatagtgcatttcctaggagtgtcattgccaactgcaaagacagagcagtatttttcagtgttgcagcatagagcctgcaacaatctggaggttgtggctgtgatttcagtctttgggggacaattaggaaagtaaagctaaggccaaagataattgacatgtggaaagagacaaaggacagtccgaatctcgtaggaggaagggagcggtcctgagagaccagagctaggcaggcagctgtcgctaagaatggaacttagtgatctgctgtgggcccagagcgctcagtgagaactcagaggactaggaaacaggcttgatagcagtatgacttttaatgctaagctctgccttctggtgatatcctgacctactccagcacttcagagcactctagggtttgatctcagtaaataacttggaaatgcaaccacctttttgttggaaagaaagtaataatgtatccggaaagaaagcaggttggaaaacaccagtgtttccaaatctttgatagatttgaatttggggattcatatcattggctgcttttcagccacatgtgctcacctttgtacccccgcctaccctgccccaccccatgaggttaatgcttcacacagaaggatggtagaacgaagtggggcagtttcaatgaaagggagcattaagctgagctctgcctctttcctttgtctgcatgtctggtaaacacaacttaatggattgtgcctcctccttcccccagtatactcccatgaagcccctaaagaataagtttatcccatagcaatctatggtatggtgtcatattgggagtcttgagctgaaaagtactttctcacggtatattgacgcaagagc

SEQ ID NO: 5662 - DNA, 2079 bp, Homo sapiens
taggattgtacaaaaaggcacacagtattcgctttgcatctttcgaactagcaatggacgtggctggggtgtaaagacccttgtgaagattaaaagaatgagttttgtcatggaatatgttggagaggtatgtttcatttgccacgtagtaaatgatggacatgcaaggtttatacttttggaaaattacctttttatctctttaagagatacttggtacattttgatattttcatttgcagatatgtagaaatttattcagatttaggagaagagttcactggcatatttagaaataaaaaacttttatatgaataaaaaatatacgttaaaacaaattgatatagtcatctttcaacaaatacacattcctactagtcaaacctaggatttgtaaaatttaaaatatgacaactgtttttacccaaaagtcctaagaagaaactcagatgtaacacatgctgctttgaaacttgaaagttttaatttacttcatctatttgaccaaatatgattaaatgtagttggcagaactctattttggatcaacatgaaagatactatatttatgagttttgtaaaatatacacaagcatttattgcatccataatctgtaacttacttttgaactgtgaagaccattctcaaaactaccatacaaatactagcaaatttatttgtatacaaatcatatatatgtatatatatatataaatgtaaaaagtatttgccgtgtgtcacatactattctaagcacttgatgtattaattcactaatcctctccaaaactcagtgaggtagtactgtttcttttttttttttttttttttttttttttgagaagtagtactgttatgtccattattgtagagaaattgagtaccttgcccaaggtcacacaggtcacatagtaataagaaccgagattcaaagctctaaaatcagtagtcttcaccatggcaccacactgcttcaaactgaagggtaggttgagctgtgactagaaagacacaagcatggctacatatctggagttgtcaactctggattttttagttggaattgggtcacctataattatctgtattcatctataattctgaaactaaattagatggctgttttgattcttacacttttagacagtggtagattattataaattattcagtatacaagatcttgtataatcaaattactctttttgttaaccaaaattttttaagttgcattcttaatgagtgcagcagccaaatttggttggtaacataaagtactttagacacttttggtttcttaagccgagcgtgtcataaaacttgtgttcttaagagcagaactgtagatgacgatcttagacttacagaattgcatgaaaataacatattctacaaaaacaaaaccttccattccaaagttaacatagcttctcccctgtatttttaacaattttccatttgtaactgcatatatataagttataggaaaaatgtgcctggatcatatttagagcatatacttgcagatttagtccttaacattcagttgtgtcctgtagagagctatagttgtatagctttttgaacatcctaattataatgaaagtaatgcagtgttccaatgtactgctcaaatcctgtttaaaaagtcataaatcaaccagttacagttaatcccagcacttggggaggtcaaggctggaggctcacttgagcccaggagttccagaccagtgtgggcaacatagtgagaccccacatctctataaaaactaaatcattagctgggcatggcggtatgcacctgtgatccagctagtcaggaggctgaggcaggaagatcgcttgatcccaggagttaaaggatacagggagtcatgatggcaccaccgcattctagcctgagtgacagagtgagaccctgtttaaaaaaaaaaggtcatcagtcttttgcattatcatttttcttcccctcattttcccacctctttgcatctgagtcttagtttgtgtgaatgtttgctttgatgacacctgaatttcttactttttaaatatttgtaggtattcgcatatta

SEQ ID NO: 5663 - DNA, 1021 bp, Homo sapiens
gtttacaccgtttgtacttaaatgggttctaatgttcctttttagtgtgacccaaatcttcaggtgttcaatgttttcattgataacctcgatactcgtcttccccgaatagcattgttttccacaagaaccataaatgctggagaagagctgacttttgattatcaaatgaaaggtatgcttttcaagtacagtttcattggtgtcagtttcaatatgaagaatcaaatcagactaggaacagaccttagatatttgaaccaaacctaatactaaagatgaaaagttgaggcactaagtttgtcatcctaaggtacaaagctaatccaacagctaatactagaacccaggtctgcctgagcttcagctgaggaatggttctacatcgtaaattttcagaacttccattttggaaactgatttatttattatagcatcttaatactgtactacttgtctttttttttttttttaaattgtgggctaagcatgctggctcctgcctgtaatcccagcactctgggcttgagcccaggaattcaagaccagcctgggcaacatggtgaaactctgtctctacaaaatatgaaaaaactagccgggcgtggtggcgtgtgcctgtagtcccagctactcgggaggctgaggtgggaggatggcttgagacagggaggttggggctacagttgagctgtgaatagcaccactgcactccagcctggacgacagagaccctgtctgaaaaaaaaaactataagcctacatttttgaatttttactgagagatgtatattcaaaagattgaaaatatttaaatcacatacaaatttattctattcctacttgaacctggcttttaaaaagaacatttaattctatttgctttattgtgacaatataaatgttttctttcctttaagaatgatggcctttacatattgtcattgcttaacctcttacatactgtgcttttatatacggtgtgaaatgaatgtgtattagatattcccagtaagtttca

SEQ ID NO: 5664 - DNA, 1057 bp, Homo sapiens
tattggtttcctgaagatgtcagaatttttcagtgtaagacaaatatcaaaggtaatagatccagtttaaaaggtgaatccactgtatgtattatattgataccatcattttcaggatctacattaagaggatggtgatacataattagtaatctcagggttttttcccccatatctaaaatgtagacaatagttgtttctcttttagttcatcagtttctcttagcaaaataaattaggttgggcatttaatgttctatttaccatggcttagctttgtttctgttttacagtcatttccagtaagactataaaaggggcagaaaaatactgatgtattgactacgtgctagcaagattaaccgaaggtttatattcaattcctttaaatgttactttccttttaagatagctttcatggttcatgcatttgatactacacttgatcttggccaaaaggccaaggagtgatggttcatgcatttgaatattaaaggacaatttgacatttcgctagcataatgtggatgaatacttcagaaatttttgagcattgtcactcaccaggtacgtaaacatactatggtaagtactgcctagaaatgcaaaggaattttagaattcagagctcatattcattgacccagtcttttatgccttttatatgtattcatgtgcttctaatgaacctgtcaggttggtgtaaggtaacaagcttagactgttaagataatgtcaacatgccaagatcacccagtgaactttttaaagtatttaatcttcggcttcaggcagactttttaaaaaactagtttatactattcaaacatttaagtcctggaactcttctccaagataaatgtggctgactgctgagtgtcttctgtgatacatcttggcattttgaaacttcatgtttcggctggacacggtagctgacgcctgtaatcccagcactttgggaggccgaggcgagtggatcaccagaggtcaggagttcaagaccagtctgaccaatatggtgaaaccctgtctctactaaaaatacaaaaattag

SEQ ID NO: 5665 - DNA, 1047 bp, Homo sapiens
aatagctgggactacaggtgcccgccaccacacctggctaattttttgtgtttttagtagagacggggtttcaccgtgttagccaggatggtctcgatctctctgaccacatgatccacccgccttggcctcccaaagtgctgggattacaggcgtgagccactgtgcctggccaatagctgggactacaggcgcccgccaccacacctggctaattttttgtgtttttagtagagacggggtttcaccgtgttagccaggatggtctcgatctctctgacctcatgatccacctgccttggcctcccaaagtgctgggattacaggcgcgagccactgtgcctggccatatgagttctcttatatgaagtgtccagaaaacacaaatctatagagacaaaccatagattagttgcggcctaaggccgggaatagtaatggggagtgactggaaatagacataaagtttcttttttgggtaacaaaaaatgttccaaaattagatagtggggatgattgtacaattctgttatactaacagtcgtggaattgttcacctataatggatgaatttatggtgtatcaattatacttcaataaagcttaaaaaataattttgtattgtggagtttataaagttaataacagagaatgtatgacaataacagcacagactgggagaagaggaatggaaatatactgctggaacattcctataccatatttggagtaatatatcatttatcttttcactctgatatgttaaagatgtatacggtcagtcctctgtatccacaggttccacatctgtagatttgactgaccacagatcaaacatatttggaaaaaagcaaaaattaaaatacaaaaaacacaaaaattgatacagtataacaactagttaccaagcatttacactgtattaggtataagtaatccagagatgattttaagtatatgggaggatatgtgtaggttatatgcaaatgtaacaccatttaatatgacttgagcatctgcagattttggtactcttgggggggtcct

SEQ ID NO: 5666 - DNA, 1027 bp, Homo sapiens
cggcactttgggaggccaaggcgggaggattgcttgagctcaggagttcaagaccagcctgggcaacagtgagactcccatctctattaaataagtaaataagaattaggttgacttgcatgtgcctggccagctcttttgacagattttcttctcactttataaattcagagcctgcaggccaggcgtggtgtctcatgcctgtaatcctagcactttgggagaccaaggcaggcggaccacttgaggtcaagagttcgataccagcctggccaacatggcgaaaccccatctctactaaaaatacaaaaattagccaggcatacgtctgtaagtccagctactcaggaggttgaggcaggagaatcgcctgaacccgggaggcgaaggttgcagtgagccaagattgtgccactgcataccagcctgggtgacagagtgatactctgtctcaaaaacaataaaaataagatgaaataaaatgtagagcccccaggtgtaattaagggccatttctgtagcttagattagatgaccttgattactcactatgtttgtcttcctagggctgccatcacaaaataccacaaactgggtggctttaacaacagacatttattttctcacagctctggcagctggaagtcccagatcaaggtgtcagcagtgttggcctcttctgaggtctctctctttggcttgtggatggccgtcttcccttttatgcatgtctgggtattgatcttttatagggacaccagtcctattggattgagacctaccctaacaacccccttttaacttaattacttctgtaaagactatctgcaaatacaaccacatcctaaggtgctgagggttcgggctgcaacagacaaattttgcagggagatacaactgagcccaaaatgctccactgcaatagtaatggtctgtttggaagctactgtttttggagttattttctttgattgttaaatttgaccttccaagtgatgactacacatctttggagaatctcctcagt

SEQ ID NO: 5667 - DNA, 1022 bp, Homo sapiens
gagctgggattacaggcgtgcgctaccatgcccagctaatttttgtatttttagtagagacagggttttgccatgttagccaggttggtcttgaactcctgacttcaggcgatctgcctcccttggcttcccaaagtgctggaattacaggtatgagatagcatacccggcctttttttcttttctttttttttttttttttgagtcagagtcttgctctcttgcccaggctggagtgcagtggtgccatcatagctcactgcagccttgaactattgggctcaagcgatcctcccacctcagcctctcaaatagctgagacgacaggcacatgccacacctaatttttttttttttacttttgtagagataaggtgtcactgtgttgctcaggtcaatgtcttgaactcttggcctcaagtgatcctccagccgcaacctcccaaagtgctaagattacaggtgtgaaccactgcactaagcctgtaaaatattttttatgtggaattttcgtaatgcattatgtagtgacaccagtttttttgttaacctgttttcacttctctgtttttatttttgtgttagtaataacttggtcaaaataggtttacattcattattactatataacataacaatttcacattagcattaaggacaattttttataagttgtttctatacaaagaatgatgtattaaattttagaccttttatctataaatatgcgaaagctttgtaagtggctatactatctctgactataaggtcttggtccatattctttacaccatacatcgtatttatatatatgcctgcatatattcatgcctgcatattgtgcagaaccacctgtgaaccagatcctagtcttctcttcctctgtcaactgatcatagggaactccccatgataccattggtgcaggctggggagagaaggcagggtggcaggattggagaccatgggcatttgagccacttcctcacataacttacttgtgtcttcaggacccgttcgag

SEQ ID NO: 5668 - DNA, 1031 bp, Homo sapiens
ctcccgggttcaaccgagtctcctgcctcagcctcctgagtggctgggattacaggcatgcgccaccatgcctgggtaattttgtatttttagtagggatggggttttttccacgttggtcaggctgatctcgaactcccgacctcaggtgatctgcccgcctcggcctcccacagtgctgggattacaggcaggggctgctgcacccagcccagggttatatttattaccccttcttgcaatgaccaaatgaagaagacaatttaaattactagagtcttatttttctaattaggaaaaggaaagcacactgcagttaaagggcttgtttcgtgtcattcagtgaacagtggaattgagattaggtcttctggtcctgggttagcatagcctcttttttaggctaagatgtgatgttaccttgggttaatacttctttattaacagagacaagaataactaattttgatgttcatagtaaatacctacatagttagtaaaacaaacattggacaagttgagagactgggttctagtttaggctatctgaccttcaaaagattaaggattccattttagcatctaaaaatgaagtcatcaaattaaatgatctccatagtttattccagctcaaaaattctaaagtcaaatagtatttaacattaattgaaatgcaaatatttttattttaagcattatacattttaatacttaataatatattttacctactttaaaaaccattaatctcaatttaaaaccagtccttacttggatgacatttaataatttgacattttttagcagtagatttgtaatttgacttaaactttctttttttatttaagaaatgtattaaaattattaaagttgcagatataagtctaatcaaaaagagatgaaaattacagtctttttttttaaatagagtctcactctgttgcccaggcatcctactgcaacctctacctcccgggttcaagagattctcctgcctcagcctcccaattagcggggattacaggcacccg

SEQ ID NO: 5669 - DNA, 1025 bp, Homo sapiens
catttatctttttcatgactttttttttcaaactggggtctctgttttactggaagccatgaccgtatttcctaggatttttttttttttttgagacgaagtcttgctcttgtcacccaggctggagtgtgatggcatgatctcagctcgctgcaacctctgcctcccgggttcaagcaattctcctgcctcagccccccaagtacctggaattacaggcgcctgccactacgcctggctaatttttgtatttttagtacagatggggtttccccatgaaggccaggctggtcctgaactcctgacctcaagcaatccacccgcctcggcctcccaaagtgctgggattacaggtgtgagccaccacgcccagccttttcctaggactttatgagaggtggttggattgagagagcagtggataatctgtcaaagtggtttacttcctttatttatttcctttataagaagtacagttggtttacaaattaaatcatatatgatggtggcgtttgtgtttgtttttctgagtctgactttagggtttgtttatagcagtatcctaagggtagaaccaagagttaagacttgttgtgagttttctcgtctttgcaatttttccagccctgcgatttgtgctgtgtcttccacataatctacttttttttttttttttttgagacagagtctcgctctgttgaccaggctggagtgcagtgatgcaatcttagcgctctgtagactccggctcccaggttaaagtgattctcctgcctcagcctcctgagtagctgggattacaagcatgtactaccatgcctggctaatttttgtatttttagtagagacggggtttcaccatgtaggccaggctggtctcaaactcctggcctcaagtgatccacccgcctcagcctcccaaagtgctgggattacaggcatgagccaccatgcccggccacataatctactcttaacattacctccttaagattgatggctgccgggcgtggtgagtcacgcct

SEQ ID NO: 5670 - DNA, 1027 bp, Homo sapiens
gagctattaaagtggtggaatttacgggatttagaaactgagtgggtgtgggtgaggcaggagtcttggatgaaatctgagttcattctgttgtttgtttgtttgtttctgagagcatgaacttggctcatagcctcgagtccaggctcaagtgatccttctgcctcagcctcctgtgtaggtgggaccacaggtgcatgtcaccatggctgactaattttgggatttgtttttctagagatgaggtctcactttgttgcccaagctgattgcgaactcctgggctcaagcagtcctcctgcctcagcctcccaaagtggtgctggggttatagcatgagccaccgtgcctggctgttttttttgtttgtttttttgtttttttttttaatttaaataagagcatttgtagatgttgcatcagagagaatgtgaaaaatatagaaatgtcatgtaaattaccgagtgctgggcttggcacatggtaattttacaataaggttgctatctattgttattgtcggctaaactagtctaattaatcttagcagaactgtgtatgaagtgctgttcatagtcaatatttggcattctctaagcagacttaggttggaattgcagcctttcagtccaggggcaagtttcttaacttttcttggccttactttcctcatagaatatcaagccagcaatgcattcgtgaaaatttgagataagagatgtaaagtgctttaagcaacacatagtagaagcttagtcaatgaacaaaaggcattattgttggttcccagcctccaagtgaggccacaggactcttatctatctttgtatctcccatagaccttacctgcctcgaataacatcttacacttattaactgcttaatacatatttatcaaatccatagtaactttttatttcatcctgttgaggcttttcgccctccattaaaagggtttcttgggagggagcggtggctcacgcctgtaatcccagcactttgggagatcgaggcaggcagatcactt

SEQ ID NO: 5671 - DNA, 1023 bp, Homo sapiens
aggatatgttcctgctaggatgcagcaatatttttatcgtcaccacacaatatttattaaaggtctctcagtacacacgccacagtagaagtcagtatctttacgacaagcacaataggttaatgagtaaaaagttgaaagcatcctgaaaagcgaaaatgaaagacaaatgacatctaatgagttaacatttttcacagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgata

SEQ ID NO: 5672 - DNA, 1044 bp, Homo sapiens
agtgggaggggaccctctttcctaacggggttataaaaacagcgccctcggcggggtccagtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaagtaaggctgcgcccatgcaagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacagatttcttaaaactaccactttgtg

SEQ ID NO: 5673 - DNA, 1093 bp, Homo sapiens
ttcaccaaaattagatggacttacagaatttttaacttaaaattggaatccaaaagccagaagatccccattatagtttatagttgtattccctggaatatttactgggattaactgcaaagcactctcagatgaatagtgtagtataacattttgaaactgaaatacatttaccaaattaatttaaccacagcaatgtgtgtggttcattttagtccttgagcatttttgattatcatacctgtcatgttttctgcagtgtagtgagttaacataaaacaacatcaatacaaaagatcctctgtttcgagattaagcaaaattcctcattctcttcaatgtgatagaataccacattgatctttctttggaggttagtaaaatatcttttatgtatttttcagggcttaacaagtaaaaatcaatgttttcatcaagtctgatctttttgtcacccactcttcattcatttttccactaaggtgatagaaaagtctcaacagtttaagaccgtaaggctatgaactccaaatataattgctgacaagataagcaatcctcacgcatccttttgagaggaaataaaatcttagttgcaagattacatattctgatttggaatgctgagctttttaaatggaaatatagaaggacggctgaatcagcaaaaatcctttatgtagtttcattctttgcaagcttgaccagtcattctgaaacaggctaactgaactgatacagtggcaagtgaaaaagacatgcctttacaggatgagtcaaaggagttttagaagaaaaatccaccagagaaagccaagcaaatacagttcagagttacatttcttttccattttttcctgaactgaatctttggcatgcatatcctgaattgggttattgaatataaatctagccttgtacaatggatgccagatgactacatatttgctttggagcctaaggataagtttcaaaagatttgagtggagaagaaaagctaaaactcttgaagcacaagtttctgttctccatgtactcaagtgtacatgaagttgtgaaaatttgtccacctctatcatcatgttattccatg

SEQ ID NO: 5674 - DNA, 1050 bp, Homo sapiens
ggagtccactgagtaccggagacaggtgcagtccctcacctgtgaagtggatgcccttaaaggaaccgtgagtaccaaccctgcagtaaaagagggaaaataatgacccattctgctgactaggctcatgatgatacctgaacaaaatgttgagtgagtaaaaatgtatatcataatgcaaagaaaatgagttatcaagacagactcaaaagggacttcatggaactcttgaaggttttagcttgcctatatcattgcttctaatatgaaggacttggtactcgcattctccacctaaaattagagtggtcgccatttgccgctaatggaaattattgcagaaggtctgtaaatggttctgggaacagctgggtttttctgagaaataacaccagacatctttctcaccccctgcagaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggtagggaactcagacttggatgcgtgaactaatggtgaccatttgttaggccctgtgccactgggctctaagcagtgtcacatttaatctttagaaagtttctttgaggtaactgctttccactttttgtagaggaggaatttgaattgagagagagtaagtgacttgctgaaaaagggttaatcaacagcagagctgggatttgaacccataactctgtcaaagcctccactcctaactcctgttcatgctcctgtggagaaaatgcttgtagtaacatattttaaatgtactaacaagaccagtcatgggaaaatgtttctgagacaaatctctagtttatgatttaaaacagtacgttttcttacgtgacgaaaacaaaaagtgtgttaatttgttcccagtggttgaa

SEQ ID NO: 5675 - DNA, 1031 bp, Homo sapiens
ctgtgattttcatcattttggttaccgtgggtactgcatgaataaagaaaggattggggctggatgcagtggctcatgcctgtaatatcagcactttgggaggctgaggcgggtggatcacttgaagtcaggagttccggactagcctggccaacacggcgaaatcctgtctccacaaaaaatacaaaaattagccagccgtggtggtggatgcctataaccccagctactctggaggcagaggcagtagaattgcttcagcttggaaggtagaggtttcagtgagccaagactgtaccactaaactccagcctgagtgacagagcgagatcctgtcttagaaataaagaaaaaaaggattggctgctgaagtaactcctagccattctaaaggtaaattctaaatgtaaaagtaaactttacattctagtttacttgggacattcttggtttatgactgttgtgtaagcataattattaataataacagtttggacaatagattgtatgtggtcaggtcatgctacccttagaataatcttacagaaaatgtgtctgtcccctcagcccccatattcaaacaactgacatggacaatggcataattaattttattagtgtaaacatccaggtctttgggcccttatgaaaccttttctatttgatttttcgttttgctttctgttctttagccattctcaccactgttccccgcagcctcctaaccctaggatccctgtctcctcttccacttgtatcccacctttggcttataagggtcatccagggaagaccccagccccatattggctttcttcacacaccagactcattattatttttttaaaaattgaaaaacaagccacagttttctttcaggggaaaagaaccaggacagcaagttctgctcatacctattgagattagtagactcccactcttaaaaatcctttacagatggaggccaggcatggtgaccaaggtgggtggatcccctgaggtcaggagtccaagaccagcctggccaataa

SEQ ID NO: 5676 - DNA, 1064 bp, Homo sapiens
ttaaattttttcattttttttctctctgtacttcagtttgggtactttcagcatattttcaaatttactgatctttcattcttacctgattaattccatccactttttaattttacatatttttttgtctctagacttttatctgggccctttttaatatatttcttcatcattatgtggatgatttccagcatgcttataatagcttatataaagtccttgactgctaatttcatcatctttgttatttctgcattctcagttgactgaattttctgctagttgtgtatggtagttttcttcttcatatcatgtcttcatatcattttattgaatgcttagtactttgaattttatatttttgagcatcaggtgttgtattcctgttaaggagtattggactttattttttcagaagtggttacattcgtctgtggcttatgttgttaggcagtatgtaggtatgattgagctgcattgctagggtctaaactcccctgtatatccactgaatcctctggattttcaatagatgcttcactgtggcctcatctctgacgactgtgtgagcgttggatctctttagcatatcgccctcggtcactttttgaccagtttcatggagtttttcacctgtgcatgcgtgggtttttcagaaggtcttcactgatacttggaaagtgcctctaggcagaaagttgaggcaaacttctggcttatctaattcattttccttcttggatattatcattcagtactgcctgtggcctcatgtctttaaaaagttaacctcagtgtggaaaatctgtttttccagttttctaattgtttacaacgggagtgtaagtctggtctgtttttccaccctggctggaagtggaagtcatggcctaccattttattttcaaacctttttttttttcctacccagaattagcctgaaatgcctcatctacgattactaataagagagcctgttaattttgtttgaaaaatttaaaggaactagtttacagtttttcaaccgtgttattaataaaaattaaatttccctactttatcat

SEQ ID NO: 5677 - DNA, 1051 bp, Homo sapiens
gccaattatttagtaagcattggtttgaaatacattcatgacatttcatagaggagttatttcttctctggtatctgtgaaggtttctttatatctattacatcaaatagtaagacttcaaattattgccgctatgaagatacatcagtattttaatgaactggccaggttttttcccttaataagcaatgagtaaaataatttattttgaaaactcactacatttatctctttctttaatacggaagaataatgccctgcacacctgccttagactaacttgaatctttgttatacatcaaccataaagagttatgttattttgggctgggcacggtggctcatgcctgtaatcgcagcactttgggaggctgaggcgggcgaatcagttggggtcaggagttcaagaccagcctggccaacatggtaaaaccccgcgtctgctaaaagtacaaaaattagctgggcatggtggtgcgcgcctgtaatcctactcgggaggttgacacaagagaatcgcttgaaccgcatcccccacccccctctgggaggcggaggttgcagtgtgctgagatcgagccactgcagtccggcttctgccacagggtgagactctgtctcaaaaaacaaaccaaaaaaaaagaaaagaaaagaaaggaaaaaaagttatgttattttgaagaaattaaattttcaaaatgattaacatgcagtgtacctcaaactaggccccagataattaagcatcatggaaaaaatgcatagtcatgaacattaagaagtcaggaatttggaataaaggaactgtatcatttattctctccttcccacttttttattgctttgcaaaaagcagacacttttccttgtcttactgatgtacaaaccttgcttcgttgcaaaatattctgaaaagtcctttcagatctccaaaatcttattacctatttaatgctttaatttgaagtgagatatatatgatgggttttttcatagtgtgaacattagttttatttcgaataactatattttcttgtctatagctatgcat

SEQ ID NO: 5678 - DNA, 1027 bp, Homo sapiens
cagagcctgagtgacatatggtgatggtctgcacttgggaagtagtggtggagatagagacacgtttgagatctattttggaggatttgttaggttgagtctttagactggtaagaattacccttggagcaataaaatctcgattctccaagattgcctttaaggctttgatttattaagtctgcagtgaagcttgatattcttgactttccaggcagttttgatgattattttgaaaaaaaggtcaaggaaaatatctgcagctaaaaaagaaaagtagatttaagagtttgtattttttattacccagaataatttacattgtatttgttcagtaaaaataggagttttcatgctgttccaattttgttaatttatttttaaactttcagttgtgaatgaatgaataaactgacaaaatgatttttgttcaatgtatcaggatatgttctagtttctaactatactattgaaggaagaataccttttatcttgatgtctttttctacttcttcagactgttggatataataacattttgggtctttaaaaactcattgttttctagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacaggtaatgttaatattacatttaaaatttgtatgaaagtgtgtatggcttctgtgtttcatattattcctgttgattgcagttaccaaatacaataataaatattgacccagatgctgctctgtatgacagttggctgatttgcttgtgttatactgggtggattcttattttgttgtttaatttttttcttatttattacttagtttataatttgttttggaggcctagtttaatctattcattttcggttccacctaataatatag

SEQ ID NO: 5679 - DNA, 1100 bp, Homo sapiens
actctgatgtgtagtaggtgattaaccttttttcagaaatacaactcttattattagtgaaatctctttttatggaaactgtaaaatgtttacaagagaaaattaagaaatccaatttcataaagtaatgttgtgttattactgccaaaatctgcaactcagttatttcttaaattgcgccttttagcttgctgggagtataagaaaaatccccaaatctctcttggaagttaaagtgctttaaagtagaattttaaatgtattattaaaaaaagataacttttacatatcttacagttaaaacagagaagaagacggtacaatttagtgatgatgttcaggtagagacaatagaaccagagccggaaccagcctttattgatgaagtaagtggtttccatggtgataggagttggtactttgtattgaaatttaaatggttttgctttaagaaaaaattgattacttgagtttttttgttgtaaaaatttttgtatttttttataaaaattcaagcaatatagacgatgcagactgttttttgaaacttcctctccagtcctttgtttgccgtgccagagcctcattattttaaattcctgctgaatattctgtagagtggccttaccatgatttatttaatctattgttgaatgcctaggttgtttacagtttttacagtgtagtagtgagattttttttttttttgaacatctatctttgtgtttctttagggtagatattcaggagtgaaactattgagttgaaggatttgtgtattttccatgttaatagataatgtcaaattgttgagcaaaacaagtttttacactcgtattcatatcatgcgagaactcctgtttcccagcatactcaacaaggatattaagattgtttgcacatgactgaggaagggacactcattgactatctattgaaacaaataaattactgttgtaaaaataaaattgtcattaaattacttctacataaatcattgcataaaagcagtgctaatatattgaatatcattggagatgattcatgattcctccttgtgttgaacactttctagtatttgaggaaaagcttacgctaat

SEQ ID NO: 5680 - DNA, 1044 bp, Homo sapiens
tacattgcctcagagtataagaattaccagggatgatttcatatactggttttggtattaagaaagtcatggctctaatgactagttaacacagctgagatggttccatattttttgtttttaaaaaataggaccaaaatgaattttcagctagtagatcattaaaaataatttttaatgacagaccactgtcattccattccatctttcagaagataccgaaagaacttaatgaaattgctataatagcttgattatatgaacaaaatttctcctcactttcaactataaaaacaaaaaataggaatagaactggtgctgaatcctggctcattttacttttcaaaacttgaaatatagttaatgttgttttgaccctttgcatattaataataataatcattaccttatacatatgaatgaatctaatactgagagtattatcagtttacatacttttagtgcaaagaaatcccatatggtcatcggtagaaaactttcaagtatattaggataaaattttggaggggaaattgagtagaaatatgataagttcaaggaaaaaaacaatttgaaatacatgacagagactgttgtttgaatggtaatggtgagtgcagattgctgtggtgtttaaattcctttggctatatttaaaggaatttttgactattttattttaaaatgtcaacacttaatgtcctgggaatcttatcctttgtaacattttaaatgtataagaaatgagatgttatctttgaaatatgtgaaggggtttatgggcttttagcaatcttttatgggaggcagaaacaaaatttgaagagcgaaacagactgtggaagactgtgctaagggcaaggaatccacctgggctaggagaagtgatgtttggctgattgcattatataagaaaatgctggccaggcgcagtggctctcgcctgtaatcccagcacttcgggaggccgaggcgggcagatcacgaggtcaggacattgagaccatcctggccaacatggtgaaaccccgtctctactaaaaa

SEQ ID NO: 5681 - DNA, 1059 bp, Homo sapiens
tgatgtaattgagtgtttttcttcctccacagtacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggac

SEQ ID NO: 5682 - DNA, 1067 bp, Homo sapiens
gttggcgaggctggtctcgaactcctgacctcaggtgatccgcccaccttggtgtgccaaagtgctgggattacaggcatgagcaaccatgcccggcagcatactagattattaagtaattagaaaaaatacctttacatgttgttttttaaagtaagtgtatgttttttaaacaagtgacttgcatcgacacatattgcgtacttgtctgtagctagggaacatatataattggtattacaaagatatttgcccaatagaattttgttttaaaatatcttgcagttagagtctactatagccctttgattaaaaatagttcctatataattttaaaaaccttagaattttattgttataaacagtatatgatttgaaagaaatttaaaaagtaaaatattcagaaacactaggtatacttttaggtagtctttataataccaagatttaaaagttttagaggttgataatgtgaaaatttgacataaaggaaaggaattaagaactttaaaaaaaaaaaaaacaacttggagaatatcagagagtttgttaaggaataaattgtcctcctatccaaccctcaaattcatctttagaagcgcagacacccagtgtgactatatttggagatgaggcctctgggagtggggctctaattcattaggactgttatcttttttttttgtttttgttttttgttttgaggtggagtctcactctgtcgcccaggctggagtgcggtggcctgatcttggctcactgcaacctccatctcctgggtttaagtagttctcttgcctcagcctccccagtagctgggattacaggtgtgcaccaccatgtctggctaatattcgtatttttagtagagacagggtttcgccatgttggccaggctggtctcaaactcctgacctcaagtgatccacccgcctcggcctcccaaagtgctgggattacagacatgagccaccgcactgggctgttatccttttaagaagacaaaaagagaatgaggttgcatgcacacagagaaaaggtcatgtgaggacacagtgaggaggcag

SEQ ID NO: 5683 - DNA, 1055 bp, Homo sapiens
ttagccgagtgtagtggcaagtgcctgtagtcccagctactcaggaggctgaggtgggaggatcacttggactggggaagtggaggttgcagtgagccaagatcatgccactgcactccagcctgggcgacacagcaagactccttctcaaaagaggcaaaaagctagcacttccatctggagagttgattggaaatgtttttctcttctcttgaatcttcactgtttccctgagatgccatttgattgtgttttctagttttccacgcattgtttttttgtaattttttttcaaactgtacaatatccctgagagtagggaagaaagagatgttcagagttgaaggtgtcagagctaggaagtggcagagactggatgtgaaacccttgtcctgtgcccattagcccactccaggctgcccttgctatccaggttttattaattttagtgtcatcagccttcactgcgaaaagcctacacctattttactttattttcagtggatggtgtagctaatggacaagtataagactagcatgtctgtgtttgtcctgcatgtaatgaccagaattccctagtcattatgaacaccaactccaagcctgaattcttatccacgctcctgaactctttagtcatcacacattgggcaagttacttaacccttgcgagtttcaattcatcttcaaatagggaaaataataaggcctttttttttttttttaaatggagttttactctgacacccaggctggagtgcagtggcacgatctcagcgcactgcaacctacacctcccaggttcaagtgattctcctgcctcagcctaccgagtagctgggattacaggagtgcacaaccatgactggctaattttgtgtttttagtagagatggggtttcaccatgttggccagactgatctagacctcctgatttcaagagatccacctgcctcagcctgccaaagtgctgggattataggcatgagccattgcacctggccataaggcctatcttataaagctattttgagaaatgaaagagatgatggag

SEQ ID NO: 5684 - DNA, 1044 bp, Homo sapiens
atctcggctcactgtaacctctgtttcccaggttcaagctattctcctgcctcagcctcctgaatagctgggattacacgtgcctgccaccatgccctgctaatttttgtatttttcgtagagatggggtttcaccacattggtcaggctggtctcaaactcctgacctcaagtgatctgcccgcttcagcctcccaaagtgctgggattacaggcatgagccgctgcacccggcctctggctttttaggttcagaacattttcccctagaattactgtggtggtcaatagaaagaaagcccattatacgtatttatggtaggaacctgagagcagtgagtacttgttcgtgtgtgaaagacacctacagcatgttgtaactagactgaattctgaatgcagcctgttatacatgagaatatttcattcctagtatcatttctagtatgccaaagacagtggtgcgcttccattcatgaccacatagtgctcaccacacaattgtaccagtgcatatttggctttgtacaaacaggattaggacaagaaaattaccagttattgcgggggtcagtaacccaccaatataaaatagaagacactgatgatggtgaacagtattatgaaagagagacagtctctgattccaggaagtttactgttttaatgaggaggtaaaatgtgcacatgatgtatttaaaagaagaaaatgggaaggctttaaatagggaaatagagaaagtgctctaggagtttagtgtaggaacatattgttcttactagggaatcacaaaagcattgcagaagaaattaaatgtgaacctccaacagtggggatgggaaagatgggtgttctaggagtggagaccagggtaagtgaagctacagaagagggaaagtcacaattcctatagttgagcaatatttttcctggcattgaaggaacattgaaagtgattggaaggtaagtctgtgaaggtgggttgtagcaaatggtggagatctagaatgccaaatggaggttagcatttacagggtgcaagt

SEQ ID NO: 5685 - DNA, 1094 bp, Homo sapiens
gggtgaccagagaaggcttctgagcaaagttctgagtaaacctccccgagatgacatggggcagatggaaccccatgagaaaaagccctggagagaagtcttgcttagtaggcttgagagagagccagaaggctagcatggttggagtgcactgatggagaaggagtaataggagacaggattgtcaagggataagggtttggataatgtcagatcttataaggtataccagatgttcagtttaattctaagtgaaatgaatgcctttgatggactttgattagggtaatcatctgacgtgatatatactgtaagataattactttgtcttctgtatggagaagagattttgagggagcaagactggaaggaggaaaaccagagaagaagctattacagtactaatagttcaggcgaagtgtgatggtagcttggtctagaacattggtggagaattgggaagaagcggttgggatctgtatacattttaaggtagaagcaacctgtagagtttgcaatgcattgtatatgaaactgtgtgtgtgtgtgtgtgtgtgtgtgtgtgtgtgtgtgtgtgtctgtattgttgtaaacaaagatgagcaaaaaagaatcaagtaagataatagtggcttctcaaatcaaacacttcatttagtttttgtttttaaaaatcaaacagacatccttgaacagtggacattttaaaacattgttcctaaaaattactaaaaagttccaacattgtttaaaaatactaaatacgtgacaacaattgaaaagcacttagggtgatcatttgcatttgtgccattaatttagacatctttttgtaggtattacattaattatactcaaaaaaaaagtttttttgtgttgaagatcttcattattgcaattgtgaaagaattgaggatattttgacttctgtaatccatatattgtactaatttaaaactcattctgcttggtgtaatctttggtatatcttatgacttacatgaattggaatatggctcctttccattcatgaaaggaaggggaaatctgattgaattagtgcataagaatgagcataaatataaataataaat

SEQ ID NO: 5686 - DNA, 1032 bp, Homo sapiens
tacatggatttagttttttagaaaattattggctaaaaatcattgggtcttattggttgtaaagtgctgaacccactgtgcaaaaatcaagacacttagaatacaagaaatactgagactttttcccttcacggagattcccagtatggtattcatgggggcagtgacatctagcgttccctcccaagatagcaggcactctgaatgaagacagtgtgtttatttcacaagtagcctacaaactcagttatttcatccagggcctgaattttaccatttttgaaagtacgtcacattcatctaagtgagggggcctggtttgttccaaattttcatgaccatcggagcgggtctgacggtgagaccagacattttgcttgtatttctggttcagctccagctagggctgaactcagggggccccctggaaatggggcatttctgggaccaatctgaggatttgcaaagaattttaagtaagcacaaaacttttgattaaaaaggagggcacaaactgaagcccagcctttgtttctaacacactttgacaaaatggtcattttgaattagatatgattagaaacctcttaagaaataaaaatgaaaactcgccaaactcttttatggctatgcatgttctgtcctttgctgctctgtgtcagataatttttcttatacttgggatgtcctgaatatgtattttatttgtgctttttgatgagcacagcactaaggaaataagcgaggtgaagaatttaagaaagcagacggatctttttaggaggctataaattttccgcgtccctccactgcccactcccaaggccatgttgatgtttaagagaagcctgtggtctggtttttcagtctcgtgttggtgccaagtcagtgctttcattgtttcttactgagatcgggtctagatgctctgtgaacaattgtgcttatggttatgtagacttttagaatccttggtgattgtcattctataattctctcctgttattttaatttaaagtaagtcttgaggcc

SEQ ID NO: 5687 - DNA, 1496 bp, Homo sapiens
gcaagaggatcacttgaggccaggagttcgagaccagcctggccaacatggtgaagccctgtctctactaagaatacaaaagttagctggatgtggtgcctcttgcttgtagtcccagctccttgggaggctggggtgggaggactgcttaaacctgggaggtgaaggttgcagtgagctgagattgcgccactgcactccagcctgggcaacagagcgagactgtctcaaaaaataaaagtaaaaaatgaaaacctttgtgttcatgagcactgaaaaccattttaaaagacctttataaattcattgcaaaagaagtaaaatgtttgaaaatcatatctttctctcctctagtatagttttctttttatccatggaaaccaatccagaattttggaaggcattttgtgttctgtctttatcaaaagcttgcagtgtttccttttggaaagtagcattggcccaattggtattgaggtagtttctctttatagaagtatttcatctactacacaaaggagggaccagagaattaggatttcaccattatgcagtcctagagattggctggcaaacttgccaaagaaaggcagtgatatcagtagttgctaacgttacaaggaaaggaagaacctggcagtgtgtatccctggcaggagtacacaatacacctgtgacgtgtcctgccacattcacatcacaatccgatccaacctctagattgaaacagcagcctacactggaatatgttaaatgaccacatgccgaggcagaacccagattgtgtgaaattctgtaggacaaatgaccagttttcttttatgaccccattgctaaggggacaatgggaagaaatggggaatctgcagaggaaagaaacataagacccagcaaccagttgcaatgtttagaccttatttggatcctgatttaaacaaatgattgaaaacacacacacatacacacacacacacacacacacaaattctgtgagaccctctgcgaaataagaacacagactggatgtttgctgatattaaagagttactattttttgtttgtttgtttgcttgtgataatggcttttgttattaggttctatttaagtagtaccgatcatttagagatgcctgctgagatattcatggatgacatgcaaaaactggcattggattcaaaagcacattgagcataaaagatgtgaaatggccaggcacagtggctaatgcctgtaatcccagcactttgggaggccgaggtgagtggatcgtctgagttcaggagttcaagaccagcctggccaacatggtaaaaccctgtctctactaaaaatacaaaaagcagttgggcgtggtggtggacgcctgtaatcccagctacttgggaggctgaggcaggagaatttcttgaacccaggaggcggaggttgcagtgagctgagattgcgccattgcactccagcctgggcgacagagtgagactccatctcaaaaaga

SEQ ID NO: 5688 - DNA, 1115 bp, Homo sapiens
ttgtattcctttaagtatgactgggctatcagagaactgggatttattagggttacacaatcttgttctcacaatcttgaatgtagcaagtgtagtctacctcaataacacaaaatatgttttaaatttatcattgaggtttagtgtgcattccatgattattagtaatttcaaaagtatgactttttccctaatttcattgcttttagttatcttatttacttctcctgctatctgcgtctaggtggtaaataaacaaatgttgccactctcattactgagaaaaaaaaatgattgattgttggtctgaaaaacaaaacaaaaaccaaaaaaaatcccgtacatcaaaagacaacccagacactttggtgagaaataaaggaaaattagagaaaggttttcagttctgtagaagctggaatgaaatagagtgtgcattttggtggctaaagaagtggagttcagtggaagctgcaagcagccagatagagattttgttcaggaccctaaggagagaaatgaggactggaccaagaaatagaagtacactggcactgacatgaaaacaaaggtttatcacagatcggattactgaagactgaacttcagaaatgcatggaaatgttcaggaatgagagaacacgggaacgtgtatgtattacattgggtttcattttctgtttctgtccttgcacttacctacttgaattccccaatatctaatagattcattcattttccttatctcccatcttcagctccttagcatgagagcatcatcttttgcttgggtaaaagtacttcctagctgatctccctggcttctctctagccgtcttccaatctgtcttcaactgtcctgccaaagtggattttaaatggcacaaatctgatcatgcctcttgtgggaaagaaatcccactgctcttagtagaaagagaaaagatccccagcgtggccctcatgatcttgcctgataatcacctgcctctctaacctcatcttctcctccctctcttactttattctccaactgcttaagctgggccttctcccttctaccacgtagagcttccctctccctgcctttagtgaactccttcccacccttgagc

SEQ ID NO: 5689 - DNA, 1010 bp, Homo sapiens
gctcattgaatacaaagggcagccagacccctatgtggtactggtggttaggacctcgtcatactggttgggctgtcctggtgtcctttctcaaatctgttgtcagtttccaggaatcacaattctggtaatactggaactaaatgtcaatatttatatacatacatgtatgcatatatctgttagatctaattacataaataatatattttagatgtaatataaatcaattgataaatatgcacctgtgtgtgcatgtgtcttaatctttcactagttcttataccttttctttttagtatgacagctttcttaagaattcctcctactcaaacattgtctctcagaaagaatatgaaagttatgtgggtttcaaagaaagttatactcatatgccatagttctttatttctaggtttttacctttctaagctgttgcttttattaggttgcctccgctcacttgtttaacgttacattcagattcaaaacttctctgagcagtgggctcacagaagtaggctgcagactgtagtcctgtcttgctctttaagactcaatgcataagctttattcttgacattattattgatgttcaatatctagtcttcattcttttgtttactcctaaccatcattcttttagaactcagcttcgcagctcagaagtaattcctgtgtttacctaaactgtcttgctatttcgttaaggacatgaaaatctgtgagctgaataaatactcttaaatttaaaaggatatataaacatggtaagctctgtgtgcatttctgtgaaacacttctcaagtattgacatttgcatgctttggagagcagagacactaactctttttggtaagctttttgaaaaaatgttttaatttttgtgggtacataataggtgtatatatttatggggtacataagatgcttggatacaggtatgcaatgcataataatctcatcatggaaaattgggtatccatcccatcaagcatttatcctttgtg

SEQ ID NO: 5690 - DNA, 1050 bp, Homo sapiens
ttacctcctaccaggtccctcccaccaatacgtgggaattgtgggagctacaattcaagatgagatttggatggggacacagctaaatcatatcacgtagttgatctgttttcaatttttattccactgaaaggtcaattcagatttgctaaagtatccttgattgataggatatacctggttggacacaataaaaatcagttcctttactggaaacatgtgcacttaaaggagaatgctgaatcccatcaaggaacaaaactttctcccattctgtccccagaaactagtcacagaagggtttgcatattctttgtggtgagtgcatactgatgacaacttctgtttattcctccaacccacttcctagagccaggatagctttgtgcatctgattcttatgatgaaaattgttagattatttttggggaactgctgtgtatgaggcagtatgcttggtcctagaaatgtgaagggtataaaaacaaaaaaatatatagaatgcatttcttgtctacaaaaaaagacgattctggttgaaggaactggatgcaaatggttgagcttttagagataatggggaactagggagtactaaatcacagatttggtcccatttttacttatccaagacgaacataagaaattcaatgggaaaggaattcacctggggctctttgagaaataatgagctaaatgtattggagacgtaagtgagaaaggccagcagtcagcagttctgtgctcatcaaattcaggttatgcacagtccttttcctagatatgtatggtagtcttacagatgtggcacatctggtctccagagatgcacctctcccaacccatgagccatataccctgtattcctgtctttgtacagtcctctcccttgaatctgggctgcctccgtgactcacttttggcaggtctaacgtggtgaaagttatgccatgtgactttcaaggttaggtgagaagctttgcagctccttagggtttcttggaatgcttgttcttgggatgctgtctcttggaacccagaaaacaagct

SEQ ID NO: 5691 - DNA, 1695 bp, Homo sapiens
ttttacagtgacattaatgaaaggagcttggaatactccaaagagtcatggaaaaggagaagggagtgttagtgatttgacatctgtattagctagggctggtgtaacaaaagcaccaaaaaatggtgtggtttaatacaacagaaatttactgtctcacagctctgaagcctggaaattcaaaaacagggccaggcgcagtggctcacgcctgtaatcccagcactttgggaggccaaggtggacagatcacctgagcccaagagtttaagaccagcctaggcaacataacaaaaccccattcctacaaaaaatacaaaaatcggctgggcacgatggcacgccctgtagtctcagctacttaagaggctgagttgggaggattgcttgagcccaggaatttgaggctgcactgagctatgatcatgacactgcactccagcctgggtgacaaagtgagaccctatctcaaaaacaaaacaaaacaaaaaaacagaggtgttactggggctgtgctattgctgatgattgtaggggaggattctcccttgcctactccagcttctggtgtttgctgacagtcctggcaatgctcagctcctagctgtatcactccaatcacgtgctgtcttctcctgtatctttacatcatcttccctctgtgcaggtctgtctctgtgtccaactttcctctttttataaggacaccagtcatattggattaaggcccaccctagtgacctcatttgaacctgattacctctgtaaagaccttaatttctaaatcaggccacattctgaggtcctaaggcctagaatttcaacacagctttttgtggggtcataactcaaacccataacaacatcagaacattgtaattcaaaggaacacaaattcaggtttactttgaaactaaatatttctagaattaaatttgtccagagttacatggtctagtcttactttcatacaactctcttctaacacactgtgtttgtgctggatatccctttatgagttttaagaactctgaaatgtgaaaagtacaaataagtaatctcttgcattcctattttagtcaaaagatcaggctccaaattgctttattcatctttgagtagtattgcagaaaattttaactgaaaattatattcaaaatactgttttcaatttcctaatggaactgtaaccaattagtcaaccacaattattgaacaaccatgagtactgtattccctgaggagaaaaaacatagtttttaggcaactatagcaagatgcagcaaatgagatttatacacacacacacacacacacacacacacagagatacccagtagatgcagaatcaaggcactcttttatttaaaaaatccttttctctgccaggcgcggtgcctcacacctataatcccagcactttggggggccaaggtgggcagatcacttgaggtcaggagatcgagaccagcctggtcaacacggtgaaaccctgtctctgctaaaaatacaaaaatcagccgggcatggcagcacatgcctgtcctcccagctactcaggaggttgaagtgggagaattgctttaacccaggaggcagagattacagtgagccaagatggcatcactgcactccagcctgggcgacagagcaagactccatctcaaaacaaagaaaagtaaagtaaaaaaattt

SEQ ID NO: 5692 - DNA, 1084 bp, Homo sapiens
atcactgcttattttcctcactttctccagcaagccaacttctttccacctttctggtcttgctggattattattattgttgttgttattattttaaacctggaatattcctccctgccctttactttgatcctaaacatctctgtggttctgcagaaaagcttttcctgactacattgcacaaaggagcttctcccattattcacatcacccagtttgcttcgtataaatgtaattatttgaccagcagtttacattttgatcctctctcctctcgtctctttttctccttcatttttttttttaacagagtcttactctattgcccaagctagagtgcactgacatgattgcagctcactgcagccttgacctcgagggctcaagcaatcctcccatctcagcctccaagtagctggaaccacaggcacatgccaccatgcctggctaatttttttatattttgtaggggtgaggtttccccatgttgcccaggctggtctcgaactcctgggctcaaacgatcctcctgcctcagcttcccaaagtgctgggattacaggcttgagccactgtgcctggcccagactcaatttcttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcaccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggctgactcaatttcttttacctgtatttcagcactcgtcctttatcatcctgaagtgaaatgtatagttaatgcaaacaaccaacacacaaatttttaaaaaccatttgggtcaaaatactgacccaatgaataaaaagattaatttattctctggtaatgtgtatttcaatgggttattatgctggcat

SEQ ID NO: 5693 - DNA, 1049 bp, Homo sapiens
gagcctgtcaaggtggactgtcagcaagcaggaactatagcgtatgtttcacagcggctcagtgtttaacttcccgttgtattgttttgcttggtctttaacaagtactaagtagggaagtggaagcagatatagttaccccattttatggatgagcaaactgatggtggatactgaaggatcttgcccaagctcactgagctcataaggggcagaattagggcaaggacccaggcttctgcctcatttttttttttttaatgttctttcacctcatcaaggagctgcttttagaaagacacaggcttatgaaagcagaaagtgcattaaaaaaaaaaagacaccagctgagaatgcattaatgtttcctctttgtttcatgctctagagagattaaggaaataaaagcttttttttttctctttaactataaaagcaaaaataaagcagggcagctattaagacgattttaaaagtataaacatcttcgtgcaatttttttttgctgttgagtctggatagagtttacaagcaaaaaactcaccttttgtcctgctttttaaagtttagtttattgtcattacaccattgatgtgaaacaagtcaatttttacacttcaacattatttaaacaaaaatcttgagctaaaaattctttttttttttttttttttttttttgagacgaagtttcactgttgttgctcaggctggaatgcagtggcgcgatctcggctcactgcatcctctgcctcccgggttcaagcgattctcctgcctcagcctccctagtagctgggattacgggcacacaccaccacacccggctaatttttgtatttttagtagagacaggtttcaccatgttggccaggctgctctcaaactcctgacctcaagtgatccacctgccttggcctcccgaagtggagataaaaattcttgaatttaatatgttgttagttaaaggaagaccttccaggatgtctgtgtatatccttttcatggttaaatggagatacaaatggaacgtacttaatactatttgaa

SEQ ID NO: 5694 - DNA, 1050 bp, Homo sapiens
agttggttaaaaaaaaaaaaaaaaaaaaaaaaaaaagcctgagcgtttgaggactatcaaagaaaatcagaatgaaagagatatgtatcagtacattcttgcattgttacactgttataaagaaatacctgagactgagtagtttatcaagaaaagagatttaattggctcacagttctgcaagctgtacaggaatcatggtgttggcatctggcttctaggggaggcctcaggagacttacagtcgtctaggaaggtgaagggaaagcaggcatatcatacatggctggcactggtgcaagagagaggtgggaggtgccacacatgtttagacaaccagatcttatgagaagtcttatcatgagaacagcaccaaaggggaaaatctacccctatgatccaatcacctcctaccaggccccacctcccacactggggcttacaattcgacatgagtctggccagggacacaaactcaaaccatatcaagatagaacactgtaaacaaagtgaatatgggaaaacctggccgggcgtggtggctcacacctgtaatcccagcacttcgggaagccgaggcaagcggatcacctgaggtcaacagttcaagaccagtatggccaacacggcaaaaccccgtctctactaaaaatacaaaagttagccgggtgtggtggcatgcgcctgtagtcccaactacttgggaggctgaggcaagagaatcacttgaacccgggaggcagagattgcagtgcgccaagatcgcaccacttcactccagcctgagtgacagagcaagactctgtctcaaaaaaaaaaaaaaaaaagaaaaaaagaaaagaaaagaaaaaagaaaatgagtatgggaaaaccttaccatttgctcaagtcccagagaatatgaaagaatctatatcacagaaaagcttcttgactttaacagcgagttagtttgtgtcgtgcatgtggcagatattaaactgtgttgatgagtttggtttgaggacgtttacagtggaagaccacccaggaaatgacttgtcttgggct

SEQ ID NO: 5695 - DNA, 1050 bp, Homo sapiens
gttggttggcaagaggtcatgtgaatatgatggatgaggcaaaacttcgtagcccaattcattcaacttttgaagcgccggttgtgtgatgtgcagccaggcgttgtcacggagaagaactgggccctttttgttgaccgacgccggctgcaggtgttgcagttttcgctgcatctcatcgatctgctgagcatacttctcagatgtgatgttttcgctgggattcagaaagctatagtggatcacaccggcagcagcccaccaaacagtgaccataaccttttttttttttttttttttggtgcaagtttggctttggagcttctcagtccaacagctgagctggttgtcagtggttgtcatataaaatccaattttcgtcccacgtcacaatccgactgagaaatggttcattgttgttgcacagaataagagaagatgcttccaaacaacaatttatttttgcttggctcatgaggcacctacttattgagttttttcacctttccgatttgcttcaaatgtagaaagaccatagaatggtcaatgttgaattcttcagcaacttctcgtgtagttgtaagagaatcagctttgattattgttcttgagtagtcgctgtcaacttccaatggtcagccactatgctcctcatcttcaagtccctcgtctcctttgcaaagcttcgtgaaccaccaccgcactgtacgttcattagcagttcctgggccaaatgcattgttgatattgcaagttgtctccactgctttacgacccattttgaactcgaataagaaagtcactcaaattcgctttttgtctgacatcatttccatagtctaaaataaacataaacagcaagtaataagtcattagcaaaaacgcataaagcgagaaatgcgcattaaaatgatatataacataaccacatttatttaagaatgtattccaatatcaaatggcaaattccaacagtgcaaaaaccgcaattacttttgcattcacctataataaaggttttcaaagtagttgtttgttatctcaaagctg

SEQ ID NO: 5696 - DNA, 1698 bp, Homo sapiens
ggacagtcttactagaaatcagtaatcctgaggctgagcacagtggctgtcacctgtaatcccagcactttgggaggctgaggcaggcagatcacttgaggccaggagtttgagaccagcctggccaacatggtgatacctgtttctactaaaagtacaaaaattagctgggcacaatggtgggcacctgtaatcccagctactcaggaggctgaggcaggagaagcgcctgaacccaggaggcggagattgcagtaagccaagatcacaccattgcattctagcctgggtgacagagcaagactctatcttaaaaaaaaaaaaaaaaaaaaattgagcaaataaaaagttgtttatctcatggaaaccacgaggaaaatacacaagaaaaagtatagtaggctgggtgcagcagttcacacctgtaatcccagcactttaggaggctaagggaggaggactgcttgagctcagaagtttcagaccagcctgggcaacataatgaggccctgtttctactaaaaaaaaaaaaaaaaaattagctaggtgtggtggcatgcacctgtagtcccagctacttgggaggctgagccagggggatcacttgagcctgggaggttgaggctgcagtgagctatgattactacacccttgcactccagcctgggtgacagtgagatgctgtctaaaaaaaaaaaaaaaaaaaacacattatatgacatagttcattgactattatttacatagtttcaataaatattaaatatggagccagccaaaattaatttgtctatttgaatccctctgggacattctagcctgttgcagtgtagatctttctttctgtgctgggtgtcattctggaacattccgtgttatatgcttggggattcctttcacctttgttttgggttgaagctcctgtttcccagatcccttgatttctttcaagctttactgtcattttagtcaaaaaccttctcatttccctaggaagggtatatacatgtttttttcaatagcctgaatgtttacaaacctttctgtttaattgctagtttaaatgcttatggaattctgattgaaatagttttccctccaaattttgaaggctttttgcttcattaccttgtggcttccattgttgctttgagaagtacaaagcattctagtgctttgattctagaccctttgggacctgtctttttcctctgaaagcttatgggtttctctttgtccccagtgttatgaaattcataaaaatatgtcttggtgtgggtatttcaacccgtgtgccggaccctttcaattcagaaaatcagatccttaattctggaattaattctttattttctttcctctgtcttctttattatctttttctgaactcctgtaatttggaatttgaacctcttgggttatgtctacttttcttacttttcttctcctatcttccaactcttttttgttttaccctttggaaatgttacatttcttttaacctttcttttgctttttttctatttctattatcatgttacttccaaaagctcttattctaagtctttaaatagaaatttgttctagtctcatagataaaaccatcttttagcttttaactgtgaataattgtcataattgatttttctgtttgttttgctctctcatgaggttttctgaagatgcctgacaaactgt

SEQ ID NO: 5697 - DNA, 1047 bp, Homo sapiens
agagtggatgacctcccggattggtgtgagataacttttttgcttgaaagagactgctctatttattctgtgacatgaacattttttcctagtacctttggctgctaaggcagcagcatgtttaatttataacaacacaaacctctgagagcaacacttgaatcaagtgcagctgaactggaacataaaagattttttcttaactttttttttttaacacactaatcttcagttggatgaatgtaatgtataactatgttttcagcaacaattcttctgtttattctaattaatcagtgactgccttgtaagaaatgtttgtcatatgcgtgatgtcttctgaaatattcttataaccttaatgaccaattgctttcaattcttgaccagcactccctcccaaccagagaattactggtttgatagagtagtcttggaaaccatcaggtactgcctgcagacttctccagcactaaatatatttgttccctctataaaccattcatctttcggacagaacttactgtaaagaaagaaatctgcctagaggatatatgtaaggaagattccacatcatgagtacttgccttttaactttcccccacattactgttgagtcatggaataatgtttaagttgttatttgcatggaaattaagtaggctgtttatttatctaaaggaatcaagtccactcttctgcctgcaacatttgttcaaaaactaaccaaggtaaaatatttatttgaaagcccaactttgatgttaaatattcttgaataaatctgttattttaagaatatcacattattcaatgcatataaaactatcagaagttagtaaatcataccagcactaaaaataagacaattggaatatattttagcatcagtttacaaacaactttattatcaacagaaattttagctcttttctttgcaagatatatcacagctgctttgggcagtagctgaagccgaagtatgaacagtccattttgtttcttaaaatttgaagtcgtgtctgtcatagcatttttactaccagc

SEQ ID NO: 5698 - DNA, 1044 bp, Homo sapiens
tgacatttcatgatataatttgaaatatctttgtaaagttcaatttgcataatttttatattagttaaccttttcctccaccagggtaacttcagttggaagatgtttctactgtcaatcgaattttttaattcactgtgtgagatagaaaaagacatggtttctatatataaggggtgtgatttacaagaggctatgtgcatgtgtataacatggatacagtgcgagggacaaaccaatacttgtggttgcacaagggagccggggaagagtcccgcggaggtgtgtgtggtgggaaagttctccagggaagacaacattcgattgtcttgtggttgctaaaaggacgcttttgacgccagatgggcttgagtccaaatcttggctctgaaatttcctcgttgccattttgaccttgggaaaaaatattaactctcgaacctccatttcttcatctgtaacacagcagtaaaattactcatctctctagtcataataactgttgtcaaaaatgtctgttctctgaatgtttggtgggtttcagtagaaaaaataaggaagttggaagtgggaagttaaggatgtcagaggcagagacaaaaaagggcagggcaaggcatggaattttctctgaaaactttacttaatctcattaagtgttggttattgatgaatctatatttcaaagtaccagacataaaaccatatcaccttcggtctaatgatagtcaagtgcagtgctactgttgcaggtctgggaaaaattcaggccaatgagagcctttgatggccgtgggaacagtaaattgcagcagtgctgcaattaactagaagtgccgactgcacctccagcaggctcagacttgcatggctgcctgctggaatgcaaagcttttctcttattcacaaccctcccactcactcattgatagcctagggccagatctggatgtggaaaacattattccaataaaaggtgcgttaaaagaacactcaaggagtttattttttaacaaactcatgttgtgtaaaatgagatgaggg

SEQ ID NO: 5699 - DNA, 1025 bp, Homo sapiens
agcaaatgaagtagctgcctttccttgctaaattccatcatccacccccaccccagttttttctatattcaggcaaccccaggtaggcaagatgacagatttagaaataattcacagtggaatttccaacagattgtcaaaagaagagaaaatgataaagattagattttaacaatgtctttctgggatctattgcatttgacaaccttcctactatggcatttatagtgtttaatagcataaaatatacttcgtggaattttgaatgttggtgtatgcacatggagattctgtgacgtggcctagtcctagtgtcagccactatgggtgacatctataggcagagaaaggagttcctcagttaaagtattagctgatttcttcttctgtacaaatatggctaccatctgtctcctctgtgccgccccccaaggtaagacagtttgtgtcctgcctctccttaaagaagcctgttctctttgcaataggttttacttggttgccttgtgacagctctctgattgtgtcatgaaaaatgataatactgtagacagtccatttttttcttattgttagtgtggcagtgacgttgttgcttttaacacttgaggttgcctcatacataaatggaaggacttgaacttctggttgtaacttacctggtgctctttatgttgattgttaaatatatacaattgttagaggtttttattttagataccctgccattgtcatagcttgggttcttggttacccatgagtattgaagccattaacaaacatttcttcagagttagaaattggtggaaaaagctatcaacaaaattcaacacccttcatgttaaaaacactcaagaaactaggcatggaaggaacatacctcaaagtaataagagccatctatgacaaacccacagctaacattataccgaatgggcaaaagctgaaacattccccttgaaaactggcacaacacaaggatgacctctgtcgtcattcttattcaacatagtattggaagtgct

SEQ ID NO: 5700 - DNA, 1052 bp, Homo sapiens
gtaaatgaaggttttgaaggttcatctagaaacctgcttaccactgaccatttcattttttaatataatttttgatgaaatatatgtttaaacttccaaacaagcaattttgacattcgaaacatatctgcaagttggaatctgcttctactgttaatactttcagtttattgagagatgtctctgccagacattaagccaaggaattttcaaatatcaaacttaacattttcacagtgaaggaaactgaaatttttaggagctgagctacgtgtgcagggtctcatagctcataagtgataagtttggaatcaaacctccgtctttgtgacacccagcttttggtcttgtgttttcaatacctgctctgtgtcacacctgccaggttgcaggtgcattaagcaagataattttcattgctttctgaaaaattgtagacatattactgaaaaataaatctttcctagttgataccacaagaaagtatcatcgttttgaaactggcgtaagaagaatgtagaggaaaatcgagcaaagtctaagacttttgcatattattgaaagcatagtttctttaagattactggggaaaagagagttggtgaggcatatgaatgagaaagaaattcatcaaagaacgctactaaaaaaaactacaagttttctgaatgttaccttttggtgttttattgaataccgaacacttacttaaaatcttggatttatttttaattcttcagcaacccagttatatacatatcaaaacctgtttaattaatcggtttaactatgcctcattgcacttttgttcaacttaatttccccactgcattttattaatttctccttagacctgtaatcttcgaaactttgctttgctgcccagaagcatttccccagactttagagcttttatgaacaaattcaacaaaacaggagaagtcttatcctaagcagcacaaaaattgcccctctgatttttttctcccatagctcttactttcttctttgtgcttacttatccctgaatgataatcggttggtggtaatta

SEQ ID NO: 5701 - DNA, 1052 bp, Homo sapiens
tttttgagacagtctcgctctgtcgccctggccggagtgaagtagcgccatctccgctcactgcaacctctgcctcctggattcaaacgattctcctgcctcagtctcccatgtatctgggactacagacatgcgccaccacacccagctaatttttgtacttttagtagagatggggtttcaccatgttggccaggctggtctcgatctcctgacctcaggtgatctgcctgctttggcctcccgaagtactgggattacaggcgtgagctaccacgcccggcctgaattttactagaaatgaggtcttgctttgttgaccagcctcgtctggaattcctgagctcaagcagtcctcctacctcagcctcccaaagtggtgggattacaggtgtgagcatccgtgcccggccagagcaatttttttatagttccgatgatatgttttggttgtgtgtgagaatgcactttaatagaattacagctgttattctagtgtgatttagcaaatggaggataaaatcaatcatagaaagtttgggacttggtgaaatctttatagcgttactctttgacttttttttctttgtatcatgttacggtttgtggtgaataggtcactacgcagtggaacgtatggtttattagtaaacactgacaatgagatgaggctgttcctgggggtgtcacagtagattgaaggctggaaaagataggaaaataaggtgggtattcagagagagaagataatgaatagggagtgtcagaatgccagcatcatttgcctcaaatgccacttgttacgtgcttccactcttttattctctctgaggacatggtcaaagtgtcagtgtgaataaggtagttaacttaaaaggtgtattagggctgggcatggtggctcaagcctgtaatcccagcactttgggaggctcaggtaggcagatcacatgaggtcaggagttcgagaccagcctggctaacatcttaaaaccccgtttcttctaaaaatacaaaaaattagccgggcgtggtagtgagcgcctgtaatc

SEQ ID NO: 5702 - DNA, 1029 bp, Homo sapiens
tataacactttcatcatggacactgtccattttgttcttcagtgactcttaacataaaagatccacgtacaagaagttcttttaataataaagcatcaggaaaattatctcccttgcgtatctggtatatttcctcctttttgatagatctgtgaaatacattctgtttgtctttttgtcctggttaccaggcagcctagaaccaaatctggtctttagttacatcagctatattaatatcattattagtatatttgttccctctttctccttccgtggggtttaggacttcacctcttatctctgtttctctgcgtgttgatttcattctctcatactacagactctacttcatgaggctggaaccatgactgctggcagctcttgtttccagccccttttaccagaagaaggggctctctagaagaatcctggaaaggactctgattggcctgtcttggatcatgtgcccatcatctctgtggctggagtggggagggtactgtgaatggcaaccctcactagaactacatagttggagtcaggggtaagagcagtttccataatgcaggggggtgggtgctgtttgcaaaacaagggggatgcttatgaagcagaaaaacaatagatgtctatcatactggcttttattatttttctttttttttttcttttttttttttttttttggagacagagtctcgctcttttgcccaggctggagtacagtggtgcgatctgggctcactgcaacccctgcctcccgggttcaagcaattctctggcctcagcctcccaagtagctgggattacaggtgcctgccaccacgtccagctaattttttgtatttttagtagagatggggttttgccatgttggccaggctcgtctcgaactactgacctccggtgatccacccacctcgacctcccaaagtgctgggactacaggcgtgagccactgtgcttggccttatttttctttttttaattgttataatacttgtcctttattgtagactgcctcaa

SEQ ID NO: 5703 - DNA, 1024 bp, Homo sapiens
cctttgctattctttgttttcttttttcatctatttgagttgcagaaggtgtttatatgtcctaaatactgatcctgtgtctgataaatgttttgtaaatactttccccaagtctatatggtttaactatttattttaactgtaccttttgatgagcagaaatatttatatctgataagtttaatttatcagtgttttcttttgtagttattgcttactgtgagctaagacagttttgcctaacctcgaagtcatgaaggtaatttcctttatttcctctaaaaggttttgcttttgctaatttatatttaggtctgtgatgcatctgaaattatttttgtaggtttgagtattttgcatatggctatccagttgtttttcaccatttgttgaaaacagtctctttttctcactgggttgctttgggaacatcacatggctgcataagtgggatatctttcagaaatctttattctgctccaaaaatctgtttgtctagccctgttattctgataattttgtaactttatattgtcttgaagtcagaattgcaagtcctaaaacctttttcttctttttcgaagttctgcatattctccgtccttcacatttccatataaattctaataatctcttttctgtcttctccaagaaaggctgatgggatcatgattataattgtcttgagtctgttgatcagtttgaggagaactgacatcttaacaacgattgagtcttaatcattagtatagtatatctctccatttatttaggtcttttttgctttgtctgagcagtcgtttgttgcttttagcctttggtcttgcatgtcttctgttttaaaattactttttttttttcctgtttttttgagacagagtcttactctgttgcctcgctggagtgcagtggtgcaatctttgctcactccatctcctgggttcagacaattctcctgcctcagcctcccaaggagctgggattacaggcatgtaccactaagcacagctaatttttatgtttt

SEQ ID NO: 5704 - DNA, 1695 bp, Homo sapiens
tctccagcctgggcaacaagagcgaaactctgtctcaaaaaaaaaaaaaaaaaaaaaaaggacccttcatcctcaccaccgctttctctgaaataggcaaatgttccctgggcaaaagtggccaaaaactgtacctaggactttcattcttttccggttttagcccagaaactcctcactatcatatcagctctttaataccttcagtcgggaggctgaggcaggagaattgcttgaacctgggaggcggaggttgcggtgagccgagatcgcgccattgcactccagcctgggcaacaagagtgaaactccatctcaaaaaaaaaaaaaatttaatatgaaatttaacacatttcaaattaaaatagtgaaatgattattactaatattaaaaatattgacactaagataaaaataatttcatgttgacatttaaaatgattaagataattaaattttgtcgtaagtattaaacttttaaaaactccttttatagtggttctcagaggtagcgttgatctgaatatttagtctgcctgtataagaagtgttagtgccaacatctgaatttataaatgtttccctttatttatgtaactgtacatcataactggggaaatgattaagaatgcttttttttggtagtggtttgagtattctcaagcaatggaagtaagacagcaatgagaatttgttaatgtccttgttgtgcatttatttcaatagacatttaagggatctgttaaggaagttaacggtgttaatttgctttcgataaaactgaaaagatgacatttatttatttatttttaggttgggcccatgtggtttgtgccctgtatattccagaggtacaatttgccaatgtttccacaatggaaccaattgttttacagtctgttccgcatgatcgttataataaggtacagtggatattattttattactgtttgaatatcactactgggaagtagaaaggaagtttttgtgtttttaaaatcacaggtctccatcaaatccagggagatttggaaaaaaaattactactccaaactgcagttattaaaatgttattaatatgttactaaggtcacaggagtacaaagcaagcaaaactgtgttaccttttatagtaacctaggtatttagtattctacgatatacaggatattttaatccttacagattggtgctttatgaattactgacctcttttgcgctttcaagtatcaagagcctgttaaatttgaattaattattattttgcataatattcattacaatgtatcatacattcttttttgaagaacagtcctatattagaatgttacttgtctcctcctcccaaagttatttgtaccccaagatatggtttttattgttggccttaaaaaaaaagtttgcttttttcctgtatatttttcttcatttagtacatatatattattgttttattctcctgtgcattttaggttttaccattacccaatgtgcctttaaatatagttttattatttaattgaaggtacacattccatccgtggaagaaattgcagccagctttaagattttaaatgtttttgtgtaaaaaacctttttattttgtaattaatatttattttaaaaacttgaaaatacagacaagtaaataaatataagacaaaaatcattcataatcttattcaggttcatcca

SEQ ID NO: 5705 - DNA, 1025 bp, Homo sapiens
gttggccaggctggtctcgaactcctgacctcaggtgatccacccatctcggcctcccaaagtgctgggattacaggtgtgagccaccacgcccagagaatcctaggttttcaatagaggagttgaaatcatgtacctagttagataattagtttttttttttttctgtgtccttgtaaatattgttgcatggtgttatttggcaccacagtgcaaagtgaatgaaaccatttggttgtgttgaagttgggctaggttatgctttattactatttagaaattagtttctttttcaacatgtatcacctgattatatgtagttagacataactttttgtatcctcaacttggagtctgctgattttattcattatacaccgatacttacagattgttgtttttgcagttcagtcttctgtcacatgaccagccatgattttgagctgtgaaaagttaatattgcgtattagttacttgcacatggaaaatggaagatgtcagtcaaagtttctcggggtgttcattggctttgtatctcttgggcatttctgacctacttagctaaagtatcttcttctgtagcccacatatgtcagcttggtggggctgaatgacagcctacccgtataggattcctcacagacagtggaaatgaatgacctaaacgttgctaattcgtgtagggctgttatttgtctcttaggtcccaataccctgtttcaaaccctcttagatatgattatttcctgcagaggggaaagataaacattgtttttacacccttgttacaggaatcagtcttgatgacaaggtgttgggaagaagaggtgtggtagattgtgtcctggcccgccagcctcagtgcctgggaagagtcttcctgtcttgcaaagtttgtgagactgatgaagataatgcctttgtgaatttttttaataggactatttgtatgtctttgtttatatttttctgtttgtattgtatgcaaaaattagattattgtccaaaatgaattcatattttga

SEQ ID NO: 5706 - DNA, 1122 bp, Homo sapiens
caggaacacaccacacttaaaccatagaataggattactcacctctttgaagagagctagactactttcttctgtggccctcaaaggaataaaactctcagtcatatcattggaatgacttctctttgtctttgtaaaagttttctagcattgagagttacctggtacctgccctttttgtgtactttccttttggaattttgtgctcaagttgaacctttcagcatctgtatatgtgaagagttaagagaggacaggtcttttcaggaacatcagtttagaatgtgagggtgtgttgggtgagactgaagagtatggtaacatgagactagctaagaagaggctagtttatgaagaatttataagcagttagagttttagacttcgtccttgggcattgagccaggcagccagtaggattaatttttttttttaaacttttggttttttcaatagtttcaaacttaaagttgcaaaaatactacaaataataatgctgtactactcactcattccaaaaatgttaacattttaccatattaatgttaccatgtccttcgctctaccctcctttgctatctctctcactctctttctcctctactctctgtagaatctttctgaaccattgcagggtaaattacaaataacaatgcctctttagcccaagtactaaagtgtatagttttaattaaaaggggaatttcctaaacaattacagtacagtgatcaaaatcaataaattaatattgttacagattattatctaatctacagatcatattcaaattgcagccactgatgtcatctacaccaaagggggaaacatttttctcttccatgtccaggatccaatccaagatcacaagttgcatttagctgtcatgtctattcagtatttcccagtttggaatatgtccttattcattgtcttttgtgaccttgacatctcttaaagtcctatttcaggttatctgaggtattgccttctgtctttcttaggtcttaaaaaaggggtttgtagccatactcttttttaaatcttcatacagctgttttctaacagtggcctagattttatctttctctgggagccattctttgatttgagcattgtttgct

SEQ ID NO: 5707 - DNA, 1012 bp, Homo sapiens
tggagtctacagaggaaataaaagagtaggttgagtagtagaaggataaatgttatgttctttggatttagcaccaaggaagtcattgaagaggagtttcaatgtagagtttcaatatatttattggtagataaagtgggtgtgaggaagtacaggtagtgagagtacttaactcttaagaatctcagatttgctgggcttgcgtgtatagtcccagctgctggagcgctgatgtgggagtatctcttgagatcaggagttaaaggctgcagtgagctatgatcatgccattgcattctagccttgacaacagaatgagacctcatctcttaaaacaaaaaattaaaaaagaatctcagatttgaagacaaaagggaggaggcaggaaaaatgatactatgtcttcttctgttttggtggggaagaaagaagagaagcatgtaggtgaataactaggtcacctgggtagtagagcaaagaaactagatgtgggttgaaccctatcagagatattgctaggcagattgggtatacaaataaggaggccaagtgcgttattttcaaaagtgtttaaaataatggatcatgagattgaggtgggataatagatgtagtggaactagggaagggctggaacatagagttacaggagatattggagcatgggcctagagggctcagtaaggttcaagaataagtatagtaagagtgtgaattaactgcaaggttatgaagaaagagtagatcattgtggtttaatatttcattgggatatgttgggtgatggcagcttccaggtgttggaagacagttctccatggttctcacatttatacacatcttgtgagtggcagccctgactgcctttgttcttttcaaggttgtttatgttgtttatatagcaagcaaacagccttggaaaacagaggcactatcattcaaatttctcctgtaattcagtccactgtgtgtataaatgtcatcttgccccaggtcaccctgtcagaatggg

SEQ ID NO: 5708 - DNA, 1031 bp, Homo sapiens
gcaaatgacctagttttcatttccatttttatagatgaagaattagggacatgaaggtttaattagatttgataaatgtttacaaagcgtctactcaattcgagacaccatgctcaatccttgggaaaacagaatttaaaaatctggagagtcacaatcaatattgaacagtttgtttaaagttttgtatttgggggcataacaccagtagaatccggtttattttttaaaacttttctgctcctttctatggcctctcttttgtattttttcagaaatgtagctataagcagtgagagtgttatagtagatagatctgacttatctgagaagccatttaactgtggtatataatctaatctcctactgattgtaggatgcaccttcattttatgtgccactaagaaaaaatcatgccaagtaaactatgacacagcagtattataatacataacctgattttagagatttatttaaataaataaatctcttaggatctattaaacatggcatgtcaaagaacttagagttccttttaactctttcaggtgttgcatatacagttaaaagatgtgtatatgattgttcatcactatggtagctcatatttagaaaccatgtaaattgcccgtaacagatgaataaattatggcacatctgtaaaaatggggcattatgttgtgtctcagtttcttcatctgcatcaagttgattttagtgcttacctcatagagtttttaaaactaaattagttagtacatgtaaaatgtcctggcacatattaactgaaaacctggttgtttagacagaaaacacaggagcatcttagttattaaccaacattattattgtaacacttatgatttagaatcatgatttagaagactaatgaagtgcaaagatgtttttaatataagtgaaagatacatagtgtattcccagttttggttaggagatttttaggccaggcatagtggcttatgcatgtaatcccagctctttgggaggccaaggcgggtctaagagttgga

SEQ ID NO: 5709 - DNA, 1032 bp, Homo sapiens
ccatacccagtgatacaagagctgtgggagcaaagtaacgttgagatagctacagagtaaacagtgggtttcagggtcgatctaagtttttgttggaacaagaatcagaggagatgttcagagaaaaggatggggtacattgcaccttgttctcggagcacagtggaaggctttcagctgttgaaggaggggtggcaggtgtggacataataggggaggttcacaaccgtgtagggatgaggcaggtgaggatggaccaggagtcttttgatgactgacataaaaacagggagaaagtcattatccgattgaccctggtagacttcaggcaaataagatgaggccttgagtgtttgaagaggttgggtagagaggtagtatgggcttcttcttgatcctgatggctggtagaagccttcagtcataggttcctttttggggaacggtgtcattttacattggttcaccacactcttatcttctcttgatggaaagatagggataggtcagggaaagaaaggctgttttacccagaactttagggttccttctagactatatgggtttttaaaaattattgatatatcgtagttgtacatattttggaggtacatgtaatattttgatacatgtacacaatgtgtagactccatggttgatgatggtagagcacacttaaattgaaagtcaagggaactttaattcactactgtaatttttaaatgtctgtatcatgtagtgtttgcacagttttaaccttagtttaccatctcttactccttagtaaaaaattccgtttcatttatttctttattaacttagattatactgccttatattttttagtgcactttttctgtgactaacctttaacccttttgcatataaatgttttaaaactagaaattagcaacaagtatctacttcaatattatgttattaatgtggtatcactatcaccttttaaatattgcaactataatttactagtgtaatattttcacacaaatctttggtaacgatggtagtgga

SEQ ID NO: 5710 - DNA, 1072 bp, Homo sapiens
gtttccttcaaaagttttgctctgtcctccgctagccttataaactcatggatatggtcctctaatggatttgtagcaccttagttcccttattgtcaccttcctgtgttgaatactaaagcttattttaatttcatgtctaggaagtgtagacattgttaaaaaaaaatgatgttgcttgacaaatgagtatcttcagtattactgtgtcacttcataaatataactaatacatacttttactagttgttgcaatttgatcctgaaacagccatctttaaattatgtaggctttttcttttcttttctttttttaaaagtaattataatagacttaaattgtttttggatgattttcttaggtgaactgacttatttttagaacagaaactttgtgtttattctgcaagttcttcttattaatgtggcacccattgttttctgtaactaaaatgtaatcaactctttttccttccctttttgaatcaaaatgttagacttatacaagcactagcaacaactctatatctggatcattgaagcgcttggaagatactactgcacgatttacaaatgcaaatttccaggaagtctctgcacacacctctagtggaaaagatgtttcagagactagagggtcagagggcaaagggaagaaatcttcagctcacagctcaggtcaaaggggaagaaagcctggtggtggaagaaatccaggaacaactgtgtcagcagctagcccttttcctcaaggtattagtgatgttttagttaaaatacttgtgtttaagatggttaataatagttatgctttgtaaaataattggtttgtttttgaacttataactaatggatgttctagattattatatgattagttgctttagtaagattactttaaagatagtgtttcctattaaatttttttaatagggactttttctttccttttataatatgatttgtgcttccagagttgaattgtaattttaatgtttaactagatatggaataatgcttaaaattggggagaaaaataataaaagctggagctttgctttgagttctgtag

SEQ ID NO: 5711 - DNA, 1096 bp, Homo sapiens
tttttctgggaactgtagatcaaattagagtagaagcctagaaaacacctataaaatgtttgattcagagttcagattctaaaatttgtattatggattgaagtgtgtcctgataaatggcctgttttatagtgacttgtacaaaatggaaaattagtgtgtttctaaaagtgatttctaagagttttaagtttggggcttataggttttgttggttttttgactgaactctttcctacgtacatttttttgggttctgaacagttaggcacgaggtcttttgaaacatcaaaaacagttttggaagagttgacaatctgtcctttcctcttcgctatttatcttcaccacattacaaaaatttgatttactaaagtgaaagttgagaacatctttttcttcactaaaaccatcttgttattttctctgagaaaagtctgatattcattaacccatttatgctggaggttgcgcttttttgtgtgtgaaaaatcagaccttggtgatgaccttgagcagtaggatataaataactcccacaagcttaggttccagtaatggaacacgaggcataaagaactcaaattgcaaggggttgatggtttagcattcacttcctttcttggggcatactgtgtcctttcaaagtacaggttgagtaacctttattaaaaattcttgagaccatagtatttggaatttcagatttttgggagattttggaatacttgcattatatatacttaccaggtgagcatcactaatctgaaaatctgaaatccaaaatgcaccaatgagcatgagagtcatgggcgcactcaaaaagttttggattttggggctatgtttttggttaaataatatccaaggaattcccagttatccctcctttaaaaaaatttttgccaacagtgttagccataagggaatatcagttgtttccaggattagcaaacccaggtcctttgagtcacagccttggtcctagttttatcaattatttttccctcagaaagccatatagaaattaatttctcatattctgagcagattttgcttttattagtgttttattccttgttctctgcaccctctg

SEQ ID NO: 5712 - DNA, 1030 bp, Homo sapiens
atgtactcacttggaaaatctgcatacctacagcttcaagtatcacctatcacctgtgcttcttagcttcccaaatcgatgcctccaatttagacttttctcctgagttgcagacttatatttcgaaaaacctaataagcttcatttccgtatgatactcagccacctcaaccagacttaggctaggaagttaacttcaactctaccctctcattttcctagtcatcatttttttaaaaagcttttttctattattgatcagtttaacttctttttcttttgtatttccactgccccatttggttatgtcctacattgtcatctgaactgtttcagcaaactcctaaccttcattccattatccagtcccttttctagatgctactagaattgatggtcaatctaaagtgcaaatcagaccatgtcaaactgtcttacttagagaattttctgggacttatgggataacatttatactccttcacatggcatgtggagtttttcttcatctcgttgtaatctgattctccagtctcatcccttcttctccccgactttacgttgcatcaatagaagctacttgtagtttcctgatgttatactactatgtgcaacatctctgacgtagaccttgtttgtatctgttggtgtggacttccaactttatctagtaaaagtagtcattaaaactaagtgtagttgcatttacttcctgcaaagtttttttttcagactctttgatagaattaaccctttctctcttttttaatacttctgggttctcatatgtgatgttctaatacttcctccaattgatttctactctttctctggacacttttttttgtttttgtgaaatatatcttagtcatatttatctcacatttgtgaaacttcaaaaaaaagctttcattagacagttgaaactatggattattttcatcatttattctagcaactgatgcatttcaaaatgttttgaataggactttataaaactaaaatttattacttcacaaaacttattctg

SEQ ID NO: 5713 - DNA, 1077 bp, Homo sapiens
tggcatgttttacctccaagatactgatatttgatatgaaaaataacaacattagctattagtccaaggagttgaaagcagttggtgttgagttggaaaaaagataatcaaacctgtactttaggaagtttcaactggtgggtagcatgtaaaaagatggaaaagagctaatgctgaaacagagtaacccaatagttttttgttacaatctaaccaaatttattgatggcctgaatgaggatcctggaagtcaaactgatgagatgtgtattacccaagaagaactggtaatgacagtagctggaaaggatgggtattcatttactaacacaatatttaggtagagatgtttagcacagaattaaatagagcttgggcaccaaagagaattgaaactaggccacttagggggtagtaactgaaactctgagactagtataggctgaaaaatgtgggtagagaagacagaaagaggttgaatcaggtttattttaaaatagtgaagtcttaataggtagaaaggagattaaggattaagattcaaggagtgatatttcatagatcaagaatctggagcagatgggaagagatcaagtgaacatgtagaaaaattaagtttgaaggaagacagagaatcactgtggaaacattcactgtcagaaaaccccccaccaaaccaaattagttttctaaaaccttcataatttgaattaatgaatttttaaattattagaaattttaaaaatagatttccccccaaaagaactgattctttcaggtatgtgtagtaacttgaatgtgtttacaaaagcgttttctttttagtgtacttcagaatagggctttaatgattaaataagagtattaaataatacttaaatatgcaacggttatgcatctgagcgagttattttattttaaattctcagtgtcgcctgagaagtgatctctttcctctcctcttgtatttttttgtccgaaatacctctgtcctggagttactgtttgtgcctgcctgtctgtcattttctctgcctattccttaactattacataaatcaccaagtgctgccttct

SEQ ID NO: 5714 - DNA, 1050 bp, Homo sapiens
gtcaatattatgttgaataagagttgtgaaggtgggtgttcttgttttgttttaggtcttagaggaaaaattttagctttttcctgttgagtataatgttagctgtgagtttgtcctatatggcctttattattttgcagaatggtccttctgtgcttagtttgagagtttttaatatgaagcgatgttgaattttatcaaatgctttttctgcatctgagatgatcatatgggttttgtcctttattctattgatgtgatacctattatgttaaaccatccttgcattccaagtgtgagtcccacttgatcatggtgtattaccttttgatgttttgttgaattcggtttgctagcattttgttggggatttttgcattgatgtttcttggggatattgacctgtagtttccttttttgatgttgttgtatccttgactggtcagggccttgtagaatgagttaaggagaattcccttctcttggatttttggaatagtttgaagaggattggtattagttcctttgtatacatttggtagaattcagcattgaatctatccagtcctaggcttttctttggttgggagacattttattactgattcagtctcattactcattgttggtctgttcagggtttctgtttcttcctgattcagtctgggtaggttgtatgttttttggaattcatcaattttctctagattttccaatttgttagcattcatactattctctgctgtctttcatatttctgtggtatcagttgtaatgtctcctttttcaattttgattttgctgatttggttcttacctcttttttttgccttgtctagctagcagttcatcaattttgtttaccttttgaagaaccaatttttcatttcattgatttttttttttttttttgagagggagagggggtctctgtctaatcttcattatatcttttcttctgctgattttgggtttgatttgttcttgcttttctagttccttgaggtgcatcattagattgtttatttgcagtctttctacttttttgat

SEQ ID NO: 5715 - DNA, 1249 bp, Homo sapiens
agtctcttgtttagataaatgcctttactagaaaaacaactaccacattaattttagctaacccgtttgggaaattggtcatttccaataatactttcatttattgtatcaacttttgccagccatcttttaaaaatagatactttccttctttagcatacgctaaagatactttatctttttttgatgatcatcattatgcaaattagttgttgtgccatactcctttctattttgatctttagtatatatagatctaatagatagggaaactaagataattcagagactagatcaagaaaatgccacccctctgaaatttgaagctaataaggataaatattaatataaagcccttggcagaaggaacccttcctaaaaaagagtatatttctagttctagtgagagttggatctttggattcttatctaaggcaagtgatgagactgataattgaaagcaaaaaggtattccaagtgatatattgatatgtcacatagatgactgcatgaacgagagtcaaaaggctgggagtgtttccttgctttggaagtgctaaggcatctagaagtacactttataaagttaataataaactaaaatgagaatgctatcctcagtgtcttcttggaggaccaccgtatccgcattctgtactgtgttttctctgttggtcctatttttctctgccctgtcctgtggtcagctgttacttcttggtgtcaacagactgtctcgagataagactgtttcttcctccttctaattaattttccatttctaatctattaaatgtgtagtggatcttttttagaattgtatctacagtaagagtaaattggctctacaaaagctatttttaagtattaggatctgagacgtcaacagatgggactggtaatatctgttttttctgttgaattgtttgtatttttcttattctatattgttttattaatagctaagattcccaaagaattgacttctggagagagaaaaaaatcttaactgtatctctgtttatgaattgtgtgttttatgtgccctctactactaaatacatggtaagtgaacagcacgatcttcatgttgaagttataacttaccttttcccgagggacagttgattgttaaacaggactgaagagtaccaacttactgactttgtctgcatatttttaataagaggaaaaacaaaacccagaaattgacagatttaatttacacattaaagtgtgaactataaaa

SEQ ID NO: 5716 - DNA, 1056 bp, Homo sapiens
tccagaaggtacatccaggaacactttgcctttgtgcttataaaaatacaaacatagataggcaatttatatccataaacaaatttaggaacaaaactttatcatttagaaacactttacagaatttctactgttctattttaacttatttctaaggttaccggcactgcgtaaaatacttagtcttatgtgtgtacttgtcattattaaaaactatccaaatgtgtggtagttttaggaatgctgaagtcattacaccaacttcaagttgaaaaccgaagattagaggaacaaattaaaaacttgactgccaaaaaggaacggcttcagttattgaatgcacagctttcagtgccttttccaacaataacagcaaatcctagtccgtctcatcaaatacacacattttcagcacagactggtaagtgtgaaaatatttattttgtatctaaggaaaataggctttcagttttatttgtattataagtgagtaataattggtcaccagttatatgaagatgtagaaaaggaactataggttgtttttgaagggcataaagaatcctgttaagtgatcaacttgaatttaactttcttagtccataatataatggtaaaatttacttaaatgtctaatgatctcgttattgatttaaagcgatggtattcaatatagatttttttttcttatttaaatcagtcttaggaatagcaagactagatatttaagtggttttgatacgggcttcagcataagctttttaataagcctttaatcttacacataatgtaatttaatagggtaaataggtttctttttgtcttttattattctagctcctactactgattccttgaacagcagtaagagccctcatataggaaacagctttttacctgataattctcttcctgtattaaatcaggtaatttttgtatggttattttcatctatgttgatttacttgtgaataatagtatattaaatggtttaaaattattttaaacagttttgcagtgttctttaaacttagtttctcttctttcttacgctgg

SEQ ID NO: 5717 - DNA, 1141 bp, Homo sapiens
tccatttttttcaggattaagaattggaaggttttgaacagaatagtgaaataatgatttacattttaaaggattagttttgctgctatatggagaatagtctgtgtgtgttatagggtgtgggggagtgaagacagaggcaaaagtggaaaaagggagtgatccaggcaggagacgtaggtgttaaaatagtatgggctacgtattgaaaactgcctggaattgtggtatatatatgtatatttttgagagggagttttgctctgtcgcccaggctggagtgcagtggcacaatctgggctccttgcaacctccatctcctgggctcaagtgatcctcctgcctcagcctcccgagtagctgggactacaggcatgtcccaccatgcctggctaattttgtattttttgtagagacagggtttcaccatgttgcccaggctggtcttgaactcctgacctcaagtgatctgcccttagccttccaaagtgctggaattacaggtgtgagccactgtgcccagccaagatgttttgaagacagaaccaacaagacttgtttgctggacatacaagagaaagaagaattctgaatggttggttagtgacttttactgagatgtgggagaacagaacccaaccaattttggagagaaaaataggtgtcatggacacactaagcttgaaatctctttagatgtacaagtcaaatggagataaggcagttgcacagtaggtgtctggagtcccaggcagagatgcagttagttagaaatctggggttagtgctgcacaggtgatgagagccatcagatttgatgcggactcctagagcatgaagactgagtcctggacaccctagaaaaggagaataagccagtaaagaaaggctattgagaaactgtggccagtgagccaagagaaggacagtgtggcatcttaggggcaaggtgaaggaaatgtttccagaaagggaggagtcaactgtgtaaaatgcttctgtggtagggtaagaaagaattgaccaaccgggcgtgctggtgcatgcctgtggttccagttaattgggaggctgaggtgggaggatcactggagcccaggaggttgagggtgcagtgacacctgcacctgacagggactgt

SEQ ID NO: 5718 - DNA, 1046 bp, Homo sapiens
atatattgaaaatacttttgattctggatcattttcagtctgtttttagagtggtgttaaaggcacactgcatgtaagtgtatataaattcttaaatgctggccgggcgtggtggctcatgcctgtaatcccagcactttgggagacggaggtgggcggatcacgaggtcaggagttcgggacaagcctgaccaacgtggtgaaaccccgtctctactaaaaatacaaaaattagccgggtgtggtggcgcgtgtgtataatctcagctactcaggaggctgaggcaggagaatcgcttgaaccaggaggtgtaggttgcagtgagccgagagcacaccaccgcactccagcctggacaactagagcgagactcggtctcaaaaaaaaaaaatcttaaatgctgacactaagatgggatcttgttttttcttaccagttgcctcatcttaatatgagcactaaaactccatttatttgggtgtcttcctattaatcaagattttactctaataatagcatgtgtagctgtctcatttccagaacatggttaaggaattttcagcacaaattattgcttggagaccatgaggactaaaggactgtactttttccttcatctgccaatgtcgtgggctaaagtttgttcatttacagggatcaaacttaacgtaggtgaggattttttggaagcctccgcacagcttccgctcgacactcttgcttgactctgcttcccccagatgacttgcatgtttgctaaatccagtggtcccttctcattcttcatcttaacgtcacctggcaacggcattagacagagttgatcgcttttcctcctccttgaaacatttcctcctcttagcttccaggataccacatcatcttggtgtcttactacctaactggtcattcctttttagcatcctttcctgggtcctcctcttcagcctgagagtgcccaaggtggaattcagtgatctctcatcactgtctgtaaatagcatctctgtgctgatacttacatctccagccagacctctctctg

SEQ ID NO: 5719 - DNA, 2105 bp, Homo sapiens
tgccccgcccccccggcgtcgccgcacccaccccgcccccgcgccggccccgcccccgcggcgcgccgcccctcccccgcccgcccgcccgcccgccgccccgcacgcccgccgaggctcggggctcgggccgggctccgcgcggagttgcagcggtggccggatgccaagtgtaagtgtaagttgctatggaaaccccgaccgaggcgagttccgaatccggagcgagacggagccccgggcgccgccggatccgcccctcgcatcccggcccccgggcgtccgccgcgctcaggccccggcccaggccgactggaggtgctcctcctgcggccccagcacccggctccggaaatgccagggatgcagggagggcagaattgttttccctgcgcgtcgcgtaaaaacgtgccaggttctgcttgctggaaccgtctaaaacaaccggaaccccggattttcacttgcagattcttgaggaagttttataataaattcggagacctggaacaagccctagtggttggtaaatatccgcggggattgtgtggcgtctgcagcagccttggggctgctgggctggaggacaaatggaagaaagagaccctaatacgctcagctcccagcccccaccccagactttcttctacctacaggaatgatctgagagaccagaagtaatgttagttggatccttttgcatcagtttggtagaactgattccgatctgatgagtaaattccttctgtagaaacgttaggacagcccagctgtacagtgttaaatgagttttataaattcagtgtttcagggtttgtgattactagatgatctccattcttgttctgtgaattatggccattatttctgtgtcttgcaggattttttatcaagcagaaatgcatcgaacaacgagaatcaagatcactgagctaaatccccacctgatgtgtgtgctttgtggagggtacttcattgatgccacaaccataatagaatgtctacattcctgtaagtaccgagctttagctctcttttgtatcatgcgtatttcacagttcgacctggaatttgaaaactgttaatgattcctgcaatctgtggaaatgttggtacaaagtggtgaaggcattttcttctcttgcatctaatgactttttgttaatatgtattgattgtattacaagcatgcaatatatgtgttctcaggatatgaattagcttatttagttggaaatgcctttcaccatcttgttttctactagttctgggtttctaacaccaatgatttatccactcatttctaaacataaaaaaacttcacatgttctacttctagtctgtaaaacgtgtattgttcgttacctggagaccagcaagtattgtcctatttgtgatgtccaagttcacaagaccagaccactactgaatataaggtaggaaactgttgaaattccttgtttgtaattattattggagttgtataatttactgaaggcaaccctctttatttcttcacagaaaatttactcttgaatacataactaatatgtgtgtgctttgtggagggtagccgtttaatttcttgccatattaatggtgaccaagtttagacaaagtttagtagtattcaagtgattttaagatttttttttcctaactgtcctttaaaaactgagttagttcaccttttttgcattgctttatggacttcatgacaggcaggaataaatatttaaaagggcttccattcctctttattccctattcatattagctagtttagtaacttgaaaggcacacttcttttgacagagcaaatgtgaagaatttattagtgaatataaaatatttttctactgatttaaaaagtgctatatacagagaacttttattctcatagtttttatcttatcaataatagttatagacagcatcacaatcaagtaaaatattatagcacaaaagaagactatagaaacttatgaacatttttagttcttgccatctgaattcatagttttctattttaattatttttcaggtcagataaaactctccaagatattgtatacaaattagttccagggcttttcaaaagtgag

SEQ ID NO: 5720 - DNA, 1025 bp, Homo sapiens
gggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaagattgttgcagtgaagaaaaacctttaactg

SEQ ID NO: 5721 - DNA, 1034 bp, Homo sapiens
cacactccactttggggagtgttaagtttctttgacaatctgaacaaagagtaaccttctgaaaatgcacaaatacactacattctgcatataattgcagggagttcacggactgcctgaagcccacctgtcttctgaataactcttgagctagaataagcaggatcaaatccagatagccccacttggcatcagagattcttctattttacacaagcacatggccattggttatcaatttgttcttcctcagaaactctcccttgtggtctggattgtataactttgttcgaccataattttatactcatttgctctggtttgggccttttgtctggattctggtttgggaaatgctgttttgatctattggtatccatgttcttcaaatggctagatttagaggaaatctcaaattttctaattctgttaattttcaaggtgtcaataaaataactggtttctctttctgtccttaagaaattaaaaaacctgcttcctcgtgctgtaacctagtatagcccactctgctctacatctgctaccagttttctcacaccagaccttcacctgttcccactatggtagattaaagcaacaacctgtgcatgaactaaagtaacccggccctcattggaataccaagcaagcacagcacaaaagttaacttccattgctgagcagaacctccatttcccagatctaccttaacatcattcaaccaactgcccatctgtattaaagtcgggctccttcaccatggtcttgcaggtttcctctattactgtgcaaacttccattttataattcaacttattcaactggtaatcttcctccatcccttctgacatagcctccttccttcttaaattgttttcatctttggcaactctacaaaaactgaaaaagtatgccaggtaggtcttcaaattcagtgaatgcagaggtggtttaattttcttatagcctaggagatatctggtctgaaagcttgattcttggaacctctagaaagatagatgattccacgaaga

SEQ ID NO: 5722 - DNA, 1035 bp, Homo sapiens
ttcaccatgatgcccaggctggtctcaaactcctgggctcaagtgatctacccaccttggcctcccgaaatgctgggattacaggcttgagccactgcacccggccttggctagcagtctatttccactttacagatgcagaaactgtggctcagagagttactgggaaatacgacataataaactatcctatactgcctgcactttttctcattttaggaggcatagaaaaaaaatgaatgtgttattgaaataactcccagcagcagcaatgattctgtaaagtaattaaaatacaaaatgttaagtatgccaaaggagccagggtatttatatttttatattaattatgcttttgccacttttttctagacaggctacagaagtgatattaatttactttttactggtacctactgataggagctccagtactgcacagacttaaaattttaaattctacctgcctgaaatttttcttggccatacaagtagagtcggattttaatgttacaggtattttcggagtgagaacccaagtcaccaaggggctgtggttgctacagggtgcagaaggagcctaggagtcgaatatactgtcctttattccttctgtattctagacgttggcacttcctcccttgcctctatcccagacagaaacacagcccataattatatcctacatccattgtatgtaagagacaaatatgtttttcattgtgctatttttagccacagtgtttctagctggggaaaacactctcttcattccagggttttcttaacaatttttccagtttttccatgtcagactattcagaattattcaggttccacactcctgggagaaggctcttaatgaagtattgagtaggctcatcgagggggattctagagggattttggcatctgagctgctgagcctgaactcattctatgacagatgatgtctgtggtcccatgaattaggctgcattgaggactctcattcccagcactgtttgggggcactgggaaaaggttgagttacct

SEQ ID NO: 5723 - DNA, 1032 bp, Homo sapiens
attatgtgcaaaaaaagaaattgctagcatctaaaaataagcactctacacgtgtatagttttataatcttatcagctgtgatcttcaggaccaagtacgtggcaactacaggaggatggtctctgtcgctgtcaaaagctgagtattccaactctcacttacttgataccaaccacagaaggacatgagactgtaatacactgggattttcaaaatgcaaaagaatttgatattaaaggcttgttagctgtctaggaataaaacaagaatggggagaaacatataaagtaaggaagattatctctctacagctaaaaccaggcaaaaggaccacccactatggcatattgtgaaaattttgggggctacttttgtttgtcacaataattggagcagttggttgaagggtacaatgcagcagggccatgttctgttaaggaaacagatccactgactacatttgtgtttaataattgcatgcttagtggtctgtttctcctcagtgtgacgtaagtaactaccatgagtttgcctaatggaagtagcatccacacacatccagcacatgccccttgatggacagacagggaaggtgccagttgctcagtccccatctcaatgatcataaagaaactggagtctttagactgggtgcagtgtctcatgcctgtaatcccagcactttgggaggccaaggcaggcggatcacctgaggtcaggtcaggagttcaagatcatactggccaagatggtaaaaccccatctctactaaaaatataaaaattagctgggtgtagtggcccatgcctgtaatccaagctactcaggaggctgaggcaggagaatcacttgaagctgggaggtggaggttgcagtgagctgagatcatgccactgcattccagcctgggcaacagaacaagactctgtctcaaaaaataaaaaatttaaaaatttaaagaaagaaactggagtctttaaatgactgcctgttaaaagaagcagatgtctgagtagacaatcacatcaagg

SEQ ID NO: 5724 - DNA, 1073 bp, Homo sapiens
aattctggtctaaggtgcggggtaatctctgaagtagttaaacacaagtggtgtaaccaatgtgtcaggatgggagaactgggcactgggaaagagaaagactagtgttgggaggagcagggaagcaccagcaaggaaaaagaccctgtacatgaacttggctaaggaattgtttcagtgatagaaataccagacactgtaaatggttgtgcacatgggccagagaggtctttaaattacatttgaaacatatacacctactgtgtacccataaaaattaaaaactattttaaaaaataaattccatttgagccactccttcaaaccacccagagtgggtagacgtctttcgtgcctctaagaagccccatctctattctgcgtctcaccttgcagggctgctcatctgaatcctgaagatggtggacacccatctgctaggactgaaatgaataggacagagggaggtgcagagtgaatggaccatactacctgtcatcttggcaacgtgtgattgaataaaacaacttctttagaagtttgatagagtgatttgataatgtaatttacaagtgatcatttctttttattttcattttcagttgttttttatagacaaagtctcactctactggctaccggctaggctagagtgcagtgccacactcgtagctcactacagcctcaagttcctgggctcagcaatcttcccacttcagcctcctgagtagctgggactataggcatgaaccaccatgcccagctaattaaaaaaaaaaaatgtttttgtagagatgagtcttgctatgttgcccagaatggtcttgaactcccgacctcaagtgattctgtcacctcaacctctcagtcttctttttatttgtgtacctggcttcagcccttttgtttcttcaagggcctggacttgttactcctggcccaggagtatgttgttaaacactggattaatggtgtgacctatgcatctatttaatttatacgtatgtacagagagatttttgcgtgccgtcagtggctaaccaaatcaggcaaaccacagttcatttgagtaa

SEQ ID NO: 5725 - DNA, 1047 bp, Homo sapiens
tatgtgtgagaaaacaggaattagggagaggtaagggaggggagttggtcaacaggaagcagggggtcaatgaggcatcatcatgggtgaggggtctgacaatttattgtttagatgcagtgatctggtgagtgtcagcttcttgatgctaactgggaggcctgatggtttcctgagaaaagaactcagataagtcaaatgtaaccatctcaagttttaagactggggcgatcagtttttatgtttttttttttcaaaagaaaccataaacattggctctatggaacaagtgagtcagtttaaaaacaactttattaacagagttgatgatgtattttttatttactaggaataaatgatcaattgatatattgttttcaaattttcaggactgggttctttcctcctctcctttttataaccgcaaaatatcctcacaaacaatgtaattaatataaattttatctcatactttttgagatacatttacttttctgtttatagcttgtcttagtttgattctatgcactgagctgaacaccatacctactaccattctgctggaatcccagttttattaagtgaatttgcaacacatgatatggaatcactgtccttcagcatgtgtcttcccaattttcataactgatgacataactttatagggttcgccagtagcattgttatgatttataccatatcacatttgtagtatattgcatagtataaacatatgctgtttatatacatagtatataagtagcacatagcatatactatatacatagtatataaatagtataaatatatagtatataaatagtataaatatatactatgtaattagtatataattatactggagtgtatatatatactataaatatatacatagtttatatttatacatagtacataaatggtgtatatacatagtatataaatagtgtacctagtatataaatagtataaatatatgctatttatatacatagtatataaatagtacaaatataaataagtttataaatatattttttaaacaga

SEQ ID NO: 5726 - DNA, 1033 bp, Homo sapiens
acggaatagaacatgttgtagatggttgaccccttgcagtagggactgagggatcatgacggatacatcatggatggaaatccacaaagtggaaaccgtttttgcttgcctttaaaagcaaatctaaaaatatgttttctagcagctgtgtaactgcaaggaaaaaaaaaaaaatctgctccactgcaacacaactcgctcaccagatatctgcagggttcagatcttaatgcttcagaaatttgttgcagattttactgtatatatttagaccaaggagcctattagcttgcaatctgagagaacctctgcattttcatgaaaatgagaaatgtggcactgttggcaacctcgggctataattatgttaatctgaccattttaagactgaaatatgttgttttaaaatgtttctgtatttttattattcgtaacaatgatctgaagaaatttactgaaatgctaataagtttctattcagtatcactttgagactagagcacaaaaaatgagtcagatgtggaattttgatatttttaattttggcacagaatttttatcgacagatatgtactcatatacatagagtatcttaatataaaaactacccaaatataattttatattttaaatatagatacagtgagtatatgtgcaaagctgtcttggcagatatgtgcaataacaaaacatctctacatttgcattaaattcccaatctttgctctgccaaaaattaattttgcgcattattacaagataaatgtttttctatcaagaaccatgctaaagcacccagttccctgtttttgatataaatgtaggacaggactagaatggataatgtagttgaaattctgagagcctctaaacacatatcttgagctaattagttcggcttcctcttcagcagccaaagcttgcattctggccacagacaagtaatgacacgggtgctcttttcattcacaaaagagatgttctcccaggtggtaagatgggaaggaaaagagaatgatccaatgccaagatg

SEQ ID NO: 5727 - DNA, 1022 bp, Homo sapiens
gtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttccttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgc

SEQ ID NO: 5728 - DNA, 1079 bp, Homo sapiens
ttttatattcatttctatttaatattcaccaaatatttatggactatctactatgtgtcaggcatggttttaaagtctttgaagtacatcagtgaaaaaacaggacaaacatttcaggcctcaaggggcttacattctggtagtggagaaaacaaaacataattacaggaaattatgtagagtgttaggaagtgataagtgttatcaaaatagagcagggtaagtgagacaaggagttgggaggcaagatgggatgcaggaagtaagactgggattgtaagtaagatgatcagggtgggacttattggggaggtgatggctgatgtaagacttgaaggaagtgagggtgtgaaccatgtcaatatctggagaaagagcattctaggcagagggaacacagataacccaatgggaaaccagccctgctatgttttagaatgagcatgaagccagtttggttattttattaaagaagaattaggtgcatgtttacaaaaacaagcagaataattgttgagatgaatctgaagatcctgaagatacgtttttcattgtattatgatcaacttttctatcttaaaaaaatccaaaagctcaatatataataaatctattcaaaaagatgagtattcatttcaaaaatgtagctttgctagtaccttttcagaattatggtaaatgcacatatcaaattatgttaaatatatatgttgaaaataattatttggcttacatgatcatataactaagaacttatttatatgttttaattttataggctagagaattacttttcattctttgcatgctaaagtattagggaaaatatatgaacattcatttttatgtcaaatgcaatttaccatagttattaagtaattagttgtttactagctgtgacattctatttcattcttaaagaataaacagctttgtatggaaaaagtgtagtttagcagtcaagagacttgattctagcctaattcttgaaattatttaatgtattattttgaagcagtcattttaaatggcttcattttacctatgtgttgggagttttgttcatttgctttatatgg

SEQ ID NO: 5729 - DNA, 1064 bp, Homo sapiens
agagatggagaagctgtacaatgaaaacattcattttattcatttcaatagttggaatggctattttaatataaggcaaggtaacttccagacaagcagtataatcagagacagatgacatttcataatgacaaaaagttcaattcatcaagaggagaaaacactttttagtttgtgtgtgcttaataacaaagctttaaaattatatgtgtcaaaaactaagagaaatgaaaaaagaaatagtcatatcctcaatattaaatggaaatttcaaaatcatttcctcagtaatttaaaaaacaagtagaaaattatttgaggatacataaaatttaaatattctggaccataagacaaatatcaacaagtttaaaagagtcaaaatcataaaagaatattatctgaccataatggaattaaattaaaatctataaaataaaaatataagaaaaactaacaaatacctgggaattagatcacacacctcaaaaacaaactttaggtcagagaggaaatcaaaagaaaagtgtgaaaatattttgaatggaataatggaaatgcaacatatcaaatgtgtagaatgcatttaagcagtgcctagaagggcatttgcacctccctgtaatgtatattagaaaaaaaagatttaatatcggttatatagatttttgccttaagaagttaataaaattgaagcaaattaaatccaatataacctaaatgaaagaagtaataaagataatagtagaaatcactttagtaaaaaataaacaaaaataatagaatgaaaggaagagttgtctcttaataaagtaaataaacttgatctctttagacagatccagagaaaagtaagaaaatacatattatttatattaagtatcaaatggggaaaattattattgaatttatagacattcaaatgatattaatgaaatattatgaacaactttatattgataagtttggtaatttagtgtcttgggtctttctggaaagacatgagttgtataactgatatgagaagaaatagaaaatgcaaatagtttatattaataaaagaa

SEQ ID NO: 5730 - DNA, 1050 bp, Homo sapiens
gataaagattataattatgggggttttatcatccaatgttacagtttttcaggaatattcttacaagtttcttgacatttttattttatagataccctatattaatcttgtgaagcatttaacatctgcctgtccaaatgtatgtcgtatatcacggtaagtttacagtccatactgcaactactaaaattatccatttttaaatttattgttgtttaaaaaattttttttgtagcgatggggagctcactgtgttgcccaggctggtcttgaactgctggcctcaagctatcctcccaccctcaggttcccaaagtgctgggattgcagacataagcacccggcctaaaattattaattatattgcctgtaaatttctattctaaattgtagatctctgcctattcaaaaaacaggaatataataaagtttgagctcaacccagagcacaatgaacatagtttagtttttctttgattttgtgggttctcaaggccctatttataaaagtgatctattgatctgtcatttagcaagaatagaattctgtatgtttttccaaattataatgaccttttcagattcatgattaatttctagcaaatatttgggctgaattttccgtatctgagtctactaaatatatatgtatataaaacttacttgaaaatgaagtcatgtgcatttttgcatgtcccaggtttcatcacacaaccccagacagtaaaacacacagtggtgaaaaatacaccgatcctttcaaactcggttggagagacttgaaaggtctgtatgaggacattagaaaggtgagttttttattctgctgtgatgtaatgttttagcttaccaaaacttactaaaattttattttattttttattcttataattattattattttttgagctggagtctcactctgttgcccaggcttgagtgcagcggtgcaatctaagctcactgcaacccttgcctcccaggttcatgcaattctcctgcctcagcctcctgagtagctgagattataggcatgcgccatcacacctg

SEQ ID NO: 5731 - DNA, 1024 bp, Homo sapiens
agctaatgtttgtatttttagtagagacggggtttcatcatgttggccaggctagtcttaaactcctgacctcaagtgatccgcctgtctccccctcccaaagtgctgagattaaaggcatgagccaccgcgcctgggcactcctacactttccttacccatccccaatttgaaagaactgaatgctggttagtccatagtaccctggaccctatagagaaagctctgcacagagcaacctggataagttgtagatccaggtatcatcataggggtctctctccacatatcccaagattcagaagctcttgtaatttcttcttcagtggcaagcaaataagcaatagtgtgaaccctgcatcatttatgatgcaactttgcagacatccattatatccacagctaaatctgaaaatattcaggggttgctgcttttagataccaattattttctcttgacattaaaatgctaacaaatctatgactgttaggatcaagttaaaaaaattcccactgaagagagacagactttattctgagccttacgtgtttctttaggtttagaaggtgaatgagcagtggctggggaggatggcctagaagttggagctcacaggcttcctccctgcactctgccattccttagattggaggcgcccttgatacagatccctccctacacactgggggtttacttgcaatttaagacttcacattttatattagtatgaacagggaaaatatattttgtaaaaccacatgtaaacctcgtaaaggattcactggtagggtcattatattattctatctatttttaggtatgtttgaaactcttcattattaaaaaaatttttttggccgggtgcggtggctcacgtaatctcagcactctgggaggccaaggcaggtggatcatgtgaggtcatgagtttgagaccagccttgccaacatggcaaaaccccatctctactaaaaatacaaaaattatctgggcgtggtggcacacgcctgtagtctcagcta

SEQ ID NO: 5732 - DNA, 1158 bp, Homo sapiens
ctgcatcagcctctcaagtagctgggattacagatgcacaccaccatgcccgactaatctttgtattttaagtagagttggagtttcaccctgttgtccaggctggtctcgaactcctgacctcaagtgatccgcccgcctcagccttccagagtgctgggattacaggcaggaacctgtaactgtgcctagactacagaagtggtttttatatgctaatttgtccctaccctccactgcttttgttttaatactccccccttagaagaatttgttgtgatctagacatattaagaagttgtaactgaaatattaataaagaatgaggccaggcgtggtggctcacacctgtaatcccagcactttgggaagctgaggtgggtggatcacctgaagtcaggaattcaagaccagcctggtcaacatggtgaaaccccatctctactaaaaatacaaacattagctggatgtggtggtgtgcacatgtaatccaagctacttgggaggctaaggcaggagaatggcttgaacccgggaggcagaggttgtagtgagccgagatcacaccattgcactccagcctgggcaataagagtgaaattccatctcaaaaaaaaaaaaaaaaaaggaatgagtagcactgtagacatgatttccaggctgagagcagttgaaagggtctagggtttagttctaaggctgctggtaagaggagccagcgtgacatcatattttaaaattatatgtaaagcaagatcaaaagctttcctcatgctgatttagtgtcgatagttaaattacagcaccttttatgtagttatacttcatttttcattgctttctgccgggtctgaggaattggaatgagcattaccttgtgcagatgttcagattcgatttttaaagaaaaagtcatatttcagaatccctctcccttttttcccctctaagatacaacctgatggtatttgaaaataagcatttggaataagtgcaacatttggttagtgtgtgtttaaatgaggatatgttttaggttccaaatggttatttcgccagtttgattttcttgaaatttagtttttaaaaattgccatagatgatggtggtaataatgattaaaatgaaatgggggacattccctctgaactgtaaaat

SEQ ID NO: 5733 - DNA, 1024 bp, Homo sapiens
tttgtctcattaaaaatatgcttgctcaaatgtaatgtggtcttctgaatttcaaaaaagtattcatgtcttgtccaaatacagatatttgataaataaataataaaaaataccatggaaaaataaacttagtatttctaatagaattcctttggttataaggaaagggattttcatgggtgtccaaaaaatgtatttcatgaggaatcatacgttttacttttgggcttagattacccagattcagtttaattttttaaacatttgtataattgagtgctgcatataaatgccaaagcaaacaaataaaactaataaaagaaaaaagaaacctcagagagatactgttctgccatgaaaattctgtcttttgaaatagaagttctgtaattgggtttggttcatatatgtatatattaaagcatatttctatattattagcattgggaatatgggaaacagggacttggtttgaggatgcatagatcctgggttgaaggatgagaataaagttgaacagatgagaatgaaaatgcacaggcatccatcgccatcaccacacacgtgctctacaaacaaaaagtttgtgcaggccaggcgcagtggctcatgcctgtaatcccagcactttgggaggctgaggtgggtggatcacctgaggtcaggagttcgagaccagcctggccaacaaggcaaaaccctgtcaccactaaaaaaacacaaaaattagccagcgtacacctgtaatctcagctactcaggaggcttaggcaggagaatcgcttgaacctgggagagggaggttgcagtgagccaatatcacactactgcactccagcctgggcaacagagtgagactccatttcaaaaaaaaaaaaaaaagtttgtgcaaacaactaccccaccctcacctccttttctctcatagatttatagtattcctggttcattcctatttaattctccttattaaaagaagagatatatgtatacacacacacacacacacacacacacatacata

SEQ ID NO: 5734 - DNA, 2182 bp, Homo sapiens
aagttattgaagatttggtgcgtggtacgttgattctgatttttcttctttgttattcaaccctggtgtttagccaggcaataaagccacctctcaaatgactcctttccttctttataggtgaatttcttcagctcgggtcaaaagaaaatgagaatgaaagatttgcacactaccttgagaagacattcaagaagaccgccagcctgatagccaacagttgtaaagcagtatgtacgttctgtctttcttcaagttaaagcctcatagctcttttttgggagctaattttcctagaaaatatttcggtgaagaatcttaaaatagtacccaaaaatcccaagaggttaatgaggaaaagaatgacatccccaaacaatagaggacttctgctgtgttttcatttttgccatcttcttttggtatgcaggcgttgacttttcatcttttcttcccaagaattcaatcaaaataagctttcccgcaccttccccaatctgattgccaaactgtatcattttgaacaatttatcataatttctctaatgattgatatcacacacactctttctgacacttcaccttttagaaatgaagtgctctgttctttaatataatatttactcaggaaaagatatctgttagattgtactagcattctatgaacttttttttgtttttttgttttttgtgtttttttgagacagagtcttttgctgtgtggcccaggctacaaagcagtggtgtgatcttggctcactacaacctccacctcccaggttcaggcaattctcctgcctcagcttccctagtagctgggaccacaggtgtgcgccatcacacccagctaatttttgtatttttcatagggatgggggtttgccatgttggccgggctggtctcaaactcctgccctcaagtgatccacccaccttggccctgcaaagtactgggattacaggcatgagccattgcacctggccaatacattgcacctggccaatccttctaatatttttacatgaaatataaacaagtcctatttcttcagagtacaaattgagtataagccataactgtttttccccttgctttctccctccctccgctgtgcatacacatgtatacattttttttttaatgagtaatacctttaatccgtagacaaatgtgtggtattcatcgttagtccaagaatgaaaagcagtctctccatagaattgtttatctgcccatctctaagcctgacagatacacagagacaaaacctggacaaatgacattcccatgtaattacagccacaaaataaggaagacctgtaagggtcgcatgtcaattgctgtcatgatagactcctaacataattaacaggtaaagagagcttttgctcagacctctcagatgaaaaagtctcttgctgttagtgtctctgttttgaaaagtgtcaagaaatgtataattgcaaggcagaaaagaatgaggacaatcttttcttcctaaaaagacctaatagaaactttaaggaatgtgaattatgtagaacatgctagccacagtctcgaccacttttgtctttttattaaaagggctattatgtttttatttccaagaaattatgtgggttttttttttaaagtgagatggaagaaagtatagacacgagatgctaaataagagaatagcctattttaagtgggtgctctaacacttttacagtaatcctttacatattatcatgcccttgatggcccaactctccctgaaggtcaggatccatcctcttaacacattagggtgccttaatattacttactaatatttatccttaagaggatgtgttaagtgaggctcattgataatttcacaatttgagactgcaaacttagaagcattagcatggtcaggcaaggtggctcacacctgtaatcccagcatttagggagactgaggcggaaggtttgcttgtgaccagaagttcaagaccaacctaggcaacatagcaagatccccatctctacttaaaaataatgtttaaaaaataaagtcttagaagcattagtagtagtgagactattggaattggaaacaccaagacttactgtctgcaccatgcagacatcctgcaggcacggggtggggcggcaccaaattggagctagcacagaaattcactcagtgat

SEQ ID NO: 5735 - DNA, 1202 bp, Homo sapiens
aagacagtggcttgtttcccaggaaatctggtggaaatgagacctgagaggtcagagggcctgtccagttgttgttaagccagacagtagctgagttgagacttgaacccagagctgggtatggtaatcctgccttgtttctctctctctctctctctttttttttttttttctgaatttctattttctccagggctgcttgtggcctggaattaatgggctctcttcctattacttgattttcaaagcctcagagtaccactacagaattgcatattgtgggtcacattagcagaacactctttttttttttttttaattcatttttttgagatggagtctcgctctgttgcccaggctggagcgcagtggcatgatctcagctcactgcaacctccacctcccaggttcaagtgattctcccacctcagcctcccgagtagctgggattacaggtgcacaccaccacatgccacacctggcctcttttttttttacaatattcatatctatctataggcctcattcagatcttgccagttgtgaactgttataacgaaagggaaaacatatttttctgttccagcatccagtccaggatttcacgttgcattttgctgtcatgactctgtagtctcttgtcatctagaacagtctttctttgcctctcattaccttggtatttggaagagtgcaggccagttatgttgttgagcctctcagtcgggcttctctgatacttctcaagattcgatccaggttatgaatatttggcaggaataccacaagagcggtgctgtcctcagctcctcataccaggaggcgcgtgctgtcttgtctgtcccattactggtgatgcatgcctggatcgcttgattaggatactgtcgggccgggcacagtggctcacgcctgtaatcccagcactttggaaggccgaggtgggcagattacctgaggtcaagagttcaagaccagcctggccaacatggtaaaaccccatctctactaaaattataaaaaattagctgggcatggtggcgggcacctgtaatctcagcactttgggaggccgaggcaggtagatcacctgaggtcaagagtttgacaagcgtggccaacatagtgaaaccatgtctctactaaaaatacaaaaattagccgggcgtagtggcaggcgcctataatcccagctactctgg

SEQ ID NO: 5736 - DNA, 1045 bp, Homo sapiens
cctggccaacatgacaaaaccccatctctactaaaaatacaaaaattagccgggcatggtggcacgcgcctgtagtcccagctacttgggaggctgaggcaggacaatcgcttgagcccgggaggtgaaggttgcagtgagccaagatcatgtcatgcactctagcttgggtgacagagtgagaccctgtctcaaaaaaaaagaaaaaagaaaaaaaaaactattggataaagtgagtgcctttggaagaaaggaagctgattttcatcataaaccctctgtactttcattttgttatgtctttattctttattttttaagtaagttttacttgtgttttttttacatttaaaaatgttgtataaagatactttgtacatagaacttctgagaaattctaataagtaaaaattaggggaaaacgaatgactatgtaatattgatgagctagttgctttgcatgctaatagaataaaaatttgcttcaatatgagaaaaaggcctaaaggaagttagcactatgagtcgggaaaagaacattagagatgtagtttgactgttaactgtaatcctcagctcatctgatctcaaaactatgtgttcatttattatagcaggaagttaaaacgctgattcagtcagtgacaggcatctgttctgttttgttctgtatcttatagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaatt

SEQ ID NO: 5737 - DNA, 1089 bp, Homo sapiens
tacaaaaattagctgggcgtggtggcatgcgcctgtaatcccagctactaaggaggctgaggcagggagaatcacttgaacccaggagatggaggttgcagtgagctgagatcccgccattgcactccagactgggaaacaaagtgaaaatctctctcaaaaaaaaaaaagtccaactaaaaataaatataaaaaattaaaaaaaatgaaaagtctaacaaattatagagactacatttcattaacttccactgttttctttgttagtttacactaaataaaatttgttatttatcccagaataggctagaaaggtataacgggttcttttttccactgaagatgaaaaataggagtgattattcttggctattcagaggtccttgaaggtcctttgatcttcacagaggaactcacaatttctgtttttctgacttttatcccaagtgaaattgattcttaccaattaagcatcagtaaaatgaccagaataactataacatgatgaagggttaataactgaaaacatattcaaatatacacggccaccactaagaccttgatcaacaaaaggacaaagaaaatgaatacacagttaacacatatatgtatatatgggactgtgttcttttcactagtagtaattaaataaatgctaatataagaaagagtaaatgaaccatcttacactattaaatgggcaaaagaaaggaataccgatggtccagttagtaatactaccaaaaaagcacactaatatttttctgggggcattgtaaattagcatagtgctttctggaggaaatctgccaatatgtttttaaatataaaagtttttaattctctttgatctagtggcttatgctttggaatttattctaaggaaattgttcaaatgaacaaaatacacataaatgaaatcacttgtagcaacattgtttctaatagggagaaactagaaattacttaagttcatcatagaaacatggataaatgattgattatcaacttagaaacatattgtattcttggccgggtgccgtggctcatgcctgtaatcccagcactctgggaggccgaggcgggtag

SEQ ID NO: 5738 - DNA, 1522 bp, Homo sapiens
taaatttcaagccctgtgcattttgcagttcaaaacagaatcatccaggccaggtgtggtagcttacacctgtaatcccagcactttgggaggcctaggcaggtggatcacctgaggtcaggaatttgagactagcctggccaacatagtgaaaccccatctccacttaaaaaaaattatgcaaaaattagccaggtgtggtggtgtgcccctgtaatcccagctacttgggaggctgaggtgggagaattgcttgaacccaggaggcagaggctgcagtgagctgagatcgcaccactgcacttcagcctggacgacagcaagaccccatttcaaaaaaaaaaaaaacagaatcatccatatacctattgcaaaatagatatgtacgtaatgcagccttaccccaaaatgtgcctgaatatgttgcctgttaatttgtcctgtttaagtagcctgtgatatacaatcaaaataagtattatagaataatttatttaaagtttagaccgtttcattcagaataatgtatataagcttataattgcttacattgctttttaattctctgttgtttattttttccatttgaaagtggcaacaggtagcataatagtttatggggtcatttatcctaccttaacggaccatagttaaaaggtcaatgaatctcagctttatataactaaaacaaatatttttttccctcttaggaaagtgatgaagcattgggcccaacaatgatgagttggaatgcagttgaaaagttatgcgcaaaatctgcaaatgccattgagacgaaaggtttcaataaaaaggatctggagttagctctttctcccattcataacagcagtgcccttcccaccactggacgctcttgtgtaaaccttgctaaaaaatgcttctctggggaagtttcttgggaagcagtagaactggatgtaaataatataaatatggacactgacacaagtcagttaggtttccatcagtcaaatcagtgggctgtggattctggtgggatatctgaagagcaccttgggaaaagaagtttaaaaagaaattttgagttggttgactccagtccttgtaaaaaaattatacagaataaaaaaacttgtgtagagtataagcataacgaaatgacaaattgttatacaaatcaaaatacaggcttaacagttgaagtgcaggaccttaagctatcagtgcacaaaagtcaacaaaatgactgtgctaataaggagaacattgtcaattcttttactgataaacaacaaacaccagaaaaattacctataccaatgatagcaaaaaaccttatgtgtgaactcgatgaagactgtgaaaagaatagtaagagggactacttaagttctagttttctatgttctgatgatgatagagcttctaaaaatatttctatgaactctgattcatcttttcctggaatttctataatggaaagtccattagaaagtcagcccttagattcagatagaagcatcaaagaatcctcttt

SEQ ID NO: 5739 - DNA, 1024 bp, Homo sapiens
ttgccactattttagtgagacatctagctccctcagctaaacaacatgctgacaacatgctgaggcccagccatgaccttcttgatgcccctccatcttgcctctcagccgagatgagccagggagtctgtcctgagttttccgtaactttatgtgcacctttttgtttcagcttagtgtgttaaaattgtctgtattgtctcttccagagtaggctggtttctctttgggaaaagagatttttcttaatcgtctttgtatcctttatatctggcacaatacctggtgcccagttcagtgaatgatgagggaagggactctaataattttaatacagtgtacctaactactgttttcttacatgcaggatttctgacttccggtgagtgagcttctctataaagtaatgcggcaaagcacattaaactgaacagtcaaagtataactagatcacattgcataaaaaactatttttccttttagctcacttgtgaaatacaaaaatgaaccgtcttctgttttctgagcagcaagacatccagagaggtggttcttctctgtgaaaagaaatataggcctgaggcgtttttcatcaacttttaaaggtagcacagagtgaagacgcagtcttttttattataacagaaaaaatagtattgatacaaatattaaaaatggctgggcactgtggctcacgcctgtaatcccagcactttgggaggccgagtcaggcaggtcacctgaggtcaggagttcgagaccagcctgcccaacatggcgaaaccccgtctccacttaaaaaaaggataaaaattagctgggtgtggtggcttatacctgtaatcctagctactcaggaggctgaggtaggagaatcacttgtacccaggtggcagaggttgcagtgagctgagattacaccactgcactccagcctgggtgacagagcgagactccatctcaaaaaaaaaaaaaaaattgacaactacagaagggctctaattttccaaatcttttcatttta

SEQ ID NO: 5740 - DNA, 1052 bp, Homo sapiens
ccagctaatttttgtatttttagtagagatggggttttgctgtgttgcccaggctggtctcgaactcctgggctcaagccatccgcccaccttggcctccctaagtactgggattacaggcatgagccaccacgcctggcccagtttgtttactcactgatttaaccaatcctatagagtgccttctaggagctaggtgatattgcttcaggccctgggaataccctagggatgatctagactcagatccctgtcctcgtggaacttacattctagtggaaagagagacagtgaacagttacagacacaacataatgtcatgtagtggtaaatactaggaagaaaaataaagcagggtgagaggatatgaagtgatggcacgagacttctttttagacagtgtggtcaggaggacctctgtgaagaggggcatttgagcagaaacctgtgtaaagtgagggagcagacatttggaaagtcagctctagctttttcaaggcacttcagacttagattatactacttaaaacatataaacacacacacgtttcaacttctgatgctgtacattggatttggacatactgagtccttgtagtattatttcagaatagatgtgagtgtctgaatgcaacatattggtcagattgccattataaaaaacactatcacatataagaaggattttttttttttttttttttttttgagacggaatctcgttctgttgcccaggctggagtgcagtggcatgatctcggctcactgcagcctcagcctcccaggttcaagtgactctcctgcctcagcctcccaaatagctgggactgcagctgcatcccaccacacctggctaatttttgtatttttagtagagacggggtttcaccatgttggccaggctggtctcgaactcctgacctcaagtaatccgcccacctcagcctcccaaagtgctgggattacaggcatgagccattactctgcccaaaagagcatacttttattttactaggtagaaggaaataggaacaatgacaggtaatgaaatg

SEQ ID NO: 5741 - DNA, 1030 bp, Homo sapiens
tgtgtctagctaaaggtttgtaaatgcaccaatcagtgctctgtgtctagctaatctagtggggacttggagaacttttatgtctagctagaggattgtaaatgcaccaatcagcactctgtgtctagctcagggattgtaaacactaatcagcaccctgtcaaaacggaccaatcagctctctgtaaaacggaccaatcagctttctttaaaatggaccaatctgcaggatgtgggtggggccagataagggaataaaagcaggttgcctgcgctagccaccgcagcttactgtggtcgtcttcctgacggtgtgttttgttctttccgctttttgcaataacagttgttgctgctgagtctttggggctgtgctgtctttgtgagctgtaacactcactgtgaaggtttgcggcttcactcctgaaggcagtgagaccactaacccaccaggaggaacaaacaactccagacgcgcaccgtttttatgaactgtaacactcatcatgaaggtctgcagcttcgttcctgaggccagcaagaccacaaacccaccggaaggaagaaactccagacacgtctgaacatctaaaggaacaaactccagacgcaccatctttaagaactgttaacactcaccgccagggtctgcggcttcattcttcaagtcagcgaggccaagaacccagcaattctggacacacccgaccctccaaaaaactgaaaataaaggacaaatatttaggtctcatatccctacatgtttgcaggaaggttctgctttgagctgtatccgtataatgacaggtgatatcctgaggacattccacatttgcctctttggcatctggaaaagaatccagtttcaattccgaaacatcccatcatcgtaaatgctctggcactggcctctaagcacagtctccctccaccccaagatagtgcattcttccccacccacccccgcctcaatattcctactcccttgtccctcactggttttccagttgggactcttgctggtagggtg

SEQ ID NO: 5742 - DNA, 1049 bp, Homo sapiens
ctcaaagaaaaaaaaaagaatttgatgaaaatacagtaatattagatttgctgcatttgttttgtagatagatagacccaaaagatacagataaaggcatagggaattggactaacaaaatcagcaaatcttttgaataaagacctcactactttaaaagcccatggaacaattatacagaatcaatctcagacttgacaacaacaaagtaaatcctcaattgaaaagaagtagaggttttacaatacacattcttgataatttattctttcagaaaatatgtttgacctattgtgtttcttacatatgagttcatagcagcattttttaaaaaattatacattaaagttgatttttttggtatacagtttgatttttaacatatgtattaaaacaaatgtttatggtcatataattgccaccaccacagtcagcataccaaatagttccatcatccccagagctacctggtgctatccctttctgttctattctagtctggtcctcctgcctctaacctcagcagccacttacctggtctctagttttatcttttttgagaatgtcatgtaagtggagtcatatggtatgttacctttttttttttaattatactttaagttttagggtacatgtgcacctctgagactgctttcacttagcttaatgcctttgagcttcatccaagttcctgtgaattgtttgttcctttttattgctgagctatattccattgtgtggatgtaccacagttttagttggtttatctattcatcaattgtgagacatttttgttgtttccagtttttagtgattatgaatagtcctgttgtaaacattcaggtataggattttgtatgaatactaatttttatttctttagaatacatacccagtaatggaattggtgggtcatatgataaatgcatatttaactttggaaaacagtttggccatatttttataaagtggttgtatcatttttacattcccactagcttcatatgagaattcttattcttctatacccctcacctattatatatcta

SEQ ID NO: 5743 - DNA, 1069 bp, Homo sapiens
aaaaaaagaagggagaaaagaaaccacttccatattcattaattagaatgtcttgttattttcatagacagtaaaaacttcttgaaattctttttaatcttaggccacagaagcatcaatggatcatatttggtctcgtcagtgtataaagcatttacaaacctaactaaatatagaattaatgggagttacgtgcttatattccttatacataggagaagaaagaaaaggacccctttatgccagctttgagtttggcttgattttttacgacttatttagaagccctagggaatgagaaagtctcttaatggaaatactgacacagtcttaaatatagtgacatgaacaagcacttctgtgaagctgccccgggatgtgactgaccactgaagcaagtctgaaatgcattgagtatcagaaagtcaattatgatcaatttgctgataaatatcagtagaaccataatgccaaaatacagagaatgcctttgtaagatcaaaacttaacgttggtaaacttgttcttaacaggaaaatatcagaaatgtatgggatctttgctcttgcacatggaggagagagaaagtataaaatttctgtatggactttctcctattctcatatgcagctaaaaatagtcattcttaaaaagtcacaactttgacttagggttcttgtcaaccctgacagtaaaggtggcatgccgcagggtttaaatgagtgggtttagatctgtgctttatttcttaagtctcacctccaaagtagtagtatgctactaggtaaacaataaatcccattacttagtgaagtcaaatttgtaaaagctccatttgtttttatttgtctatcggctgtgctttttattctttggtggattttttttaaactctctaaatttttccatttttcatccttgcatttctctggaagtcactcctttacttgaaaatcgatttagtttcattttactctttctatgtttttcttttgactctcttaaacatttcattgttttcagcttcattgtttaatttttttttttttactttacatttttcctcttt

SEQ ID NO: 5744 - DNA, 1043 bp, Homo sapiens
aaaagatatgtgtgcttttgtttctgtaagaattgaggtctttgggtacttggataatcattctgatgtaggtggttctaggtaggtgggttcctttttgttactgcagtcattgtgtgtgaagttctaaggattatgatgaaagtggccccaattttcaggagggaaacctcataatgattgttaaccatcagatgactgcagaaaacactttctacatcttaaaggactagagagcaggtttctaacctgatggttgtgttatacagctgaatttgaaaacactgtcttctgatatgtaaaacattggatatgtcaaaaattaaactttactgaatctgtcctccaaagcatagctgattacacattgcaacagattagtacatcatgattgtcttaagatatgtgttagaataaagctaaacgattattttgagcgcattatgcttagttagaaatagtactcacattagtttattttggttagtatttttataccttaaaattgtttcccacacctgggagagtaaggaagttaggtctgaaatgctttatttgaatcaaagaattggagaaactggtgtgtgggtttttttttttttttttggtaggtttgcaaaaatatgcatgtgcttatttatacatgtgtttgtgtatatcagctgtagagcagaaattgattatagtagtactgaatttctagttttcttttgactatcaaaaaatgattctaaatattctcagccaaatttttttattttttgcagaatcagtgtgcaaggtggtttataagataatggagtgggttttttttgtgtttagtgtgatttgttatcaggagtcttattgtaacgcttaagcattaggttttttgtctgagaaactttaaagagtaaagcagaattgaaagtggaaattttaattttgtaagttcataaaatttaatgataatacaccaaagtttatgtttaaattagggagtttaaggtttcaattctttctctctttttttgggggggtgatgttttacaggcacttaagta

SEQ ID NO: 5745 - DNA, 1033 bp, Homo sapiens
caatattaaaagcttccaaggaaactcagtaaagtaccatgtgactttttgcccctattggcagctagttcttcaatacttggcttactttaaaaaaaataccttgcatcttgccccttttgtccacctaggatagaaatcagctttattcagtgtgatcatatactgagaaacattggcttcctctacataattactggtttgagaaaatacagtcagaagattgcactgggattgaataatttggatgagaagaaagtagttctctattgaatgtagttatagcttagtgctatttatgcagataaaccacatttttgtaacagtagtagcaggtgtatttgattattaaagtgttacaagttattgggttgcaaaattaagcttttagagttatcagttttgtgggtaagttttccatagtattatgtaaagcctgagatggtactctctatcaaccactcttctatagtggatttcatttctaatgttagctcttggagagcaggtactggttgtactatactgtatttattttgaaaaatttggtgattgtaacaaaataggatatggcacctcatcttcttacaaataggctcttattttagtgactatgatccagtttatccccaaatgcaagaagtcagtttttcagttataaatgctttcaatcatttccagcaaaccttgctcagccaattcttttacaggtgaagtaatcccaagaacattctgttgcttattcattcaacaaacctggggcatctactgtgtgccaacatttgtgtgatactcctgggagtcaagatgtgatcctggccttgaagctattcttaaatgctttgactcttgagagctagtggtgttttagccacttactttttctgtacccattttttcttcactttgattttttcatttttctacctgtatgaactccaggtacttgttagcttttcgtttttaaaaatttgcatctttcctgatgtttctttagcttcatttgcaagaaacttgatgtttttctgatcta

SEQ ID NO: 5746 - DNA, 1051 bp, Homo sapiens
agatttaatgattttctttactaataataacctatatgctatgatttgtaacttgcattttacaaagcaagttaaatgtggaacttgtgcgtttgtttaccttaggattaggctttactggcatcacagcatttttcagtaattactagatttcttagcatcttggatttcattgaaaaatgctcgttcagaagtaatgtatgaaaggacttgcagatacaatataaaaagtgagaaatcagggattgtgaaggtttttattcccaaaaaccttgctagttaaaataagacttgctgtaacatagcgtgtatagtttagagttagagattttatccattaggatttattaaaggaaataatgtctattgtaaatttaagataggttatgtgagagtataattaaaatatttttttgtgaaatgagttatttttatatagtctgtgatctgtctgaaaacatacaatcttgtttaaagtaaccaaaagcaaaaaccttaaggtacaatcgttagggtttgttttttggtttttttttttctggagacagagttgcccaggctggagtgcagtggtgtgatcctggctcgctgtaacctctgcctcctgagttcaagcgatccttctgccttaatgtcccaagtagctgggattacaaacatacgccatcatgcccggctaatttttgtatttttagtagaaatagggtttcaccaagttggccaggctggtctcaatctcctgctctcaagtgatccacctgcctcggcctcccaaagtgctaggattacaggcgtgagtcaccgcgcctggcccatagtgaagtttttattttgtcatttagctatatctttggaaaaatttggaaatgtattttcatctccctaactttcaaataaaagttactattaacattttgaaggaattagtagggattatttggtgataatgtctttttttaatataatttagtaacgtttgagtctttcacattgaataatagactggcagttgagcaacatggtcttaccgttgtttagatgactttgaaat

SEQ ID NO: 5747 - DNA, 1058 bp, Homo sapiens
tactatgcagaaatgtttgcattggatttccattggtcaatttagaaaacacaggaaacatactctgtttcaagagaagtggaataagattgaaggagtagcagtcttaatgtttcaactcttcattgttttttttttaattttagaaaacagtgtctgtgatgtaagcatctgtgcatgtaaattgttaaatttgaacactagtaccaagtcatttgtcttacgcttctcataatcacattttaactttttatatttttagagagatggttattatgtattgtttataatttaatggtatttctattttacaatcagtattttggaatgagttcacttagatccttagatccttaagacagtcttaattgaactgttttctagttgtgcaggaagtatttaaaatttttggtgtaacatacttggggttttggtctgtaattcacagaaaatttatatattctaatttgtgtctattaagcatctgttaccttattctgttgtgcagaattgtttggggggtagtgcatcattttgttatgatgctggaaagagtgaagatggaaataagctgggcatttgggatgctataccaggcactagatataactcattgtcaatttgataattacaaaaccaatttttgtggggttgtgtgtgtgtgtgttttgttttttttttttttttttttttttttaagacagtctcactctgtacctaggctggagtgcagtggcacgatctcgatctcacctcattgcaacctccaccccctggcaaaatcagttatttggttatttggggcttgcaaatatattctatgaacagtccttttcaggatttgtatgatgctttataattttcaaagggtttctatattgtttctcatctgactccacagtagctctttgaaataggctgatcagtattattcctgttgtactgatgaaattataaagtatttagcctactgttgttgaaactggaaaggaagtctcttcacataaaattttatctctgccttcaaattatactccaagtataactaattctcacta

SEQ ID NO: 5748 - DNA, 1030 bp, Homo sapiens
caggattgcaccactgcactccagcctgggtgacagagtgagactctgtctcaaaaaaaaaaaaaaaaaaaatggtagtgcaagtttagagtaatggttcccaaattaggctgcttattaggctcccctgagaagcttttaaagttacagcttccttgactccctccccattacccagaatcaaagcaatagttgatggagcctagaaaactgaatttttaggccgggcacagtgggtcatgcacgtaatcccagcattttgggaggccgaggagggcggatcacctaagttcgggagagaccagcctgaccaatgtggagaaaccccatctctactaaaaatacaaaattaggcatggtgcatacctgtaatcccagctacttgggaggctgaggcaggagaattgcttgaacccgtgaggcagaggttgtggtgagctgagatcacgccattacattccaccctgggcaacaagagcgaaactccgtctaaaagaagaaaaagaaaactgaattttaaaataaacactgggttaatttaagtatttataaactgcagatttagggagagtacacagaagggaagaggaactctgaagtggacattaaggaatgtgagttttatcattaacagtctgattattagagtggttatttggcaaattgtgtaatgtgttcttgttttaaagaattctctatcatctagattcacagataggatttgtaagtaattgctattaaatagctaacttaatatcctgtgcaagggcatctaatgcccagcagtagagaagtttctaattggacaggccagtgagatacattgggtagtatctggagccactggtgttactttagataatacctacttaggtactacatttccaccataacacctcgtctctagcattaagctgtcctgagacacttcagtggtaaatttcatttagcttttatctcagttggaaaaatagcctttctccaagttagtagagtatacttaggctgatcttaggtgttaacaaaagat

SEQ ID NO: 5749 - DNA, 1059 bp, Homo sapiens
tttaggcgtgagccaccaccacgcccagcccttgtatgtgtattgtaataatgtttactttttaaaaatcaatacattatttgttacttttcagttttttttcctcttagtatttattcttaggtatatgtgtggtttttgaaaagccatcttctgactttaaaaagcactaattttgtggatgctgcagtgatgtatcgttatggtttttcttctgcctaggctcagaatttatcagaatcaggtggttaaaatcaggcctgttggtcagagtggtagtttatattttggtttgttagcgctgtttcttccttatgacattagatactactcctctttctattgtaattctttcaatatcattaatgttgctgtcagtggaggaatgcaaggaagcatatagagggcttgtgttttgtgtagttttactttagaagacccttaattggttggcctttgggtttttgagaaagcatcatgttaaggaattacaccaaataaaatttaaaactgaaaattttgaatcatatagtcagaactctttgaatattgactggattctaatgtgtatgaggaatttcctttttgggtttggatattatgtatcatttaggattgtatgctggtagagagtattgttaactcgataacaagaattaaaatgagaaaaaaagagtattagaacagtcttgggatctggatgttgtcgtttttattttggtttttagtgttttgacagtgagcaaatccacttggctgctttttttttttttttttttttttgtcttcttgggtaaagaacaaggttgaatttgataatctccaaggtccttttcagaataaatgatttgagacctgtacaggagagcctttcgatttttgtactttaatttctgctttcaaatatttgttctgtgtcctgccagctcatggtaactttccctgcccgaggtagtatttatggcttcatttgtttgtgtggagacgaatggaatattttcccccaatgttcatttaatattttcatcagtatatagagaaggatggaacaggaaaata

SEQ ID NO: 5750 - DNA, 1035 bp, Homo sapiens
ctggtgcactcaagaaattcaaggaatccaaaggtggtgctgtcctgtggtaaagataagttgcaaagagtagaatataatttttgtgcactgtgggctttttacttgatacagttggctggcccttagaggtcaagtattgcttttgatgttattggaatgttggaaaatatcagaaaatcctagaatgacgaatacgggtagttcatttggtgcaaatcaacccagctcaatttgttaatataacaaatagaatgtgtaaaataaagctttggaggtgggtgtaatattttccatgagacacttaacgtagtacgtaaatatatcaggcagcctagtgtgtcaagtactgtgggtatggtagacaacagattagttaaatctctgctctcgagaaacctgatgtgtgtgtgtgtgtgtgtgtgtgtgtgtaagtctgatgttctcttgggtgcgatagtatatgagttggtgatagtgctgtcttgtagaaaaataaagctaggtaaaggaggaagtagtaagatatgcttgggaagtaggagttgcttttttatgtaacaatgaggaagctaagcctgtggctttgggagtgagggaagtgtgttctaggcagagaacagtaaatgtccaggccttatggtgagagtgtttgtttaaacaagttagctaccagtgtgtttctggtgggaaagtaatgcaagatgagttcagggaaggagtaacgagttgacctaagaaggaaacggaggcaaaattaatatagagatttcctttggaccaaggttgagcactgcagccccaaaaacactgggaggtgttctgtttagcatttgtgacaagcaagtttgtaaagacaaggaaacaaggagtgggctgatacaaggatgtttgatggcagttcccactggtttacagaaataacactgattattgttatcgttaatgataagggataagttaaggtgtccagcatatcattgttaggttaatttacggctacttggtgtcagtctagaacccacatagcaagaa

SEQ ID NO: 5751 - DNA, 1051 bp, Homo sapiens
tggctaatttttatatttttagtagagacggggtttcaccatgttagccaggctggtctcgaactctgacctcaagtaatccgcccacctcagcctcccaaagtgttgggattacaggcatcagccaccaggcccagccaattttctagtagattttctatgtgtttttttccagtttcttaagagcagtgacaatatttgaaaatttgttgcaaatataatgattgatcattttacaaccatgattttttggtctgatatagtgattgatctggtattttacaacatgatttttggtctggtatgtattgtctttgcacataggagatgctgaatgatatggtgatttagtaagtgttattaatgtttctgaatttgaatatattttcagaacatatttttatgagataagaaaggtagtaaacattaataaagctgaaaacatttaggcatttcattctgtgcttatttgaagaggttaaactaattacattatggctatactgtaaccaaatatcagatgttgtataaattgtagtgcattaatgacagtgatagaatgaaaataacaaagttagcattagggcaaaacctctagcctgtggttgtcttcccagtttgtggctttgggctttttttttctttaatgctgtttttcaaactgtgaaaaatgtattttttactaccttctgcaaagattttcttgaaaaataaataacggtgaaatctgtaacaattactagtgtgcagcgggtgatcaaaaattttattttcttttgtgttttatgtttgagtaaaactctttggagttaggtacaaagaactatattactctttcagcatgactcttttattcaattttattttttgtagagatagggtttcaccatgttggccagggtggtctcgaactcctgacctcaagtgatctgcctgccttggcctcccaaagtgctgggattacaggtgtgagtcaccgcatgtggccgagcattttagcattactcttttcaagtaatttgattcttttccttctagttgggaagattag

SEQ ID NO: 5752 - DNA, 1087 bp, Homo sapiens
accaccccacccagctctgcttaatgttctagtgacagttaaaagcagaataatcttcacttattgtcatcaattatcaaataatattattataaattgttactgtttttatctgttgtcttctcattacatttttctgtaggttattatggaaatacctgaatttttaaaaggaatttgctagatgctaatttttaaatgtaccaaattagcttttcattttgctcataaaataacacaagcagctctttctgtacaacctgcactttaattttggtcagtacatactgtataacaaatacacttcttgtttaatgtatttaaggtaatttattttgagcctgtcaaactcttgagctagtatgtttttacaggtaattttgctgccactctgtattttcgagatgtttaaaaatattagagtgtgcagaaagcaggagcacaatctagaatctgacatttataccaaagtttcatacttatagtactgccattgtgttaaaaaaaaattagagtaaaatatagtactgaaggctacttactctgccttagacgacgtaggagacttgaatcttaaaaagcacttcagttttgtttgatgcctaataaagcttggaaagtcagacaaagctccagggaagaatactttctgtcttactcttttggtgtcttataccagctttggcatataataaatgttcaataaattaaatgtttgttaagtgagtattgtgtgtgcacgtgtgtgtgtgcatatgctgggagtagggtggggcaagtgttgactgtttttataaaaaaatagaaaaagtgtgaggaatatattttgagtaaatatttactgtataatgtcagtccttggacacaaaacaaattaagttgtcaaaataagcacatggtaatcagagtggctattgatctcagacagtaagcaggtgagtttagctggatttggtgtacactgtcagtcctcaaagtacagctactccatttgtgaatgtatgttgatttttcttatgattgtctgtattctgtagtttcctctcccccagtgtattcgagaatgtcttcctattgcttttactca

SEQ ID NO: 5753 - DNA, 1024 bp, Homo sapiens
tagaaccatcctgggaatgcctattaaaaattcaggtattaagccaggcatggtggctcttgccttcagtcccagcactttgggagaccaaggcaggtggatggatcacttgaggacaagagttcgaaaatagcctggccaacaaagtgaacgtctctactaaaaatacaaaaattagtgggacatggtagcgtatatctgtagtgccagctacttgggaggctgaggcacaaggatctcttgagcccgggaggcagaggttgcagtgagtcaagatcgtgccactgcattccagcttgggtaactgagagatcctgtctcaaaacaaaacaaaacaaaaaaatttaaaaattactgtgaattagaatctctgagaaagacaactttgagatctacaatttttaatatactaaagattcagatccactactgagctttattcagtcctatttttgcttttgtctgaaagcaatatgagatggtagatgtctttgaattatttcatttagtatacagatatacctgttccttccttagtgtcttaaagagaataaagacactaagacttctaagtctgtggatctggtaataaattctggcggttgtcagggtctgaataaggacataaatgccataatattttgctcctgagtagactgaaaactgttgttccacctttttgaaagctggttgcctttcccactgccatttaatcatatagagttgtatgtcctccctctgctttccctactcctaatatcctggttcccttttgtaaatggaagggcattgtaattgcttaatgtccatttctcgctgagtcaggtatgttttgatgaattttttttggaccattttctgattattttcctaggccctcactctttgaaactataggttgtgtccttctcacccttaaattttagcttctgaagtttcagaagatgccaaatagggattattctgtcaaaaatactgaagattttgtcagggaaaatgtcattctcttgtaccgacccttgga

SEQ ID NO: 5754 - DNA, 1032 bp, Homo sapiens
taaagcggagtgaatttctggatcttaacctcatgagagaggtcaatagacctcatttgtaatataccttatgtttgtagaatacctgtcaggtctttcagcaaacttttaatgtggcactttcatttcatagatttaagcatagaacatactgttcaagaatgtgtgcaaataaatgtctgagtggggtatctaacccaggctttttaatggattactctgggatttatttcagtcagtaagattaggtttttttccattactgtcgacaaacttaaggaaattttcatggaaatcccactctgcgagtagtgcatatatattctagtagtccatattactagttctacttcttatattcagttgtaaatctgatttttaaaaaatctttggagttatatctgaaaagtagaaatttcagcatagatctcatgtttttctttaaaacttgaagtattaattttcctttgttactaagcattttgggatcctaaaaccatttgtgaggtttggtgattctctaagactctcaggactcaacatagtcattatcatgactgtgacttactacagtggacaggtgcaaagagaaaaggcacatggggcaaaatctgaaggaatccaggtgtaagcttctaagaattcttgcctaagagtcatacaggatgcacttaattcctccagcaacaaattgtgacacacttgtggaatgttgtctaccagggaagctcactagagatttagtgtgcacggcttttactggatttggtgagttatataggtactctttgccttgcatgtaccaaaatttcagactccagtaggaaagcaggtgttcagtacaaaccatattatatacccaaacagcttaggtacaatgagcgattcttttttttttttttttttttttttttttttttaagacgggttctcattatatcacccaggctggtctcgaactcctggactcaagggattcccctgcctctacctcctcagtagtcgggactagtgcaagccactgtgcctggc

SEQ ID NO: 5755 - DNA, 1025 bp, Homo sapiens
gcccatctacactttttagttgcggtggttggttgccccttcgtgttttccatagtttgtctttacttttaaaaacaaaaaacctggctgggtgcagtggctcatgcctgtaatcccagaactttgggaggccaagacgggaggatcacttgagcccaggagtttgaggccagccctggcaacatagtgagaccctgcctctacaaaaagttagctgtgagtggtagcatgcacttgtagtcctagctactaagaggctgaggtgggaggatggcttgagcctaagaggccaaagctgcagtgagccatcatggtgccactacactctagcctgagcaacagagcaagatgctatctcaaaaaaaaaaaaaaaaaaaaaaaatctaggatagataggcagctgtccacaaaggacttttgaatagtcagtatagttaataaaatacctacatttatgcatctttaattttgatggaaattttaatagtttaataaggccgtaatgtttctttcacatgtagaattaaaattgctgagctttggttatggcgttagtggtataacaattggtataattttgccattagtgagacatgttagtgttctgtttgctacgttccatctcacacaccagttaaattatgaccatgttcactccttttgttttctgtataccatttgttaggcatttggccagagctgtttagtatggaaactcatgcccttaatgtaatttttatatgtttatctttttttttatttttagagaacagagacaaaaagaagcaaacaagatggcagtcaacagcttcccaaaagatagggattacagaagagaggtgatgcaagcaacagccactagtgggtttgccagtggaagtaagtattaattttttttctttgaaatgtatgtttgacttattcgtatttatttttcaaatctgtatccattgccatctacatatgtaaattaaaataaatagaaacatacggagattcttttatgttggatttattataccctc

SEQ ID NO: 5756 - DNA, 1046 bp, Homo sapiens
ggatgaatgaatatatgtagaagtccagcttaaccatgtaaaacaacacggttcataaatgggcaaaggactcgaataaacatttctgcaaagaagatatcctggtggccagtaagcacatgaaaagatggtcagcctccttagtcattagggaaatgcaattcaaaagccataatgaaataccacttaatacccattaggatgactattataattaaaaaatggaaataggtgttttggagggtatgaaaaaattgaaacccttgtacattgttggtaggaatgtaaaatgatgcagctactctggaatacagttcggcagttcttcagaaagttaaacagaattatgtgtaggatctggcaattccatttctagatacatacccaaaagaaaggcagagactcaaaacatgcttacatgcgggtgttcctagtaattcacaacagacaaacattagatagaaacaatcaagtgttcattagcagatgaaaggatacgacgtgatacatagactaacaatacaatattcagccttcaaagggagtgaaattctgatacatgctacaacatggatgaaccttgagaatattacatgaaataagccaggagcaggacacatattttatgattccacatatactagggtacccagaatggtcaaattcatacagacagaaactggaatagtagttaccagggactgtttggtggtgtccggggtgggagtgggtgttaagtttctgtttgggaagatgaaaatgttctggagacgtatagtggtgatagttgcacagaaatgtggatgtacttaaagacactgcattatacttgtaaaatggttaaaatagtaagtttgatgctgcgtatactttaccagggtaaaaacaatgcaagagaaagattgccagtgcatgctgaaaattaagattactaggaggatatttttcactcttgagactaatgacaacaattgaatgttgggaagcacagtatgtgggagtgtgtaagtgggtcttgctagtaggggatgtcactttagcaaaat

SEQ ID NO: 5757 - DNA, 1121 bp, Homo sapiens
agtttcttaaaacaaattaattttccccattaggttcaccagcatttttgtgtattgaagggaaaaggattattctctaatcctagtataaaattgtactcagaaatttaatgttttattttgtgtatgttaatgtttatattttatgttttcttcatttctttaattacaggcatcaagattacgcgaagaagcgcataacatgggaactattcacatgtccgaaatttgtactgaattaaaaaatttaagatctttagtccgagtatgtgaaattcaagcaactttgcgagagcaaaggtaagtctttcactgaaatatatttttatgtttctcaggattatgattcttaaatcgaactaaagaatgtaaatcacattttatttatgaaatgtaaagttctcttcgatacattgatcacattctatcactgcattttcataagttaatatttctcgtgaaggataaagcctgtcgattttctcttaacccatgatgaatgcttcattagacttttctcataactccataagctgcaataatatattactgaaaaaatgaaatattgaccacaactaattataaatgtcctctcttgctgagggtgtttccattgaaatttcagattatttgtccttgcatcatcaatagatcccttgaaaagtatagaaagaatttgtctagcaagtttagtgtatctgctgtcttagtatttttcacctgaactcttgtcttgtatttcttaatctagtgtttcactcaagtagaatatctaggtcacaataataatagcataggtattattttttaatgcctattacagaattgaggacaaacttggcaatggctttatgtcctgtctgtgcaagtcacagagttacaggtcgattgaatcttgtcaagaaaccataaatatttagtaaataccaaatggagtttatagtacaacttgaaaaagtaagtttatttacagttactaaaatatctggaggtactctctgagtaacaacttgggttcttatagtcagattgctctgaaagtagttctaacaaacttcattttggcttgttacatcattcgacttttgggaaattattcattattgcatcttaggaaaaca

SEQ ID NO: 5758 - DNA, 1025 bp, Homo sapiens
tgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgttaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactataaaattaccttgactttttttttcctttgctgaaatattagtcacatagccttagcttcacactgccagtaatgtatcaaatcacaagggtttccgcatgaaaaaaatcttttcttcccccacaaaaaaaccttta

SEQ ID NO: 5759 - DNA, 1076 bp, Homo sapiens
caaaggtgggtgccgggggcgcacggggcccggggtcccgtcctcgccgcggggctttggagccggctgcagaggctttgttagcggcaggcgaggctccctcctgcgccggagccgcaggtcgcgacaagttgctgtgttcttagaagtcgcggcggtggcctggcgcgtggatgcggactccgatctaagggcaggcgctgatcagagggtcctcctggctctgcctgcggggagcggcgcgtttgcagcccagcggggagcggggccggagtctcggcctcgacgccgccgcttccgcaccctgggggctcgggcggccgggaggaatcgcagatcctggcctgtagctgccgcgtgccctcagcgtgtctgtgtgagtgcctcagggtgtatttctgtgagtgtgtctctgagtctcagtatccctaaatgcatttttgtgtctctgagtgtcgttgtgtttctgaaagtgtgtctgaacctctgtatcactcagcgtatctctgtgtctctttgaatgtatctctgaatgcatttctgtgtctctttctgagtctttgtgtctctgaatgtgtgagtctctgtatctctgatcttgagtgtgtctttctgaatgcatttctgtgtctgtctctaagtgtctttgtatctctgaatgtgcatctgagtctctgtgtgagtgtgtctctgcgtacatctctctgtgtgcgagcgagtgtgtgggtctccctgagagtttaggtgtccgaggtgtgcagaagtgtgtgttgtgttgcttttcagcagccgggaggagtaggctctgtcagcgtctcactgccactcacctcatattttacaaacaggaccaaaaaaaaaaaaaaggcagcgggtcagtttcttctttcctctgcaggctttcaccttttagaaagaaataacccgaactgtctccgaatttcaaggttctcctcacctccctgctgtgaaatctacctactgttctgtgaacagataatttttttaagtaggaagcagtttagtctttgcagccccctacttctctttaattgctatgtagcaggcatgaggtt

SEQ ID NO: 5760 - DNA, 1068 bp, Homo sapiens
gatcaaatatttatactgacaaaatcaaaaagcctaacatttttatgttgtatggtcatgtaggattaaaatgaataaataatgtgttataccttatggtaggagaaattatactcattactatttccttcaaaaagcaaaagtttttttaaaatgactctaaactcctcagaaacctgctattgggattactacattgccaaaatgacgtttaactggattgaaacttacgcactggctgcaggaagggcttctccaggctctgtagactggagccctcagcttggatgatctaaaagttcatgcctttgaatttgggatttagcagttgcctaaatagttgctttatctggtctctggagcagagtttgaggtggtttctcattgttttcaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggtaggtggaagccgtttctaaccagaatgcctgcctgatctatagacttgtgacagccacgactttgtatgtctgctattgattttgttgttaatgtaattagagacaccagagggagaagcctggctggatgcaaagatgcatcttgattgagtggcttttatgtctgagcattagatgtctgtctacataataggttttgcctgttttttcaacattttgaagacattaaaaggccattacatctcagtaatgacagtctgtaaacaaatgcgtttgtaagcttcttcagatagttttgcaatgttttctaaatatcgttgatttaattgtaagcttctttttaatggaattcttggttaaaatgaattgatgattatgaatat

SEQ ID NO: 5761 - DNA, 1033 bp, Homo sapiens
ttttattttgcaatatacaacagttatttgagtacttactgtataccaggcactgttactaagaggtgggggtataatagtgaataacataaacttggtctctgtcatcatggacctaacagtaaagtacattaattgtgtatgttcagcatttgctacagtgtttgacatgtattctgatctttacatatgtattcatattagttattaaggactgttaggagcaatgatacttaaatgccttttaaagataaaatttagatggcctgaaagtggttagtcacactaacttatgaaaatatatgagaagatagagataagtattttggtgtcatgtgtttagaccatagacaacaacgtaaaggaatgaaaagaccgcttggaatagttgaaaggtagctgagctgagtcagagctagataatagtcttggctttgccttgaattaggtgtaatcttgacttactaacttcatctgtaaattgggaggttttggggagagagaatacttttttttccctgagctttaaaatttaaatcataaaattttaaatttgatgatctgatgagagtatagtaaagatgatcctagcagtattattagggaaagcaaatagtttatcttaactgcctttatttgtttacatttattgtatgtctattttttcagactcatatatctgtaaaaatagcaaaaataattcttgtatatcctactaaattactccatccaaatgttaatatttgtcacatttgctttatcattctctctatgtatacacacacagtattcttttaaaaaaatgcatttttttctggttttttaaaatgaattatttgagagtggattgcagacatgatgtctttaaaatgtctacatactttgtatatttcttaaatcaacatagatacaactctattgtctatacacagattttatcagttatcccattaatgtcctacatagcaaaagacaaataatcgttttgggttcaggatcatacattgaatttggttatttctcttcagtctct

SEQ ID NO: 5762 - DNA, 1600 bp, Homo sapiens
tttgtctttttgtgactggctcatttcactaggcataatgttttcaaggttcatccttgtagcatgtatcagacttcattcctttttatggctgaataatactgagtcctccaactctgttcgtctttttcaagattattttggtcatctgagactccttgcaattccatttgaatttaaggattggcttctctatttctggggggaaaaatggttgtcagaattttgatggggattgtgttgaatctgtagattgttttgaataggactggcattttagcaatattgagtctgccgacccaggaactaaggatctttccatttacctaggtctttttaagtttcttttaccaatgtttggtagtattcagcatgcaggtctttcacttccttggttaaatttattcctaagcattttatttgtttagcgctatttaaatggaatagccttcttaatttcctttttagattgttcattgtacatgtacagaaaaacaactaatttttgtgtgttggtcttgtatcctgaagctgtgctgaatttattaactctagtagtttccttctggattcacatgtatgtacttctagctactcgggaagctggggcagaaggatcagttgatccaaggagtttgaggccagcctggaaaacacagcaagacacctacaggtgtgtgcccccacatctggctaatttttgtatttttagtagagatggggtttcaccagtttgcccaagctggtctcgaactcctaggctcaagcactctacctgcctcagcctgccaaaatgctggaattacaggcatgaaccaccgtgcccagtctaaaactgtgatatcttgttctcattaatagctgtagaaattataacttttggctgggtgcggtggctcactcctataatcccagcacttagggaggtcgaggtgggcagatcacctgaggtcaggagttcgaaaccagcctggccaacatggtgaaaccctgtctctgctaaaaatacaaaaaaccaggtgtggtggtacacacctgtaatcccagctactcaggaggctgaggtgcgagaatcacttgaacctggcaggtggaggttgcagtgagttgagatcgcaccactgcactccagcctgagcgacagagcaagactgtctcaaaaaaaaaaaaaaaagaaaaaagaaaagaaaaaaaaattataactttttgtaaatttttattaggttggtgtcttctactatttcagttgcataaatatcatttgaggtgggcttagtctttgaaggctctttccagcaggtgtctctttcaccaggcttatttataagcctttattttttttttttttacagtaaaagaaagtctataatatatcaactgtgccaagggaagacaacagtaaacttacaagtctctttccagcaatctaaattagtaattcaacaggacaaaataaagacatttttagacaagagctttatctctctgtgctgcctcctggttaatttccttggttttatctttcagtgtattaattctttccagccgtattcagtctgctgctcagtatgaccaacgggccttagattctctgtgtgtg

SEQ ID NO: 5763 - DNA, 1574 bp, Homo sapiens
ctgtactgtccagtcaactgacttcagcaaagatgtctgggttcagcagcgagttgctgtgtgaggccaccagaatggaggtgatatcggcctcagtgctcatcctggaggtggagaagtggtcagagtcctctgtggtgaaatggccctacaccaaagtgggagacattcagaatcgaggcgaaattggcctcagtgctcctcttggaggcagagaagcagtaggagtcggtggtgaaatggccctgtgtgaatgtggaagaccagcagattggaggtggaattggcctcagtgcttgtcctggaggtggagaagcggtcagagtccttggtggtgaagtggccctgcacaaaacgttgctcccccttggccggtgaaagaataaaagaaagctggccacttgcatttccgtttcagtttatagaatacatgttttggaaatagtatcttctagatctgtctttttctcttctgatttaacttagtaaagctaagttttatctcttcatagtcttgcttttgtttcaaaagcttttatgagatttgtttactgtctgtggctatatggcagacaatttgttcaagtggcatgcctcctctttctcacattgacctcctcaggaggagtttttcaagggcaatgagtcttctctctgagataagaatagtagccagaattaagagggtaaagtgcattgtggaattaagtactgattccagtggaaactcactttatggccttagacaaatatttacccttctgatcctcagttttctgtcaaagaacttctgctcatatccaattcctataaagtgggagtactctaacctgatattaccaacattaggttagattttatcctaatgttaggtattagaatatatcctaacattactagttcttcactcttactaaagtgcatgttagatttcttcaatgatttttttaaattggcatggttgatacaaagcatccttctatccaaatactgtgctcagtcgcctaagtgatagtttagaaccatactatctctctgtggaaagaatgctggggctcctggctacacactttgagtagaagggaaaatacccctcttgtatttatgatgttttttctttctacttgattaagaagaaagtacaaaaaggtgcttattgaagcattgtcaatttgggaacaagattctcaggaatgaaatatttgtgactgttctcagcatgaaaggtagagagaagattacttgatcattatgtgcttatttgaaagtcactttcctcccatgcctcaacatctcactttttagaatgcacactgaatgcctggaatctctttgttttagaaaagacaaagttgcattgttttttttttttttttttttttttttttaattttttttttttttttattatactctaagttttagggtacatatgcacattgtgcaggttagttacatatgtatacatgtgccatgctggtgcgctgcacccactaacgtgtcatctagcattaggtatatctcccaatgctatccctcccccctcccccgaccccaccacagtccccagagtg

SEQ ID NO: 5764 - DNA, 1063 bp, Homo sapiens
atgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatattgaaaactggcacaagacagggatgcattgttaaaaaaataatatttctggggaaaaggctcagtgctcaacggttactctataaagagatttaaaaagaaagtcaagggaagataaggaaggtagcatggctaacaacctcgtgggttctactagcattatttcatgcaaaatgtcattaacctttatataggagagaataagtctgggaatcaactggcatctaaactccatttcttgttttgtcactgcttccctggttgactatggaaaatacatttggtcttttgataccttggtttcaacaactataacatgacttaagaacttttatgcatggactttgtaatagttatctatttctgcatacaaattacttcaaaacttaaatcgtcgtttgaaacaacaaacactatctcacagtttctgtgggtcaggagtccagacatggcttattgggtaaccgcctcaaagtcttactaggctgtaatacagttattggctagagctgctgtttcatctgaaggttcaattgagagaggatccacttctaagctcactcacatggttgctggcacaattcaattcctctcaggctattggattaagggtctcagttccctactgactgttggtcagtgaactttcctcagttctttgccatatggggatccatagaacagctcactacatggcaactggcttctatcaaagtgagcaataaggaagtaagcaagagaggtttgcaagacaaaagctactatctctttataatctaatctcagaagtagcatcatatcccttctgccatattctgttcattagaagtaaatctc

SEQ ID NO: 5765 - DNA, 1049 bp, Homo sapiens
ttggtcccagacatggtgtctttcaaagctccccagatgattctaatgtgtagccagatttgtggaccctcaggtttaatgatcttcaagaatcctctatctaaggttctaagcttgtccgaatggacttgtagagctataagcacgtgtaccaccttctcaggaaggtggccgctccaatgctctctgactctaaagaatgaaatgattattcccacccgaacatccatcttctctgggtttaccgtcccctacttacagtccgtaaaaaggtcaccctagacttgacctcagtctcattgtgacacacacagcacgccagcgttcttaacctttttggttacagagacccttttagaaacttcatgaaaattgtaagtcatctcataaggaggatcttacatgcacatcaaattgagcatacaattttcatggatccctaaactcttgatacaaagttaattctatctcactataatataaaagtcaaaaacttacataacccagaaaagcagaatttgcaacatagtagaaatagaccagagtgaaagttctaatcctggttccacaactcaccagtcaacatttaggagtcactgaatcacttgatgcctcagtttactcatatgcccaattaagaattataaaatcatgcaccacataatgtcttggtcaagtacagatcacatatgacgatggtttcataagataatactgtgtttttactgtacctttgtcactgtgtttagatacacaaatacttacattatgttactattgcctatggtattgagtatagtaacctgctgtacagatctatagcctaggagcaataggctataccatacagcataggtgtgtcacaggctctcccaccttggtttgtgtaagtacactctgtgatgtttgcacacaacgaaatcgcctgatgacacaatgctcagaatgtgtctccatcattaagagatacatgactacctaccccatcaatcttgcctattccagaaacaaagtgaaattaataatataaaattggtttgatcaattta

SEQ ID NO: 5766 - DNA, 1782 bp, Homo sapiens
ccattgtatttccctccctgcttgaatcagttttgttgctggtgcccattcttcagtagcttctttgcaaatgtcagtgaggcagaaactcttgttttatttaaatgtctggatatgtgtttaattatcttttttcttcaatggtagtttattatgtgtagaagtttaggttcagagttctttactttgggtacattgaagatatttccccatgatcctttagcattcatttttgcttatttttatgagtgctctgctacccacatgatagccatttctttacagttaatctgtcatttaaattttgaaattttgaaattttgtggatacataataggtgtatatatttatggagtacatgagatattttcatagaggcatataatgtataataattatatgagggtgaatgggttatccatcacctcaagcatttatcctttctttgtgttacaaacaatccaattatgctcttttattttaaaatgtataataaattgactgtaggcaccctgttttgctgtcaaatactagatcttatttactctacgtaactatatttttgtacccattaaccatccccattcccaccccccacccctactaccctttctagcctctggtaatcataattctaccctctatctctatgagttcaattgttttaacttttagctctcacaaatatgtgagaacgtgaagtttctctttctgtgcctggcttatttcacttaacataaaatgtcctccagttccatccatgttgttgcaaatgacaggatctcattcttttttatggccaaatagtactccattttgtatatgcactgcattttctttatccattcatctgttgatggagacttaggttaattccaagtcttggctattgtgagtagtgcttcaataaacatgcaagtgcatatatttcttcaatatatcaatttcttttcttttgtgtatatacccagcagtggaatttctgaatcatatggtaactctatttttagttttttgaggaacttccaactgctctgcatagtactaatttacattcccaccaacagtgtacaaggattcccttttctccacagccttgccagcatttcttattgcctgtcttttggatgtatgccattttaactaaggtgagatgatatatcagtgtacttttgatttacatttctctgatgattggtgatattgagaacctttttataaacctgtttgccatttgtatgtcttcttttgaggaatgtctcttgagatcttttgctgattttctaatcagattattagatttttctgattaagttgattgagctcctcatatatattcttgttattagtcccttgtaagatggatagtttgcaaatatttgctcccattttttgggttgcctcttctgtttccattgccatgcagaagctttttaacttgatgtgatcccatctgtccatttttgctttggttgcttgtgattagggggtatcactcaagaaatctttgctcagtccaatgccctggagagtttccccaaagttttcttttagtggtttcatagtttgaggtcttagatttatgtctttaatccattttgatttgatttttgaatctggcaagagatgggggtttagtttcctttttctgcatatggatatccagttttccaagcagtatttattgaagaaactgtcctttccccagtgtatgttcttggcacctttgtgaaaaatgagttcaatgtagatgtatggatttgtttccgggttctttattct

SEQ ID NO: 5767 - DNA, 1427 bp, Homo sapiens
tgttgttggcatatagaaatgctactgcttttgtatgtcgatgttgtatcctgaaactttactgaatttgtttttcagttctgatagttttttggtggagtttttaggtttttccaaatataacattatatcatctacaaagataatttgacttcctcctttccaatttggatgtcctttatttatttctcttgtctgattgctctacctaggagttccagtaatctgtcgttttttaaatgaaggctttacgatttttctctgtgttctggatactctgatgtttcactgtgacctttccatttttaatttttaactaatgtattaagttgagcctacaagttcaaggctgcagtgagctatgattgcactacttgcattccagcctggaaaacagagcaagactctgtctcttaaaaaaaagaaaaacgaaaagtagttgtctgtggttccctaaaaatagcttcaaaacgcttggagttttctgtgtgatgggaatggttttgttttactgattagatgactcactgtgggccattagatagctttaggatgggaactgccctccaaaaagaccaggaataggattagagggttagaactttcagccacttgccctctagggcgggaaagtttggagattgagttcagttatgtgaccaatgatttaatcaatcatgcctaagtaataaaactccaataaaaactctgctcatggagacttgggggagcttcctggccggagaatacatcaatgtgccgagagcgtgtcatagcctgactgtattgggagaagctcttgtcctggactctcccagactttgccctatgtgtatcctttaaaataaaactgtaataataagtatagcattttcttgagttctttgagtcattctagtaagttatcaaacctgaggagatagtgagaaccctgaatttgtagccagtttgtcagaaatgtcaggggctggggaccctacttgtaactgaattttaaaacctgtagagtttgatgctaagtctgggtggtttgtgtcagaattgaattctagttcacacctgtcttagtccattttgtgctattataaaaataccacagactgagcaatttatagtgagcacagatttattggttcatgggtctggtggctgggaagtccaagattatataccttgcacataaactgttttttcaatagtttcacattcaggatgcctaattacttttaaattatacaacatttcttgcataaattcccttttataactttttttcacgacttttacagacaattctttggcatgcctcagctttcttacttgttgcaaacatccctttctttaaacaaccagttaatttattttaggataaggatttaccatataacattcctttttacataaattctcccccccccccctttttt

SEQ ID NO: 5768 - DNA, 1119 bp, Homo sapiens
ttgtgaattactgttgacattttttaacatcagagtgaaatagatttttttttacctaaaactgaggaggttacataaaagagtttaaatggtttattcctgttgattgggatctgttattccttctttacttctctactttttccccctttttatttttaacaaagaaagtttcacaacattggaggctttattttggtctattttttatcttggtttgctaaatgtactttcttttgactattcagtagaaatacctgtcttgagtctaaaacctgttgatgtaaaaaacaaacaaacaaaccccagactgtaaaatattttaaagaggtttattctatactaatatgagtggctgtggcccagggaacagtcttgagagcttctgagaaagcgtgcctaggcagttgggttacagtttggttttatacattttagggagataggaattgcaggtaaaatactaaattaatatatggaaagtctatattcgttcagcctaaaaaggtgggatatcttgaagtgggcagtgaggtgggggtgaggtggggtgggattacaggtcctaggtggattcaaagattttctggttggcaattggttgaaaaagttaagctttgtctaaagatttgaagtcagtagaaaaaaatgcttgagttaagataaggtgacttatggagaccaaagatcttgttttgaagatgaagtctcataggtagcagccttcagagagaatgcatggtaaatgtctttttttcagatcttaaaatatatcagactcttagttaatctctcctagatccaggaaaggcttggaaagggaaggcctggctgcattcatagagattctctacagatgcaaatttcccccacaaaagacagctttgtgagcaatttcaaaatatgtcaaataaatatattttggggtaaaatactttgatttctctcgcggtctgccatgtatcatgcaatgctataccagagtcaggtgggaatttggtatcttattgccacaaagagtctgttttttcagtcttgtgatctctatttaatgttgatgctggttggttctgcctaaactccaaaatggaggggacataatcaggtatgtccaaactc

SEQ ID NO: 5769 - DNA, 1028 bp, Homo sapiens
ggaaattaggtagctattgggaaggaaaatggatatactgtcacccacagcaataacatacgtgtctttccccaaaaggaaggtagtcattgaatatgtagttgcaatcaaatcctggcatgtgcaatgtggcataagaacttttgcgagcacccatatacaacccatgaagggtaattgtggtcccactaagcttgatttccatgagcttggattgcaacttttccttgtccacacttttcctactcaaggctgctggccgagcagtgaattgcttggcatccctcctgttcgccattcaactggcagcattggcagttgtgttgtactttggcagttttctttctatcccatcttcaagcttggcttcttacaagtcatgatgattttacaagcatttattaacctagatcttaatgtcggtggccactgtgaatgtcccagagaagtaagggatgttctgcagtcacagataaatctatcagaacagaaaaaatggatccatctgttccaagtagaatccatgtcacatcaaaaggagaacaagtgagccacactagagggcaaagtgtcttccacttctcaatgaccaaaggacacacgatctgagagccaatgtctatgagatgcaccattagtaagaaagaaaaaacactgccaagctatgagacaatatttttgtattatgcaggaattttctcttatgcatattgaaaaagatgttttggtcttatttcgacataggttttataatagattgcttttacgcacatactaaaagggaaacataagaaaaattgcagacaactttggattcacaccgtgactctgctgaatcacttaaaaaatttttttttaaatttcaataggtttttggggaacaggtggtggttggttatttgaataagttctttagtggtgatttctgagattttggagcacccatcccccaagcagtgtacactgtacccagtgtatagtcttttattcctcaacccctcccaccctttcccctaagtccccaaagt

SEQ ID NO: 5770 - DNA, 1035 bp, Homo sapiens
ggattttgctgctaagccttctgtaaaatattttaatttcctttctggaatatgtctgaaggtaggatattaaaaggagtatcaggtaatgtaactgacaggggtaaaccaattgagtaaggtttggccaaagcatcaaaccttgtgtggtaacttaatgatgttagtcatccgtaaaggagtgacattagaattgcttgaattagtttttaccatttataatttcatgctttgttgcattttaaaaaatctgtctttttctttttctgctttcttctatgtggttttcttcttgttctaccttttttttttttgagagagagatgtactctactaatgaccacatgctgattaattctctttagatggaatagaaggtacatatccttctgtcatcagcaccatttccccttgctgtcattggaaaccaccagtagaggatgctaacaaaaatgattattggtgtggtagcatcataagtctctctatcgactgtgctgattgggaccttcagtataattctgagtcttattgttacttaaaactagccttggttaaattaggcataagcattttctagtttgccgaaactagaaagaagcaggactgttttaacttgaataattttataaatttgagttatttaagtctctaattgagattgctgttaattcattcttgttttagagcagttgtattactccttattttaaaaagattttgttttatgttcttaggtttggagaagaatatgtaataattgacccatatttatgttgcatatttagaatactttttaatcacccctttttaaaattcatagtaagatcccttaaaatatatattttagatgttaaaatacatctaaaatggtcaaagtttaagagtagcaaggaaaattacaattgattgataatactgtgtaattatttttatataacttatgtagacttagactatggatgggttggcagagagctactaacggaggtggtaactagcagtcacttagatgttagtgatttttagatttta

SEQ ID NO: 5771 - DNA, 2036 bp, Homo sapiens
taaaatgattttttaaactactttttaaagggtagatgttgtacatattactggctaaataatcattcaactagatatgaactaaaagtagtaagcaagtagaaatatatgtagtagagaaagttttgtagcaaccctagttaaaattaaatttgatctattatgtaggcattgccatataaactaatcattcttttgcatggggcagtgttttgagtattatgtcactaaaggaaacatctttaggacattagttttactaaataaaaatttcaatatgttatgagcatgtctggattttagccttgatggaggtgggttacgctgttaacttaaaactgggttgcttaaaaagatggcaatataatacagtacttaagtagcaaaatgctctctaataagtaaaatttgctttatgattgttttcagagaaaacaacttaatttttagaacttcattaattttgttaaagcatatttttggattatataatatggatgtagataaatggaaagattatgaaaggaaaagcaaaaaattgaattcaagtgtctatttgtattatagctgtgaaactttaagcttttttcattctctacaaagttacttttctctttcttcaaacagctccctgttgtttaatacacgttccctctatacatagggattgcatttatctgtccatatgcacatttctcctcctaatcaacattatgtatttattgagacttggtacatggaggttgaggtatgaactatgtttgtagaaaaccttacagtatggcaacctgggaaaaccttcatctcttttgcagtaacaactacatctgtgctgaaattattcataacagatgttttgtgatctcttaattccctccctctcccttcccctcccccattcagatttaaaattaaatgtgaatggaagataaatttataaattatgttaatttctttttattgttttattctatattgaaagtcctctgttttctctttttaaaatattctaattttaaatgtttaagatattttaagtactctgatttcaattatcttttaataaaatatgacaccattatttatatatctgttactattcatgctcacggcctaaaatatattctgatttcccttactcttaaggtctttgtattcatttaatccacaattctagcagagtgtttggttttgggtttttttttttttttttaagtagatagtgctgagtgtaactagtttgctgatgaaaaaaactcattttcttggaatcatatatttttaatatggaagattcatcttttccaaaataactttttatctgaaaactgacacagataagctgaaatttagggtctttaagtagaaactctagaagagactttaatgtgtgttttaagaaggggtaatgccaggcagatacagtgacatatggaataacatgtagtgaaatccttcaaggagtagattttctgaacctgggctcagggtaaccttgctctgccttgaatacttgaaaaggctgtcaaaatcactgtatctctttaacgttttctcctttctaccctaaagttaagttgctatttgctcctattgctacatcacttttctgaatctcttttgatacacttggcttttgctttatttgggagggagaaagtaaaggaaggaggaattggagtagacaaaaaataactttatatgaataaatattcattaagaaaatgaagtggaataattttggactggagagatttgggagaatcatccaaagccattttgcagtaaagcagacagtcaaagagataagatgactttgccaagtttatgttactagttagcttggactaggtcacagctttttgggttcctagttcggtattcttttcattaggtcatttgagcatatttatctaagacggtaacaagcaagaactagataccatgaattttcaaatttattatacttaaaaccaaaatgtgtagaatgcttcatcatctcaaaggcaagttctaatacatatgcatacatctgt

SEQ ID NO: 5772 - DNA, 1048 bp, Homo sapiens
atcaaaattaataagtatcagtagctcattccttttgtattgctgagtagtattccattgtatgaatgttatatcaccaaatacacaatttgtgtcgccattcacctgcagtggaactattaacttgggttgtttctggttctttgctctaatgaataaagctactgtgaacatttacataaaatttatatgcatatatatcttacatttttcttgagtcaatacttaagagtacagttatagtacaggtaactgtacttctaagtacatatagtaagtatatgtttaacttggtaagaagctgcaaaattgcaaactgcttgtaacaaacatttttacatttccaccagccatgtatgagagttctggttgttccacatccttgcaaacaattgtccatgtttttaattttaaccattctagtagatgagtggtagtatcattttggttttgattggatttcaccggtgactaatgatgtttgaagatcttttggtgtatgtattggccacttgtatattttcctttgtgaactgtctgttcaaataatttgtccatttttaattggattgtttgtctttttattattcagttgtaagagttctttgtatattctggaccaaaattttttgttggatacaagtattaaagatatttctctctttctgttggcttatcagttttcttaatggtaccattgaagtgccaaagctttaaattttgatggagtttaattcataattttattcatttaagctttgtgtcctttctgagaaatctttgcctattccagatcttcaggatttctcccatgtatttttagaagcttatagctttaccatttaggtctgtaatccatttcaggttaatgtttggtcttaactcaccagaatttggcataagaatttttatttgaaatttttaaaaatgtttctcagggcccaactaatacccaaagctcaggattatagaggaacacaagtcctacttccctggttttgaacatttttaactgagagtgagtacattgtgcctagttggggttttc

SEQ ID NO: 5773 - DNA, 2174 bp, Homo sapiens
attatgtttctttatatactcagtgttaatatgattaaaaatttaagaatatatatgcttgctttactaaaagtgaaaaaagttgtaaaacctgatgtatcctgctttcctgagtttttgcttatctattctgataatactaatagatttgcatagtaattgcttcgaaatggtgctgccactaccacttctaccaccaccataaattagtagaagacttacgctactagaagcataagcagccttacgttatagtggctggtatctgtgcaccaagtttggctgtgcatttctagtccctgcactgttagggggaattgtatatttttttttccttttctcaaatcagtaaatcagtgcaaacaaatgtgttgtggatttacaaacctatggaataaaatgtttttacttctatcaattatggctctccaaagacataaaatactcttcattcactattactagttaattttctagattatttctggcatttattaatggttctgcatagagctccaccttgtgaacatgttattgtactttgatatcagttctgtgtcatagatatttaataaataaaataaaactttatttacctgaatgtttctcattcagaatagctgtaattcaggcctggtatatgtttttatttgaatagaaacagttcactgtttttttggaggttatgctgtatactacaagatagattaaaaccagtgcctttttttagaccagctgctgaggaaatacctttatcatgtttcaacctcttaagtttaataattctcatgtaaaaattagtgcttgatttatgcatcaattttctaaacatttcacatgtgatctactttgtatattcagggacttttgtgttctatgttattatatagcgtattttttaaccaaaactttaaaaattaacctcatttcattagtatttgtttatactttactataccttgtttacatgcttaacctgcctatgtattatctgtgacagtaatgaaactgaatggttataaaatgctatataattttatcaagttaagctgacttttttggtggggaacatcatcttcctcttgctaatagataaaggagttttactgtactaatttcaaaaatggtataaagcagtaaggcagatcttcacagcctattctttgacagtatattaagcatgtggagaggaaagcaaggtgttagctattttaaggtttcacagcaacactcccatcttgttcattttcacctgagttgtatagagcctgggaattgctatatatctttaatgtaaagtcagcagtgcaagtaacagtattggatcatacttccaccattacattctctgagtttctgatcaccacattctcacagataaggaaaatagttgtagatggatggtctgaaatgtaaaaaggataaagaacacaagaagtggtaaatatgtttagtttcagacagacattatataaaacttgggaggagggtaaaattattgattagctacgggtaggcttggtaagttttaacgcatgttaaaatttctaagataaggaataaaaatctagaaggtatgtgtaccttacaaactagtagagaagggaagtagaacaagaaacaatattcaatctgaaaaaaaggtaaagaagctgaagaaagaaaacatggaaaagagaagacaagtagcacaaaagtacatagcagcaataagtgcaaatatattagtaattacagtgcatatgagttgaaaaaatcctccacttaacagaaactggttattagatgggataaaataacaaaatatatttatatgctgtttacaagcaataccttaaaaagcatattctcgcttgaaagtaaaaaggatttaaaaagatattcctgacactactaaccaatagaaatgttgtatggctatatatatcatgtaaagttgactttgaggcagaaaacctgtccgagagagtgagggtcactcaatagttataaaaggaaggtataattttaaataagtgactacctgataatacactttcaaaatacattaagcagaaactaggactgcagaagaaataggtaaatttatcattattatagcttatttaaaataatctctgttaatgtgagaacaagcagaaaaaaattaagaaaaatatagatgattttaataa

SEQ ID NO: 5774 - DNA, 1045 bp, Homo sapiens
cccgattgaaataacaggggaataattaatgaactagagaaagtaaaagtaattcaaaaaggaaacaatgcaactaaaaatagattatttgagaagagtaacaaaattagcaaaccactggcaagattaataggtggggaaagaagtcataaagcagtatctggaatgaaaatgggaatgttactacaggtgtttcatgaatgatcaactttattttaatgcagttgaaagattaagtggaccaattcctaaaaaaaaatgtagctcatgctggcccaagaagtaatagaaaatggaatacccttaaaacaaaaaggaaaaatattcttacaaagaaaaaaataccaattctagacaggtttactggcaaattctacaaaacattcaaggaacaataattccagttgtacagagagtatttcatggtttggaaaaagaaatgactgtccccaacttttttttacgaagctctaagtataaaaaatgatgattgtctttaactcagacctatgtacaaaaattcatagattagatatcatcacatggtagtacccccttatccatctgtaggtggttacctatgctcaatcacagtccgaaaatattaaatggaaaattcaagaaataaaaattcatatgttttaaattgtacgcccaggatgtggatcctccctttgtccagcatatccacactgtatatgctacctgcccattagttaccattggtagccgtcttggtcatcagataataaaaaaaaacatagtatttatagggcttccatgctatccatggtttcaggcatcctcagggggtcttgaaacgtatgccctgttgataaaggggaattactgtacttgaccaataatgtgtaagaaagtaacccatcataaccaagttgggtttactctagaatttcaaagttggttttatattagaaagtcacttaatagaatttaccacatcatctgtttaaaggaaaagaatcatgtgagcatctcaatagatccatctgtgataaaactcttagcaagtcagtaaatgaga

SEQ ID NO: 5775 - DNA, 1156 bp, Homo sapiens
gagacagggtttcaccatcttggccaggcaggtcttgaactcctgaccctcatgatccacctgccttggcctcccatagtgttgggattacaggcatgagacaccgcgcccggcctaagcataataatttctaaccctggttgtgtgatactccaaaatgtattcatttatttttaggggtataggcatttttaattcttttatatttttgtagtcactaaatttacttggcttctacctttacatattttctgtttattgaccaccttttaggaagtttgagaaaggtattaccttattatatttttttctaacttaaaatatgtgtgttactattgcacttgtggatataacatttcattttagaatatttacattttattttgtttatcaaacaatagcatttttgtatcaggcactattctcaatatcgttaaaatattaatttatttagtattcattgcaaccctatgagaaagatcctgctatctttgataggtaaagggaaactgaggcacggaaagtgttgggtaaggtcacttagctagtaagtggagcctgtgttcaaacctaggcagtctggttccacagtctgtgcacttaaccactaagctgtaagagaccatatgaagtagatctctaagaggagtatgtcatctatttcaatgttctttaataaacagggtactatttttgagcggtgccagcatattgtcagattatgatgaaataattatattattccctttgtttgatctgagaatgtaaaaagcaatactggtaaattacacactgctggacattgcttagatttactcttcaatgaattttgtgtccgtacgttcatgagatgagaaaaatagataggcaaaagtacctgttagtctgattgcagatctacccgtaatgcacaaatggtgatagtgtactttcttcttccaaaggtgggttaatggagtcatgatttaaaataagagtttaacagtagcgtgtataaatttgatatttatacatcataaatgatgtataaatcatttatgggagagtgatatttgattcagggatgttgacatgatacctttgggaaattctcatagtaaaatagagttagactgtcaacagggaaaattctaagtaatttgtgaagaaactagta

SEQ ID NO: 5776 - DNA, 1051 bp, Homo sapiens
atacattttatgaattactaacttacttttttaggacagacttgaaatcatttagagggtaaactctagcaatatagaaatctgttttttgttgaatggagtagcagctaatctttaagacccattgatagcattttagtagtagcacttaacattcagaaaagaaaaacaaatcatccagcttctgatcttcagttttatgtaactttacaatttggtacttgatgacttggtattggtatgagactgaatagtgtgatgttacaaacatgtgatgtttgcctaccatgttctaggcactgtgccaagtgctagagatggaatggtaggtaaagctgtggtctatacttagggagttcacagtcaaatgaaggatacagtcacaaaacagacacttgtataaagcatggtcactataatacagagaaatggaaagaatggccagagaaagcttacttgaaaagataatgcctgaactgaatactaaagggaggtcagtgggagagacaaggaagggtagatattgattgtgagtgcatgagcattgaaatgagagggcccaggggaataggaagagaggaatagcctaaaggagaacaggagcaaaggcacatgggtgagaaacaacatggaatgttctggacatacaagcagatctctgttggaaggagtatgagataagggtaagagagtgattggagttgagtctggagagatacgaaaccaaatcatggaagctttttaaatgccatgtttaggagcttgaacttcatctttttgtgagttggacagtcattgaagggttttaagtaggggcccaatttgattgtattcaggttgagtagagtactctgatagctgatgtgaaggataaatttgaagggaaaaagattggaggcagagaggccatttgggaagtagttagcttgataagaggtgacgagggcttaaactgacacttaatagaaatggagaagagggagtagatttcagagtctgtactttttttgttgttgataaatagtaaatttagtaggactcgatgcttgga

SEQ ID NO: 5777 - DNA, 1007 bp, Homo sapiens
gaagctttttctgttttaaagtattttgcttcccgttactgtatttataagatgatactggtatacgtagtgtcttggctatttatctattcccctttctctttaacacaatattccccaactttggtgtgatactgaattgaaatctctgggagtgtggcctaggactctacacttttactaacaatcagttgagatgcttatgaaggtggtggtagtagtgataatggtagtgatgatgatgatgattgtattagctctgctttcgaaggcttatgatgtacttactgcacttttctaggcagtttgcaactattaacctaatgttcacagcaagcctatgtggtaatacgctattatcttcattatacaaatggagaaactgtggcagatataaattaagtaacttgtcgccaaaatgactttcttataaataggtcaagaatccatgaaaaggatgaggcatatttttttggttgatagtttttaaactcactttctaaaggattgctttaagtgatgtgaatgatatgaatgtaaactggttcttatataaattgaagtatcaatatgctgactctatataggaatacttcaacaactagacctaaatatagatacttgctcttgcttttaggaagcctgtcacaattcttggtgaaaaagtaagcatgcacccaaaaacgtagaacattgaggaaaatttttaaataattacactttctaaaatacatgattttaggaagagtgctttattatatactatatatatatatatacacacacacatagacatacacacgtagatgcatatatatttactctatatggatgtgtgtctatatgtatagtcattcttcagtatcctcaggtggttggtgccaggacaccctcagataccaaaatccaaatactgtcccacagtatttgcatgtaagctatgcatatcctctcatgtactttatttatttatttatttattgagacatggtcttgctctgtcgcgc

SEQ ID NO: 5778 - DNA, 1049 bp, Homo sapiens
tttattcttatcccatcatgtccatggggtggagaggaacaactaagtaatcatgatcatgcacttcagtttatagcgttttctctagctttgggcattgtcacttaacagacaatacaattttaaaaattaaatgctcaatttcatttcactgaggttttttgttgttgcacaacattgtaagtatacagtaagttgttttttcttttaaatttttgcctctaattcaggtttacattgagcaaccaaatcagtattttcagaaaccattgaagttaattcatttatttaataattacttatgaaatatgtcatgtataatagtgctatagcctaagatgatgatggtgagaagtactcctaccttttgttactggcacgatggtggcgatactcagaacaaacaaaaacagtgtgataacacaaattattatatgactcgctgttttaatagtgtttacaaaagcagtgaatcccaggaaaataaactattggctacaatatcaaaaaagaaatgatggaagtggtagaatttaatttgggtcctgacaaataggcaggatttgaacatgtatggcaagaacactgcaggcaagggtaacatctcatgagaactgatgcagaaaaaaatacagcatatattggcagagtgagaaactggccagactgtagcagaaatcacaagctggtgtgaggagagagagaaaagcttcattaaggaagttttgaattactgaaaaattcaccagtcataaggcatggattattgtcttgctgtttagattacctataaatgtaattttactttactcaccaccatgtgataattatgtagggttttatctttttagaaacctgatgtgaaattacctgaaggaatgaagttagtgtgcttttaagttaagaatatcttcactcagtatccatggataggcttcagggaatctggatctctttgaaattaaagcaaaagtttggatgtatttctttttctggaggaaggatccattgcctttatgagtatgtaacagtccagaagaagttaataa

SEQ ID NO: 5779 - DNA, 1034 bp, Homo sapiens
ttaccctgcaattgcttgtctggcaaacagacaatttttaaagactcatatatttaggaatttttaaatgccatagaatcgatggacaaaatgattttcatttatcttaatccaaaatcacaagattgattatatacttaggttatatggaaaatcagcattagaagcattagttctacacctcatttgcatgacattattacaagatattaactgtaaaaatgaagtaaatataatatctgttcaccagatgcctaaaacatacaacattagtatagacatatagaaggatctgcaagcaactaaacaagtagcgtaaatcaaagaatatactgataaagtggtaagtgccttttgggcttcttaggtaataagcccttgtatctgccagaatagtctagcaaaaaatgcatttttttctttagcctagggaaacttttcacaggagatggagttttaggtattgtgtagatgatgggagaaattgcttttgataagcttcagtgaaaaaggaagggaatgtgtcattgcagatagagagggagagaaacactggtagttggtcgtagactggtagtggtgtagaaatagaaagcaaaacctattggacaaaggaactgaacagatttgttaaaaaggaatgagacaaacagatatgaaagataaggagtaagctgatacaggctggtgagctcactgatagcagagtccaccaagaggcatttagtggttttccttcagggcaaaaagtttgaaagagaaaaatatgatctctaaatagggctactcataaaaaatattgactattaagaatatagatacagtctgtatctttaagactgcaatttagtacaatttaattttgtttataggctaaacatttttataatttcatagcgattaacttgataaaaaagggaaaatttcttggtctttctgccaatctgtgtttctaactgaccctaaacagctctgttggtttcctgctcatgcattagagcttgtccatagccacaagcccctcttttcctgtc

SEQ ID NO: 5780 - DNA, 1046 bp, Homo sapiens
tactaactggggctttgtgttctgactggtagtagcaataggtttcaccctttgtgattgagtaggctcctaggaatttactttcatctattcaacaaaaatgtgtatacaggttgagcgtcccaaatctgaaatgctccaaaatctgaaacttgttgagtgccaatatgatgctcaaaggaaatgctcagtggaacatttttagatttcagattttcagactagggatgctgaaccagtaagtataatgtacatattcaaaaaaaaatctgatatccaaacacttcttttctcaaggattttggataaggtatgctcatcctgtattcttagtactagtaatgtttctctgagcaaaatagacacaatccctgacctcatggagtttccagtataatgccagagatggatattagaaagtaatcctgtaactataagctgtgagataaatgctgtacagaagaggtcacttacattgagagatctgtaaagaaatgacatttagatagaaacttaagtggagatctgaacaatgagctggtggtagacagtggtgtaggcagaggctgtaacatgcatgaatgccctggggggataaggtttgtggcagcagtaaagccggagagggaggtagaacccagattatggacagccaagttagggatttcgattttatcctcagtgtaatgaaaaaatcatcaaaaggttttgaatagtggaataatataagatgacttgttttattaaaatattaattatactatggctaatgtgtggagatttgctaagagaacaggtagaatgagtgagtatggggacatcagttacaggagtcatattctcatatccgccacatagtgggcactcattcaccattttgtggttagctgaatgatgactagatcactgcctctgttgtaacatctcaaattatttgcactttaaccatgagttaagttggatatttttgaggaatcatgaagtgttgctgatttgtactaatttttcctcataaaactttagatattttgaactgctgcttcatc

SEQ ID NO: 5781 - DNA, 1112 bp, Homo sapiens
agaactcataaataaagtgacatacctacaaccaactgactttcagcagattcaacaaaaataaacaatggggaaaggacatcctattcagtaagtggtgctgggaaattggccaaccacatgcagaaaaatgaaactggacctctgtgtctcatcatattaaaaaattaactcaagatggattaaagacccataaatgtaagatgtgaaacttaaaatcctgaaagaaaacctaggaaaaactattctggacattggcttaggcaaagaatttatgactaagaccccaaaagaaaataaaacaagaacaaaagtacacaggtgggacttaattaaaccaaaaagcctgttcacagcaaaagaaataacagagtaagcagacaacctacagaatgagagaaaacatttgcaagtcatacctccgacaaagaactaatatccagaatctacaatgaacccaaataactcagcaagagaaaaacaaccccattaaatattggtcaaaggacatggacagacatttcttaaaagaagacataaagttgccaacaaacattttaaaaatgcttaatatcactaatcatcagagaagtgcaaattgaagccacaatgagatattatcttataccagtcagaatggctatgattaaaagtcagaaaacaacagatgttggcatggatgcagagagaagggtattcttatacactgttggtgggaatgcaaattagtacaaccgctatggaaaacagtttggagattcctgaaaaaactaaaaatggaattaccattcaattcagcaatgccactactgggcttctacccaaaggaaaagaaatcattatataagaaagacacctttatgtatgtttatcgcagaactactcacaatagcagagtcatggaatcaacctaagtgtatatcagtggataattggataaagaaaatgtggtccatatataccatgaaatactatgcagtcataaaaacaaatgaaattatgtcctttttagaagtttctacatggatggagctggaggccattatactaagtgaaataactcagtaacagaaaagcgaatactgcacattctcacttgtaagtgggagcta

SEQ ID NO: 5782 - DNA, 1041 bp, Homo sapiens
acctaataacggcatgtctttgggcaagttatttaacttctccaagcctcaagttttttaacttataaaatatgttgttacaaagcttaaaagaagtaagttactagcacagtgcctggaacatagaaatttgtgctttagagaagaaataaaaatatataattctaccgtctataggtagagctcttttcccaaaatagtactaaaattccagtttgcttataatcctaaaatatttataattccagaatatctaaatctgtactgcttttacttctctaagatatcttcgtgagtttggtaagactgtccacttaatttctttaaacagctttacttttcaaggacacattaccatattcataaaaggaaaaaatccaaattaaatataatctgtactgaaagtttccttttcagatttcgggaagttaaaatgtttgtgacaactggatttgtttttttaatcttttattgatatataatagctgtatatatttggggagtacatgtgatattttgatacatgtatacaatgtgtaatgatcagatcagagtaattgggatatccaaaactttaaacatttgtctttcgtttgtattaggaacactatagatctattttaatttcttctttgatttcagcaggaaaggaagggcaagaaatcctggggcctgaagctcaggcagatgaagcaggatgtacaggtactctgctgcgactttctttcataccatagcctttaaaagaaggtctttgtgtcactgatttcgcatttgtgagtcctgaatttagtccgtttccttctcttttatcttaccttccttaaatgtttaagtacttaggcatatggtgcactacataaaaagaagtaaatattccttaaatacagagtaacttacagattcatattatgtagcagatttctccattctataagaatgacaagtataacctacagataatccaaaaaataagtgtttgaatgatgatttgaacttctatcaagtttttgaccaaagttagagaaatgcagatctaac

SEQ ID NO: 5783 - DNA, 1073 bp, Homo sapiens
agttcactaactttccagattttgacaactcagccctcaatggaaggcaaggattttaatatatttgaaagttaaaagaatgtactaaacagtgctatatctgcagccttataaaagtgaaaatgattatttatttgagttatctggtcattcctgagattaaaaaccacatatgaacgttactttagaggtaactcagtattttgttcaggtaagaccctttccatcttgacttaattattttgcttatgccataacagttaattcttcaagtttagaagatgttaaattgcattctattaaaatgttcagtgtaggaaaaataagtactgactatataaaccacattatactaaccaaattgacaagaaagtcaaattaaaaagtttaagtttctttgaaccagttactatttattctcagtataagctacgtggtttttttcccccgtagtaaagggagttgcctcctctaaaaatctaaagtttagatttttttattctgaagactcaatttttatatggtttattctacttctgtgtcactgtgccccagttttcagaagtataaaccaagactgttttgtaactataagttacatttaaattgctggttctatatttaggattaaagtcaaaaaagcttttatcagttgttcctcttttacaaggtcctcatagttatcagccatcaacaatgaaattaatattgccttaattctaactttaaaaattaaataaattttcagccacacagggtttgtgagggtacatgttggggttaggccacatttccagtttcttacatcaaagaatgatgtatatctacatacctgaactctgccctatggatgtacctaatatgtgtcacatatcccatagagaacaagttagaccatttgctaaggtgatggctaggccaaacaaacaacaaaaaagaattgtaacagaaaaagaatgactgagcagagtcaacctatttccttagtactttggcaacagtactcatgaaataacaagataataagaagagggtggcaatcagggagaatagaaccaagattttataggttt

SEQ ID NO: 5784 - DNA, 1027 bp, Homo sapiens
atgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatg

SEQ ID NO: 5785 - DNA, 1045 bp, Homo sapiens
caacctaacacttaagttttaagaaagtcattacatttcaaaaaattttcctctttatttaaacataaaacgcatttacaacatgcaagttaacttaaaattaaacggtgtcttcccaaaccaagtatttgtgaatgtatcttcaagcactgaaaataaaccaacatattccacaggtagactcagactctcttctgtcacctcatgtcaaatggagttaagcacaaactgagagttacgcacagtagttttcttaagttaggcaaataatttaattaatcgccatgaataaatattctctttatttcattgagtttctcttctgaaccatctatcaatgccattcagaggaacgttaatatatccagtcaaaaagacactgcaaattgaaatgtgtcaatatcctagatgatcagaaattttcatttttaagagtaagtgctgtgtttaatgacctaccatagcaaaaagcagttcactgaaaacaaatttatgaaattcttggtacactttatgaaagtctgaaattataaatagaaaagaaccatcaagatactttttaaaaacctaacattgtatattctgaaccacatgctaattaaaattcgttgttcattacacagcaccaatacccatgatacatcttacaagaacaaaactaacatatttggaaaaaagagaaaaaaaaattctgcttcatttacgaatgttgccaaaggaggcaagttttcaactgaaaacaaaacataaaggtctatgtggatgcagccaaatgtttctccatttagaaaatcatcataaaaggtggcagcactttttttgcttgttaactatattacttataactggctgcaccaacatttcatctcaatttttggagtgtttcttctgatcaatcctaaaagcaacacaatcattttagaggttgcagactacaacagcaaagatttttgactattaaaaaaataaataaataaatttatattttaaatcaaaattattacaaaagtggaaattacaatagttacggaaatagaaaaataag

SEQ ID NO: 5786 - DNA, 1061 bp, Homo sapiens
tttaaataacttattgatataaattagatattgtgataactgcattctatatttcttcgttttgtttaagttactgtgactcaaaaaagcctgaagtgtaatcatagcttccagaagttgcttaatgtactctgagcaaattgctaaagccatcagaaaaagagaaatgtagtatgtgaatttaattagagcctggtgttttctctgaatctcttattttttttcacagggaggaataagtttttttcatctgtaatttggaagccaagtcagtaacaaaatgaaaccagtaaagcatctgttgaccaccagtaacaaatcggcaaatgttccagcattaactactaaaaaaggactacataatttaccattatcacctgagctaaaggaaaaacataatgcaaaattaattcatgataaaattgaaccaatggtcctaagatctccaccaacaggagaatccattttacggtatgctttgcccattccatcgagtaagacaaagaacttactaccagaagatgaaatgatcggaaaaattatcaaacatctgaagatggtaagaggcttgttagtttctgtgttgcagggcccccatgatcaccccaggtttagtgatgtgctaggaggactcacatgactccacatatagtcataccgatggctaagatttattacagtaggcacatgaggtgaaattaggagaaaaccagatctaagcttgcaagagtcttttccctttagagtcacccaggagatgcttaatttctttagcaatgaattgtgacaacacatatgaaatgtctgccagggaaaatcattagaaactcagtgccctgggatttattgggggttgtttactattcactctgtgcttagcatgtacgaaaatttcagactctcacaaggaaaggaggttcagtataaacaatgttatacaaacagtttagggacagtgagctgcttctatcagtgaatggggagaaccctcctgaaatccaggatctcagatgccaggttaaggccaaccttgcaagcaggccttcctaagtcctgcattt

SEQ ID NO: 5787 - DNA, 1025 bp, Homo sapiens
ataaagaggaggtaactaagggaaagacaaaaaaattggccaataaacattttaagagatgctcaatctcaccgtgatcagggaagatataagacaaagccatgacttttttgtctacaaaatttagaagttttctaatatcaactattggcagagaggtagtggaatgaatactcttaccatgctaatataatagaaatttccccctttcgaggacaatttagcacagtttagtaataacaaaagtgtatgccatgttatatagcaaatctctttttatctaccctcgggaaaggagtacaatgtgctcaagaaagcatataaaaggaattttttttgcatcagtgcgatggtagcagaactagaaagaacctgtttttgttagtaggagtatggctcaataatctatggtaaatggataataagggaatactatgaataactatgtgaccacaaattagataacttagatgatatatatctctagaaaaacccaaactaaactgtatcaagaagaacaagaacatgtgactgaacttataagtagtaaaagatttaattagtaattaacatattcccaccaagaaatgcttaggccagatgacttcactttttaatcctgtcaaatatttaaagaagagttaataccaggcctgtacaaactcttctaaaaaattaaagagttcacacttctcaattcattctatgagattagtgttactctgataccaaaattagacaatcacaagaacataaatatgatatttattttaagaagataaatatatgttatgaatatgaacatgaaaatccttaccaaaatactagcaaactgaatccaacagcatataaaaaagattatctatgatgaacatgtgagatttattttaggaatgcaaggttgatttaaaatgcaggtatcaatttacataatgtgtaatattgattaaataaaggagaaaaaattacatcagttcgctagattcagtaaatgcacttgacaaaattcaacatctttttatgat

SEQ ID NO: 5788 - DNA, 1068 bp, Homo sapiens
gttcaagcaattcttgtgcctcagcctcccaagttgctgggactacaggcacctgccaccacacccggctaatttttgtatttttcgtagagatggggtttcaccatgttggccaggctggtctcaaactcctgacctcagttgatcttcctgcctcggtctcccaaagtgctgggattacatgcatgagccactgggcctggctgtcactagttttaattgcaaatcaaaactacaatgagataccactttacacccactaggatggctatattcaaatagacaacgcaatgatttgttggcaagtatgtagagagattgggaacctcataatgggaatttaaattatgtatctgctttggaaaagtttgccggttcctcaaaatgttaaatacagagtctgcatatgattcagaaattctgtgtctaggtttatacatgagataaatgaaaacacatgttcacacaaaaacttgtacataaatgttcataatagcattattcataatggcagaaaagtggaaacaaacaaaatgtccttaaagtgttggataaataaaatgtgggatatccatataatggaatgttatttggcagtaacatagataaacatagattatttgttgaaaataatctatggtctatccatactgtggaacaatgtcaccaaactgtgtcagcaaactgtggaacaatgtcaaacctaacctgaaacttatttttgtaaataaagtttaattggaatacagccatacgcattgaagaatagtgacagagaccatcaggcttgcagaatctaagatacttactatttagttctttacaactcctgctatggaataatcattagcgcttaaaaaaactgggaaagatctatgtttatggacatgaagaaatctcagacattaagttaagtgaaaaagtaagtttggaacaatatatacagtgatgtcatttatgtgaaaaagaaaactgaaatccaacccactaataaaaattacagaatggaaaagttacatgcagtattgtgtaaatgcctagaacaagtcctggaaaggtaacagtgat

SEQ ID NO: 5789 - DNA, 1027 bp, Homo sapiens
gggagcaggccatttagaggtcattatgcattgatgacagatattagagcagtttggtagccttgtggaaggatattagttatgttttccaacttattctatataaggttaatctgaacatctaagtgaaaaaaagatatggacaggcatttgaggtgtcagttgttgcaaacaagttccctcagtttggaaaatatcctgtatgacaactgtagtcacttgtgtctttggtggccagggctgtaatatagcattggaccagcaaaatcaattgagtcattatgcacctgagggtgtgtacaagatctacttagttattgaatggagaaatagtcttatagagaacttttgcttcattaagctcaacaaatgacaacagcctttctgtttcttcctaggaagctattctgggaaacaaaggtgctaggtgctgttaatctggatatttacattcttccatatgccccactaaaatgaccttaaatgcctcagtttccatcagggactgggatgaatgcaagtgggggttcacatagaaaatacatctataccaacaatacatttggtgggggaggggaataaaatggagttttgcagttgtccgaaaggatactctcatggtagtgtttgaccaagggtcattttggtggtgtcctcagatgcaaaaccagagagcattacttcttttccccagttcctggtgtcagaggttgtggggatcacagccacctgtgcaccagtatcctaatggccctagaaatgcaatttcttcccaccttccctttaaattctgaccttacgatacattctcagattaccactggtaacatggggatcttggcctaactcttaattttctttattttcgagagcatgaagtttgagcaaaagtagtggagggttctctgattgatttcaatatcactgggaggtgcaaagggaagagcacttttattagtcatggggtcatcgcattctggatttagtagggctatgtgttggtacccatggcccactacctggccag

SEQ ID NO: 5790 - DNA, 1030 bp, Homo sapiens
gatctgagaatggacagactgcttcctaaagtgggtccctgaccccccagtaggctaactgggagacatctcccagtaggggctgactaacaccacaaacagctggcagcccctttgagacaaagcttccagaggaaggatcaggcagcaacctttgctcttctgcaatattatatttgctgttctgcagcctccgctggtgatacccaggcaaacagggtctggagtggacctccagcaagctccagcagacctacagctaagggtcctgactgttagaagaaaaactaacagaaaggaatggcatcaatatcaacaaaaacaacatccacaacaaaacccatttgtaggtcaccatcatcaaagactaaaggtagataaaaccacaaagatggggagaaaccagagcagaaaagttgaaaattctaaacaccagagtgcctcttctcctccaaaggatcgcaggtccttgccagcatcagaagaaagctggacggagaatgactttgacgagttgagagaagtagacttcagaagatcggtaataataaacttctctgagctaaaggaggatgctcgaacccattgcaaggaagctaaaaaccttgaaaaaaagattagaagactggctaactagaataaacagcatagagaagaccttaaataacctggtggagctgaaaaccatggcacgagaactatgtgatgcatgcacaagcttcagtagccaattcagtcaagtggaagaaagggtatcagtgattgaagatcaaatgaatgaaatgaagtgagaagagaagtttagagaaaaaagagtaaaaagaaatgaacaaatcctccaagaaatatgggactatgtgaaaagaccaaatctgcatttgattggtgtacctgaaagtgacagggagaatggaaccaagttggaaaacactattcaggatattatgaaggagaacttccccaacctagcaaggcaggccaacattcaaattcaggaaacacagagaacgccacaaagttactcctcgag

SEQ ID NO: 5791 - DNA, 1049 bp, Homo sapiens
tctaatccgttgatagttccttttgctgtgcaaaatatttttagtttaactagatcccatttgtcaatttctgtttttattgcaattgcttttgaagagatagccatacattctttgccaaggctgatattgagaagggtatttactaggctttcttctaggattgttatagtgtgaagtcttacatttaaatctttaatccttcttgactaaatttttgtatatgataaaaagcaggggtccaatttcattcttctgcatatggcttgccagctatcccagcatcatttattgagtaaggagtccctattgcttattttttctgggattctcaaagatcatatgattgtaggtatgtggctttatttctgggttctctactctgttcagttggtctatgtgtctgtttttgtaccagtacaatgctgttttggttactgtagccctgtaatatagtttcaagtcaggtagtatgatgccttcaactttgttctttttgcttaggattgctttggctattaggcttctttttggattaatatgaattttagaatagcttctcctaattctgttaaaaatgacattggtagtttgataggactccactgaacctgtaaattgctttgggcagtatggccatttaatgacatagattctctcaatccgttagcatggactgttttttcatttatttgtgccatttctgatttcttttgcagtgtttttgcagttctcgttgtagagatctttcaccttcttggttacatgcattgctaggtgtttcacaaaatgttagttttttaaatcaactactttgacaatctgttattcttacagttaaaaatgaagcagcctcagaacttccagatacagcagaaaatcttccagcaatgtacccgtcaattagcgacctaataattcaatttgatttaaacaaagtggtcggtaagtatagatttatgtttggatacagtagaacacaatctaagaattaaaatatttcaactgtatagttctgttaaaaaacaggaaattcaaagaaggagtag

SEQ ID NO: 5792 - DNA, 1030 bp, Homo sapiens
tgccagtttcctccttcttctcagctgtcggacccctgggaggcgcggggtgggaagtgggcaccgaagggctgggagttaaatgcctaagttgagcggaaggagcactgtcgaagccatgggcagccctgcgcccgggcaggcgggcaggcgggaggcgaggcgggggcgccgaccgcgcccagcgcagaccccgggggagtgagcgccgcagaggcagcctgggctctcggctactacccgcgcgcggtcgccgcctccccaggtgcagccccgccagtcccagcccccggctgcgccgggcgagcggcatcatcagatttagggtgacccggagcgacctcggtccaggctcggagggagaggcgcctctcaggacctggcaggttgacagggaaggggaaccgggagggagcggcggccggggcggcctggagtctcggaggcccgcctgcgtcctggggggacccgacctccgcgctcgctccggagcgcccgtttggatagctctgagcctcggcggggtgagcgagggggcacacgagggagacttgagctgtgttgtttttagaaaactgccgccaatctctcttcccctttccctgctgagtgtgcattttccagcctagacccgccaggccagcaaataaagccaccggatcgtgcactccggagcgactgcccccaccccgaccttgtctttcccgaagggaatggctcctccggcgcctcaacgcacagaaaacgcctgcctccagctgagcgcttttgccagctttctccaaccagtgaataagggatgcactatggactcagaaggaaatgtcatatttaagttctgcctctgatttctctgctcttagctgatctaaggtttttctagactccttagtttccactcacagtgctgggtaatggagccctaccgcactgattgagaattgccggccagtgggttggtacagagcaaattgtccttgctaacaacctttttcctttgctgttggattccactaagtggtgagagggg

SEQ ID NO: 5793 - DNA, 1032 bp, Homo sapiens
tcctggagagctgtctcctgcagtgccccagtgtctagtatgagggggtggcatctaatgggttatacagttgttaaggagcataagatgtccctacgtaaaatgctagtgtagcatacaatgaggtttgatgtcagaatggcatcagttctgctttttgttcctcttgtgaggagcctgttcaaatgccctactgtctcttgtccctatgctgggggcacatggtagcagtagtaaccatcgccttagtgcccttagtgaggtttgataaacctgcctgctgcctacagttccaaatttgaccaggattatatgacatcatttagaagaacccttaggagggaactctgaaagcaatgtgtctgtctaagcactgctgttgctggcagaggtatctagaggttacttagggatgagcacgattgttttctccagctctaaaagaaattaaggactctcagttttttttttttttttttttgggactctgtctcaaaagagtttaggtctgtgaatggtcttgctctgtcacctaggctggagtacagaggtgcaaacatggcccattgcagcctcaactttccgcgctcaagtgattctcccacctcagcctcctgagtagctgggagtccaggcctgtgccaccatacctggtcagttttcttgtagagacaaggtctcactgtgttgccaaggcttgtctcaaactcctggattcaagcaaacctgctacctcagcctcccgcagtgctgggattacaggtgtgagccaccatgtctggctcaaatgttcttttgtctttttctttgccagttttacttctttccacatgtcaaatatatatttttaaagatattagtaaaaaataaagagagtttaattgctacagtgtctaaactaggttttttaatggattgaaggctatcagaaggacgttttgaataaacttattttgtttggagtttaattttttaacaaaaacccaagttggaatttaaggtaaatgaaaacttttttgcattggagtgaaa

SEQ ID NO: 5794 - DNA, 1035 bp, Homo sapiens
cacttaatacgttcatggtaagatcaaattcttaacctccctgagtctccttttccttatttctaaaagaagaactaattattttttattttttgagacagtctcactctgttgcccaggctggaagaactgatgatagtgatcttatagagttgttaatcaaaactaccaggcacttaccacatggtaaactctcaataaatgatggttatagttatgagaattagaagtttggattttatcctgtagtcaataggaagctactgaagagttttaagcaaagaagtattttaagcagaaatacatgttttagaaacataactattggcatggattggagccaggagttagagtggtggctgtggaaaggtagagaaggagacttaattgttctttagaaggtagaatcatcatacctggtgatgatgctgtgtggaatgacagagagggagtttcaggggtttctggcttgaacaactcgttggatgatggggtcccatttcctgagatagggaactcgggtagaaagtttgtggaggaagaagaggagtttagttctggacccactgattttgaggttcctgcaggacatgtgtttggagatgttaaacagggatttgcatattggattttggaattgagaagagacgtctggcctagagtcatgggtttaaatctggcacttgaatccagagaaacagaccatatgaagtagggagagatttgagagtgaggcaagaaagctaagcagagtcccgaagacatgccatgttgaagattaacattgaggaagagaaggaattgtcaggggagcttgtggaggaattgtcagcgaatcagatgagaagaggaaaatgtagtatcagaacgctgagacagtgttcaagaaggaagatgttgtcaacggtttgaatgctgctgagggatcaaacaaaaggtaggacttaaaatgtacgttggatttagtgacagagattagttaccatttctagagacgttttagaggtagaaacctctctaaacttgggggtatct

SEQ ID NO: 5795 - DNA, 1048 bp, Homo sapiens
gctcactgcatcctccacctcccgggttccaatgattattatgcctcagcctcccgagtagctgggattacaggcatgtgccaccacgcccaactgatttttgtgtttttagtagagagggttatgccatgttggccaggctggttttgaactcctgacctcaagcagtccacctgctttgatctcctgaagtgctgggattactggtgtgagccactgcacctggcctgtttgaagtatttgatcaaactgaaactatggtttttatctttcacatgctagaaatatagagattaagaagtaatctgtatgccgacttatggattattttagttaactaagaattatcctccatgccatgcatggatcatgattttttgaagaattagaagacaattcttagcagtcagaattttctgaacataattactcattaaagttcttgtgacaccagcagctgttcgtttatgagtattgttactatcatacaatagtatatgtcttacaaggagtaggaaatcaagctgaactctattaaccctatgatgtatgccaaaagtgactgactcttctgaatttctgatggcttcatatttacttgccacttgtctcatttttcttcagacttgaggattgtaaatttccatatgttttagatttaaacttagttgtgaataaagaggaatttctgacactcaccttccttgtttatatgatcagattatcagtaaacagtgtgggaacaaaaggcgtaagcagaacgttcagtgggtttgattctttgcatctaaggtcatttgatactggttgttttgattgtcctggcctttccagagcttctgctaatcaagaatatactatgaaaatcatcagagacctagcaactgttgagcttggttttggctgtcaggcccctgttctgctgatggattgaggtgaggtgcaggtacaccaggggacactggagttttgcttttctgttttataactttgtagtaataaatggagcctttctcttctgtttgaaaacaaaatcacggtggtggta

SEQ ID NO: 5796 - DNA, 1073 bp, Homo sapiens
gtaggcctccaaagggtatagaggagaaaagctaattttttatagttttataagcaaagttccggtatgtcaggagcttgcttaaaattatatgttttatgcttcttaatttaggtactttagatttctcctagatattttaaaacattgctggccactttgggcataaaaatctaaaatataatctgtaactatttcagatttcatggtaagaccaaactgcattataatttttgtaaggagctaaactcttagactttactatttatgtactctgaccattggactggaactgaaaacaacttaaagatgcaatttggcctggctgtgttaaattagtctgctttgcattgctataaaggaatacctggctggggcagtggcccatgcctgtaatcccagcactttgggagcctgagttgggtggattatttgagctcaggagttcgagacgagcctggccaacatggtgaaaccctgtctctacaaaaaaatacaaaaatcagctgggcatggtggcaggcgcctgtaatcccagctacgccggaggctgaggcaggagaatcacttgaaacttgaacccggaaggcagaagttgcagtaagccagattgcaccactgctctccagcctgggccacagagcgaggctccatctcaaaaaaaaaaaaaaaaaaaaaagaaaaggaaaaagaaatacttgaggctggataatatataaagaaaagaagtttgttttggctcacggttctgcaggctgcacaagaagcatggcaccagtatctgcttctagggaagcctccagaagcttcaaatcatggcagcaggagaagggggagccagggtatcacatggagagagagggagcaagagagaggggaagtgccacactcttcaacaaccagctctcagaactaccagagcgagaactcatgaccattcatgagggatcccccatgacccaaacacctcccacaaggccccacctccaacattgaggattatatttcaacatgagattgggagcggataagcatccaaactgtatcacgttttgtcaaaatgattctgattt

SEQ ID NO: 5797 - DNA, 1024 bp, Homo sapiens
gtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcat

SEQ ID NO: 5798 - DNA, 1050 bp, Homo sapiens
catgacctcatcacctctcagaggttccacctccaaatactattgcattggaggtgaggatttcaacagaggaaattgggtggggatacaaacattcagtctatagcatccactcaaaagcatccatcaatgtctgtgacctgttagacaaagctccaaatctttcatgtggcccaaatctttgcttgatccaagccttgcattctttaatagctgcctacctctccacttctccctcttttgtaatacagctctttctttcatttcctgggataggccatgccctctctccctccagggccttcttcacacataccgattgcctgataagaatacgttccccgaggaagccttgcccatcctccacatctggcttaggcaaccttctgtgagttcctactgtacttccttaggcacatatcatgttgtgttgtggctctctgtcttgctagatggtaagttctatttggacaaatacctagcacagaccctggcatgtgataaatgttcagtaagcatttaccaaatgaaagtgaactgttcttcctctgaaaatgtgatttgttctgtgtgctgattgacttgagattaactggtccagggaatacattaaaactactaagagcagtaatcaactaagcaacccatttcccttctttctttccttccttgccttttttttcacaccaatatttattgagcatctatgtgccaatttaaagaaatgctgacataaaaatcaatttcttattgattttctgaaatttgaaataaaatttactaatagcattcttggacccaaaccctcaggtgtgactgggacagcaaagagtccctgctggagccccagattgaggttgatgtctaggtgaccatccagggttccttactcagccaagatatcttcagctgaattgaaaccctaaccccattgtcaggtatcctggagaattactagaaacatggacactccctgaaactttacctcctgagcatctgaggtgtaaagtccttacctttactggaagatgattaaattaaatacagcta

SEQ ID NO: 5799 - DNA, 1029 bp, Homo sapiens
acagaaaattgggagctggtttgcggagcatccagctgctgctttccctgtaccactggaattctttcccttatctgtcactcccagtaagtagggcatgtcattgttggctttctttaaaaatatttattcttccttcagagtcggagctctgaatttcttttttctttttttcttttaagacagagtcttggtttgtcactcaggctggagtgcagtggcgtgatctcaactcaccacaacctccgcctcccgggttcaaacaattcttctgcctcagcctcccgagtagctgagattacaggcgtacaccactacacccagctgatttttctatttttagtagagatgaggtttcaccatgttggccaggctaggctcgaactcctggcctcaagtaatccacctgccttggcctcccaaagtgctgggattacaggtgcgagccaccgcacccggcctaaatttcttttatctcaatttttgtcttctcttctacagagaagatgaggaaagaagtcaaggaagaaaaaggaaaggaaaactccaggtttcaggtgcaggacagtaggaccttgcattcactcatctgcccagtcagttgctgtgcgccagtggtgtggctggggtgggtggacacacagaggggacacgaggatcagcaggcaagatgtacaaagttggagacgatgcacgctacatgttagaattctagaaagatgcagctgggggttaaacaggagactttatgtgggaagtggattttgaactgggccttgaagtgattgacagtgctggggcgtggggtgggtacttcgggaatacagagcacacacactgctccaaggagcttgggtctggaggacagagggaggccaagtgagttctcacccaagagctagtttcatttaaaaatcaggggaagacagaagcaatgtgtgcgcatgcctgtgtgtactctagtctgcaaaataggttatattattttagaggaaagggactatccaattacttgggaccaccagcaac

SEQ ID NO: 5800 - DNA, 1048 bp, Homo sapiens
tgagaggtagcagatagggtgaagtactgaaaatgaaacttaaaggttttaaagcttaaaaagaaaaaaagcatacccaggctgaaaggaaacctggctaatgggaatctgtttaataatgtggtatgtttagtcttttttccttgtttctttcaacgaatgactttagctgtggccttacatccttaaggatcaaattgagactcaaatgctcaattaaccaaaaaatactagatgaacatctgcaattatgaacatagtcacttatgttgattttcttgtctgaaacatgaagtgtctaatgggatataggtacatggtgttttggctgtctacagccagagaagctagaagcctcagggactcatcccaagcagcggagggataactggcaaaactgcttgccgttagaagagtggggacacagggcaatttgaaatctaagtgcctgtaggatgagcttgcatattgctcttggcttccttgagtctctacaatctatttaacatcacctctgcagcactctttcttgaatcttggtcccacattaacattaccagccctggtgggcagaacataccgtggactttctttccaggctaagacttatcagccctgctgtctgcaaggtatgtggagacaccccgaccaagcatgtgacttcatattagttagcagtgtggagaagtgcagtttaaagatttgtcaagagagccattctccatagcactgaccatgggtccatgacctgtctctgcttacttttcatgtttctctttcacttagaatcagggagtcgtttgcttccacacacccattttacaggtgggaagactgaatctcagagaggtgtagtttcttgcccaggtcatgcagatcatggatgatggtagtagaatttactttgttaattttcggccaacaaccgtgctaattacttgacctgtattgtttttcttagtcttcttatcattctccccattttctaggtgaagaaattgagccttaaaggttaaggcatttgcggaaggttcctcagtttgttagt

SEQ ID NO: 5801 - DNA, 2005 bp, Homo sapiens
caattgcagggagctcaggagataccccacccaccttttctttcttgctgttggctctgtgtgttgctggtagctgttgctaggctctctgtctccctttactttttctaggggcttcctttgctatttgccagcttggaaagaagggtgtgctaaagctaaaattgagcatgtcagcctggcaagtcacattggtggatcccacacatcagcaagattttgcctgtaaagtctcttgatgactctggcagaagaggtcatttcaggggttggccaactccagactgccactttgttgccttgccaggaaggttgcttttcaaatagataagtggaaaacctgtaaatctgtttttttcacctttgtcagaagatggacattctatacattaggttttactgtttttttgagatgggttttgttctgttgcccaggctggagtgcagtggcgttagctcactgcaaacctccgcctcctgggcttaagtgatcctcccacctcagcctcctgagtagctgggactatagtcgtgtgccaccatgcccagctaatttttgtattttttgtagagacagggttacgccttgttgcccgggctggtctcgaactcctgggctcaagccatctgcccgcctcggccttccaaagtgctgggattataggtgtgagccaccatgggttgccccattagtttgtaaagaaacttttttgttattgttttgttttgttttgttttttagtatggtttaaaaactgatctgagaggcagtttcataaaagaaattgtaaaatgttttgggccatggtaacaactctgggctgagtctagtctcccatggttatactacttgcattaaaaagtacttcactgcagacacattatcccttattggggatgtgtagtggggcttcagacacattgtcccgtactggggatgtatagtggggcttcactgggtatggtgtatttgagtggcttgctcagcagagatgtgtgagcagcttagacatgtcagctggctcctggtactgagagaaatacagctgggcacagtaaggagaattgttagcaactacaatcacatccgtgccagtttgctttgtgagctttgcagaaatcccagttgggtggtgaaatgcaagtcacttctattttggatgcctctgattatagaccttctgactgttgaaggctgactaggaaatactctgcatgggagttctatgtaatatagctatatgtttcaaaactgtgagtgcagtgcttacaacattttataagcaagttctttattttgggtggatgcttctgttcttggtggtcaataaggaaaaagagcagttattaaggatattttgtttatatttggtaagctccttgtctcacactgcagatttaacatgaatcagaggaattagtgtatgggtgggtaggatgagttctgttttttgcttctcaagaaaagatttcactccaaatttagaattctgtctattaatgattatatgatcttaggattttaattgactttcaggattttattggatacatttattccagttagtgcaatgataataatcctttaaattatttctggttcttacagtaggtttgtaaaatttgtgtagttgtttaaaagtccaggttttacagctcctcgtctgtgtatcctgtcaaagtcccggaggagaaagaagtcatggtgctgtgtttaatccagtttcaaaaatttcagacgcacatatttatcaaggattcctttcatttacagtgagtgttaacttttgtcagtttagggataatcttatttttccacagccttttttccctcaagctgtgaaccgttattgcaccatgtagtgcttgttgctcttttgcttgcaaagtgatgataagcagtttatatagcattagagattgtgttctatattctgaaagccaaagctgatgttattgaagagttacaagttgtttattcactctaatgttagcaaatattcga

SEQ ID NO: 5802 - DNA, 1033 bp, Homo sapiens
ttttttagcagcttatgtaacttgaaatgaaattaccattttttgttctaaaactgcccatttagtgtgttgatagggttttgcttttggcttcagttgatttcaatagatgacaaagatgcagaaaaggtttttattttcatttttgcatgcttgttcacttccatggcactttaaaatgatgcacactctggcttagctgcaagaaagcttgtattacaaagatagaaaccaaaagccttttctggaggtgtttttctttttgctttgtagataagtcagaagaatcctgtgaaacctaaagacagtctaccacttgcatagttgggtagttttcatttttgttcttggagttggatctgagcagtacagcagtagcagcaattaaagcatgttagtgtatggtaaacacttatgcttgtacatcttaagatgttgctttgttggtcaaaatccgattttaaaagttgagactggtgcagtggttttgggaattaacacatggtaaacagctctgttcccagcccccaattctccatgactccgcgtgggggtagctggtgttgtagcgcatgtttgaggacgtggatgtggcaacgggaagcgtgcttcacatggggtgggtccacagagcctagcatggttggctgggtggtgcttcttcagaaaaatctgcgcccactccttaacctcttcatgttttactcatactctgctattgtgggtttaggtttggcaataatgctgctacttacattgagaacctaatagggaaaaaagactgggctttgtagttgcaacgattgctgggaagatgcaacaagtttttctagcttcttattatggtttactgtgatccattctcttaaaactattctttcttataatcctctctctctctccttaacagatgaggagttgatcatgccactgccctgctcacaatccctgagtggcttctgttgtggttagagtaaatacatactcctccccgtggctcagagtcattggtgtctgtcccctgcctgccatg

SEQ ID NO: 5803 - DNA, 1517 bp, Homo sapiens
cccgcaagaagtatggatgtcatacttccctttacagaacaccaccataacatctgtactcattcatgatacctacaaatgtgaccttaagcaagtcttttttttttttttttttaaactcatgatttttcttgctgtttctgtgaaatctaagaggagcagcttgtctgcttgtagctcagggacagaatagcattgtgtgaggtggtccacatatttattgaatactgccagtgcataaagcattctacctggagctggagagaatcacacaagagagtagaagagagttatgtatctgctctcaaggatggcaggattcagtggagaaagaccagactgtactgcatataggaacaaatgaagttgaaaagattaattttcacaactaacagtcttccttatcctgctcatgggtaaagattaccatttaatttgtagcagtagtgagtcggtgccatttatgaccacttcttgtcaagctcacacttgagacaagtcaagggccaaaaaggcctgacctgtagatacaacaagccacttgtagatttaggtggttaattacttatagagacagagaaaagaagaagaaggcaaagatgccagcttcctgtagttcttgtctagcataccaagaagggtgacactgaaactcacagctgatgaccgtgagccacaggattccggctcctgaggagctagatccagatggcagctaagtgggtttatgttctggacccttatttgaggccaggtgaagggatgcccagaaagccccatgcttcaccagaacccaggaggcaatgaggacctgtctcccgtcggctgccagggaagtagggaggtgagtgggcgctgacatagcatccctctcttttgtgttcctggagggtcataaggtgttcttccaagacagacaaagcatctgtgcttcaggccttgcctacatggcttattaggtaagtgcggactgccagggatttgtggcagagctgttcccctgtacttctttggacttgtagtgtgactgatgtctccacataacagataatcacatcacctctcagtgttactccccagctgttttgcctccccctgtcctgtcccctctgtgggtcgacagatgctgttgtgtgaatcaggctgttcttggggcctgttttctgtctgcctcctctttatatctgacatgtaaacatggctgtcattggtttgagaatcctggttcaggctctccctgtacatatttggagccactggactgtggcagatactgcctcattatttgtagatggctgtgttttttgtttatttgtttaaaaaacaaatttgtggtataatataacatcaaatttaccattttaactctttatttattattattattattattatttttttttgtagaggcagggttttggtatgctgcccaggctgatcttaaacttctgagctgaagcgatctgcgcgccttggccttccaaagtgctgggattacagttgtgatccaccacacc

SEQ ID NO: 5804 - DNA, 1760 bp, Homo sapiens
ccaccatgcactagctgggagccttgggcctggtgcctatcttccttctctgtaaaatgggacagtaaaaatgtctaccttgtagaattattttgggtgtaaaatgaaataagataaagtgcttggtacaaagtaaatgtgctcaatagatattagttattattaataatattgttaggtaaaggtcatttcttgtgagataacatgggtctacatctcatggattttatagaataaaacagacactttaaaagttgggacaggttaaacctctctggaatgcagatctgaaagcagctgacttcccagggtggcttccgccatagaagtcactttgtgagagcacaccttcctgctgctgcctggagcagtgtctttgggagctgggtagggttgtcagcgtgcgcccatgtcagtgcctcttccccttagagactattgcaggtctgcagttaaacaaaagtaattttcctaaacctgaaaaaggcatgtctgaattactggatgtgaaatatttcgtttaacaaaactgactctcatgggacctctaattttgcctatactcctaatgaggcacaagaagtagtcacatacatactgcccctctcccacacctctttaaaaactttggagtgtaaatgctggcttaaggtgtttggctcatacttggaagtctgttagaaacgagttaaaattctctgaagaatgacttaggtgcatatgctaggaaacttttgaaagattggatagagtctgcaattgattacaattgaggctgtggagtctttctgcctggaggttgttagaacaacgagaactgcttatttgggaaatcagctttgtagtggaaaaacacctgcccagaaatctggagacctggcataatgtgtgcttagtctttagctgcatgaccttcggtgagtcttgttcagttttctgggcttcaagttccatcctcagctttagtattaatttatggactgtgtcgcagtgtttttcatttgcagaaactgctttgcactaaaatggaatgatcataatctttttctaatttgcagagggaaaaaagcattttcagctgaactggtaggcttttattagtttttctaatgtaaaattaaacttttttgccattctttatctgctaccaagtgctcatgttattattctcatgtatgtggtacatggcggttgtcattttatactctgttcagatgtcacaggcacacctctgctagtgaaagcattcccaggttggactgttcgcatccacatttcgtggtgtttttggagtgctctccagagacacagtgactcctcctgggggtgtcagcgcctgggtgactccctccggcattgactgctctatagcccggccccaggcgtcagggcaggccgctgtggggtgggcggtgtggcataggagtgcccttccaacttgggaataaggtagaagctttctgatgtggagagtcctaaatcagagatagatcctcaaaggggctgcagagttccttttccttggcttttcttaaccggtgctcggaggtaccagaggaagtgaggctgggagggtggggctgggcctagtgagcagggtctctgtacttccactgctcacttctgagatcttatcactatttggcttcagaagttgttcagtttctccacttttctggtgtacaggaaggagcagcagtaacctgcctattactctgaggaacttcctggtgatttacatcgtggagatctgtcctgct

SEQ ID NO: 5805 - DNA, 1028 bp, Homo sapiens
tgaactgataaatattcaggccgaaatgaccttgcagtagactgtggacagcattcattaagagtgtgtgaggtgctggtgactgtgcctgtcctgatttccactcctgtgtgagcatcagcgggacaggaacagagcaggatggtgaggcttgaggtcccacttgtgaccttggaccgtatttcctcctgccagaggcatctgccaaactattaagggcatgaacattgtttggtttcagtgatggattcgttactacatttgcaaagctccacacggtttagggaagttgtggccttaggaaagacttaaacagctgtttttgtaatccctgagaacttggattcttgctttcagaagacacagaagaaattccagtcaactttttatgggtaagagtcatgagaatataaattaagagaatacattcttggcttaatatatcctttttgagaaaactactctattgaggctcttccctatttaagtttatcttgcctgagattatcataggatttttattagtgtgctgagccggccacttaagtgagctgaagatacatacaaatttgcaatggaaaagtttctgagattaagcctactaatatgctgcttaatgtttcttgttctgcacattatctcaatttgtgtgaatattttgtaaattggacctcataaattttaatttctaatcaatatttttattagaggtgaccaaataccttaataaagtgtatttgaatgaagactcgtttaactccaaattttgtaaaccacttttaagaacatttaaaaaggtgacctgtttattctctgcattagaattaattacctggatgactatttaaatattcagggatcagatgggaggacatgcattttttagtaagccttaaagtttgagaatcactgctttagttcatacaggcttcacagtaaccccagagtttcatggtgagggtatgagcttgagagtaccctcaagcatatacatatgcatatacatgtacagtaaattgtttgttaca

SEQ ID NO: 5806 - DNA, 1122 bp, Homo sapiens
ttgcagttgcaggtgggatatggtttcctcattgagcccgttaaaagtattccattgaatggcgatgcaactgtggtctttgtgaactgtttcttggtttgtcaggtgtgtccatgtttatgaatatatctctgaatcattttgtatttatagcatactagagattctaatatacgtgtctctgaaaagtagctacatatgttaaagatagtgggaaaaaaaggggatggaaaatgaactaattgtccatggaagaaattttggattgttaaaatgaggatgcagagaagacagaggcaaattgtcaacacttgtcactaagtgatactatgcagcttctcggatgcttgtcatttgatggaaaaaagggttctcagactgtaagaaaggaagttgacaatctcaagggaaaagagtgtggccaggtcagggcctctatcttatgaaatgagttggggtatgagactagggagggggtgattctttaaagtacatttttttttttaaagaaggacttatactgtgttaattttctattgatgccataacaaattaccacagagttggtggcgtaaacaacacacatttattattgtatagtgctgtaggttggaggtctgacacaggactcagtgggcagaaatcaggctttcagtaggctgtgtttcctgttgtgggctctaggggagaatctattttcttgccttttccttgcttctagaagttgctcacattccttggcttcaggcccttcctccatctttaaagccagcagtggtagatggagttctcacatcttctctctctggctctcctgcctccctttttaggatccttgtgattatgttgggtccacctggaaaatctgggctcatctctctaccttgaagccagcagattagcagctttaattccatctgcagccttaattcccatttgctatatgaggtaatatattcacaggttatggggaaatgttctaagtattgagtcatcttgtttgaattttgtggggtactgaagttcaggaaaactgttctctccagaagtcaccagaggcttgctttcagtatagggaagtcttagtttttgctgcctcacagatgtaataaatattgcaaa

SEQ ID NO: 5807 - DNA, 1050 bp, Homo sapiens
ccctaaacacatggggattcagctgcttgcattcatttccagagtaacttcttaagactttagaattgttcagaaagcttgcttaggacagtcttgtgtatttaactctgtagtattacgtatatctgtttttaaacagtagatttgaaataaatgatagtgttactgatgactataattgtcactctgtttgatcacttggagtttttgtccaagagtccttaaaaattacaacagtgaaacagaatgcaaaccatgaggtgtaatatttttgcttggtaagtgcaaaaataatatctgtaaaattaaaacttatcacatttaagacagttgttttaaaactaaagaacaaatcaagaaaataatagttactgatttttacataactattactgaaaataatttttttcatacatggagggtgtgttaaaaaatattccttcctgggtgtctaatgtgttagatatgccgttgtaggcgaaggctttttctgtgattcgtttttaagtgaggagattgagaatctttcatatgtgcaactggaaccgttaggataggaagaaagttacacagggcattacttgtactgaaggattactctgtgtctgaaattgctggcacttggtacagctttgtctcactttgatatttgtcaagcttcaggcctgtctgcagtgctgacagactgtgtgtgcgacagaggcaagagctcctgccggctcctttgcttggagcatgcaaagggggcttgatgccttctcttgggagggggccgtggcgcctttgcagtggtaagacctcagccagaaccctggcttcttgactctcatctccagcatcacttagaacagtgcttctccattgattttgcccccagggcacatttggcaaggtctggagacattttagttatcaccactggatgggggctgctattggcatcttgtgggtaaagacatgactcctgctaactgtcctgtggtacacaggacagcccctctacccctccagtaaagaattaccgggcccagttgtccagtagtgctgagc

SEQ ID NO: 5808 - DNA, 1014 bp, Homo sapiens
ttttttttttaagatggtgttttgctctgttgcccaggctggagtgcagtggcacaatctcggctcactgcaacctttgcctcccaggttcaagcagttctcctgccccagcctcccgagtagctgggattacaggcatccgccaccacgctcagctaatttttgtattttcagtagagacagagtttcaccatattggccaggctggtctcaaactcctgaccgcaggtgatctgcccaccttggcctcccaaagtgttgggattacaggcatgagccctcgtgcctggcctgaaacattttcaaaagaagaaagtatttctggccaaatgttagcttatcaatattttctcaactgttctgattgtgtcacctcatgtgcctgttaagctacctgacccctcccttaaagtttttgataaagggatcggggaatcttgttttaacataatagtcctagatgatttttaagatcaagctagattggggacagtacttttaggtagaaaaaagatttatcaactaagattgggaaaaacctggcttagagtaaagcaggtttctttcctgcactactctaagcactttatatggtcaatggtaaattgtattatgcattgtggggaatgagagtaagaatatatatatatatatattaagtaacatttcctaaacttaactatgaaatgttctgttaaacacattttctgatgatgtttcacagacagcacactgggaaacaattacaactccctcaccataaattctgattaaaggagggtttccttccccttcatattttagcagaatagctatataaacccaaaagtatttgagacaggtcgcaatcagtttagaagtttattttgctaagattaaggacaatgacggggattaaaaaaaacatggcatcacacaagcagtttatagtctgtgcttttctccaaagatgattttgagggcattagtattcaaaggggaaaagcaggctgaaggggaaagagggtagggtat

SEQ ID NO: 5809 - DNA, 1046 bp, Homo sapiens
tttaccataagcatgtgtgagctctgaatgtcactacatatctgtcctaatgcgtctcatgttttaagtgtcttgctcctttgtctttctgttttttttttccccagcaatctgattgaaatgggaaacagagggataggaatagcgtgcgcttttggacctctggatatgtaattctgctagatttagccaaaaatttgtgtcacgttcctatagaagagagctactgacctggggatgcttaacttggggccggcttgttgagaagtcatacattacattctgtgaatttatcttttttaaatcttcgtatcgtgtcagagtctctggaaccttttttgtccttagctccctttaacctttgtgctagagaaaaggcaggtccagaatggaaagggatttcccggtaaagcatggcagcttttctcatcctgcaggtctctcttaagagagctatgcatcctggttcttagaagatggcaggtgaggaaggggcctctgatatccaaagttagacttgattgttctttagtagtgactgagtctaagggagtatttgttgtttggagctttaaagtttattgtatataagcagtatcccattatgtcagtttccattataaaaatactatactttattattggcttttacaatatgagaatgcaggtttccctaaactgatgacttaaatggactcgggagtccacatggtggtgacttgtgtgagctcatcttgcagtgtacggccttccaatattgaccgagttgaaggaaacttggaggttttctgggaactaatcttcaaatgaggcatttacagtatattgttacttttgtaggattgattatgtgtggaaaatgcattcttagatatgtcaagattccttcattgatttttaataatgaaggtctttagtaaaacctgtttttttgtttgttgtttggtttttatggaggggtgggggatggtgcaattctctgaaagcgttgggagtgaaaagctggcagtggcccaaatgcagtgctgcctttgtgcacgttcaca

SEQ ID NO: 5810 - DNA, 1035 bp, Homo sapiens
atagtccttttcctcctcaggatgctgagttccttccccatgtagcttgctgaggggttgcgggagctcccataagaatgcctggtgatgatggtggttctgaggcttcagggttctgccccttctggatagaaatgcagaggaggctgctctacagctggacagtagtgagctctgggccgccatgagactgcctgctccatgttgtatgtggggcagatgtgggagaaggatggtgggaagaatggcttccaaactgtcgattgatcagataaacaagggaggatgccaggggataatgccaagaagaggtgggtaaagaaaggaaaggaatccacaaaagggaggaggggagtgcaggtgtgcatgtgttctgaaaagtgctcatgcacatacagtttgcttattatttaaaaacttactgtgtggagttttctaagtgtattttataaagcaagataaatgtttgggttttgtgtaaatacatttagtagttaatgtatagcatgtagaattaagcatcttcttcctgagtgaactcactgccaagatccacgtaagaatatttaaagtcacagatctttggtggattctgaacacagctgtaggattccatactgaagcacagctttcctgaaaatagccaaattaggtatggcccttcccctctggccttagttcttctgcctttgtgcacgttcacttacttgagatgacttagttgagtcatctcaagtaagtgaacaaatgctgggccagtgtccaggaggaagcagcccctttgtgtgttttcatgttcctttagcatttcagaatgtggcctgacaggtaactgtggggctatatttgactcctggagagcaattctagagaaggagatgctctggccccaggccaggggtgggctgtcttctgcagcctttcctggtatcacatttaaatgttgtgctccatttgtatttggagagtgtatttgtagagtatataggtaggctatatttgtagagtgttggctgacaaaggctgaaacaaaat

SEQ ID NO: 5811 - DNA, 1050 bp, Homo sapiens
tattttattgctgctactactactactgctactactactgtagtctactacattttacagacttctcaaggtcaggcactgttcgtttcatctttgaatcctggcattaccacagcccctggtgtacatatatggtgcttagtaagtgtttgctgagctaaagggaactctttcaactccctgattttacttatgaacaaactaagaaatagaaaactgtgctttttttttttttttttttgagacggagtctagctctgttgccaggctggagtgcagtggtatgatctcggcttgctgcaacctctgcctcccgggttcaagcagttcttttgcctcagcctcccaagtagctgggattacaggcgcctgccaccatgcccagctaatttttgtatttttagtagagatgggttttactgtgtcggcaaggctggtcttgaacccctgaccttgtgatccgcccaccttggcctcccaaggtgctgggattacaagcatgagccatcacacccggctgagaattgtgactcttaaagtagtgagaactcaaaaacccttttatgttgacttccataaaactgtgaaatgccaagttcaattcttcatgcttggaagaaaacttgggtatgcaataagaatgtgttattgttgccttctctcataaaggcatcgtctgatattggtcatgagcatagaacaaaatgaacaaagtgaattatttcctatctatctgaagactgctctctgctaaacagagtatcacttagtcataaatcagctcagtgtttagtaaatggaaaatgaggaagatctcctaccaggcattcattggctcgcttttaaggattatactttcaaaatgtgagaactatcagattatgtttgtacaaaatatggcatacaaattaaataagcacagtagcataatttgatcttgctttatcccatgcacttgtggctgaatatagataaattcttgtcaattagttttgaccttgtctaaatgccttgcaatgattaattagtaggaagcaaacctaggatggc

SEQ ID NO: 5812 - DNA, 1415 bp, Homo sapiens
ctttttgactaggcctttttcttgggtcctgtcttcaggctgcatagctctgctaagtcagtttagctacaacctcccacccttgagctctcctcccccggcctacgttcagcaagaatccccctccccttgctgtctcctgtgagttattttccatccactgaccctgctccctctgcgcattggtgctaagtccccagctgccctgtgttttctgagttgagctccgtctccttcccctattaggatagtcttagcatctgtcacagtagtcctgggaaagtcttcctcaccattttaataagcgtcagagtaattttttcttttacacagatctagtaaagagatgctcctataagtatatgatgaattgaattgacttgaggaaagatgaggcaatcaaataacagtgttttctcaaaccttgctgtccgggctttttgttgtcattgtcctgagtggtgtcctgtgttttttattgactcagaaatcgtggcctggttactatttgggaaggcatgtctgtgaaccagtgcaaattggtggcgtttagtacccctgcatttcctttttaaattcaccttccgctttcccttccaccctgttgtagggacacctgccttgctcacaggttgttcctggagactttgcgtgaaggctggtgttgacctgaagccctcctgcagctcgttttgcctcccttgtgtttttccttacatcttttcccttctctggcttccatccattctctgtgaagaggcagctcactaggtgagctgtggctttagagcttctttgcattcagtagatttccaggccattttctccaggcttttagtgcatggcgaaggcatcattggatgagtatcatcaggagggaaagggcagatggctgtgtgtggactgttaaagcagtgtgtgggcacggtggcacgcacctgtagttctagccactccagaggattgcttggagccaggagttcgagatcagcctggcaacatagcgagaccctgtctctaaaaaaacaaaaaagtttacaaatctaggcttttaatctgtatataaaaaaagaaatgaaacaacagcaaaaaagaatgcagtttgtccagagacagggatgtgactggacagcaggagtgagttgagcctttctttgccagtgtttggttcagtggacccgttcttcactctccagtgctccgtgcaacttatgtttcccctcctgtaacgactgctgggaaacagcattctccaagagacgtggagctgtggctagaaatggccttgtggctatggtaatgcccaagtcttcctcatagagaccatttggctgttttctgatttctccactcctaattaaagctttagttaattgcctgcactttgagaagcctggtagagataacttataagg

SEQ ID NO: 5813 - DNA, 1043 bp, Homo sapiens
ctcagacgacaaaaaggtgtgtttctcaaatctgaaacacaaaaagattctagctaataatgttgaatggttgagggtttaagtgatcttggtatgttagatttagcagcgataggccgggtgcggtggctcacgcatgtaatcccagcactttgggaggccgaggcaggaggataacctgaggtcaggagtttgagaccagcctggccaacatggtgaaaccccgtctctactaaaaatacaaaaattagccaggcatagtggcgcgtgcctgtgatctcggctacttggggattctcctgaggaagaattgcttgaactcaggaggtggaggtttgcagtgagctaaaatcaagccactgcactccagcctgggtgacagagcaagactctgtcaaaaaaaaaaaaaaaaaaaaaaagatttagcagtgatacatgtaaaatggctgcagttagttacaggaggctctacaatacaataccttctgggataaaggcataggaatttgggttgacctcagtattgtttgagacaaggttaaggtggactatatctcttccatctgacaacctgtttctcacccctacctgggaaagaatgcagaaacccaagacaagttttatgttctactaagagatttcttccatggtcaggccatatctattgtatttagtgcagttctagcaccacatttgaagattttggcaaaatttgatagcatcttgaagaaagagaccaaggtgtttaaatctggaatggatttgctatgataacaacaccactgtctcactggcttttcctaacaagccttaatttcttgctcatatcatgggaaggttgcaggtgaactgtggctctgcagggctgtgcttggttccaagtgtcttccttcaggactcagaccaaaggagcagctcctgtgtgggtctgagacatgctgttctcatgggaaagggctggagtgcaaggtggggaagatgccatgtttgcctccatctaattggctgagggtgccaaggtcagggaggtggagaagtgacct

SEQ ID NO: 5814 - DNA, 1245 bp, Homo sapiens
aaaaaaaaaaaaaaaaaaaaaaaaaagaatttgcgcggcgggcaagaggatgtggatcacgctttgggttggggatggcataattgcagctggaggctggaaatagtggactgcttcctgggggccatgttttgcttgctgctgtatctccagtgtccagaacagtgtctggtgaatgaatggtgagtttagtcttttggtattgtgttggagagataagaaggaaggaaccaaaaaaggaagacaccaagaggtaattttaatgccattttcatgggacacttgggagctagattagaagaagccaagactagaatcggggagatgagttgcagagggaagtggtgaaggtctgaaggaaggtaggaaaaggtcggacacattccagacatatttaggggtggaggtggttggatatggggagtttaaaggggaaggaatgtggggtgaactgggtggtgagtcagtggatattggtgactgaaatcaccactgctaggaatacagtagacagagagcaaaaatagtgaaagggaagatgatgtattttgttgttatgtttagagtttgaggtgactgtgagacactgaggtgaggatatgcagtgagtcattggatatatgtgattctgccctaaaaatgtatatttgagctttatcattagaatgggtgaaattgcagagtcagactgtaaaacttggaagtgtctgggacagaagctctgggacatacagtgtaggaatggccaggggaggaagatttttgaagatttagaggggatattcttacagcgagagcacaaccagggaaggtgatgtactgtgtggaggagagcgttcagcaggagagagtggccgtcactaactgcagggcaggcaagctcagggcccagcaccatggctatgggaatatcgggagttgaggaagaaaaaggctccagtggcactgaagcgggaaatgcggtagagatttggaggctcaacttttcagaacttgactgagaagtgagggagagagagaggagttctgacatgcatcgggcacgtcgcttttgccccacttcacaaagggaggagaagcagagccactgaggctgacctggacttcactggttcccctctgcagttgagctgctgtcaaaatgtagatttgcaaataaagatatgttttttaacccagggtttttctaggctaaaaaataggcctattttttcctgtgttagtttccttgctgtgtaacaagtt

SEQ ID NO: 5815 - DNA, 1028 bp, Homo sapiens
aaactggcatttttggcaggttatgacactggtacccgtggggtgctgttcagtgccatgttacctgatctggaaacttgtggcacccgtgtgtgtgtgtgtgtgtgtgtgtgtgtgtgtgtccttgtagggtgctacttctctccttgcctacctaccgtgtactttgatgatgctgacattggtggatttctgtagatgtgctgtttagccaggtatgcagcactctttatttaaagtggagggccattaatggtggctcatgcctgtaatctcagcactttgggaggttgaaacgggaggattctttgcgtctaggagtttgagaccagcctgggcaacatagtgggacaccgtcttctaaaaataataaaataaaatggggaatccttttgattggggagaaattagaatctaattttggaaaggggcataaaataattcatgagtttggggaagcaccatgacgtataattacctagttatctcttaaatttcaaaattggacttaattgagcaaatggtggtgaagataccatagaacaaaagatttcctgttgctttctgtgcttttttattatatgaaatgatgtggcatgatttatttggttgttactgtctggttgtgaacgtgagcaacctttaacagatggctgaaatggggcccagttggaaggagggccgcggaccacctgcttttgtggccctgttgccctggagatcactccagctgtgactgttgatggcctgtgggggcaaaatcaactcttcagacaggtggcagcgggactacactctagactagaggaaaccagggaagagaaagcccagcctgagtgtagcaggaaagaaactgaagtctagggtcattaatactagccttcataacccatcaaacagtgaaagtgtatttcttgcttaaacaaaaccatgcagattaaccctcctccatcctgtggccaccttcttcagcagtaacacagagtcgagagaggcatacttactgccttactgtggaaatgaaacac

SEQ ID NO: 5816 - DNA, 1053 bp, Homo sapiens
accttctcttccacatgagctcccgtctctgtgctgcaggaagttcagaggcacggtttatcatgggtgcttggcaccactctctctctaactatgtggatcctaactccagtctcctgatggtcagcttgacgcgggttcactggatcagtgccttccagtcctgggcaggtgctctgtttctgttattctagaacccccgacccagggaacacagagcttgctggtctgccttcattttctcacctccaatttaagaccaagtaattttattttgccttcatttggtatttagaagcgtcgggtggcttttgtcagggacagtttcatgcctctctggcttttgtccgtgttgcctggtgctcttctagctggccctgctgactggagtctgtgatggactcccattttcttgagctgagtcacttgttttcctccaggatgccgttccctacagctcatcctgcttgttttcacttactttcctgttttctgcccttgctcttatatccaggcctgttagatctgaatctagtcattctgctttctcttcagaggtttctcttgacagtaaatataaatacagtaatttctgtgggccagatatggttctcagtgttgggtgaattttaattcagtctccgtaacaatcttaggtggatactcatctccattttgcagaggggaaactgaagcacagagaaagtcactgccccacagtcatcagggtgccaagtggaggagtcagggttgaagtcagaaaagctggctcctgagcctgcactcttaaatgctattctatattctttttaaaacatttttttgacttattttgtattctataaatatttttgactcatttttccatctaattttacacctttctattcttttaaaatttttttaaaatttaaatttaaaacctacagtcgtcaataaaacattattctatattcttgctggctcgtggcacctcagctgtctggaatcttctatgtggcctccttgatcccgggatgagttagctttttcatatgatattcagctacaatt

SEQ ID NO: 5817 - DNA, 2415 bp, Homo sapiens
gagagacggaggttgcagtgagccgggattgtgccactgcactccaggctggtgacagaatgagactccatctcaaaaaaaaaaaaaaattaatacttacattaatctttggtcataaacctttctggtgaatatgtttataaactaagcctgctaatttcagagaagcataatttaaattactccattactgttctttaaatgttttccacccatgcttgatcttggaagtgaaattgctcacacttggaagcatccttcactcctcccctcctcctctcctcccatcttcccctcctccccccacatcttccccccctccccctccccctcccccttcccctcccctcccctcccctcctctctctctctctctctctctctctctctctctctctctctctctctctctctctcacactcactcatccccctcctcacaccactctgtgtgtggtggtgggggagagagagagaaacatttcttgaggttgtagcacagtctgtcattgctctaacctttgaattctgtctgatctgtccgtcaaatgctttggaaatgaatgctgtatttttaacttcgttttcattgactgaactgtcattctttagagttttgatacgtgttcttcctgcagaatccagtaaagccatgctcgttttgttggggaaaaagaagcaccctaagcatcgggtcccaggctcaggcttggagcctcataggctacgttagacctcggttccaccactcacagggtgtggccttcttaggttggttacttagcctcctagttttttgttgtttttttctcctagcctctaaaccaccagagattagcctcctattgtgatcctctgtttttacatctgtaaaataaagacatcatggatttgttggtatggaagtttataaggtattcagttctgtgtctgagaaaaattatggttcattttctcttgtcaaggagtggcaccagcaaagataaggaggtcatattatggagcgaatgtcagtgcgagaatcatcttgcatatcagtaacttaaatagttgattcatgtggcgtatttttattagtataagctaacccagattgtctaagtgtaggggaaggatcattagatttgaattgtaagtgctgtgttggaatcttggctccgtgacttgctgttctgctttgggaaggtgttttaatttctctccacttcagtgtcttgatttgtaaaatgagaataatgatagctacctcttaatgtggttaagatgactgttgagatgattaaatgagattataccaaagaacctaagagtgctgatactcagtaagcactaataaatggggattctctagattttgtaagtaaatgaccaatatttctgtcaaactgcttacctttgactgaaactttgaactttagtgagaccttcatataattttcatgacacttgacttaataactgaacatactgtgctatgctttgggtataagagtatgatacttttgtgtattttgtaatatttaagtacttcttcctaataagctgttgggtagagcatatatatctgtccaccagccatcttattgagagagacaatctgttccttccactgaaagcttaggatcacaagctgaaatttccttaatatgaaaacaaaaacaagttcacattttgggtttcataaatttaattatggttaactttggaaattaaaatgttttctgaaaagtaacttttctgttctccctaggaaaaatccattattagaatgtaagagacaaaacaaatcttttaattatacagcaaaggtgccccagggctcagtgtgttcctttgctgtcttttttgccagcatcttatttgatccttaatgtgtctggaatgtggttaagaatactaaaaaatattttgaactagactaacgtgccattagcattaccaccttggttttaccagctgagtgagcattcagattcttgatgtgcatatgaggttaacatctctttaagatactgcctgtaggctgggcacggtggctcatacctgtaatcccagcactttgggaggctgaggtgggaagatcccttgaacccaggagttaaagaccagcctgggcaacatagtgagatccctgtctctacaaaaaataataaaaaagatactacctgtaaactaaggtggggtttttcattgattatctccctcctcctattgtaaaacgttttgaatgaaataaaatacatttttcctttgtactctcttctcagcttttaaatttacttttttcaagtcctagaatgtttttcagccttatttttatttatctaataaaacctctattttggggtttcttttcataccttcagtaccataagaagatttcagggtagttatttgacaggttcttgtcaaata

SEQ ID NO: 5818 - DNA, 1035 bp, Homo sapiens
actatttcagtcacagaccttgcgagctgttggtacaatcagaagcttttgtgttgaggactcagtggacatgtgctcagaggctctcattaaatctctctgggcctcaggttcttcctctctgctgtgggaaccaaatgctaggtattggtgagaattaaatgggagaacatctggcacagataatggctaagatgtttaagttcctcctcctaattatgatggtagtagtgacgatggatagtgcctcctgtagttcggaaggaggaagttaattctgggtgggaggtggtcagcagaagttccagaaaggaaggaagttcggttatgaaagagggatgaaatttggatagtggacaagagacagtttcaggtggagagagaagcccagacatgggagctggagagttgggcaggggtggggcagcagcagcagccaggccatggggaagtgtgacatggggactgggcaaggccaggagggaagcccaggagtgacttgtgggaccctgagtgccaagcagggatttggacatcgccttttggaaaggcagggctttagaaaggtgtgtgcggtggtgggatgcagtgttcacaatttcctggtgagctgatccttatgggtcccccacccctcagcaggtatctagaaagattatcttgggcataaagtgacctctgccctccctgtttgtcagaagctcttgctcctggctcttggggttaggttttctgctgctgctggctttaccctgcagttggttgaagggtttccagttagtctttggaggctgacagtgtaggacctggtttcacctgagcttggggccctgctccagggagagagctgttgtgggggtcatgatgtttctggggttgtggatctctgacttgtggcagagcttcgtggaaggacactggaggcacagcacttgctcttacccacatgttgctcttttcctccatgactttgagatccttaaatacgttacctttttagaactggtggtggctttgacttctgtacgttggatg

SEQ ID NO: 5819 - DNA, 1677 bp, Homo sapiens
aaggtgtttgaggctgtgctttgccgttcatggtgtagctcctcattcgttttcagctatcagaaaggccacttgttctggtgctccttggctcagctggcaccaggtcactgtctcatcctccagccagtgaaggagaccgccttcactgtgggaaccagcggctcgcattttaattgtgatctggtgacttctgtacagcagcagattgatgacagctttggaggggaacaggtggctcagtgtgattgaatcgttctttaactcattcaacaagtaatggccaagtacctgctctctgttggacaccatctggggccccagggcagtcacgaacaaagcagaccggagagaaaacaaagcaggaagttaagggtggggacatgggtagggccggtgtagcagaaattctggagccaggctgcctgagttggaatgcgaattcccattacttgccgtgtgactttggcaagccctttaatttctctatgtctctttcctcataggtaacatgagggtaatattattattatatgagttgtactaaataaattggcatgtgtaaaattcttaaaatggtgcctgccatgtaactactatgtgttaggtattaggacagtgcttatataaagggatgttatggtgttactgttaggtaaggtgacatccttcagatacctgaaggatatgagagctgaaccatgtgactccttggggaaggagccttcccagcagagtgggcatgcgcctggtgggtttgaggggcagagggagtgtgggggatggaggggagtggtcagagaggcagcaggggcagggcatgtccagtcctgtagccactgtgagtactttgcactctagaatgggggccaatgtggagtttgagcagacgtgctcctaatgcagttttggcaggattcctgtggcaactatggagagaatggacaatggagtatccccagggggtgcagtgtgggttagaccctgaggcatgtcaaggggcaaggtcaggggatttgctggttggctgcattgggtgggaatagcgagggtggaggatgagtgcaggccttgaagggtggagttgctccttagtgactgatgtagactggaaggaacaggtcttgagcctgttgattttgatttacatgttagtcaacaggggagctgaacgggcagcatgggagttcagtggagtcagtgctggagataatagcatgggaaccattggcatactgagggtattcattacagtcttgtggctgaggtcaccacgcagcgaggagggaagggacaaggaagcagcagaggtgtgtgtgagaaggagctgaggaggggcagagataggggcagggaggggggtgaagagagagagatggtcccggcagtcagcgagggagacattttgaggagaaagtgggcatctctagtaagataaggactgagatgtggccattgaattagcagtggccttggtaagagctggagagttgggggtgggagcaatggccctactgggcagggttccagagagaacagggaggaggaactggagcacgcaggagcctggctgaacaggaagcaaagaaatagagggaaggctgcagagggggaggctggttgagagctgtagttcggtttttggaatgagagtaattactacgcgtgcctgtgctg

SEQ ID NO: 5820 - DNA, 1078 bp, Homo sapiens
gtctctactaaaaatacaaaaaattagctgggtgtggtggcgggcacctgtattcccagccactcaggaggctgaggcaggagaatggcgtgaatccgggaggtggagcttgcagtgagccgagattgtgccactgcactctggcctgggcgacagagcgagactccgtctcaaaaaaaaaaaaaaacaaaaaaaaaaaacacgtagatttggtaactttaatgaattctttagtgacatgataatcagagaattggctacttggtgaattggcttttggcaaattggtcctaagaaatcctgcccttctgaaagctcctcagacatcttcataaacttctatttgtccctctaatgtagtatttcccagggtctcttgtttaccctcttatctttttggtttgcacacagttcctcatggcatttatgtcaactgtcgtgtctaaccatatttttctctgtactgttcaaaacccacgtattcagctgcctgctggacatctttacaatgaaggctgtaggttcccctgactcagtatgtcccagacagaacttaagaattccagttaactttctgcattttctaccctgcccaggtccctaagccaaggagggctttggattttcgtagactctcctcttctcacaggtgggcagcggtgctggagatacatttcttcccagctccaggttcagtgacatcatattggcggcttgaaatagccataatcagagtatttacaccatggaaattggtaaatgctgcaaatcagagcattttttaaacagatgactgttaaacatttactagtacaccattgcatccaggcattccaaggtgtactcagtttcacctcttacccagccttgaacctgaccactatttcctattgcagttgctgccaccttagttcagactcacagttccccacttgtgttactgcagcagcctctagactggactccctgcccttgaccttatccctctctagtccctggtctgtgctgccgctagctgacaggacttcccgtgaatcagatacgattgtgccactggcttccttaacctttctcaagg

SEQ ID NO: 5821 - DNA, 1052 bp, Homo sapiens
tccttttccttctggatatccaagagatttaggctggacgtggaacttttttcttgttccaagcaggagactaggaactccaacaaaactggttaagtagcctgctcatcagacccctccagaggctgaaggtaagggtattttatccaaagccagagtgactgctttctttcttcacacaaagaggatgacattgcagactttgtacaggagccactcagcagagaagggaccaagagttcctcatgggggtagagaagtttgccaggccagagagaagttaggttgcgagacctgccatggtttttcatgctactatcattacttgtggggaagaattgtagttcctcatgtcctttccttttctgtacttattttagttcatcattttcaaagatgtgagagcttaatattcttaaataatatgagaaagcagccaagccacatctttttccttttaattagtgtgatttttagagatttattgtcttaacaaagaatttggaggaaaaaaccctaagtttgcggaatctgtgtttctcaggagtcccttgaaataattaaaggaataaaaactatccatcccttgagtggcttgagccaaagtagaaacattaaaattcagaaataaaaatatgattcttagttttagttgcacaaccttttagaaatactgaaattgaaaaaatattctgtggctgtcctcattggggtcgtgttttggttaccgggcagtgttgaacttttgcgtggtgaaacaaccaccctttttgtcctcctcttatctagcatttaggagcaactttccactgccctgtcgggattgctttcctccgagcgctgccatggccttgctgtcctcacctcacttgcattcccagctgtctttggctcgttcgtgtgtgcaggtgtgcaggtgctggggtgcccctttctccagctgccctcagttgctcggtgtgtctccttcagggcatgtcaagtgccatagggaagacctaagcttacaccagtgattttcatgctttgttcctttgcttacatactatgga

SEQ ID NO: 5822 - DNA, 1043 bp, Homo sapiens
aagtgacggggccactgagctgttgttatgatttagcctggtaactcatggtgtgttctccatggaagttcctatgttggaagccctgatcttttgtatatagtgttaggatatcatcccttaattagccagcacaaattcttgaccacagctgcctggttttcacattgctctgacactgctacatgtggggaaggagctgttctcattttagtcagtcactgactcttggttccattgctgccattcccagagttaggggaagcacaaccactcctgctagctgggcaggcactgagggcctcttcactgtgcattctacttgtcacttcattgctctcctaacctcctcagttttcaactccatcaccttgctcagggacttctggagtagagagaagaaaggaatgaagtgaagccttgaaggagcattctacttgaagcaggaactttgtcagaaaagccctttaagaagcagactttgtatcccttagccttgtgttataatctgttctttgactttatatatacatatatatgtgtgtgtatatatatgtgtgtgtacatatatatgttttaacttttatttcaaacttacagaatgattttaatagtagtaatacagaaaactctcatctaccctttagccagattcatcagttttaaaccaatattctctcacattctgcacatccttggtcattgtcttttattattttttctgaattgtttggaagtaggttgtctgcattctgccttttctccctaatactccactgtgtatttcctaagaccaaggctattctctgtgtaaccacaatattatcaaaataaagaatttaacattgatatgtttcttctaattaactgatcatattccagcaatgttaagtggctccgtaatgtccgctacagcgtgtttttctgtggtatgggtttcactccagcctgacacatggcatttagttggcatgcacgctctatgtcctttaatctggagcagattctcagcctttctcagtctttcaggacattgacactgt

SEQ ID NO: 5823 - DNA, 1030 bp, Homo sapiens
aggaacatcttctttctcaaagacattaaactaatcacatgaaatattcctttgaaatgtaacattagattagaagaacagtcatcacagcatgactagtaaacgaatgaaactaattcctccctttcccagaggctacatggtcaaaacagaagggcacacagccttatacaagccagaaatcctggcagctaccgtctgaacctgagtttttcccatttataaaatagaatcaataacatctattttttcttgcaggactgttaacatacgtgaaaacactttgaaaaccttactattttttataaattctgaagctcttttataccccagttacaatttcttcatcagcttcaatgcttttcaagatgttaggagaaaaaggatgtattagcacttatttgctcatgagtactttcaactaggctgaagtcatttgaatgaagagctctggaaagagagaggtttggaagaatataagagagtgagattagctactgtcatgttaagtcacaggaaaacatctgagtgctttggaatccaaggtgcgtgctcatgtctctaagccggtgtggctgagtaagcggaaatgttcgggccgagtcggtaccctgagaggatcagaacaccgtctgttgcagccagttacctatgttcttagaggcttaaaaataatttttttggcctcctcaatacattttaatgtaaaacacaaatagtggaagtatctagacagtttttgaaagaggaaattttaaaaaattgtccagaacatgaataaccctgccaacctgataggagtttaaagaaactcagatagaaaaaggaaaacttttttgtttgcttgtttttttacctgtccagttggagaccacttggtcaaaacattcgggtcagtgtcagtgagtgtgagttgaaacagatgctggtgggaagtccactggtgtagactttccgcaaagatgtttggcaatatgtgttgagagcctcaccattgttaatgacttgaggtcaagtgattccaattata

SEQ ID NO: 5824 - DNA, 1027 bp, Homo sapiens
tatttccttatatcagtactacactatcttgattaccatagatttgaagttgaaattggaaagtatgagtctccagctttttctctgtcagtgttgttttggccatgccatccatgatccttgcatttccctatgaacattagaattagcttgtcaatttctgtcagcacccaccacctcaaaaattttgggattttagtaggaattgcattgactatgtagatcagtttgggaagtattgcagtcttagcaatattaagcattcaaatctcttctaacatggaatatctttctatttatttagattttctttcattttgtcaacgtttttctatagttttcagtatacaaatctgacacttcttttgttaaatttattcctaggggcagggtgcagtggctcacgcctgtaatcccagcagtttgggaggctgaggagggtgggtcacgaggtcaagagatcgagaccatcctggccaatatggtgaaaccccatctctactaaaaacacaaaaattagctgggtgtggtgacatgcatctgtagtcccagctactcgggaggctgaggcaggagaatcgcttgaacccgggaggcagaggttgcagtgagccaagattgcgccactgcactccagcctggtgacagagtgagactttgtctcaaataaaaaagaaaaggaaatttattcctaagtatttaactcttttgcatgctgttataaattgaattgttttcttaatttcatttttggtggtttattgctagactatagaaatacaatttatttttatagattgatcttgtaccctgccacattgctgaattcatttattctaataattttttcagtagattctttagaatgttacatgggaagatcacctgcaaatagagatagttttacttcttccttttcattatggatgccttttatttggttttcttgcctagttgccacagttagtacctctagtaaagtgttgaatagaagtatcacgagtgcacatccttgtcttgttattga

SEQ ID NO: 5825 - DNA, 1036 bp, Homo sapiens
tctgtattttatttatgtgtaaacattttcctttccacatgtacctttttgcgttttgtaatatttaagactttatggacattatatactgtgaataattataacattaatgggttttatctgcaagttcttaaaaatagcatggatggtgtctgtttaattttgtttttttttctgttacattttcactttgcaaatgcatttgataaaaactgtagtagtaatttcatagttcagagaagtgtaagacgtactatcaataataaacagagttctactatgggaaactaaaaaagacattcttacctcgtggcccaacttaatgggctttgtagatatttctgatgtctgtcttcaacctaaactctgtcagtttagaaatcctgtattacttggttttattttccaatcattttaatgatttaaaaataggtatataaaatcctaatcgcagtgatatacgacttcacacacattaggatgactattaccaaaacaaaacagaaaataagaaatgttagggaggatgtggagaaattggaatccttgtgcattgctgaaatgtgaaatggtgcatacggtggaaaatgatatggcagctcctcaaaaattgaacataggattaccctatgatccagcaattccacctctgggtatgtacccaaaagaattaaaagcacggattcaaacagatacttgtacaccagtgttcatagctgcattgttcacaatagccacacagggggaacagctcaaatgttcattgacagaagaatggataaacatgatggtgtatatgcatacagctgaatattattcagccttaaaaaggaagttctgacccatgccacaacatgggtgaaccttgaggtcattatgcgaagtgataataagccagacagaaaaggacgaatattttattattctaccaatatgatgtgccaagagtagtcagattcatagagaatggtggttgcccggagctgcggagagggaggaagtggggaattattatttaacgggtatagagtttcag

SEQ ID NO: 5826 - DNA, 1025 bp, Homo sapiens
agtgaccacaatagtggaggtctttatacattttggcctgtttatccctagaagtagtttggaaaattttatatcctcactacattttttttttttttttaagacagagtttcattgttgttgcccaggctggagtccaatggcgtgatcttggctcactgcaacttcgcttcccgggttcaagcaattctcctgcctcagcctcctgagtagctgggattacaggcgcccgccattagtcctgactaatttttggtatttttagtacagatggggtttcaccatgttggccaggctggtctcaaactcctgaccttaggtgatctgcccacctcggccttaatttgaaaatttttatcccaagttttagttgttgtaaaggatgttatttgcaatatattttatatagtagggttttaaagttaaaagtattcattagagactgaatataccagagtaatatgaaactcacagttacccattttcttagaggtgaaaattttacattgctgctttttctccttgaactcattattttctttctagtttcctcacacattagcctcttcttcaaaattctccatatcaaaaatgtacatttaagtcaaaattgcagtagtgttttctggatgataatgttctaatttattaaaaacactttcaggtctgagttgtcattagtacacagttgatcaaaatatagacatactaaagctgggtgcagtggctcacacctgtaatcccaacactttgggaggccgaggtgggtggatcacttgaggtcaggagttcaagccagcctggccaacatggtgaaatgccatctctactaaaaatacaaaaattagctggtactggtggcgctcacctgtagtcccagctactcaggaggctgaggcaggagaatcgcttgagcccaggaggcggaggttgcaatgagccgagatcgtgccaccgcactccagccttagcaacagagcaagactccattttatatttaaaaaaaagtcagtataaattattaa

SEQ ID NO: 5827 - DNA, 1393 bp, Homo sapiens
gccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatcc

SEQ ID NO: 5828 - DNA, 1040 bp, Homo sapiens
aatataaaattcttatcactggctgggctcagtggcttacgtttgtcttagtgctttgggaggccaaggtggaaggatcgcttgaggccaggagttggagagcagtctgagcaacatagtaagacccgagtctaccaaaaaaaaaaaaaccaaaaacaaaacaacaacaacaacaaaaaaaacaacaaaaaaacaaggccaggcacggtggttgttcacgcctgtaatcctagcactttgggaagccgaggtcagaggatcactagaggtcaggagttcgagaccagcctggctaacatggggaatccttgtctctgccaaaaatacaaaaattagctggacatggtggtgggtgcctgtaatcccagctacttgggagactcaggcaagagaattgcttgaacctgggaggcagaggttgcagtgagctgagattttgccactgcactccaacctgggcaacacagtaagagtctgtctaaaacaaaaaaaaaaattagtcgggcctgtagcacgcacctgtggtcccagctacttgaggcgctgaggtgggaggatcgcttgagtccatgagtttgaggctgtagtgagccgtgatcatgcctgtactccaggttaggtaatagaaagagaccctgtctcaaaaaaaaaaaaaaaaaaaaaaaaaagacaaaacccacaacaacaataacaaaacctctaatggtaatattggggcatcttggtgttttaaaaatctgcctttcaaagggttatgtcttgagtctctcagtccataaatggaaggggaggtagaggtgaactggcctcatcaatctctgctagctttaaacaggtgagattatttttatattcttccttattaacatgaaactcaattgaagtgctgctgcttctgttctctccactgccaggaaagagatcctgttggaaggaagtactctttgctgtgtctgctgtcaccaggccaaggtgcacatggatggagataacaggcccacctgtgccactggctggcaggcccatgctcactttacatg

SEQ ID NO: 5829 - DNA, 1180 bp, Homo sapiens
gaggaaatattccaaaatattagtggatcttctctctgggtagtgagattatgaatgatttttatttttaaaatattataaatattatcctacattgtccaaatgttctaaatgagtttgtatttttcttcattactatttaacaaaattgtatttaaaacaatacaaaatattcaacactgacaatggaaaagttcgccagggcaggctggtgagagactgaaattgtgagctggcggcagaagctggtcagcagcagcatggattagtgtttttatttataaagctgcaatttctccaagcaagacaggcacatccacctgctgatttataccccttgtcaagggaagccaaagaacggtaattctctgatggtaagccttcctttgggatgatgttcagtcacttcactccccaaatgcttgatcaattatatactacctgttgatactctaggaaacatttaaaataactgtctttcatgcaggagaaccccgcaaatccagtgatagatacactttctttccaggttcaaaaacactcttaactgcacatgagccttgactttttggctttgagtcaaaacacttcccgggggaaccatacagctgaaagcgatagactgagtccctgcatgttgtctcgacccatgtgattacggcaggacacaaaacctcgcttggcctaaaattgtccatttgtaaaatggaaataagggattacattgtacaacaatttattatttgacccatatgtgatattaattgtgaaaacattttgtaaattttaattattactcaaatagtctacttgctgaggaagagattatcttctcatttttttttcaatctggctctaatcctaactaatccatacagtccctgaaagcaaaacatcagtcttttatatcttaagtgcctaacacagtgtctgatgcatgaatagtgttcataaagttctcattaaattgattctggattgccgtcaaccattcaatggcataaacaccaagtaattatttaattcttattataaaccagtcactgtacaaattccaaggtaaataaaagtagattctgccctcacagcctatagaccatcaaatcaattgatattgaacaaatgtatacaaatgcgatatgggttacatgaagacttgcatgggcatttaccttagatt

SEQ ID NO: 5830 - DNA, 1127 bp, Homo sapiens
gttcttcagtgaatggtcattatcatggctatcttttcccaagcatctattatgagacaaacactgtgcttgatattttcatgcattatattttttaatcctcttcacaataccatgaattaagttgctgcagcccaggaagctggagatctgaaaatgtgcccatcttgcctgtgtgtagcgagccaatttcttggaaaaggaagaggtttcttggaattgcacaggatgcttcttggcattctcacatctcaagggctttcaggaggggttttaaacacaaatacttacaggggccatgtgcgttgcataactgagtgatttctatcaggtacatgctctacctaaagggctcagacagtgctctacaccatccggttgctatctgtggaaataggagctcagaagttccagaacagatgtttcaaaaaaggttacaaacccagtcttttccatggaaacataattttttaaatgataactcatggttttggatttcaatttttttgtaaacactgtgctgaccacaaaatacttaaaatcaggttttgcacaaaatctgctgctttgagacatctgatacagatattacaaactttaggataatctgtttatgtgtagatactcatttatttacttaatgttggagggtgtgggtgtgatgattctttctgagtatgtgggggatttatctgtgttcctagtatgtggagttaactcaatcaccatacctcaggaattaatttatatctcagcattgtttacactattcccaatggaatcgataaattgatttcttctgttttctcactcttatcaatcttatcaatgctgtcatccatcattgtgagttttctctgtggacgctgttgctaccatgtagtttttctgggtcaattttggtaagtctaaattttacctgtgcatttttagcaaatgtcaaatttcctttgtgtgaattatttctcctagtaatattatttatgttaattaatttattaatcgaatcagtcctgctcatttgtatttatgaatgagcaaaccccaaaaagcatggtgattgtctctcctaggataatccagggttgtttcatattctaggaattaaatatctctggtaactttgc

SEQ ID NO: 5831 - DNA, 1070 bp, Homo sapiens
gggggcagaagtcagcttgggttcagtggagggaggtggtaccatggcattacacctggatgtcccctctgtaaagtgaaatagcataaagagtgtggtgggaggaatcactcaaaaaggcctgggttcaaattcagatttggctacttagaactgttccttaactattatgagcttccacagactcatccatagaatggatggtaatatccatcacacaggggtctttgtgaagctattgtgatggctgtagtaagatattgcacatagggcattatgcctagcaccacataagtgtccttggtggacagtgttgacacatttaatctctcaataatagtttgaggtattaatacttccattttatagacgtggaaactgagacaatgaggtgtattcacttaagactacacaaaggaggaagtggaagaataggttttgaacctaactatgaaagatggctggcaaactctcattttgtcaagggtagtagctcctaacatcttagactttgagatttccttttagcaaagtgaagctggttgtttttctcatttggactataaatattcatgatgctaaaacggaagcattggtaggatatataggaatacactgaagttgaaagaagagagaaaaaacagagggagaaagggagggaggagggaaatgaaaaaaggaaggagggaaggcagggaggggaggggaggggagaggaaggacgggaggggacctcatagagaaataggatccagtgtgaattggcaacgcacttgttaattcttttaatccactagtatgttgatgtcagctcctgggaaggatccatagcctttgatgatgataattttcacctaggcatgtttttttcccttcagggaatgtctagtttgcttaagggactctcattcctggctgctgttacaaggagaaatatagctgtgggtaatatgtatgtctatgtgtataagtgtggacatacacatacactcactcttacacaaacacacacacatgaatgctgtgaagcttatacaggaaagtaagagtgctctggcttcactgctgtc

SEQ ID NO: 5832 - DNA, 1050 bp, Homo sapiens
aggtgatcttggttaaccttaacctcttttattattattatgatttttttttttaatttttgagatgaaatctcgctctgttgcccaggctggagtgcagtggcatgatcttggctcactgcaacctccgcctcccaggtttaagcgattctcctgtgtcaacctcctgagtagctgggattacaggcacacaccaccacacctagctaagttttatatttttagtagagatggggtttcaccatattggtcaggctggtctcaaactcctgaccttatgatccgcccacctcggcctcgaggtgtggagggaggggcgctagcgggaaccggggctgcgcgcgattcttgcgggccagcgggagttccaggtgggcgtgggctcggtggagctcctgcattgatttaataaaaaaggtttcttaatatagacacccaagactaattgtattgtctaggcacattggataaggatttaatttcacacatcacaaacgatcaacatcaaattgtcagagtcgtattttataccttctttatagagctctttaatcttcttagcccactttcacagcccactatcctgaaacaagtttcagttagagcttaataggtaaaaaagaaaggtagaatgacaaaagagaaagtattaaatggtcactccatcactgatttcaggaaatcatacatgtcctgaaaagttgctgtaactttagagccagattcaggcagtgtcccaggaagccacctgtgagtgtgtgcagcttctagcatctgctccaattttatctacaaagggcttaaatgcaggctacaaagcagagttaaacccaatcacctggatccacaggaactcctgtattttctccttttcagagaccaacatcctctagaagttcaggggctaaatccttccatcaaaatcacacagtgggtttctaaaaagcagttggagtaagagacttatcagttctgcaatatgccacttttatgctgggtgcttctgcactgcaaccaaaagcaacaattgcactactgtctaatatttct

SEQ ID NO: 5833 - DNA, 1030 bp, Homo sapiens
caagtagctgaaattacaggcacgcgccatcacacctggctaattttgtattttagtagagacagggttttacttggccaggctggtctcaaactcctggcctcaagtgatccgcctgccttggcctcccaaagcactgggattacaggtgtgagccaccgtgcctggccaaatatttaatgtctgattttttacagaagaagtttaccaatccctagattagtttattacgtttatttgttgctggtgtgtactagtctagatgacttttcctacttcaaggttatgaagatactcttgttaccttttaaaatatttcttgttttggcattcacatttacatctctttcattggaatgagtgtctacttctgtatgaggtagatgtcagattccttttttcatgtggttaatgtagaattatttttgaaaacaccatcctttccccactgttttacattgtgatatttgtcatcaattatgtgtacatatatgtctgtgtgttttttgggctatgttctgttggttggttgtgccagtaccacacttggtgaaacatcttagcgtctagtagctggtttaacacattttttcttcagcaagatcctggctcttcctagttccttgcatttccatacaaatattgttagtattaataaaataacttgctgagactttctttggggttgaattgaacctatatataaatttgggaagaattacttacctttttttttgagacagagtcgcccaggctggagtgcagtggtacgatctcagcttatgcaacctccacctcccgggttcaagtgattctcctgcctcagcctcccgaggaattggaattacaggcacctgccaccacacctggctaatgtttttgtatttttagtagagacacggttttgccatgttggccaggctggtcttgaactcctgacctcaagtgagccacctgccttgacctcccaaagtactaggattatagatgtgagccactgtgcctggcctccaattccattcttgattat

SEQ ID NO: 5834 - DNA, 1052 bp, Homo sapiens
tgtgagccaccatgccaagcctatgcttcaaatttaatataattaggatgtttcttactagaatactgtgtccaacctatatagccctaactttcctggtttacattgtggccctagtatctgggcagctgtgcatggagatagccagaggaaacattttttttcttaatgaattggtgaccacattttgttgttcttgcctcctattatccgtgccctatttgcatcctggtttcttctacagtagtttatgtaaatgttgttttgtcctttgtcgttctcagtagaattggttctgtaaacgaaacctggtcctgtaatttcagtatatgctcatatctcatctttggctctcccattttcacagcagtgatccctaaaagatgtgccctagaggatatccagaacaatccaattggatgtcttctccgctgtactccacagaggtttcaaatataatggttccaaaatctttccattttctacacatccttattattgtctctgaattaaaggattagaacccagaatatgtattgcgatgaagaaaatgtcaggctctttttctacatttttaaatccaaatgagagttaaattagaattcataatgaatgtactgacaatttatttctgtgatttgtaaatataaatctgtagttctcagtaatattcttgaaaatggtaaatgatcaaatactttggagaccattggtctaaaattactctataacccatttccttggctttttttctcaagacagcaccaggccatctcctgtgctgtctgccattttgttgatgtctgcagtgtgttggaggccctcacctttgcttgtatcatggccctatgcttatgaagaacgtaatagagtgtttttcataattcaaccaacagctgtacttcctcagttaagctcaaaacagagccaactttgctcctaatgttagtctactgtgtttgtactttcaccttagtacttgtaacatattaccacacatattttcttaccactctgtgtgttctttgaacacaggaagatttttattaatc

SEQ ID NO: 5835 - DNA, 2022 bp, Homo sapiens
aagcacatttttaattgtatttggaaaattcatcacttcactgttagcaattggtagaattactagccatgaggtcaggaattcaagagtagcctggataacatggtgaaaccctgtctctactaaaaatacaaaaattagccaggcatggtggcgcatgcctgtagtcccagctacttaagaagctgaggtaggagaatcgcttgaactgggaggcgaaggttgcagtgagccaagattgtgttacaaagcttgggttacagaataagactctgtctcaaaaaagaaaagaaaaaaaaagagtagtgcccaacaacagcaaaataaaatttttttctcaagtgtccatggaatattcagaaagatagaccatattctgggccataaataagccttggcagatttaaaagaattgaaatcattctgagtatgtatgttttctggccataatgaaaccaaactacaaatcagtaatagagtgacaataggaaaatatctaatcatttagaaattaaacatcagacttctaaataaagtctggagtgaagaaggggcctcaaattcaatagtagaaatgcatagacttaatgaaaatgagaccataccgtatcaatatatgtgggaggtagctaaagcagtgctgatagagaaatttatggcactaaatgctgacagtagacaagacgataggttgcaaacccataattgactttctaccttaagaaactagaaaagagcaaaataaaacctctgttaagtagaaggacgaaaataacactggaagcagaaatcagtaaaattgaaaataggaaaaagtagagaaaactaatgaaacatagggttctttgggaaaaaatcaataaaattgataaacgtctagcaatattgatttaaaatatagaatgagatgacaaatcatcaatatctggaatgaaacagggaatatcactccaccatccatttaacagtataataagggaatcttgtcaacaactttatgtttataaatatgacaacataggccaggtgtggtggctcatgcctgttattccaacactttgggaggccaaggtgggtgtatcacctgaggtcaagagttcgtgaccaccctggccaacatggtgaaactccgtctctactaaaaatacaaaaattagtctggtgtggtggtgcacgcctgtagtcccagctactcaggaggctgaggtaggagaatggcttgaacccagggagtgggaggtttcagtgagctgatactgctccattgtactctagcctgggcaacagagcaaaactctgtctcaaaaaaaaaaaaaaaaaaaaatgacaacatggaagaaatgtaccagttcttcagaaaccacaaactattacaactcagtcagggtgatatagataatttgaatgacccataggttttcataaaggttgacataatttgaatcaaataatttaaattttaaaaacctccaaaaaaccaatttccaagtacaagagagttgtagtcctcactagagaattctaccaaacatttacacaagaattaatgatgattttacacaatgtcctcagaaaatagaagtgggaatatttattttatttatttaattagatggagtcttgctcagtcacccaggctggagtgcagtggtgtaatctcggctcaccgcaacctctgcctcccgggttcagatgattctcctgcgtcagcctcccaagtagctgggactgcaggcacatgccaccacactcggctaatttctgtatttttagtagagacggggtttcaccatattggccaggctgttctccaactcctgacctcatgatctgtccacgttggtctcccaaagtgctgggattacaggtgtgagccaccgcacccggccaagagggaacatttcttaacacatttaaaaaattattttgatgccaaaatcatacagacagtacaaaaataatacaactacagacatatacctctcataaatttagtagcaaaaatctttaacaaaatactag

SEQ ID NO: 5836 - DNA, 1086 bp, Homo sapiens
gccagctgtggttcaaaaatattaaataggaaacttcagaaataaataattcctcagttttaagttgcacactgttgtgagtagcatgatgaaattttgcactgtcctgtcccaggacatgaatcaaccctatgtctagcatacccaggctgtatatgctacccatgagttaattacttagtaactgtcttgattatttattgtcacaatatgtgttcaggtaacccttattttacttaataatggccctgaagtgccagagtagtgatgatagcatattgttataacttttctattttatgatcttgttaatctttccctgtccctaatttataaattaaactttatcataggtttgtatatttaggaaaaaacatagtatttatagggctcaatactatctgaggtttcaggcttccgctgggtgtcttggaatgtacttcccttggataaggagtgactactgtatgtatatattaatagctataataatcaagaggacaggatgttggtagaatatacacattggtagaacatacatatagaatgatggaaaagaatggaaaacctcaacattgattatgctgttatatagactatatgttcatgtctccccagaattcatatgttggagccctcaccccaagtgtggtggtgtttggagatatgcagcccttggcaggtaattagggttagattaagtcatgagagtggggccctcaagatgaggttagtgccttacaggaagaggaagtgagagcttgctcactcaccatgtgcatagaggaaaggcgatgtgaatatgcagtggccttctgcaagctaggaagaggccctcaccaggccctggccatgctggcgtcctgatctcagacttccagcatttggaaccgtgaggaaataaacttctgttgtttaagccacacagtctgtggtattttgttatggcagccgaagctaagacatttgacaaactgttgacaaaaatgcaaaagaaattcagccaggtattcagcaaatgatgctggagcattttaacgtatcttgttttgtgtgtggtaaaatatatgtatcatgaaatttgcc

SEQ ID NO: 5837 - DNA, 1033 bp, Homo sapiens
ttcataccattctttgtaattatttttatttctgtaagagtactagtaatacatctttaatccctacttttagtaatttgaaccttctctctcttttttttctttttcaatgtcagtctagctagaggtttgtatattttgttgatcttttccaggaatcagctattgtttttctgttctctagttcattaatttttactctataatctttctgctttcctgccttctgcttgatttggttttgtattgctgctcctgtccaagtgttttaaggtggaaaattagtttactgatttgagatctttttaaatatggttattacagctacaaatctctaaggattgctttatctgtgttccataagtttgagtatgtcttcatttttatctcaaagcattttttctaattttccttcttattgcttctttaacttttttttttaacttcggaatatgttatataatttgtgcatgtttgtgcattctaaaaattcctttgtcttactgatttgtaatttcgactgtggtcagagaatcattttaaatttattctggggaatgtttcatgtgtacttttgaagcatacctgctccactgttcgagtggaatgttctgtctatatctcttagatctggttgctttagagtgtcatctatatcttctgtttccatgtttatattgtgcccagttgtcctaaccattattgaaaatggggtattacagtttgcaataagtattgtagacttgtatatttttttcttttaattctgtcagtttttgctacacatactttgaggctctgttagtagtacataggcttagaattgttatgtctcctttattgattgacccttttattgttatattaataaaattcccctctttatccttagtaaaatttttgtattaaagtgtattttgtgtgatattaggatagctactccagccttataggtgccatgtgccggatatatctttttctgtcttcaaattttcaacctgtttgtatctatctcttatagacagcacatgtt

SEQ ID NO: 5838 - DNA, 1028 bp, Homo sapiens
gttttgttgttaacatgacttatagattcaaaataatataattccatgtagtaattagcaggatttcttgtagtaattgagtacgtaattctaaactttatgtggaagtagacaggaaacttgtctactttagttactctacttctagagtaactaaaactttgaaaaataaaagctgagttgtatggataggattacctgatttcaagactcaaagtaaaagtttgctgagacttggtctttttgtccagagtactttttcttcaattttcacatctagtagttttattaagctatgttttggagaaaactgttgctgaacatttttcccaggttcatgatggttcctttgaatatgtggatcaggtcttttatttttggacagttttcttagattatactttttaatattagatttattctgttgttttttcttctttaaggactgcaataacatatatactatattataattttatttatttatttaattgtagaccatctttatccagaactttctttctgatccaattttcttttttcttactcttttaaaattattgcttcttctttttcttgtttcattctcctttgcaatgctgtttattcaagtttcagtcaagtgtagtttcccctttggctctgtattagttgactcaggctgctgtaacaaaattcaacagactgggtagcttaaataaattttctcacaattgtggaggctggaagtctaaagtcaaggtgccagcagggttggtttctggttaggtctcactccttggcttgcagatggcattttcttctggtgtcctcacacagccttttctctgtgcatatgaccagtggttgggggtggtgggttgggggagaaagagagctcatgcatgtgctttccagtatcctcttcttcttataaggacaccaatgccattgtatttgtgtcttacccttatgacctcatttaaccttagttaatctccttaaagtccccatcttcaaatacagtcacactggaggttggggtttta

SEQ ID NO: 5839 - DNA, 1028 bp, Homo sapiens
ggccctggaaaggcccacacatacagcccagggctgcccagggctgttggactgtcatttcaaggctcattgtccccagacagggatctgggccctcagacttttgagaatatgaagaggagggttgaggctggagcagaaccagaatcaagctggtgtggggcttttattgatagtgtgaagattgtacactatattacatgatcagatcatacaaataatctaagattatacagtctagtgatcctagattacacaagtaatctaagcttccactttaggaaactagaaaaagaagagcaaattaaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccatcacagctaatcctatggtcaccaaaaggattagaaagaaacatggacaactctgtccataaatttgataacttagctaaaatggaccaattccttgcaagacgcattctctcaaagctcacacaagatagacctcaataggcatatgtatctattaaataaaccaaagcagtaattaataaccttccaaggccaggtacagtggttcatgcctgtaatcccagcacttcactttgggaggctgaggcgggtggatcacaaggtcaggagttcgagaccagcctggtcaacatggtgaaaccccctatctactaaaaatacaaaaaattagctgggcatggtggcatgcgtgtgtagtcgaagctactcaggaggctgaggcagaagaatcacttgaacctgggaggtggatgttgcagtgagctgagattgtgccactgtactgcagcctgggtgacagaatgagactgcatctcaaaaaataataatgaaactttccaaaacaaagtgccaggaccagctgggttcactgatgtgtttttgagata

SEQ ID NO: 5840 - DNA, 1047 bp, Homo sapiens
gttggattttctcttccctgaggtgaaggatgcccggaggcctccgcaggacggcgcagaaacgggccttctgcccaatagatgcgcgcttctctcattctttcccctcagaatctcgctgtcctcacaaccacctgtggtcggcgtcgccgcggtgtcactgcgatgccgaggcgaatggggtggggggaagcgcccgcggggcggggagggaccctgcaggcgcggactccacacccagcctctggccagcgtcactcggcttgctgtgtcctcgcaggtcgcagcttcattgcctgatgtcttcgggaagtattttgaagtcatcgtggctgtggattggggaatttcttgtttccactgacctgtgaggccgcgcacgcggagggaggcaccccaggccctccggcactgtccagcctcgcctgtgtccccattagcaccagtgggcattttcagagggtccagctcatggctcaagtgacaggaagatgtaggagctttctgtcttgaatgaggattcgaaccaaagggcttaggcccagctgtcttggagcaaagcagctgttgtggggtaagaagggaagggtggggggcgagggcccaggggccctcctaggaggacacccaacccgttgggctgacacctcactagagatctagagcacgggtgggaggagcagaggctcgatttgtgtcctttccagacccccacaggctgggagctttgtgcccattcagatgtgggggcagaagagggcaaggccgaaggagcagacagcaccgcttcttggggagttgtgaaggcatcatgcggagggaagagcttagcagccaagtggaggacagcaccctccatgcctggattcgttactcgctcgttctagatgctgagctgctggcgcactgcagcacaactagagatgtacggatgcccccatcttgatcttacagaatcagaggtacagccgcgagaaaggtctgtaagttatctatttacgctttatttaaaagatgggatggggtggggtggacaggaaacgagct

SEQ ID NO: 5841 - DNA, 1050 bp, Homo sapiens
cctaatgtagaatttttgttatttttttttcttttggtactttaaaggtgccattatcttactgcctctggccttcatggtttctaatgaaagactggctgttaatcttatttcagatcctttgtacatggttagtcccttgtctcttgctactttcaagactctttgtcttctgacaatttattatttctctcagtttgaagttctttgatgttatcataattatagtttctttagagtcttggacatagagattcatgtctttcatcaatttggaaggtcttcagacattgtttcttcagatattttttggttcccttttctcctcttcgttagtaactcttgttattaacttgtgggtatgtttgatgttgtctcttggatctcttaggcactgtctatttttcaccattctttttctctgctccacagaatgagtaatccccatcagtgtcttcaattttgctgattctttgttctctttgagctccaatctgtcactgattttcactgattttaaaaaattttagttgttgtacttgtcagctccagacagtcctaattacatttttataattttctactctacattaatattttatatttggcacagcatcattctcctggtttctgttagttctttgtctgctttcatttagctctttgagcacatttagaacagatgatttaaattctttatctagtaagaccagtatcaaaggtgtctttgagtacaggttttatttcttttttctgtgtgtctgtgggtcatattatcttctttgcatgcctcataattttttattgaaaactgaacattttgaatattaaaatgtgctaattctagaaatcagattcttttcctcagaatttgttgttgctgtttattttgtattatttgcttattttgtgacttttataaactatttttgtaaagtcagtgttctttgttgtacatggtcactgaaacctctgttctattagtttagtggtcgtctgtgatttgacagagatttctttaaatgcctagagccaaaacaaaacaaaaaa

SEQ ID NO: 5842 - DNA, 1083 bp, Homo sapiens
aaacttggcgtataatcttatagcagttcccttgtttgttttgaatcacatttcaacccaaaggattccctttagcattccttgcagagtagatctagtaaaaacatactcccttagctggtgttcatctgggaatgtcctcattattgacaggcatgtttgccaggcgtagaattctcagctacagctttttctttcagcactttgaatatatcagtccagtgccttctaacctccaaggtttctgctgatgatcttttttttttttttgagacggagtctcactttgccacccaggctagagtgcagtggcgcgatctcggcccactgcaagctccgcctcccgggtttttgcagtctctattttaatttctagtcatgtgtggtcactgaattctctctctttagcttgtgttcaggtactgttttaacaggcatttttcctggaaggccaggattcaaacaacaaccaccaaaaaaaaaaaaactaaaaaaaaacccaacaaaacccctttcctattatttgcaaattggctctgtcctggggcactttttaagcacttagcctggtccatttagaacttcatcttagtcttcactgcttgcttgcactgagcacagagattagccagaagtaaaaccttcgggtcttttgaggtctttgccaagcttctcctgtcctaggtatgtgcttggctttctgaattccctaacccatgtatgcctagtgttccattagtggaatgctaagcatgtgggagttatttatatcctactgctcagggtcatttcaaggtctgattgcaaaaattaaaaaaaatttgtgcaacctcagacataaacgggctataatgtacacagtgctcttgattgccctcatttccctccaaaaaagtctctccttagcttttttttttttctttcggaattcattttagaatggtatttatctcctggatttatctatattttacaagctattcttttattatctatttttccagtttttattttgttataatttgtgcaattttatatatttagatttgtacaattctgtattttacatccattttcttttct

SEQ ID NO: 5843 - DNA, 1065 bp, Homo sapiens
agtggcagcatctggaccctgctcagaggaccctgtacagggatgtgatgctggagaactacagccaccttgtctcagtaggtaggtaggaattgtttcccatgtagaaggccagaatgcatgtcctttcttatcaatagaaacttgtggaacttttgtaaaatataataatatttaggtttgagattcagaggtcaaggacaatttatcccttttggataccagaaagaatgttttcctctgcccccatgacaggattaaatgaagtgtgtgtgtgtgtgtgtgtgtgtgtgtgtgtgtgtgtgtgtgtgtgtgtactgtttggggtatactgtcttcctccttcaggaaaacccacccagtttgtcccaagtaatacaattctcattcacagggtattgcattcctaaaccagaagtgattctcaagttggagaaaggcgaggagccatggatattagaggaaaaatttccaagccagagtcatctgggtgagttagtatgtgccagatggaatttaaaggaaggtagatcacaaagggtaagtttggataataagaccattgaaatgttctttaggaatcatgttttagaggctccagacctttggaagtaacatgttgacgtgacccaaatatgcagtgactctgaatcacccagcatctcccagtatcactttcatacacacatcttgttgttttttttaaattgtgatataaactatatagtttagccagagattaataaaattttatatatatatgtaacactcatgtacccatcattgagatgaatatataaagtgatttttcaacacccccagaaagctccctgttgtactcttcccagtaaagagcatccctccttttgtaaaattaaatatatttttctatacatgcttttttgagttgctcattcattagctttttaccatatttaccattttttacagaattgttttaaaatagcctgggcccagtggttcatgcctgtaatcctaggtctttgggaggctgaggtgggaggatcacttcagcccaggaatttgagaccagcctgggcaaaa

SEQ ID NO: 5844 - DNA, 1835 bp, Homo sapiens
tggtcccatgcctggctaatttttgtgatctcagctactggggagctgaggtgacagtcttgctttagcctgggaagaggctgcagttaactgtgtttgtgccattgcactgcagcctgggtgacagagcaagattctgtctctaaaaaataaaaagcaattaaaattaaaattacacattcaaccagtaacgatttcagcgtgaagcctgaaaaaatttgtgtttgaaaaagctctccggataatactgataaacattatttgttaagtaccattgatttaaatatctatatagggcactgagagaaaatcataggtaaagtaatggctgccaggaacatagttgttgaacaaaaacagaactgcatgaaatattttaaaattcagtgtttaacaaagaatattgttatagcaatccagctgatgtttgtgcttaaatgaattataaaaacagtcctttcatgttttttagtaaatgaacctgggaaatttgggaaggaaactttttaaaaacactgttagactgcaaactgacaatggaaaaacaatcagtatgagattatgatgggaatgagcaatttatgagggacaaacagctgaacttacctagagcgaaatatattcactctagacttgtaaaagaatggcttggttctaatctgaatctaaatgtaaagatatgtttacttcagtgataccttgtttaaaaaaaaagtgtttgttcttgggacattggactcagtatagtataggacagttgatgaaataaagggcaaatcccacagctggaatagaaccataaacctgatcctgtggcaaggatggcttgttcactcactgatttcactcttattgttgcatacttttatttctagtgaatcagagctagaaaaacaattgagccaggtgcagtggctcatgcctgtaatcccagcactttggaaggccagtgtggatgaattgtttgaggctaggagttcaagaccagcctggctaacatggcaaaatcctgtctctactaaaaacataaaaactagccaagcatggttgcgtatgcctgtagtcccagctacttgggaggttgaggcatgggaatcacttgaacccaggaagcggagattgcagtgagccgagatcacgtcactacactccagcctggatgacagagcaagactctgtctcaaaaacaccaccaccaccaccaccaacaacaaccaagaacaacaaaaccacacagaattggagcctggattataggactatgaattagaacttttagaaatttaatttgttgctgctgtgttgacttgaaaagaggtataagactggaagtgtgcacattgtcataacataggtatgaggagataatggcctaaactgagccatgccttcaaatataatgctaagtttatttctcttacatatcctcgtcaactaacctttcttttcactctgtatttcagaattaattaataccagtagaaactattcaataatgaagttcaatgagtttaacaaaggtggaaaatgtttctgtgatgaaaagcatgaaataattcattctgaagaggaaccttctgaatataataaaaatgggaacagcttctggctgaatgaagacctcatttggcatcagaaaattaaaaattgggaacaatcttttgaatacaatgaatgtgggaaagctttccctgagaattcactcttccttgtacataagagaggttacacaggacagaaaacctgcaaatatactgaacatgggaaaacctgtgatatgtcatttttcatcactcatcagcaaacacatccaagagaaaaccactatggtaatg

SEQ ID NO: 5845 - DNA, 1047 bp, Homo sapiens
caccttccaccaagacccacctttaacgctgagcattacctctcaaagtgagatttgggcagggactaatatccaaactgtatcaacatctgacaaggtgttcacaaccagaatatataaggagctataacaattctatagaaaaaaaaatctgatttaaaactgggcaaaaatctgaatagacgtttctcaaaagaagacatacaaatggcaaacaggcatatgaaaaggtactcaacatcattgatccattagagaaatgcaaatcaaaactacaataagatatcatctcaccccagttaaaatgtcttctctccaaaagacagataataacaaatgctgaagaggatgtggagaaaagggaaacctcgtgcactgtggaaatgttattagtacaaccactatggacaacaatttggaggtacctcaaaaactaaaaatagagctatcatacaatcccacaattccactggtagttatataccccaaagacaggaaatcagtatattgaagatatatctgcaccgtgtttactgtagcactactcacaatagccaagatttggaagcaacctaagtgtctaacagcagatgaatggataaataaaatatggtacataaacacaatggagtactattcagccataaaaaagaatgagatcctgtcatttgcaacattgtagatggaactagagatcattaagtgaaataagccaggcacagcaagacagacatcatgttctgacgtatttgttggagctaaagatgaaaacaactgaacttatagagggtagaaggatgtttaccagaggcgggaaaggcagtgagggcatggtgagggggaagtggggaatgttaacgggcacaaaatgtagaatgactaagacctagtatttgatagcacaaggttactacagtcaataataattgtgcattttaaaggtataattgaattgtaacacaaaggataaatgcttgaggttatggataccccatttaccctgatgtgattattagacattgcatgcctatatcaaaatatatcatg

SEQ ID NO: 5846 - DNA, 1035 bp, Homo sapiens
tttttaggtgctattgtaaatggagtcacttcctaattttctttttggatttttcgtcaatggtatagcaaacaaaattgctcatcttgtacccataatcttgctgaatttgtttattagctctggtggttttctttggattctttggaatattctacatataggttcatgtcatctgcaaatagagatatttttacctctttctttctattttggatgtttttatttttcctatctaatagctctggctagaacctcctgttaaatagcagcataaaaaggagtatccttgccttgttcttagtgggaaatctttttagtttttcaccactgattatggtgttagccatgggtctttcataaatacccttggtcatgtagaggaattattcctttattcctagttttctgaaagtctatcatgaaatagtgttggaatttttcaaatgccttttctgtatcaactgaaacgatcatgtataggtttttccccctttcttctattaataatatgtattgcattagttgatatatttgtattgaaccacccttgcattgctgggataaatgctattcactcataatgaataattcttttaacggactattgaattcaatttactagtattttgtttaaaatttttgcatctataattgtaagaattttgagtttcagtacaatatttaataaataaagtaagatagtcaacactttattataaaataggctttgtggtagatgatcttgccctgctgtaggttaatgtaagtgttctgaccatgtttatatgggccagataagccatgatgttttgtagatcaggtatatcaaactcattttcaacttgtattttcaactttctttatggagatgtaaccccatggtaactcaatgtgcatctgtagttggtttactgtattgttcaagtcttttttttttttaacttttcatctatatgattgatctatttgtgactttaagtagagcactgaagtcaccagctattatcatagaattgtttatttctcccttcc

SEQ ID NO: 5847 - DNA, 1118 bp, Homo sapiens
ttcgctcttgttgcccaggctggagtacagtggcacaatctcagcgcaccacatcagcctcccaaagtgctgggattacaggtgtgaccaccatgcccaacccacaacaggcgttttaatagtttatgaggccattgataaacagctagattggacttagggataaattaattaagccctcatattttattggtgaaaagacagatcccgagagacaatgacaaagatacttgatttctactgttgggttgatcctggaacaatctgggcctgaactgtgcaggtctactttcaggggatttttaaaaataaatgcagtagatccatataggcagtttccacatttgaaaccaaatgtggcaagaaaatacagtattggccaggttccaggcctacatgcacagagggtcaacttttcctacccacaggctccacaaggctgacttcaggacctgggcctgcatggatttgtgccgagaccagctcggtcgtggagactccaaccgagcggcactagaggaatgaagacaaagacaaagacacagaaataaagtgcaaagtgggaatcggggataacagccttcagagatgagagccacaaacagagtttgacccacatgtttattgacagcaagccagtgataagcattgtttctataggttatagattagctaaaagcattccttacgggaaacaaagcatttttagcgaggagcagagaaacagtctctggctgattatctgcagcaaaaacatgttgttaaggcacaggctgctcatgctatttgtggtttgagcagttttccgctctgggaaggccaggtgttccttgccctgctccagtaaaccaacaacttcttgcagtgtgtgtcatagccatcacgagcatgtcacattgctgcagaaatcctctttatggccagtttctttaaggcctgtttatgacaggcttagggcctgttcccagcaaatttgggtgtccaaagtgggtcctggaactaatcctctggataccaagggacgactgtgtttaaaccatcgtttgggtttggagagattaatgacaacagtggctaagcatgggaagggtttctatggtgggactgcattggaccac

SEQ ID NO: 5848 - DNA, 1055 bp, Homo sapiens
attcagattgtagcccacccctcagcagtccctatccgcttttcttcattttgttccataacttttgacaccttccaacattctacagttgtgctttttttttttttttttttttgagagagagtctagctctgtcgcccaggccagagagcagtggcatgatcttggctcactgcaagctccgcctcctgggttcacaccattctcctgcctcagcctcccgagtaaatgggactacaggtgcatgctacgacacctggctagtttttttgtatttttagtagcgacggggtttcaccatgttagccaggatgatctcaatctcctgacctcgtgatccgcccgccttggtctcccaaagtgctgggattacaggcgtgagccaccgcacatgcccggttttgctaatttctttagtgaactatttgctcttctgcacaaaattgtaagttccacggggatagaattttttttatggctttattctttgcgttatgtccagtgcctagaaaagtacctggtaagtgttgtgaagtatttcctgaatagaggttgaatgttgtgataagtttcactgtgactcctcatcttgtacctgcacttgcaagtttcttcttgtctgcctggggcgttgcgctcagcaccttcagcccccaccactcaaggttcctgtctgcatgagtgtaatcaccatcgagtgtcaacagcaccatccctttccccactctcattcagaagctcctcatctgctctgggatgggacaaactcactcttgtgtcatcattctgccaagtttattaaaactcaaaatgtgagtgtctgctcttttctttctctttgtccttttgttaaaacttcccctttgaaagaggagatgccaaggtttagactaaatgggagagaaatagtgggcaactggagaacaagggaggaaaaccacattggttaatctatcaaatcattacatttctatatgattaagcataaaataaaatgtctttgaagaagttatgcagtccaaggggtctctaactaatgagcaggtcctgaagga

SEQ ID NO: 5849 - DNA, 1034 bp, Homo sapiens
aaataaatgagatgataaatttttataaatgatcacatcttttttcttctctccctctatagatttacctttggagtccaacccttctgaccatccagaggcaagcacaatattcctgagaaaatctcaaatagatggtgagacaacattgttttttctgccaagaaaaaaaataaaagtcttgttctttgatcagctgtattatagaaagtatttagaaactcatattggtttaattttttcaacttttcacatatttacttgtcttattttaatatgtgatatactttttttaagttgttactgtgttagtgaaatcatgtaaactttttgtttatacattttgccatctttttatcaatgcaatttgtcatgtgatggaggagtcatagatttatctttatttataattctttgccccttttcccttgctccaaagagtacattttaaagatagaacttaggcttcagcttggtttccagttaaacaaataaaagaaaacatagttgttcatcagcagagattgaatctgtgattttggactcctcttgcacagtcccctgatcacatgtgtttatcacatccaagtttatgcttcttgaaacttttaagttattaaccttttcatctaatgtagtataaatttaaacatgccccactcttgcttattttccttaatgttatgttaaatcctcacttgtttgctaaaaagccatacacagccaagttttccagttgatttaagcagcaagaatacaagtgaggatctataataatatgggaagtaatgcagcacagtaaaatatgggagtttgtaacctttctttttgtagtttgagtagactttgcctgtcttgagtcaggtatttctggttagaatttgtgttcagttttgcattactataaagaggtacctaaggctgggtaatttacaacaaaaagaaatttaattggctcataaatcttcaggctgtacaagcatggcttcaacatctgcttctggtgagagcttcagcaaacttacaatcatgat

SEQ ID NO: 5850 - DNA, 1088 bp, Homo sapiens
ttcctacattgatgtgaagcatttttaaagacactttagagattagtcctttattggttcatttctattgtaggttgttgtttcctactctggtctttgttgtttaatttcagttttaatttcttgcttggtttagttcatgtaacaatatttttcttagaatatttgtatctgtgtttgtgaaacagaacatctattatttctgggttttttattgtctgatcagattgtgtattaatgtaatgctggcttctcgaaacaaattgaaaaaccatccctttcgtctttctctttgagagagagtgagcagtgtcaatatttttttcttccttaaatatttggaacattttcaaagtctgatcctggtgttttccttgtggagcattattgttgatttgttggatttttaaaattagttagttaattttgtttaatatatataggagtgttcttattttatgctatttttgtgccagttttagtaagttgggttcagcatctgttgcgatctctgttgtcagacttttgatcatatgtatttcacaaaattctctgattatcttgttataatactgttatgtagagttgttgttttgattctgatactggtcacttgtgttctttcatcttttttccttaatcagttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgagggtgagtccgggagtctggggtgccggcagcggaggaaggacaagcaggagtctcggcctcccggggagaatttcacaaaattctctgattatcttgttataatactgttacgtaggctgttgttttgattctgatactggtctcttgtgttctttaatcttttttccttaatcagttttgctagtggtttattaactatgttgtttataaaaacaacttttagccttggtttatttgtgttatgtttttttttccatttcat

SEQ ID NO: 5851 - DNA, 1023 bp, Homo sapiens
agagaaacaggtatttatcaatcttcttgattctggtgctcatcacaaggctgcaagttactcagttccaccgtcttttgcatctgtggttgtggttgaaaggaatggcctgaatcatgcacctcataactcacagagtggccccatgccttccagttttctttttttttcactgaggttctgaattacccatgtagtttaaggagttttgttgttcttcacaattctgtctgtggctaatcttatgtccatgggattcatttgagtctggaacatgtcccagatggcaagatgcagcatgccatgatattttcaaaatccatgaacatggttgtttggcagttccacagtaaatatgtatttggagccttaagctatttctttcatgatatatgctcaggtactgatagcgacactgttgaattctacttgagccctgaggcactgggaaactgtgatggttaaagaaatccccaccttgtgttcctgccttaccgcaaagaattccccttccccgttgacttagctaagactcacggatccccctcaaaggatgtcccacctatgacaaggtcagacacagacccccccaaatgctgtccttgtttcatgaaagtttagctgaactgcttgtccccacagattcatcaggatataatgctaattaactcagctttgatatgggctttaccatgtccttcaggacctgcttattagttagagaccccttggactgcataacttcttcaaagacattttattttatgcttaatcatatagaaatataatgatttgatagattaaccaatgtggttttcctcccttgttctccagtttcccactatttctctcccatttagtctaaaccttggcatctcctctttcaaaggggaagttttaacaaaaggacaaagagaaagaaaagagtagacactcacattttgaattttaataaacttggaagaatgatgacacaagagtgagtttgtcccatcccagagcagatgaggagcttctgaatga

SEQ ID NO: 5852 - DNA, 1071 bp, Homo sapiens
tactttaatcattatgggattgattgctgtcacagctactgccacggtagctggagttgctttaccaacacagtacaaacagcagattatgtaaataattggcagaaaaattctactttgctgtggaattcccaaactaatatacaccagaaattaaccaatcagattaatgatctccgacaaactatcgtatggttgggagatcatgtagttagtttaaaatatagaatgcagttaacaatgtgattgaaatacttctgatttttgcattactcctcacctgtataatgaaacagagcatgagtgggaaagagttaagagacatttaaaggatcatactggaaatttatctttggatattgcaaaactgaaggaacacatatttcaagcctctcaggcacatctgacattaatgacaggaactaaagtgcttgaaggagctgcagatggattagcagctattcacccatacaagtggatcaagacacttggagactttgtgatttcaatgatgattgtgcctttaatctgtattgtttgtctttgtgtagtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctgtttgtggctctcagctctcaaggctgttttccccctgattcccactttgcactttattt

SEQ ID NO: 5853 - DNA, 1044 bp, Homo sapiens
tagctataagtgtaccaaaaaagtctacttataaggttgataccttttactctattttgaaaatgagtttactatttatttatttgtttattttttaatgaataggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaggagatgccaccacagacacagagttggcgtggctgttgtcatctgagggacatgcatgcgtttgttgttttcttgagtggaacatgttaaatattgtcatatcatgggacttctcttatacttagtattactaagttggctatagcttcagaaaagggtaagttcccagagataaggatgtgataatgttcacatttcctcccagcactctgggaggttccaaggcaggaagatactcgaacccagcactcgggctggaaaatcaagctttgctgctcgattgcgacaccagccacagtcctcttcctccgtgtagaaggatgtgtggtccagcctcttaaggtgatgctttccttttcttcctggtttcctcctccattttttgtatgagaaatgataatgttcactatgtcttatcctgactgctctttggctttgccaaacatgttccttggaagggcctagcaggcctagtcaccgtgaacacatcatttaacagatagcacgcacctcctatgtgccaggtgcatatgcttgccttatgaagccacattctggtggaagtgcgagttttctctttttcctgtgagaattgtctgctttgggagatggtgacctttccgagtttgagggaaaatgaaacaaacttccagtggtagaatggcaatgtacactctgaaatctcttgttattgcaataatatagttggattgaggcttttctttatctttggagcatccatat

SEQ ID NO: 5854 - DNA, 1054 bp, Homo sapiens
agtagctggtattacaggcgcccaccactaggcccagctaatttttttgcatttttagtagagatggggtttcaccacgttggtcaggctggtctcgaactcctgacctcctgagccacgtgcctcggcctcccaaagtgctgggattacaggtgtgagccactgcacccagcccatgcttgattttttaatcagtttgtggagtgattctccaaaggatacttgtttgtaagtttcactgtgatgtcatggatataaatgtagttgatgtgccttgtgctcctgcacctgttatcccttattgaagctcctctttatcccacctgtggcctgtaagagtctgtgcacaccagctcctgagtccttatgttacaatcatagtcattctttatcaattcttgctctatgatatgagagagcgcttggaatcacccataagaaatcctgatttcttttagtaggaaatggtatttcaacgtgacagcctaggcataggaatgctactgccatgagttggtcattacttctaggccttctcagtgacctgaaccaggagagctcatatagatatttccagttcacatacaggactacatcttactcattcttccactggagaattattccttggttgaatcagcagatgatgaaattagagaatcacataattactcatttgctttatcccatattacacacaaaatagtgtcagaataatatgactactgaaaacagttaaagatttttttcccttatatactgtctcatttctcttttcaaaagtgactgtgccattttacttacccactggcactgtaggtgggttccagtttcaccagttcttcaccagcacttgctattatctgtctttgtgattatagccatcctagagggggtgaagttgtatctcattgtagcattgacttgcattccctgatagataatgatgttgaacatcttttcatgtgcttattggctatttgtacatattcttcatattgtttgcccatttcaaaaattggattacttagttgtatgcgttgtttatatattc

SEQ ID NO: 5855 - DNA, 1075 bp, Homo sapiens
ttattgctaaggccaacgtcaagaggctttctccctatgttttcttctaggagttttatggtttcaggtcttatttgggtcttgggtcttgtatctattttgagttgatttttgtgtatggtgtatgatcagggtccaattttattcttttgcatgtgaaaatccagttttcccagcactattattgaagagactgtcttttttaccattgtgttgtcttgtttgcccttatcaaaaattagttgacagtatatgtttggatttatttcaaaggtctctgttctgttccattggtctatttttttgtttttatgccagcaccatactgttttgattactatagctttgtaatacaattttaaatcaagaggtgcgatgcctccaactttttctttcacagtaatctcttggctgtttggggttttttgtggttccatatgagtttcaggattgttttttcttttattttctttttttttgaggcaaagtctcactctgtcgcccaagctgtagtgcagtggcataatctcggctcactgaaacctctgcctcctggattcaagcaattctcctgcctcagcctcccaagtagctgggactacaggcacgtgccactatgcccagccaatttttgtggttttagtagagacagggtttcactatgtttgctgggctggtctccaactcctgaccttgtgatctgcccgctgtggtctctcaaagtgctggaattacaggcatgagccactgcgcctggccaggattgttttattctgttctgtgaagaatgccaacagaactttgatgaggattgtgttaaatctgtatatttgctttgggtagcgtgaacattttaacaatattaattcttctgatccataaacataggatgtctttccatttgttcatgtctaaatttctttcatcaatgttttatggttttcaagtgtacacatctctcaccttcttggttaagtttattcctaagtttttgtttttctttgctgctattgtaaattagattattttcttgatttgtcacctaggttatttgcatacagaaatgcaactgatt

SEQ ID NO: 5856 - DNA, 1033 bp, Homo sapiens
ttagtgcttaggatgcgagtgtgtggtgtctgagagcattctgatactcaccggcttttgtccttgtcagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacaagtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttacttttggcttagtagttttcattagggatgaatgcctgacaattctttgtggataattatttatactaccaccttcatgaggagtcttccagaagagaaagaaatattcacttgaactctgagctcccatggaagattttagagaatagtgtgtagtgtttttgttttgttttttgtttgagtgacacacaaacctagatggtacagcctactgtgcacccaggatctatgggctcctttgatcactggcccttgtggacattttctatcttatttcatatgttctgcacattagtatagtgacaaggtaacagtaagtacttttttaaagctttagacttaggagattattgtctcaggtgcagagaccaaggaaatcgtatgtatcagtgagataggcttcccgtattatgctcatgcgttata

SEQ ID NO: 5857 - DNA, 1038 bp, Homo sapiens
tcatttcgtttactaaaataataaatgactaaggagagttaagaccattatttgtggtatattggccataagaagttttcttctgtcctatgttttatacagacatgttaccaaaaaaaaaaaaatacgcattgcagcatttgccacagaaagcatccaggtttttctactcattaaaaaagtggctaggactgataacctgtagtgatcttccaggttttgctgcagtgagaaaaccattactgttaaaaacctgctgtcatatcacattatccttctcaacaagcactttgttacaatggaagttctctttgcagtggagtcctccttgcctcccttgtcctaagttaaacctctatttttagagttaagaatcattaaagacatggaagagttcgcacaactggttgtggcatgaacgatagcatgtaattttataaatgtataaatggtttttgaatttttttctctgctgataaggatgattaaattcttcatgttttttctttatatagactccaaacctttctagacttgtaggaaatctgttgatgcataatacagtggaaagaattatgtgatctaatgtgcaaataatctactggaggacattggatataaaaatgttttcttaatgtgtttttcagatgtctgtgagcttttgaagttgttctttcccccacttaattttaagtctcctagattggctgagctgagcagtagaaattaatgaggtagaatgcttgagttgaataaactgggagaaaatctctctctccagtaaaccgttattactgtaacagaaacagtttctataaactcagttcccaaatggtcataagctttagttgggaaatggtgcggtaattgaaatactatgttaataaagagttataggcaatataattttcaaataattagagaacagtagaatatatgtaatacagactatgctgacgtaattttaatgtttctttgattcaagttatagctgtgtagacataatagttaaaagtattatacatagtttattgtttt

SEQ ID NO: 5858 - DNA, 1027 bp, Homo sapiens
tagacaaatgctagtattgtattgtagacaaatgttagtaatataagtcagtcattatccacagtattaaaacactgaaagtttttgcacttcattgcaccaagaattttaagtggccttctggaaaaaggtatgagatcataataaaaatggagaataaggactagggaaatagaataaaacagctcttgttgcatgtgtatgatttatattcctcacttacctgatcttggtgttcttttttatgtttttaaaaaatgtgtaaactaaaactcaaaacttgaaaaccatttgataaaggaaagaaaaaattagtagactcttagctatttttcgtattggaggaaggagaagctcatgtctgaacaaggggttatacatagtttaaaaagcacatttggcatttggaaaagtaaggaaatacctgttttcctaatacatatttcagaaagggtatggaatttttatgtatcaagatgggatgtgactcagaggttgaagaacactgctataaaatttaagatattgattgatattaacagtaataattctagatccctacccatctcctttacactcactgctagacatttaattgctgacttaaaccattttaaaaataaatgtttcttgaaagttctctttgcttgattctataaactgtgttatcacagtggtccccagcctttttggcaccagggactggtttcatgggtgacaatttttccatgggatggtgaggatggttttgggatgaaactgttccacctcagatcatctggcattagttagattctcataaagagcgtgcagtgtagattccttgcatgtgcagttcacaacagagtttgctctactttgagaatccagtgcagccactgatccgacaggaggcggagctcagacggtaatgcttgccaggctcccatcactcacctcttgctgtgccgcctagttcccaacaaacaggccacggaccagtagcggtctgtggcctgggggttagggacccctcgtatagcacatg

SEQ ID NO: 5859 - DNA, 1089 bp, Homo sapiens
ccactgcactgtgaaagcacccatagacaatttgtaaacagatcaacacaactacgttccactaaaattatttactaaagcaggcagcaggccagatttagccagaggccatcgtttgctgaccctgccctacgaccaaatgtcctttctagtgagtctcttagaagaacgaaggagctttgttttccaaagttcccaacaaccaccctggtttacctacttggcctgatttttttttaaatacctattagtgagccagtaagtaagtgagccactatggtaagtggggtgagactgtctcactagtatagagactcatggcccactccgaatctactggtgacagcagcttccctgaattcatgggctgcccagggccaggtaattaccagaacaaaactgtaccaatcaggaagggggttgggggaatggatactgggtaggcaccagataaagtctactgtgtaaggttgatcctgtgtgttacaatttgtttatgcaactgttgtcctagaatgtaagccccttgaagtcaggcaccacaatgataattagtaacctcagcttgcaccttgtacaggctttgagttctatttttatttgttttgtaaggatttaataacataagtgcatgtgatccttaatcagtcacataaatgacaggaaaaaagtatacattagaaaataatttgtttcatcgttgattaaaacttctgcttcttatggaattaaattgttttctgtttttttttttttaactaaggttcacaaaaaggattctggcttttggcgagattttggctttggaatgacttgtcagtatcgttcagatttcctgaccattggtaagtatactttacatttaaggataggactttatttactccagacttaatggtattttgctaaaaggtctcagatttgagtgttttcctactaaagtatgagtgtctaaggttagctaaaaagagaaactggatatacaaaaggcaaaataagtttataattaatgttttgaataggaaaaaaatggtcataaaaataaagtataatatttacttgttcctttaaaatcaaaacacctgtttt

SEQ ID NO: 5860 - DNA, 1073 bp, Homo sapiens
tttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagtttatttgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaag

SEQ ID NO: 5861 - DNA, 1048 bp, Homo sapiens
agagatgaggagtgccactgtgttgcccaggctggtctcaaaactcctgagctcaagtgatcctctcttggcttggcctcccaaaatgctggggttacaggcatgagccattgcacccagccttaagctatttttgaacccatttgggattcatccctgttctccccagaaagcctcatgtgagtcataagcctttacatattctctctgtgcatgtggggctgtcaccagttttgaaaaaccaggttttgggtggggaatctatctcgtatctttgggtaatatcacagataaatacagcagacattaacattttattcagtaaccactgacagtaggggaaagagctgagctccattctgatttgtgcagtgatgatcgggctttttttctttttttggtggttggatattttatacctttttttccccaaatactctccactgaatgtagtcgactggtgattttaaagggggaatgagggagtatggaggggtatgagttggggctcagtagagttggggatgtgaaaaattacaagggaccagtgtaaatgtgatgaggccagcggtgtctgcctgctggcaatggtcaaagttagattccatcctcccacagagactgggagacagaggccttatctttcccaatcactacatttcaaagcaatggctccttgagaaagcaatgttccttgagaaagacacttcttagctgtaggagatacacacttgcatacacatacacaacatgtgtatcacataaacatctcaaagggacagaggacagattcataattgtaagtcctttttagtaaatgctcttaagagagggcggtcaggagcctatggtcagatattggcaagaatagtaagttatcctggcagcactgagatttctcaggcaggcattttaatggtggggacaggggtcatcctgggaacacaggctatgctactagaagccatgccaatttgtctctcagtgcagagtttcagatggagttatggggggagagttctgcagttctcagtaaccacaacagtat

SEQ ID NO: 5862 - DNA, 1034 bp, Homo sapiens
acagtgatggggtgcttctttttgagcctgtccaataggggatccccaagctacacatgaccatggctgggaggcatgggcaatagaaaagaggctccagatggcaggcactttatacgaaataggtgtgtacagggcctcattataacttttacattgattgcatgttgacaaatagtaatttagatatattgagttcaataaaatgtgttattaatgctaatttcacctgtttcattttcccctctgtattaggccattcttgtgttgctataaagaaatacctgaagctgggtaatttacaaagaaaagagatttagttggctcacggttctggaggctttacaagaagtgtggtgctggcatctgctcggcttccagggaggcctcaaggagcctccagtcatgttggaaggcgaacggggagcaggcacttcacatggcgaaagcaggagcaagagagagggagtggagggtggtgccacacacttttaaatgaccagacctcgtgtgaactcagagcaaaagctcacttatcaccacggggatggcccaagccactcatgagggatctgctcccatgatccaaacacctcccacctggccccacctccaacactgggaattacaattccacatgagatttgggtggggacacacatccaaaccatatcacctcctaacatgtactagaagattgaaattaccagtgtggctcacatcccacgtctgctggccccacagccccacagagcccagcttgggttcaggcagctgtccaggcctccccttcctccaacattagccagggctgtggctttcccttcgggaagggagacagcgttgagggaaagtggcttactgcagacttcagggccttactcacagggccatcaccttccactgcgcctttggaaagtcagggtggggaagaagcaggcacccctcagggtggcccgcagcagccacagcaggccttgtaggaagtgatatggggaaaagcaagaggctgtacaatgccaaaagcaagtcca

SEQ ID NO: 5863 - DNA, 1043 bp, Homo sapiens
ccgtgcagaatcccctcccccttcccccgcagcccccctaccccacccggcggacagccccgcctcgcttcctgtctcttcctcccaagggagacccctgtcctggctctgactggggttgagttcgccagttttgacttatgtgtagagtccggcagcatcattttttggcatttaactcgtcacatctatttcacctaacctctttcttcttagtaaactgacactcgggtcggtctctcatctttcgtgccagtcaagcaggtttcagacaccacaaatgccgaatgagctgctgccattccttcatcttaccccgaactgccacaacctgtgaacaccttccatgtgaatcaatcagccttggagtcagaggagagaagtacacattctgagctccgctgagtcgcaggaaagggagaggggtgcccagaggtcatcactctttccccaggcctgatttttggtccgtctgctgagcctgatttggacacatctctctgcctcctgcagcaagggaacattttcatcgtggactttgagctgctggatggcatcgatgccaacaaaacagacccctgcacactccagttcctggccgctcccatctgcttgctgtataagaacctggccaacaagattgtccccattgccatccaggtaggctgctggggggcacacctttctgagcagctcagtcctctgcgatccagggctcctgggtggctccattcacactccagctgaggaagctatgtcttgaaagacactagggcttcctgcaggccctgaggtgggctgtccataggggcggagagggttctactccccaaggcacacttgagaagcccctggccagtcgaggcacactgtggaggacctgccctgggatcatattctgcactctccaccccagcaccctgaccaagggcccccagtcaaggtgctgccaggggccaggcaggtgaagctgtggactaagctggagaccaagaccactgaggggcaccatgggttctggggtcaggaaccaggccagtcct

SEQ ID NO: 5864 - DNA, 1048 bp, Homo sapiens
ctatcttaaaatttggaaatgttccagaagcaaatattgaagggaacatatttgccactttcacgattttttgccttttcccacaggagaaaattgcctaagctttcctaggtttgttatagacatctaaaggaatgagaatttaggagctacgaatagctttatcatgtgacacatttgaagaaaatggaatgctgtcacatcttttaaatttagtgttattgggatcttcgattctgtgaagattgcagatttgtcagagacctggtaaccacaacaattcattgaggcctggaggcctcttaaaaaatgagggagattatttattagtaccacttagaaatattatcttttctgtattttctgtggttttctaagtcttctgtttagcgtttctatgattataatggtggattaaatttcttgttccttctcaagagcatctactatgagatgacactggtttttacttcggcagtatttactgagcattgcactatactaatccaggtattcggtgatgtaggaaccaaaggaaatagaagtcagtttctaccctcagtgagctgagtataatttgatagaagataaggattaacgtaagcacatttatgtcctaacacaaggaagcaaatattgttagtcatttcattaggaatttcttttgtcattggggcatttggggccttccaaaccttacatctcttgccatgcctttgtactcactcgataaacctgagaaagcaagatatcttcttttctgattcctggtttaagttgagagtgtggtgcacattagtcaaaatccaaatcataagaaaaggcaaaccttatgaattcattttggaatacaacagggtatcaaaataagtatatgagaaatatgaaaagctgacagtagaaaagatgctactcaggtactaaccagagttctcaatctcctctgtattgaagctcttatgatgtaaggctggatctgtactagaaacactttttaaagtctctctccagtattgagaagtatagtcctccagtactgcctcttggt

SEQ ID NO: 5865 - DNA, 1050 bp, Homo sapiens
catttcagtcattctttttaaaatagtcttcatttgtagaagttttagttttacagaaaaattgagtatatactacagtttccatataccccagacccaatttctcctataattaacatcgtatgtttgcatggcacatttattacaattagtgaaaagtattggtacattattaactaaaatccatagcttattcagcttttcttagtttttagctagtgtttttgttttgttttttcaagatcccatctggaataccacattacattttgttgtcatatctccttaggatttcttagctgtgagtttctcagatattcctttttgtgattaccttgactgctcaaatattttgtaggataccgttttattggaatttgatgtttttctcatttttagactggccttatgggtttctagaaggaaaatcacagaggtaaagcatcatttcatcacatcctgtcaagggtatgtactgttaacataatttatgacttgattttgactttgatcacctggctgaggtaatgtttgtctgatttttccattgtaaagttactcttttttcctccttttcatactgtaatactggggaaaggtgaccatgcacagcccacactttagggagttatgtcctgcttcttgatggcagagtatctacataaattattaatatttggaatccttctgtgcaggagatttttattttctcccatttagtaatttgttcagtcatttatatcagtatggactcatggttgcttattttatactttgggttatagtccaatactattaatacttaattttgctacacacattgtttcagatttggccattgggaacccctttagttagctcctgtgcctgtgacatacttccatcggtgtgggtgttttgtgagcacttactttctggcactgcaggatactcccagctcatcttgtatgttttctaccctagtcctgggatcagccgtttctctaaggagcactgtttcctttaattagaaaatggtattagaaacaaagatctaggtgcccttgttgc

SEQ ID NO: 5866 - DNA, 1044 bp, Homo sapiens
cctgcacagggatagatacaaattttgcaaaattttaattttcacttgatagttttaattttttcattggcaataaatactgtcatttatttttcttgaagtgataggcacactttgttcattttcaagaaaatgtcttccacataccctagcccaaataacatagtttgtgtgtcattctttcaagtaaaaattgtattatttaaaaacatgtctcacaagtgcttttcctgcaatggcccctgtacttcagtatatagcaacagtgcttatgtatacttcccatttcatcataacagataatgtggatattcctcttttatatgtgctacaccagaatttaacaaggtaactgcagggagaatctgaaactatattaataaatttttcatattctattatattaaaatccatttgtctatcttgcgttttaaatgagtgttttgcccatttataagtttgaaacatcatgtattagtcatttggaaaatactgatttagtgaggcctgcagatctttcaaatgtgtttctttataccaccattgtcatagtgtggtttgaggactgacagggctagcagaaaactccatctgtatcaggtatttgacggtcaagatttatgtaattaagaatttttggaaatagtaagattgttaaatttctaccctgactgatgagtattaaaaaaaagaaccacagattatcagtatgtggagtgaaagatggacatcacaacatatatggcagatattaaaagaataaaggaatattataaacactcaaaagctaagaaacaatgtagatgaaatggaacactcttttaaaaaatattcattgcccagatttacacaagaaaacagctacgtatttattaaggaaattaaatttgcagtaaaaaagttcctcacaggccctgtgatatcatgagggaataatttgatgtggctcctacttctaaaagcagcaattctcaaactttttaagagttttggaatgtctgtgttgttaaaaattattgaatatctcaaggtgctttatatagg

SEQ ID NO: 5867 - DNA, 1032 bp, Homo sapiens
agaaatgcaggccagcatccctgatgaagatagaggcaaaaatcctcaacaaaatactagcagactgaatctagcagcacataaaaaagataattcaccatgatcaggtaggttttttcctagatacaaggatggttcagaatatacaaatcaataaatgtaattcaccacataaacagaattaaaaaacaaaaaccatattcttatgcagtaaaatccagcatctctccatgataaaacctcaacaacctaggcatcagaggaacatacctcaaaatagtaagagtcatttatgacatacccacagccaacatcatcctgaatgagcaaaagttgaaagcatttcccctaagaaccagaacaagacaaggatgtccactctcaccattccttttcaacatagtactagaagttctagccaaagcaatcagacaaaagaaataaaagatgtccaaataggcaaagaggaagtcaaattatatgcttgttgatgacatgatcctgtacctaaaaaaaccctgaaagattccccgaaagactcctggacctgagaaacaactccagtaaagtttgaggatacaaaataaatgtacaaaaatcactggcatttctatacaccaataacattcaagctgagagccaaattaagaactaatttacaatagacacacacaaacacacacaccacacacacacaatatctagaattacatttaaccaaggaagggaaagatctctacaaagaactgtaaaacactgatgaaagaattcatagatgacacaaacaaatggaagaaacgtcccatgcttgtagattgaaagaatcaacattgttaaatgaccatactgcccaaagcaatctacaacttcaatataattcctatcaaattaccaatgtgattttttttcacagaattagaaaagacaattctaatattcatgtggaaatacaatagagcctaaataggtagagcgatctaagcaaaaggaacaaagccagaggcatcatattacccaacttcagactatact

SEQ ID NO: 5868 - DNA, 1025 bp, Homo sapiens
cctcagcctccaaaaatgttggaattacagccatgagccaccacacctggccataattttattttttataaaaaaaaattttacaataaaattcagatttgttcttattgggagaacagtagaagtcattgaatgaggaatcagtgagcagattttaaataagaaaacataattttgttattgtgaagaatggatagaatatggcaaacctattagggaactattgcagttatccaggaagacatgatggtagcttgaaatgtagtcgtgtgaatggattcaagagagatttagagggaaacagtataatcaacctgttgttgataggaggagtaactcctcagagtagttgtgggtaatggaatacatgtttctaccgtttgctgagacaacaccggaagaggaccagattggtttttggatatgttgaatttgaggtgccttttgaatgtccagatggaaatgtcatgtaggcatttgagtttgaaatcagaggagagatcagaattggaactcacacttgggttttattatattgaggtagtaattgctgtgggtgtgaatgagattagccagagcaaaggaatatagaaagagaagagcagtcctgtattttgaggaattccccctattgaatatccaggtagaatagtgaatcattaaagaagcctgcaaagaactgatttcagcaaacctaggacagtgaattattaaagaagttaccgtgtgttgctttcctatggctgctttaacaaattaccagttctactggcttgaaacaacagaagtttattctcacagttctagaggccagaagtctgaactcagtattagtaggctggattcaaggtgtctgtcaccagggccatgctctctccagagtctccaggggagaatctgttcctttcctcttccagcttctgttggctgctggcattccttggcttatctccacatcactccagttactgcctacacggtcagattgcctcctccttttctgtgtgtctaatctccctctgctt

SEQ ID NO: 5869 - DNA, 1024 bp, Homo sapiens
ggaggcctaaccgtctccctgtgatgctgtgcttcagtggtcccactcctagtctgccttcatgttccatcctgtacacctggctctgccttccagatagcagtagtaaattagtgaaaatactgatagtccctgatatgcagaaataatggcgtaagctgtctttctctgtctcctctccctctctgtctcctctccctctctgcctcagctgccaggcagggaagggccccctgtccagtggacatgtgacccacgtgaccttacctatcattggaggtgactcacattctttaccctgccccttctgccttgtatccaacaaataacagtgcagccagacattcggggccactaccggtctccgcgcattggtggtagtggtcccccgggcccagctgctttttctcttgtctctttgtcttgtgtctttatttctacactctctcgttgccgcacacagggagggacccaccgaccctgtggggctggtccctacaaaagcctagtgagaaacctgcacttccaccccccactaggcattttttccaccagagcaatgtcaaaggaagcttactataatggaatattaaaagtagatccagtcacctaatgtaataacccaaatatccaggtttcaatgaaaaaaacctctcataccaagaagcaggaaagtgtcagctcaaattagaaaagacagttaatacatgctgacactgaaataacacagatactagaattatttgacaagaatttttttattgtactttaagttttgggatacatgtgcagaatgtgcaggtttgttacataggtatacacgtggcatggtggtttgctgcacccatcatcccgtcatctacattaggtatttctcctaatgctatctctgccctagctccccaccccgcaacaggccccggtgtgtgatgttcccctccctgtgtccatgtgttctcattgttcacctcccacataagagtgagaacatgtggtggttggttttctattcctatgttagttt

SEQ ID NO: 5870 - DNA, 1059 bp, Homo sapiens
ccccatcaagccaccattgactttcttcacagaattagaaaaaataactttgaattttttttttttttttttgagacagagtctcactctgtcacccaggctggagtgcagtggcatgtgatcatagctcacagcaatctcaaactcctgggcttgaatgattgtcccgcctcagcctcctgaggtctcgctatggtgcccaggctggtctcaaactgctgggctaagcgatcctcctgccttagcctcccaaagtgttgggattgtacccatgagtcatggcacctcgccctgacacaaattttaaaggagtcatcaagacagtgcttcaacaagcagttatgaacatgcttgaaataaattaaaaaaaaaggaagttttcagcatagcaaataaataggtaaagaaaaaccaattggaaactttataactgaaaaatacagtaaccaaaataaaatcttaatgggtaaaactgtagcaaaactgacacaaaaaaaagaagacacaaatcatcaggagtaaaataagagatacaggttgagtatccttcatctgagatgcttgggtccaaaaatgtttcggatttcagattttttcagattttagaatatttgcattggttgagcatcccgaattcaaaaacccaaaatctaaaaatgctccagtgagcatttgctttgagtgtcttgttggtactcttaaagtttcagattttggagcatttcggatttcagattatcagatttgggatgctccaccactctggagcctgtggacatgaaaaggatactatttttaaaaatctacagaaataaatttgacaactttgatgaaataaactaagttttcagaaagtacaacatactgcaagtcactcagtatggcatagataatttgaatagtgctacaacttaatagaactttataattttaaaatgaaaataggcccgaatgatttcattggagaattctagcaaaggcttaaagaagaatttacactatttctgtgtagtctctgccagaaaataagggaatacttcctaattcatttatgaaatc

SEQ ID NO: 5871 - DNA, 1124 bp, Homo sapiens
gaaactttattaaaagtcctcaatagggctgggcgtggtggctcacgcctgtaatcccagcactttgggaggccgaggtgggcggatcacgaggtcaggagatcaagaccatcctggctaacacggcgaaaccccatctctactaaaaatacaaaaaattagccgggtgtagtggcgggtgcctgtagtcccagcagctcgggaggctgaggcaggagaatggcgtgaacccaggaggcggagcttgcagtgagccgagattgcgccactgcactccagcctgggtgacagagccagattccgtctcaaaaaaaaaaaaaaaaatcctcaatagatgaatttaactgcagattatataaactcaaaaaaggaaataatgaactgaataattactcaacaagcattcaagagaaacagttgaaaagtacgaaagagaagttatacatatttaaaaataaatatttatctgaatggttttctgtaagagagaatggtaaacaacagttaaaagaataatggctaagaattttctgcatcttgtgaacaacactaaactatacattgaagaagcacaggaacctaaggtggttaaataaataaatcctcacttagccttgttacaataaaacagcagaacatcaaagacaaagaaaagatctttgatatatctggggaggaagacagatttaccgtgaataaggtcacacccagaagacaggggaacattttcttaaattaaaataaaaatctagaattttatactaagagaataaatccagggaaattcatacgtttcttgcagacaaaaactgagcatttgcaattaggaagtcttcacttgaaatttagaagtgtgtactctaggcatgaagaaagtgactctcagacaggaggccagagatacaagaaagatcaaaaagcataagagtaataaatatcttagtaaatctaaacaaacatttttataaaacagtaatcattttcataggctttaaagcatattaatatatatgtcaatgatagcacgtaagtcagaaggatgaatggagtttctgtaaggtacttgtgaggacagtaaagacacataacttttcagagtctaaagttaatcagtatgtgtgtca

SEQ ID NO: 5872 - DNA, 1049 bp, Homo sapiens
ttcaattgccaataatctatttagatttcttcaaactaggcatgcagttaataattcatccatttcttcctgattcatagtcatttggagtcattttccagcacatggtggtacctcaggagtttttgaggcacacggggctatttgcttcagttctgtagtaatatttatttagtgtttttgtgcttggaattgtatggggcagtggagggaaataccaggatgactaaagaggatattttcatcagcagggagctcactgcgttaattcgtttccttaagtttccttttttattattttttatttttattttccctgaaagcacacattggtatcttgagtttttgaagccaaataatgagtataatgaaatggctcattagagcttatgtttgtaaccaaccctgaggagaattttgtttttgacattgaccctgttgatattgcctgaaaaaatttaaaaaaaaaaactgaattctttagaaatattttatgcttatggctttctgttttgagttaagtaaaaaggaaaaggaattaagatttgttgaatgcttatcatgtgccagtttcttacttaatttgatgctctcaataatttggaagacaagtacaaatatctctatttacagatgaagaaactaaggaatcagaagttgcctaggatcaaagaaacagtaagttagagaggcaaactctttgtgatatcaagggttgttttttatttttttgcccaagagaaaataattattttctgaaatggcagaaacatttgtaatatcaactagttggatactttcatatcctaaagacagaaaactccaaacaaaggattgattgcctctcacagttgatctttgagattataaacaaatattcttgccaagctagagcaatcagtcatactggtatctcttttacagatacctttagaatgacagcaaacactataaaattgatttttccagagaaagtgtttgcacctaataatcttatttttcaggaataataactgaattatttcatcagtttgaaaatatagtgtacg

SEQ ID NO: 5873 - DNA, 1029 bp, Homo sapiens
ggagaatgagtttgacggattgacagaagtaggcttcagaaggtgggtactaacaaactcctccaagctaaaggagcatattctaacccaatgtaaggaagctaagaacctggaaaaaaggttagacaaattgctaactagaataacccgcttagagaagaatttaaatgacctgatggaactgaaaaacacagcacgagaactttgtgaagcatacacaagtatcaatagctgaatcgatcaagtggaagaaaggatatcagagattgaagattaactcaatgaaataaagtaagaagaccagattagagagaaaaaaaaaaagagtgaaaagaaacaaataaagcctccaagaaatatggaactatgtgaaaagaccaaatctacgtttgattggtgtacctgaaagtgaccgggagaatggaaccaagttggaaaacactcttcaggatattatccaggagaagttccccaacctagcaaggcaggccagcaacattcaaattcaggaaaatacggagaacaccacaaagatattcctcgagaagagcagccccaagacacataattgccaattcatcaaggttgaaatgaaggaaaaaatcttaagggcagccagagagaaaggtcgggttacccacaaagggaagcccatcagactaacagtgaatctctttggcagaaaccctacaagccagaatagagtgggggctaatattcaacattcttaaagaaaagaattttcaatcgagaatttcatatccagccaaactaagcttaataaactaaggataaataaaatcctttacagacaagcaactgctgagagattttgtcaccaccaggcctgccttataggagctcctgaaggaagcactaaacatggaaaggaacaactggtactagccactgcaaaaacataccaaattgtaaagaccatcaatgctatgaagaaactgcatcaactaatgggcaaaataaccagctagcatcataatgacaggatcaatttcacacataacaatatta

SEQ ID NO: 5874 - DNA, 1025 bp, Homo sapiens
acaatctttaacctctaaactaggcaaaattacttttcctttagcaaaactcacaccctcctctcttttttataactttcttcaccaaaaacacatcctactttcattgtatactttgcatacaagagtgtttcccatgtatctagtacttttaattacatatattaactacgattttaactcttagtagttctaatttcaagtgaaaaacctagaaagtaagtagtagttaactggtttatgtctgtatttgtagacaaatcatttcatggtttcgtagaaagatatttctataaaatataattgatgcctacttttttgtttattaacagatctaaagattattaacagatctaaatatatttagcttttttataccatgtaaaaacaaaataccaaattatgtaaactaaactaaaacatatctaataattaatgtttttgtatcttaatgtatgtagaaatgactcaaacattttatgattatctattactttattaaacctaacatgacttcaaaactttaaactactgaaaagaattttgaaactgcaacacagatacccttcctaatgtcttcctcagtcatactgagtcgcaactacccacgtggcacccaagtatgattatgaaggggcagggcctatctgagtcctgattttacacacccataatggagcccaggacagaggacagaactgtgaagataatgtctgactcttcccaccatagccaggagacaacagccaggccagagggagtaccacatatgtctgcagtcctcacttgttagagcccagaatctaatgagtctaatacataagctcacagacaagtcaaataagcatcaaacatatcacagaagcaatagttttatgagcttcagacatctagtagagaaagcctaaacctttctgaccagcagacccaggcaaaaatgtctgattgtgtttaaaactgacaagtctgaagacattctaattttattttaccaacaattaaaaagctaattttatttctcaaag

SEQ ID NO: 5875 - DNA, 1068 bp, Homo sapiens
gcttttgagtaccttgggaaatagtatattcttacaaagtagatgacctatttattcagttgaatgtccttgtgaaaattgacgttgctttactgacactaataatctacatgcagttgagcaagcccagaagccaactttggaatattttgaaatgtttaccattttgagtacaaagtaattttagaatcttggataccagctcactgaagtgttatggtaatatcatacccatatcatttccgttacttatatttgttattgtttaaacagtagccaaaaatggccaggcacggtggctcacatctgtaatcccattactttcggaggccaaggcaggaggattgcttgagaccaaggagttcaaggccagtgggccatatagcaagacctcatctccattgaaatatatatattttaaagtagccagaaacatgtacttactttactgccaaggatatggctgtaaagtcttgagatctttaataaataacttgaatgtctgaatgacttggaaacaagttctgaattagcttactgatttcatgtgtctggcgctatttagctaaatccaccctcctcaaaatgtagaaattgttaagggacagtttcttgttgagacagtttctgtcttagcatcattttgtggttagaatgtagtaaacctactcaaataagcccaattaagaattaaatctattttatgaataggtctttaaaaacccaattgcagaactacaaaccaggcctctttctcccctttgtgggtgggggtcagattctcctagaagagagggcaaactaggtatgattagtatacctgctagaaagaacagttaagtggccagggcaaacaaagttgtctcttggctgtaataatttttttctggactcatgggcaactaaagaaacatgctaattatactgatgcttaaaggatttgccctctattacggagggtctgtgggagtagaactgtaacctcttctttataagcgagtagtacagaaaagggagaaggagaaagaagaatcctaaatatggaggggaatcatctggaaagagctc

SEQ ID NO: 5876 - DNA, 1043 bp, Homo sapiens
ataaaggatattacaaaggatgcagataatgagatgcatagggtaaggtatgggggaaggaacacagagcttccagaccttcccagggcacgccatcttccagaatcctccacgtgttcagctatccgaaagttccctgaaccctgtcctcttgagcctttcatggagatttattggataggcatgattgacaaccatgtggaaatgggattggacaaaaagggtataatctaatactaacaggccgagtggagaaacccacaagcctgtctgtccaaattcttcttagcctttctgtgcagcattcctttctcaagggtgtgggacaggaccacttctgaaatgagagtcttatgacctgcagtcagaaaggcaggggaagattagactcttgccttgagctggtgaaaggaggatgggaaaatcagagagagagattctgttttctgaggcctggagcaccccaacatcataaccaaagtctgtaacaaggtatatgggagttaagagccgggagctgtggatgaaaacctatatatatgttccctatatatacaatacatagaattatatatatgttattatctaatatgtaatagatatataatatcacacttggaaattgcactttttctcagtcttttgatgatacttttttatggtagtgacacactaatatctccatccgtatggccacacatgtgctctggatcccattcttttcttcctttttggaaataatatgctatctgagaaacctattttctttctcattcccccattctcactcttcctctctttattggatcctttttgttagcatataaacatgttcaggttgtctctatgttatatgtgttatactatgctatatcatatatactatataatctaattatcctcccttgaccatttactcctctttatctatttcatctttggtcttctttgttaaacttctctaaagaagtagctatatccagtttccttataaatttcccagttacatggcagctcattttaatctagcttctgctgcgttc

SEQ ID NO: 5877 - DNA, 1027 bp, Homo sapiens
accagtattcacatgggtagaaaaaaagtgtcttgatttttaatcctacaagtagtaaaggaatggtagtcagaagttgaatcgtacttttaatgcctcaggcaggatagaatagtattgttttgttttgtatcccaatatgcctaactacttctctctctctcctttctgttttgcttctcatcctttcacccattacagtctcagtatgtgtgttacaccaggaggttgccttggcaggtcagaggatctgtcacagtgaaggcactgtggtaccctttgttttttaggcaaggatgacacatgctagtcaacttatttccatttgttgttccctccacttggcactaaatgagacttaaccatttttgaatcaaagtttataaatttcttacaaaaattaaggtttttattctctataataagcacatgagaaagactggttttaaattttaaactgtggagtgacgtaaaaacatgtttaattttaattatttgctttcttttgttcgtcttgtaagttattaatgtattaatactggtaacttctagattggaggaatgatttatcctaatgtttcttttttaaaaaaaactatcagtcattcatatggcatatgctaatcaaggctctgcggtattttttttcttatgttttttaatgaagcagctcttttcatgatctagcagtctgtgttactatcagtacgtaaacagtaaggactcaaattttaagattaaaacaagttcattttgttaacatcatgttttgttgcatcttgcagcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatggtaagtgtttacttccaaaaattaggcaaagaatcattaactgctaccttttctcctctcgtaatttagat

SEQ ID NO: 5878 - DNA, 1149 bp, Homo sapiens
aagtgctgggattacaggcgtgagccactgcacccagcctcgtatgcattctttatcctaccttttcttgatggaagtacaaggttaaggatttatttaggctttaggctatctagtggagctaaataattatggatttgtacattgagtgcccacgatgtactaggtggatctttgaggcaacacaacgaacatgcagggtctctgttggcatagtccactgtctatttggatccattagcattttaggaaatagttgcaaaaaaatatatgttgtaatagatatagaagacacatgttgagcgtcatagacttggaagggatccagttacttgtctttggagaaagtgagaaatgtatatgactgtttcatgaattcagtttacagatttttgcttgaagtttttttgtgtgtttttgaatttcttattacagcgcagcttatgatgccattcttgaaagaaatgttgcaatcaagaagctaagccgaccatttcagaatcagactcatgccaagcgggcctacagagagctagttcttatgaaatgtgttaatcacaaaaatgtaagtgaacatttttggtttcctaagtatagatgaaatcaagatttattcatgaatatgtgaatatcaaagactaaatattaggggctttaaattgttctgtattaaaacattgtttaaaagggatatatatatatatatatatatctacagggtgattttcctcaactttattaaattgtatcagaagaatggcttctaaaatttagattatatgatttcctgtcatttaatttacaaaaggagttttaaaaagataagcgtttgagaagaattttattcagcttgatctcatcttctgctttttgttctccgtcaggctgacatttagaaaactgtagcattagcacagagatgaaattgttcccattatgctttgacactctgactttaatcatattgaatataaaatttatatcacttctccctaccccactcccacctctttaagtgatggcagtattcactgatcactttatgatgaggatagtgggtttagcagaaagtgtttgaaactatctagagggtattaacatgtttctaattctattttctaatgattgcaaagataagtctttataaag

SEQ ID NO: 5879 - DNA, 1031 bp, Homo sapiens
gtctattctggacatttcatgtacatagaattatataatatgtgatattttgtgcttggcttattttacctagcataatcttttcaaggttcattcatgtatttattgtgtgtcagttcttcttgtcattttattgacaaatatttcactgtatagatatattgtttatccatttatcacttgattataatttgggttgttaccactgactattacaggtaatgctgacatgaacatttatgtaaaatttttttgtgtgttggtatgttttgtattttagttaaatctagcttattctttgaaaagtattgagaggatttttttttttttttttcctgagagacagaatcttcctctgtcactcaggccaggatgcagtggcgtaatcatagttcacttgcagccttgaactcctgggttcaataggttgaaaagaattttttttttttttttttttttttttgagacagggtctctgtctgtcacccaggcatgagtgcagtagcatgaacatggcttactgcagcctttacctcctgggctcagtgatcatcccacttcagcctcccaagtagctaagactatggacatgtaccaccatgcctggcaaatttttattttttatttttttgtagagacggggtcttgccatattgcccaggctggtcttgtattcctggcttcaagcaatccagctgccttgacctcccaaagtgctgggatcacaggcatgagccatcatgcccagcctggaatttttaaaaattatttaattcagtggaattacatcttccttctgagtcatctgcgtcaaataaccttactcatgtaataaaataaatacagagagagttttcacagtataagacaattatgtcttagggctattggggctttttttttaagtgaacaatcctgctacaggcttatccttaattatcattgtaagtgaattccttgtatattacatatacagctgctctaatcatttgtctaatgcaatctttaaataacataataaaaatctcttt

SEQ ID NO: 5880 - DNA, 1029 bp, Homo sapiens
cttctttgcttggaagtgacacacatgacttctgcttagagtgcattgacaaagctagccatagacttgcttaatttgtaaggaaactcggaaatgtggggagagcagacttcagcatagtggtgagccccagcctctgccacagtctgttcttctggctggcaaacattcctttgctccctttattccacaccttcttaagggaaataacccaaagttctattccatcaagacatttatcaaatccaggcattgttcctcttggtccagaaacataggaactggaatgaccaaattatatggccaaccctataaccactgctcccctgccaaataccatagatggagtggtcagacagggccagtgttatcacagtgaacaatcccatttagaaaactgaaaaatgcagtcattggttagttgtaattaaattcttctgtacagacattgtgagtgtcccttgccgtgggtggggaatattcctaatcagtcctcctgactgatctctgtggttctctatagtacctggctctaccctgtgggagagtcatctttttgctatcctcatgaatatatctaaagtggatattgaagaatgtattttccttgagggctgctcacctttctcagcctgcttcttacctataaaagattggggcccaagggtcattttaaggccatccttctcagccttgccactattgacattttggagcaaacagttctttcttttgatgatggaatgtttagtagcattcctggcctctacccactagatgccagtagcactccccagttgtgacaatcaaaaatgttttctgacattgccaaatattattttggggcaaaattactgtgaattgagaactcctgtttgaagtgtagaaggatcatagacctttggcgttaggtctgacagttaactaactctttcagaaatttaagagatttcttatctttctgattgtagttcctttcatagtatcttttttagctcatgggtcctgtattcttggacttaattgagg

SEQ ID NO: 5881 - DNA, 1108 bp, Homo sapiens
aatttttttgcttaacaaaaatatctgtctttaaaaattgttactttgctcttaattttttcacaatgaagtgcttgaaattggaatgttatttctaaattggaatctgctagtataaagagccagtaaccttcaaccatcacactaaacattgaagtagtatcaaagcttgtaatatttattcttaaacatgcagtgtttctttgctgaggtactgtattttagaagtattagcaacattatatttacagaataccaataatgaaaatttttttcttctgtttcattaagacctttgaattgttggtatatttaatttcataaaaccactagattacatatcttctaaacccatccatgattgcctgtcgaaatatgttaaagacaacatacatgcttttctgtatgttaacattacaaaagtaatacaaaagtaatagttgtctttcaagcaggctattttccttttttgtattaatcggtgatatttaatatgtatactgcatgtcagtacaggtaatacagtgcatttgtgttgtggatttatgctttcttcgttttttggtcctttggcttataatagtattcatcaaagctaacaggcaaagtatgttaaacatgaagccatgagtgtttatgctgctgcctgacttttgatgggcacagcacagaatatgttaaagtaggggccaggtgaaaaattctgaattattcagtagtatctatagcaagtaattttatagattagtggcaccaaggcaatggtgtcctacttctacaaacagacagaaattttatagcaaatttgtgtgacttcaggtgggaaatcagggatggaaaaatggataatgactcttctagtcctttggaactgggtatctgccagtctaaaagatcaaataacatttgttaggattgacaagatggctcgttgttgacttaaaacatctgtataaagcttattgtgactttaaaatgagattttaaaaatattggtaatatgttatgcaaatgaatataaatgctaacttatgactttcttttactatagtagtttttttatgtgagctttgcgatgtcttttcaaatcccttttactctaaccaaa

SEQ ID NO: 5882 - DNA, 1034 bp, Homo sapiens
ctcatagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacttgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtataca

SEQ ID NO: 5883 - DNA, 1114 bp, Homo sapiens
gtggtgggcacctgtagtcccaattactgggaaggctgagatgggagaatcacctgagcccaggaggtcaaagctgcagtgtgccttcattgtgccactgcactttagcctggacgacagagtgagaccctgtgtcaaacaaaaaaaaaaaaaaaaagatagattctaagaggccaaggcaggcaaatgggcagattgcttgagcccaggaattggagactagcctggacaacatagctactaaaaatacaaaaaatgagctaagcatggtggtacatgctactcccgaggctgaggtgggaagatcacttgagcttggggaggtcaaggctgcagtgagccgtgatcatgccactgcactccagcctaggtgaccctgtctccaaaaaagaaaaatgtggtatatacatagaatagaatattattctgcctttaaaaaggaaattctgacagatggtaagacatggatgaactctgagtacattatgctaaataggccatctataaaaaaaaatggtgtgattctactaatgtgaggtacttagaatagtcagattcatgtgaggtacttagaatagtcagattcatacagaaaaaaagtagaatggaagacggctgggatggggtgtagttattgctaaatgggcagagagtttcagttttgcaagatgaaaagagtcctctgaagatagatgttggtacacagagcaccgtggctcacgcctgtagtctcaacactttgggaggctgaggcaggaggattgtttgagcccaggagttcaagaccactctaggtaatatagggagacctcatctctacaaaaaatttagcccggtatggtggtgcatgattgtagtcctacctacttaggaggttgttgtgggaggatcacttgagctcagaaggtcgaggctgcagtgagcctttaccaaaccactgcactccagcctgggcgacagagcaagaccctgtctcagaagaaaaaataaaggaaaagtagatgttggtaatagcacagccgtgtgaatgtacttaatgcctctgaaatgtacacttaaaaatggttaaggtggtaaaatttatgttacatgtattgtaccataattcttaaaa

SEQ ID NO: 5884 - DNA, 1051 bp, Homo sapiens
taggatggtccttggcaccaaatttgccttcaaaaaagcatttgcttcatttaatttcgatttattcacgaaggactaaaggacactgcaagggcggggagggagtgtgcgcctgcgctctgcgcctcctagagggcagtcaagggcttctggctgacccgagcggagatctcgcgagactgtcagacgtatggcgagaggtgtgggaggaagattgtgttgtcgcgagaactctgcctttgggccgtaggttagtgtggggccgtgtctcagtccacccaaggtctcctcggatcgcctggagaggcactcggacctggtaagaacgctgtgggccgggtggaggctcgatgaccgctggcccgctgggcccgggcttgtccgccccttcccgacccgaccgacaccgggaccggtctgccttctccttcccttccctcccctccacacgccaggcccgggcacctcttcctgcctgcccgccgggcccgggcctgtcttctccccttccggccacacgccgggcccgggcctacgttctcgccttcccgccacacgccgggcccgggcttgtcttttcctccccgaccctcctcgtgcccggccgtgggcctgtcctttcctccccgaccctcctcacacccggctcggacacctcctgctccccgccggccttcccctctctttaggtgtgacagctccaagtttcctgtttctctcgcctcttgcttggatgtggggcgaggcgaggtctgttttgccggacgggcacagaacataatccatttctagcttgtcaggtggaaatgcaaagaagatattgggtttttttggccctctgtgtgccaaacacatactgtcacatttaattctcccaataatcccgaaaagtagcttgattatctctgttttacagctgagaagagtaaggcttgctcattcattggttcattccaccagcaatcatttatttggtgcctgtatgttcaggatgttgaggatagcaatgaaaaaaatggacacctaattctcatggaactaaattcttgtt

SEQ ID NO: 5885 - DNA, 1025 bp, Homo sapiens
cacatgaacaatgtggaggtctaggctggaatgggggcccagttgaccacttttgctctagctggtaggcattaatactatctccatgcatgtcagttagaggagctgccatattgtccttagcttatcttctttgattgttaaatcataacattgcaatgcttaacttctgatatgaatgactacagtcttaagtcttaatcattcttttttttttttttttttttgagacggagtcttgctctgtcaggaggctggagtgcagtgggcgatctccgctcattgcaagctccgccttccgggttcacgccattcttctgcctcagcctcccgagtagctgggactacaggcacccgccacaacgcccagctaattttttgtgttttttagtagagatggggtttcaccgtgttagccaggatggtcttgatctcctgacctgacctcgtgatccgcccgcctcggccttccaaagttttgggattacaggcgtgagccaccgcgcccggaccactcttagtcattcttatcccaagttgtcatccctaattttgcttggcttgattaatcaagatgttcctctttggggttagcagtgtgtttgggggcacctttggggcttaatattcctcttatgcagcattacctaagtgctctacaaatatggcagtttggttcagtgaagtagtgagtagctcacaaaataggttaaaaggttttgttgtcagtttggtcatgggtgagaagttaagtcttttaatactgagacaatttcagctttcaaaagaagataatctcaggtgtgttttgagctttattttggcattattgttagtcctctaggctttaaaggagggaaaatattaatattttatcacttgttggcttctatggggagaaccacaaagtgtttgccatataaaatcaggataaaatggcattattactgtgatagtaggtaagttaacatattttcctatccttgactctattatggcaagaagtttcaagttgaatatagtcc

SEQ ID NO: 5886 - DNA, 1285 bp, Homo sapiens
catataatatctcactttaaccttactgcagcccctctgtagcaaccatccttgtctccctttttcctgaggaagttgaggcccagagagattatgttactagctcaggggtctcaagcttggagacacagccataactcaggtttgtcagactccagagtgacctcttaacggtcatgcttgctactctggctcttgaacctgaaacaaatggtgaataactgttgaaaatggccatgtgaactagttacctcatacaagtctctttggatgtaacatttcgtacagctggcttaggctcattgtgatttgaattcacccatggttggggctcttcatttccgctctgaaggcttcctcttcatcacagtgcaagagggcaagcctttgcatagctcctttcttggcatctgggctctgaaagctgacagtgctctaactgcgccacagggaggaggagggacagagagagccaaaggcagcaaaggggcaagcatcctgggacttaccataaagaaatgaaacagattttcttcgtggctgacagatgagttctcaagatgacttttgaaggataacactccttttaatttgaaaaaaatgtgataactgtgtgtggaaaaatcagttttgtaacttttaaatctcatcctacattctgtctatagctgataagggcaaagtccaatgtgtgaactcttgctgtagtctactcttattgtgtaatattaatacttgtgattgaattgagaggacttgctttaggaatctagtaatacagtcagcactgtatgtatttgagtttgtctcccgtatgttccggaattctggagttttgacattgtgaagcaacaatttaattttattgattcaattttacactgtgccaggcattgtggcattccacacaaatggtgagaagctaaaagtgagaaatttggcacaggtgaagaaggctgggtaacacatttgaaagactgctaaacaggtcttgcatgactggcctaagtgcaaagtgaagcagcccatcacgctccagctctccaaatcggagccggcatttcacccatgtgatacaggtatttttcatagtccctgcagtgagttccaagtgcacactaatgcttctgcctaacacaggcagcttatggcatgcaaaaggaggctgcaaagtaaccactgttggtgtgtccagggttagaaaaatttccacagggatttctgtgaaatccaattaaggcagccctttctttttaatagatgattatggagaaaagagactgac

SEQ ID NO: 5887 - DNA, 1049 bp, Homo sapiens
aacagccattccactactagttctttctccattgaaatggaaaaggttggagatcaagagcttcctgatcaagatgagatggacctatcagattggctagtgactccccaggaatcccataagctgcggaagcctgagaatggcagtcgtgaaaccagtgagaagtttaagctcttattccagtcctataatgtgaatgattggcttgtcaagactgactcctgtaccaactgtcagggaaaccagcccaaaggtgtggagattgaaaacctgggcaatctgaagtgcctgaatgaccacttggaggccaagaaaccattgtccacccccagcatggttacagaggattggcttgtccagaaccatcaggacccatgtaaggtagaggaggtgtgcagagccaatgagccctgcacaagctttgcagagtgtgtgtgtgatgagaattgtgagaaggaggctctgtataagtggcttctgaagaaagaaggaaaggataaaaatgggatgcctgtggaacccaaacctgagcctgagaagcataaagattccctgaatatgtggctctgtcctagaaaagaagtaatagaacaaactaaagcaccaaaggcaatgactccttctagaattgctgattccttccaagtcataaagaacagccccttgtcggagtggcttatcaggcccccatacaaagaaggaagtcccaaggaagtgcctggtactgaagacagagctggcaaacagaagtttaaaagccccatgaatacttcctggtgttcctttaacacagctgactgggtcctgccaggaaagaagatgggcaacctcagccagttatcttctggagaagacaagtggctgcttcgaaagaaggcccaggtgagcataaacatcaaaatagcactggtttgagttttatttatttattcatttattttgagatggggtctctgtcactcaggctggagtgcagtggtgcgatctcagctcattgcaacctccccttccgaggctccagccatccccctgcccgcactacagcctcc

SEQ ID NO: 5888 - DNA, 1001 bp, Homo sapiens
ctactgaagtgtcctccattcatgagttggcaaaatcttcagagtgactgttggagcaaggagcctttcatgtgctcccagttattatatagtgcatagaggctggtaagtgttagtcctgtcagaccacctcgtgctatccctcgaagaccacctgggaaacagagacaaaaggaaaatgaaatagctgtatattgcatagtgccctagcacgatagggttaaataaaaagtactgtgaaatgggctgggcacggtggctcaggtaatcccagcacttcgggaggccgaggtgggtggatcgcttgaggataggagttcaaccagcctggccaacatagtgaaaccctattaaaaattcaaaaaaattggctgggtgtggtgatgtgtgcttatagtcccagctacttggaggctgaggcaggataatcacttgaacccaggaggctgaggttgcagtgagctgagatcataccactgcattccagcctgggcgacaggatgagacaagtgagactccgtcaaaaaaaaaaaaaaaaaaaaaaaatactatgaaatggagagaccattttaaaaataaatcaatattccatctcaaaaaggagacaacgtttttaaagtaataccacttgtgtaatacatatgacttaacattttcatattcataatttttttccccctactttccaatttgttcctatggcagtttattacggagttccaactagaacagtcgtttcctgctagtaatatgatttagaactccactagcactgtcaatggatttaagtctgtaatgtaaacaaggtgacaccctatttggaaagagtattaacaacctttggactctggatgggtcctccaaatattaaccttgaagattagtgacggccaggcatggtggctcacacatgtaatcccagcactttgggaggctgaggcaggcttgagctcaggagtttgagaacaacctaggcaacacggcaaaaccctgtctctgca

SEQ ID NO: 5889 - DNA, 1027 bp, Homo sapiens
ggctggagtgcagtggtgctctcagctcactgcaacctctgcctcccggcttcaagcagttctcctgcctcagcctcccaagtagctgggactacaggcacacaccaccactcccggctaattttttgtgttttagtagagacggggttttaccatgttggccaggatggtctcgatcccccgaccttgtgatccacccaccttggcctcccaaagtgttgggattacaggtgtgagccaccgtgcctggcctgaaggtcatttttataaagatctctccacgtcttagatttgattcttcctttaaatatttttctcattgacatttgaaagcacctgaccttatataaaatgaacaattttcataactccataaaaggagaattatggcatcatctatttctttctcttgtctcataaatctaaaccatcaacctgcttatttttgtatactgtcacactgtgtattccctgcattgaatgcctgtctgttgacattatctgtaaaaattgtgggaagttttctgcaccctgaaatttctgttatgcggattaaatatccactatccatgtttttccaagtcttacagtagaaagggtaaatgcagccctcacagcagcctgttgttcgtcctgcaaatgtgtttccatcacattacacaaagcctctttgtcttcgtggttctaccctactaataagttttttaaaaaattatgtaatgtgtgtatatacaaatacctatatgtatgtgtgtacacatacagctgatatctgctgagattatgtatgcatgaactatagaattaacttgtaattttaagaaaataaattattttgtaaagataaatctcatgtttaagaagaggaattacagttgaatcatttagggatgcctcagcctaaacataatatggaaaaagccataaccaaaagtcattttagagtactgctaggttactcaacctatcatcacatttaattaaaatgtcagtttgaaccatggccagtctatgttggttaatatgt

SEQ ID NO: 5890 - DNA, 1030 bp, Homo sapiens
ctattgtctgccctgctgatatgtgataataatttgtgatcctgttgtcttaaaatggggtcactcatctccagtagaattaagtccacagtgaagttgtccccccatccccagagataaacatatatgaatgaactcacgtgataacaactactgctgcctgggatcatgagagacctgaactgaactgataggaagtgaaaggtggctgaggtaatgagaatagacccatctgcagaggatcataaaaccagcaaagacaagatcttgtctaagatgccttcacaaactttgtccatgagaactctaaggacttctccagacctgttggctgctgctgtgatctctgcccaagaggagcctctgaccaacatccaaagggcttctggacccactggactcctctggaggtaccttggtctcccgatccatggctgtggttttttactccgtttatcactgcctgtgtgtagaatgataattgcacaattgatagtgtgaagacctcttgataaatggtgaatctgagcatatgtatttggctgacatgtcattgtgaaacctcacagcttcagtcagtgtcagcacagctagggagcatgtacctaatgcacatatcactgggcatagtctacaggcacctaataactcaggtaccttaacagtcactaatgagtgtctctccaaggtctaaacaatggaagactgtagaagatgttattcattaagatatctcaagaatgtggaagactattattcgcttctaaagggacaggacttcatagggcacctgaagaaactcccatgaaaaatcacttttacaaaatgtcaagttatgatatccaagatgaaaccaatgagtcacaacattcacataatacactgtacaaccctgatctcttgactgtcatcaaatgtttcttacctctaaaccaaagtttcattttataatttaatttttctcattttttctgttctcttagcttaagaaaagatcattacaaactttttgtaagtttttcatatatgc

SEQ ID NO: 5891 - DNA, 1045 bp, Homo sapiens
ctccccactcactccaaaagttgagtaggtcagcattctaagatgcccattttccacattataatatcttggaaattgggatgcattttccaatcagaggaagcttattattataattagtagcatgcttttactttcttggtggttcaaaagataatatgagttgttaaatcaatggaagcttagatttgatgtaaaaatagtggtgccttggaataaaaacattgcatctacctaaaatatataccactgaacaagtttacttgatttaaaggaacttcacttgtggaaatcttccctttggatgcagttgtttatgaagctgcaactgtgatgtcagaaggttagtcaacaaacaagataaagagcttaaaataataagcagccccttatataataatatgtaagcctcagtaaaaaatgtgaaacaattgtggcatagcaaagaaaataaagcccttttaatgaaagagcttggatatattaaattgaaataaatgaaatggttgtctctgtaggttgcatcagtcgaacgttgaaaatttcatatgcctgtattattactgattgtgtgtttgaaatttcagtattttatataatttctttgcacatattttaatcaattgatatttattttcattttatcataattttggtctcagttttaggttactttttttgaataactgtttgtatttatttatttatttatttctattataaaatccaaatctatttgtaggtcattcagattatacagaaaagcataaacctataatccatccctagagataactactgtttaactgtcactatgctcataggtctatagttcttcccaagaaaatagattcttcaaattttgtagtgacaatgaagaaaaatgcaattaatttggtggaaatttgttttacagacaaatttctggtcaagcaccttaaaactagctatgtgatcttgaaaaaaaccactgaatatgtctaagcctattttctcatttgcaaaatgggaatggtaatacataacctatctcatatcatatgca

SEQ ID NO: 5892 - DNA, 1054 bp, Homo sapiens
aaagtatctgagaattaaaaaaataatctatgcgctttcatgttagcattgtgtctagtggatgagcattcacttttgaagaagagagcatattagctactatctaaagcattatttctctgtattgttttagtttaaaacctgagtatttctgagattatccagaaattgtaaaagatagcaagaaaaagagagaagtatacttaagtacaaatgggcacctatttttcattgttgttttaaaccccatttagtttatgtgcagtagaagcctgcccaaccccagacacattgatttttttctagtggcttctcagaaagtggtggcaggaagctggttggattattttgaacaaaaattgaatccactcttggtgcattcattttggtcagtaatgctgattaatgcactagtgaagtttggtccattttccaaggataggagacatgtgttaacagttactttcatggttttggaaacagtatttctaaactaagtgagtaatgtaactgtgtgagtgtgtgcacacatgcatgcatgtgtttgtggcacagattttacctttagggattttgaattttctttttcaacttggtcaatttgttaagtgccagggtgtttgggtttcaaactgattcttcccttggagcctattattctttgcttgactccacagcaaagttataagagaggctctcagattcttaggcattcccaagacaacactcatgccctaaatatttttaacttctcacagaagccagtggaagtgagaataagataaaacattcttgggtaaaagcaaatcctttccaatgtgaaagcaaactttaaaattctgacagtggctcattagtttaatagtacatttgttaggtgtctttggggtgcagctttctgtaagacaggggctcaactttctctaggaactgagaagccctggcaggcatcctgagtaaatggacatgtaaacaccctgttatgtggaaagcaagcactggctgctggccccacactgcccaggaaggaccttgccctctgcaatgtcagctg

SEQ ID NO: 5893 - DNA, 1062 bp, Homo sapiens
agcaaatggaaaacaaaaaaaggcaggggttgcaatcctagtctctgataaaagagactttaaaccaacaaagatcaaaagagacaaagaaggccattacataatggtaaaggaatcaattcaacaagacgagctaactatcctaaatatatatgcacccaatacaggagtacccagagtcataaagcaagtccttagagacctacaaagagacttagactcccacacaataataatgggagactttaacaccccactgtcaacattagacagatcaacgagacagaaagttaacaaggatattcaggaattgaactcagctctgcaccaagcggacctaatagacatctacagaattctccaccccaaatcaacagaatatacattcttctcagctccacatcacacttattccaaaattgaccacatagttggaagtaaagcactcctcagcaaatgtaaaagaacagaaattataacaaactgtctctcagaccacagtgcaatcaaactagaactcaggattaagaaactcaccccaaaccactcaactacaaggaaactgaacagcctgctcctgaatgactactgagtacacaacgaaatgaaggtggaaataaagatgttctttgaaaccgatgagaacaaagacatacataacataccagaatctctggaacacatttaaagcaatgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaatgagatagaggcacaaaaatccttcaaaaaaatcagtgaatccaggagctgttttttttaaaagatcaacaaaattgatagaccactagcaagactaataaagaagaaaagagagaagaatcaaataagcacaataaaaaatgataaaggggatatcgccaccgatcccacagaaatacaaactaccgtcagagaatactataaac

SEQ ID NO: 5894 - DNA, 1048 bp, Homo sapiens
ataaagctgcacacctataactctctgatctgcaacaaagttgacaataacaagcaatagggaaatgactccctattcaataaatgatgctgagaaagctggctagccatattcagaagaataaaactggatctctacctttcaccatacacaaaaattaagaatacttaaagacttaaatataaaacctaaaactataaaaatcctagaagaaaacctaggaaatacccttctggtaatcagctgtagcaaagaatttattactaagtccccaaaagtaattgtaacaaaacaaatagatctaattaggtgacatctaattaaactaaaaagcttctgcatagcaaaagaaactattaacagagtaaacaggcaacacaaagacaaagggagaaaatactcatatattatgcatccaccaaaggtctaatatccagaatttgtaaggaactcaaacaattgaacaaacaaaagacaaatagctccatcagaaaatgggcaaaagacttgaacagacacttctcaaaagaagacataaatgcagccagtaaatatatgaaaaatgctcaatgtcactaatcattagagaaatccaaatcaaaaccacaatgacatactatctgacactagtaagagtggctattattaaaagtcaaaacataacaggtgttggtgaggttgcagagaaaagggaatgctatgctttcggtgggaatattaatttttcagccactgtggaaagcagaagacagaccataacaaatgttggcggggatgtgaagaaaagggaatccttgtacactgttggtaggaatgtaaatttgttcaaccactataaaataacagtttggaggttcttcaaaaaactaaaaatagagccactatgtgatccagcaatcccacccctaggtatatattccaaataaaggaattcagtatattaaagcgatatctgcacttccatatatattgctgcactatgcacaataggcaagatttggaagcaacctaagtgtccatcaatgggaaataaataaaataaatgtag

SEQ ID NO: 5895 - DNA, 1064 bp, Homo sapiens
aggctggaatttcctcagttagccctgctcttggggttgccatttaccagtccttcatcttcttccttcctcatccaacttctctagctcagtgctgtgttacaggcagggcatatgataatacagttatgaaggatgtgaaaatgaccttggttgcctcctttgaataccctttgctatttgtcacttgtgtcattcatgctaatcccttcatccctacctttcccaccatcaacatggattgattactggctgataatatgccaagatattaacctgttacctctttctgatgaacgtggtgatgtgctaacaggagcttttgggagaggatatttatttaatttactcagctgagtaatatttctgacaagattttaaggggaggaaggctgaggaagggaaaggaaaatttttaggcagcacggcttgtaaacatccttgtatcttgccagatgtgatttgaagaggacagggcttgagcataagcacttcatacatgctttcagtcaaggctgtacaggaggtggtagtgtcttgattttagtgatgagaaaactgagcaaatcctcgtggaagtgtcctttaaaggatctcggaaataagacctgaaagaaaatttgggttgtttgtttttttattttgcatcggtaccagagttggtgaattgaggtcttcaacttatctgtttaacttgttatttaagacacattgattttgctttggggttagttcaagttccagagtcttgtgcattttccaaatgtatttctaatacaccaggagttcttgttccatttgaattaccaatatatgcacaggttgaaagtttacatttaatcatgtattcactggaaatttgaccctcatgaaactatttctaacagacctgaaaaaacaaaagatgtcgtatctttttcctctttcctgactacggtcctgtttcctagtgccctctcaccataacatgtaagagatgctgagagtgcgttaaaaccttttcttttgataagattttcaggtgatttcatagttgctcagggtatgaataattattttcattt

SEQ ID NO: 5896 - DNA, 1051 bp, Homo sapiens
gtgtcacttaacgctaattatttataagtaaatgtaagattcactagattctacttagccagcacctgaatttcataacaatggttcccaaagtgtgatgtttatataattggtggcaccagggatgcttctatgtggtagagaagtgaatttattttatagttatagatattttaataagtgttgggagaaaacatacaacaatcacatcaaatccatgctgtgtagctatgttgctgagggtaaggctaagtattaagagttcatagatttttttttttaagaatgaggtgtaaaaatacagattgtgcgtaatgtcaataagggtacacaagaaagttttgggaaagattgttttaaagtcattttcaacaaggaatgaaatggattgttctcctgtttgtgtttttgctccccactgccctgtttgaagaattctggccgagttctctctgtatctgtgtttgaatgactccttgcatgctgtttgtcaacttcttcataggaattgctgtggggacatagagttagatggagatggtggttttcatgaaatatattcttgctttgaggataagtcattctggttaaaaattgctcacattaatacatcatcagaaaaacatttgactctcatcctccttcagatttataaactctcttgccttgagacagtgaggtccatggctgaagaggccagcctagaaataataaaggatgctggggcacccacttccatccagtctgggttccctggggagctctcacttcccgtactgtctccacagcgaggcctctcatttcctcctccaggctccttcttgattcctgacagtagatgcctgtggctgtgaagagccattccatcatgtggtattttatagcagaaatacatggtgcttcccccgactcctttctttgtaaagaaacaatttggaaaaagtttggaagggaaaaatctttgataggatacacatttattttcccttaatctgttccctttccttgtagaaaaaaaattagattattccaaattaaaactatgtgtttt

SEQ ID NO: 5897 - DNA, 1034 bp, Homo sapiens
ttttagggtaaagagtagtctggcttataccacacagggttacattgtgggttgggtctaatgggctgtacatttttggatcaatattccctcagagagtgccattcagccttcctgtaaaaggctatttcattcagtctgtgacccctttcatgtgaaacctcccaggggcctggatgtgaagcagtcttgctactggcatcatttgtgatttaacgctgaggagaaatgtacttattttggtctgtcccagcaatcaagggtcagtggtaaaaggaagttgtactctgggtcaaaacaagtcagttttggattaatgctattccttggcctctttaattggtctttttgctcagatactgtgttagatcatacttagataaacaggcaagaagggaacttgagaatttagaacagttcacattttcatgccctgtttgacaataagatgcttttataaaaagtgttttgaaattctgtgatatatttatttgaggttatcaatgtatagaaatgctctctgggacagtagtcaatatgtttcctaggttaggaaaaaaacaatgttacactgtctatgactgccagagagaaccaagggtagattgaatgttgggtatgctttctcgtgtctgcagggccaaaacaacaacaacaacaacaacaacaacaacaacaacaacaacaacagaacacctagcctgcattggacatagtgaagcaagcaatagacagtaatatcttttattttctctgatctttctagtttgttatctaggccaagacaaattcccgaagtatagcagcagggtttgaagcatgctacattgaaatcccccggttacccagactcaccatctgactccagggcatcacgagaggtgtccacacaaaaggagacaggctgtggaatctctgggcttcttgatattagagcaattagaaaaagaagaaaaagtttctgttttgtggtaccaaatccccatttgccatgttaaaagtccggacatgcttttgtgatacttatgagcata

SEQ ID NO: 5898 - DNA, 1059 bp, Homo sapiens
acacacaaaaccacagcctcttcaattattaaaaacctctcaaggttgttgagaggattaaatgagctcatgcatgtaatagatttagtttattgccttatagaatgtagtcattcaataaatgttagctctcattgttatcatttattgattctgacttcattcaccaaatatataagaacttttaaccctgtgacaggaatgggcccatgtgtattcttcccatatttctaactctatacttggatctaattttgctcattgaaatagctctgaccctattttcggagtaatttcctgaatcacagatggtactctgacataggtcatatttaggacttattttcctttctttcttttccatccatggtgttgtctcagttttctttccatgcatttcacgccccctccccaccaccccattacaatataaacttattactctagaaggaaatattagaaacttttgtatagtgatatatttagctgtgctaagaccacctctgcagctatctactctctgagctgaataaaccaagggcttctcaaactctagtttacatatgaatcatctggggaatctccttcaatgcaggttctgattcagtaggtctggggaagggcctgagattttttttttttttttttttgagatggcgtcttgttttgtcacccaggctggagtgcagtggtacgatctcagctcactgcaacttctgccaccctggttcaagcgattctcctgcctccgcctctggagtagctgggattacaggtgcccaccaccacacctggctaatttttgtatttttagtagagatgtggggggtgggtttcaccatcttggccaggctggtcttgaactcctgacctcgtgatccacccacttcggcctcctaaagtgctgggattacaggcatgagccactgcgtccggctgggcctgagattcttaatttgtagttatctctcaggtgttcctgatgctgctggtctcctgaagaccattaaatagcaagggattaattgattctctccagtttcttcctcctttcctttt

SEQ ID NO: 5899 - DNA, 1080 bp, Homo sapiens
taagcacacacagctgtagaatataaaggctaagagcatggactgtggaatcagatgagcttgagtttcaagtttctgatatcttagtcatgttgcttaacatctttgaccttcaatttcccccgtaaatgagaataagaaggcccacctgaaactaacgttatgcaaaagacctgttgtaagcatgccctaaacaatggccattgcttctgtagttttaatattagtgttttggagacaaagtcaaatttaaaatgtgattcagaaggaattttagttgagatataatgggaaagtaggaaatactaattcagcattgttaagagcttactttgtgcaaggtactttattggcatgaattaatttgctcttctcaacaatcccatggtggtttcatggtgcctccaggcaggaattgttccatgtgctctgtacagaggaggagactcagtgcaaacacatcaagtgactcatcccaaggcttgctggtccaagacgtctggctctagggctctgacactatactacatgataatcaacagcaggaacataggggaaaattggaggaaattgggctttgtgaagaccttcagatcattcatatgcccagttcttctcaaactgtagtacgtataaacatctcttgggttccatttgttgcagtgaagactcctaggcccatctccaaagattctggcttaataggtaggcttggggaatttgggaccaggaaatttgctataactccttgagaagtagctttctaggtatatactgcaagaagggtgactatatgcattcatttcttagttctgctggaacacatcgccacaaactgggtggcttcaagcaacagaaatttatttactcccagctctgtagactagaagttcgaattcaaggtgtcagcagagccatgctctttctgaaaaccctaggagaggagcttcccttgcctctttctagcttctggtggttgctggcaaccttaaccattccatgacttggacttgcattccaatctttgccttcattttcacatggttgtcttttctctgtgagtatgtgtgtctaaattcc

SEQ ID NO: 5900 - DNA, 1035 bp, Homo sapiens
cttttggaaagaaaatctgccagaacattcatgctacccagagagaagtatcattctccattctcctcaaaattgtatcttctttgctttgattctcatacgcctgctatcagagattttggaaagtttctcttctctttattgtaaaagatctcaggtataattcaaatggttatttcattttatagaaactttactggaaatgtccaagtgccttcagcagtggaaggaggggtcaggagagggtggctccactgggaagcatgattggcctctgatttgtgggaattttccagggccattgtttgtgcgaagttgtgttaagaatgtaggttgaaaggtagatgtggaattccatggagcacgtgcagaaaagcgaattctactacccagcgtaaatcattcgctctacattaagcatctttgccaattatttgggtgaggccattaatggcatctcactcagatttgcacagggcaagatgctgtgaggattgcttattatgttggaaaacagaatcaagatcccaaaagattatgatgggcaagagtagtgatttataaccctatttcagacaatgctttccttttcataccagatatttcctaatgctccctcactatgctgaaattaaattcatcaataatataacccatctgcacacataattgtgtgtatctatgcatatatatatatgtggtatcctaactataatataaacaaaagataggggaacatgtatcatgaaataatacttgctttagtaagtgcttgaactgtccaagttggagatgattgctggaaaagggctacacagtaagttgaactgaagatgtgaagtgcttgttcctaatcctgaaatcatttgatgtaacaactgaaaacaaatactagtactgatgtgttttacaggttactctggtgccactggtggtgtttgtatcaagtgactcagttttccaaagtgatgaacatctctctgtaaagtttttaacaaaataaagtactctctttccttaatttacatttttgtt

SEQ ID NO: 5901 - DNA, 1091 bp, Homo sapiens
ttatattatttcatttcattaattctaaccataacccagtgaagaaggtattattatcctttctttttttttttttttttttggaatcttgctctgttgccaggctggagtgcagtggcgcgatctcggctcactggaaactccacctcccagggtcaagcgattctcctgcctcagcctcccgagtagctgggactacaagtgtttgccaccacacccagctaatttttgtatttttagtagagatgagattttaccatgttggccagtagggtcgcaatctcctgacctcatgatctgccccctttgggctcccaaagtgctgggattacatgtgtgagccaccgtgcctggcctattatccccatttttaagaccaaaaaaactgaggctcaaattaatccagtgacttgctcaaggtgctatagcatcttgagttacatgagagttcactctcttcatgtaacgtccccagtccccagccaatcccgactaaattattctttctgctgtttaggatactgcttaagtacatctcctctaaaaagccttccatgatcccccagcacttcctgggaatccctcttatgtgctcctgtagcaccctttatttatccatcatccaaagtagcacttggaatcaatattgtatttttacaatatcttattttgtaaaatttttttacaaattttccgtttacaagcctgtcttctcaattccacttgcaaacaacttgagaagtatcatatcttcattctcactgactccccttttagtgtacctgccacagagaagattttcaaaaatcatttattgaatgagaaagttaaataattaaaaccttgtttgaatgaaaataagataatgtatgtgaaagtgctttgtaacacttatgtgtatgagattttcttagtcaaatcactaggtacaaaatgttatattaggatatagtttcaaacattcaaagagtttaccttctagtccaatagacactttactgatatgacccagttataaaacagttgcactgacttcaaattttttcctggggctctattaatctgtgatctcctacaatctttacattggg

SEQ ID NO: 5902 - DNA, 1038 bp, Homo sapiens
tataataaagatggactaacagtaatcaaaacaatgtggtactggcataaagacagacatatagtctgatagaatagattagggaggccggaaataaataagatgtatgatcagttgacttttgacaaggctaccaagaccattcaatggggaaaggacaatcttttcaaacaaatggtggtaggaaaattggatatccacatgccaaacaaggaagttgggtccttacctaacaccatatacaaaaattaactcaaaatggatcaaaggcctaaatgtaaggcctaaaaccataaggctcttagaataaaacatatggggaaagcttcaaaacactggatttggtaatggtttcttgaggatgacacaaaataggcaacaaaagaaaaaaaatagacaaattggacttcatgaaaattaaaaaaaattgtgtctcaaaagacaatatcaacaaagtaaaaaaaccccacagaatgggagaaaatatttgcaaatcatatatatgaaaaggaattaatatccagaatatgtagagaactcctgaaactaagcaacaaaacaaaacaaaaaaaaactcaatttaaaaatgggcaaaggaaatgaatagaaatttttttaaagaagatatataaatgaccaataagcatataaaaaatgctaaacatcactagccattagggaaatacaaatcaaaactatgagatgctacttcacacccattaaaatggctactataaagaaaaaacccagaaaatagcaagttttggcaaggatatggaaaaattggaagtcttgtgtgttgttgctgggaatgtaaaatggaacagccgctaaggaaaatagtatgatggtttctcaaaaaattaaaaatagaattaccatacgagctaactattctacttttacatgctaggctaattatttttattttttattttttgatggagacagggttttgccatgttgccgaggctaatcttgaactcctgagtttaagcagtccacttgcctcagtggattgagattacaggcatgttg

SEQ ID NO: 5903 - DNA, 1047 bp, Homo sapiens
tgtctgtgtgtatgtttatgtaagttaaaacagtgaagatccccataaaaatgtgcattttattgtggagagtttaatgtgttgaatcgagaccagagttatcaaatatggtacactctttaatcagattagtttgcaggttcctggaaaagtagattaattttgatatagaagaaagaaaatcaagtccaaagcaatttcatgagaacagcatcactgcagggttagacagagctcctaaaggaatctcatacggccaaagaatcccagggagtaaggtcctaatgacaaaccatacgtccgtaacaattttaccaaagaatagcccaccctcttgcttcccatagcatttctcagcaaatctaacttttgctagaacttgctaccaaatctaggaaactttcctatttgattattcagtgtgtctctccatcacaattatatcatcagttaataattctgacccatttttctaaaagacagcacaaattctttctagctagtcatgttggaaatctttcttcctcaacagatttggcagactgtgtggagtagataaaaggtagaatttttttcctcctaatctaattgcctacagatcttctatcaactaaaaataaaaagcctagttctttttttgttttgctttgtttttgaggtgaagtctcactcttgtcacccaggctggagtgcaatggtgcaatcttggttcactgcaacctctgccttccggattcaagtgattctcctgcctcggcctcctgagtagctggtattacaggcgcctgccaccacacctggctaatttttgtatttttagtagagatggggtttcaccatgttggccaggctggtctcgaactcctgacctcaggcaatccacctgcctcggcctcccaaagtgctgggattacaggtgtgagccactgcgcctgaccaagcctggttcttataatgggtatgaatcttattcgacaaactcaaatgtgcaagcaacacatctctttatttttataaaatcaattaatatctgaccttgagctcctg

SEQ ID NO: 5904 - DNA, 1055 bp, Homo sapiens
aaaaagaaggcttctaaatctaaattgggatcttcctcagtattggtcagaattaagtacttacaataatttctgttttttccatgagttcttaactatatgagtaatcactacggttttttttactgaggcccaaatcatagccaatgatggagagttaattatactgaaggacaatgtagacagaacagatttttctttcttctccctggtctgtatcacagggaggatctgtaccttcctcatatgaacataatgatagtagtcatgttcattaagcttgtactaagttctacgtacttgacctagatattatttcatttgatgtttataataacctatggcatagatactttttagatgaagaaatttagatgaagaaattgattaatcgaataatttgagaaaaaaatctacgtaactgtattagtttgttctcacactgctattgctataaagaaatacctgagactgggtaatttataaagaaaagagatttaattatctcaggctgtacaggaagcatggctgtggaggcctcaggaaacttacagttatggcagaaggtgaaggggaagcaggcacttcttacatagccagagcaggaggaagagagggaaacgggtaggtacgacacacttttaagcaaccagatcttgggataactcattcactatcaccagagcagcaccaaaggggatatccatccccatgatccagtcacctcccaccaggccccacctccaacattggaggttaccatttgacatgagatttgggcaggggacacagacccaaaccatatcagtaaccataaatcctgagctcctgtgtgccataccatggctcactttgggcactctcaagcccagctacccagttgattggaccagctggactgggtgcaggctaaaaacccctttttgttactaaccactcccttctaaacttgctccatagacttgttcttcctctttcctagatgaaatcttgtgcagatagtatacctttccagtcttgatcaatcacaataacagcctcattttaatccatta

SEQ ID NO: 5905 - DNA, 1050 bp, Homo sapiens
tgcagccacctctactctgtcgtcaggctgaaactgttccaggcatagctttagactcctcaggcaccacaagttctttaaactatggaagacatgggcaaaattatttgattctcataaattagatcttatcacttggcttgaaggaaggttatgggttgaattatgtcccttcaaattcatatttgcagtcctaacccccagtacctgagactgaaaccttatttggaaatagtcattgcagttataattagttcagttaagacaaggtcatgctggagtaggatgggcccctaatctaatatgactgatgtcctcataaaaagggggaaatttggacacagactgcacccagaaaatatgccatgtgaatataaaaacagagattggggtgatgtgtctacaagccaaagaacaccaaagattgacagcaaaccaccagaagctaggagagatgcatggaacaggctcctcctcccagctctcaaaaggacccaaccctgccaacaccttgattttggacttctagcctcctgaactgagagacaataaatttctattgtttaggccacccaccctgtagcactttgttataacagccctaggaagctaatacagaggggaataaacatcctgtgcccctctctcatgccctcatggggagaaatggaacagagactgccagataaattctttttcagtctctccaaattcaacctcttacattagctagaggtggacaatcagctaatactcacaaaacagattttaaaccactcccttcacaagtcctgcctggatgatcttgcacctcactttagaatgcaagggttcatggaacctagtgccaatcagccatcctagtttctttattcatgggaataagtgcaccaagtgagcactcttgactcatgctgccttgggtccaggctctgtgctgagatgtggcttaaattttatctcttttccctttttgtcttcttgagtcacagcagctagttgtggataacttcaggatactaaattaaaggtacatcttatcctagcagt

SEQ ID NO: 5906 - DNA, 1316 bp, Homo sapiens
caacaacaacaaaattacaataatctgcctaattttattgctgggagaagacagggaagagaagccaggaaaaaaaaattcagataacagaaaggaagaggcagagtggaaagacaaagaaattgtcagggaagaagaatgagaaaaataccaggagttcaagccaaggatggatttaagtttgttggctcaaataagtaagaagctcattagaagttcctactctagaggagtggcaaaaccaggcaggataatttttctttagaaacatgtctgatttcttttgttatttttgcagctatcatcattagatgtttgttcattcgagaatataaactcataatttaacatgttacctaaactaacttgccttactaaatttaattctgtgatccaaagcccaatctgtgtttatttttaataaaagttttatttaaaaataaccaatagcttagttaacagctgttctctcaaggaacacaagataacttccttccactccttttgtccatgggcagctctgtgtgaatggaaaggtaccaaataaagccattttgttatttctatcttggtgtcagatattaaatttgcagtgtaaggttacaaaaagcacaagctgccatttcactttgggcaaatttgcttcaaaataatagctaggaaaatgaagactcaacctttatggcaacaattcaataacagagaggtgatcaggtcacacgactgcaccaacattcatcactcagtgtgatcacacaggtattattcatttggcatcacagaaatgaagtcattataaccaagggctgtgtcatcagatcagcatctgctgctctagaaagaagctcctcatctttgcctaatggtttatatttgagaaaggtctcagtacccagagtttaacagtccatgtcattagcctgtaactattttttttagaaagtcacctcatccatttcctttattaccatatttctcatgccggaatgtcagaagtcataaaacttgtgatatcttgcaggacacattaggaaatgtgttggaatgtgctcattggattgattcagctctgggggaacaagtcctaataaaataacagtagacctcaaaaattaggttccagtcccaactctgacatgagcaagttgtacccatggatgagtcatttaaatttgttcttggtttgcttatttgagaacaaattagctccttttccatttcatccatttcttgtgaggatcaaatgaaatcgtggctttgatatgagtgcaaaacattacacgaatgtaggagtgtgtgctctggagttagattac

SEQ ID NO: 5907 - DNA, 1043 bp, Homo sapiens
tgcaaacaggaataataatgctgtttaattcatagggttatttgatgattatgtgaaatacatgctgaataaattttcattatccacgttgtaactaacaaaattaagtttcctcccccgacaactatagatcttagagcaggagacagcagcatatttttctcaacgttctgtcatttcataatttgttggtcataagaaacaaaggcagcattaaattgtcttgtggtctcggttgtagtgtcagggtaaaatcagttataggtcaataacctggctttattaacataacacctgggtgatacctgactggcaggtatttcctgcatgcctgcattccagtgctataacctgctcaaggacacagagcgctccttacttagctctgtagcctcagcacctagcgcaatcctttatacacagtaggcatctgatatatgtgaattgctcagatacattcttttttaaaaaatacttttagttaaaaatatacctttactaaattataaacttattacatgcacttgtggatcatttggaaacaacggagcttaaaaaaactacaagcttaaaaaattgaaatcacctataaccctattatctagcaataaccattaacattctcttatatgtctttctactgtttatccatgagtacatacctttatttatttatttatttatttattttcagaaagacaatcataaacactacttttggtagcctacttttaattcaataatatttaactcatatttgtccaggtaattacatagtcttctgaaacatatgatacaagttatcccatgtttattcttgaacatttcaatcgtatcccattttatgcctttgtattgaaatcactgtagttaagtactgacatgctccttgctgtccccttgcctctgccaatgtgcttccatactattgtgtgcttaacttactacagagcctacctatgtcattaggtttttctgttttttcctctttttctcctcatcagtcaacatcctccatgaaaaaagagaccctatgtattttt

SEQ ID NO: 5908 - DNA, 1053 bp, Homo sapiens
ccatatctgttattatttccaaaaaaaaaaaaaaaaaagaggagatgttgcatcacaagacttcagtcctccatgacagtcatcttcaggcaatccccaccactccctatcatccctggggccaagtttcagttggcattcagcattgtgcttgccatatttgttacagcagaaacaatattttctatcaaaaatgaaaaaaacaagatataccaagaaggtcaagagtatatatttttttataaaagtgaggaatattcttaggcatttactatacaaggaaagtataaaataacatgcttggcctgctttattgattgataatatctctgcggttcctgtagtcatgttagtttgtgaaccatgatctacagggcataaggaaggatgaaagagagttctctagagcctgaaatagccagaagtggcctgtgatattaatacttagttttcatagcacatagagccatctgctgtctttcagagttcatgcagccctgctattctttgtcgattcttgcatatcacttcaaaacctcattctttcccattatttctatatttttggactagaacactaacaagtcttccttcttcctttgttctttcctattttcctttcttcctgtctttctgtctgtctctctattttctttttccctttcttgctccctctttcttttacttcccctctctttcctccttcctctctccccctttctccctccctccctttcttccttgtgcttgtatagtattttaacaccattgttcaattactcttccatttaaatttgtatctattctacaaagagtataacaataataaagtaacccaaatcccactagcactgttttccatgttgtgggctagtttctctgattaattctttatcagtgtctcaagagtctgcaaaaaatcttcgtttatatgatttgagcttcaaatcaatggtgcaactacacccacttcccaaatggtattaagcttcatgtggatctttctgtgggaaaagttgctttccttacattagctgggaactactagtcttt

SEQ ID NO: 5909 - DNA, 1044 bp, Homo sapiens
tttgagtaaagctactgatttgggggaattattccctccatttatgtcactctttttcattcccctgcttttctgagaacaatattcatttattcacacttttctcctgtatagcttgtttaacttaatataagtgctaagttttctagatgggcacagttgcctgctaggttgatttaacttttaagctgaaaacaaccatatagaaagatatttaaatgactgtttttgctgctgcaactactactactgctactactaataaaaagttctatgttttgtgttatgtattttaccacctagtgacaccttcacagggtcttatgcccaacatataattactgattctagttggtatgggtttttgtgtattgtccatttcaatatatttaaggttttattttgtaataattcttgctttatgaacattaaaataaaatccgaaagtacccatatgcatggcatgggtattctaggttgcaaacattgtaataaattgtaggcttcataaaattagagctcaggtaagaataccacttccatttatggaagcgtgtggaaactccagtttccttgcttgtcattaaattcaggtcaatggaaattgtctgccaattgcttctcccatttcaatggattttatattttctacatattattttgttctccatcccaaaagaatagtcttctacatgttttctcttgaaaacactaacatattctatcatgtattttattttgtgataaggatatttaacataatatctatcctcttagcaaagttttaagtatacagttcagtattgtttactataggcactattctgcgcctctagacctctaggacatattcatattgcataactaaaaccttgtaccctttgactaataccttcctgttttcccctcccccaacccctggcaaccaccattgtactctctgcctctacacatctgactattttagattccttataaaagtgggatcacatagtattctcattctatgactgtcttatttcacttagcatagtgttctccagg

SEQ ID NO: 5910 - DNA, 1048 bp, Homo sapiens
acttaaataagctaagaatctacttcctttataattccccataatacactggcctgctatcacctagcgacatcttagatgaagaacaaacatcacttaactcacattgcaaagttgcacttctgtatataagccttcaaattagcacattcctaaggcttaagaaaaatcgattcaggatgataataccacaagtaaatattaaccctaactaacacatgtgggtagattaagtgatattaaaatactttgataaataaaaattgatacttaaaatgcaagttactattattggtaacagaaaaaagataaaggacttattgaattatgcttatttaaaatatattttgaagatggtttacagcaaaacgcatatgaattttatagtacaataaaaataaaagacaataagcacattttgtaaaattttattgtttctcaaaaatgattttagtgaatagatttatatttcttttaccagagttcaaattccaaccactagtattggactgtaggccttttatttcttttatgcaccaaagggagtaaatcaaatataaaatatggccaaagataatttttggaaaagaaaacatctcttggcaagaatttaacctggaattttcttattaataaatgaggagtgtgtttggtggactggattatgttgtgcaggctttcccatggaccaatgcccagtttgaatattctttttttgaatacataaacagatgtgcacaaattcttttttgccattttcattactcagaagctttaagaagaaagttgcccaaataaaatactgactgtggaaaaattatttagaatgcaaatatatctctttgttttatttttaactagatttagcccttactccatactccacattggattcagttagtaagcacaactttgtttcgtgtaaagaattaataaccaccccaatggtagagaatacatggctggtagagatcacttattaatctgaaatcagttttatcattgaatgcttcatcaataatatttctatgttcaatgtagaggcttt

SEQ ID NO: 5911 - DNA, 1121 bp, Homo sapiens
tggagtggctgatgcctccagcagattgacttgaaattcaacaaaaattcctgtcccctcattaaaaaaaaatcttaattcctttcatgtaccattgtagattctttagattattttattcattataatcttataaagccagaatctatatggtccagtctctcagtgcagggtcaaatagacaggtcaatatccaaatgttcattaaaaataattttgtttgtcaggagatcgagaccatcctggtgaacacggtgaaacccagtctctactaaaaatacaaaaaaaaaaaattagctgggagtggtggtggtcgcctatagtcccagctactcgggaggctgaggcaggagaatggcatgaacccaggggcagagcttgcagtgaggggagatcgtgccactgcagtccagcctgggtgactgagccagactccgtctcaaaaaaaaaatttctttggatttttaaaatgtcccaaaaggaggatacttacaaataccattttcttcttccagccccatgtgacaactgctctcctctctctccatcccatcttagtaaaaatcccaccattattctaagcccctgtgtctcctgttcctttcctccttttctttcctcttgattctacattacttatggacagactattggtccagctaaagtcctctcctcaaaaagtggtgggaagggaagactgagccaatcaaatcaagcatcaaacaatgaaaacctgtaagttcactagtttagcaaagattatcaggggaacaaaaggaaatatctggagccttgggctctgagatgagcctaaacaggcatgaaggggcagcagttgtgatgaaggcactcttaagatggagtgaggttatatataagggtgcccactcaatagcccttcaataattttcacttgttctccaagtagtactagatatgctatttgtgtttagctgggtttcagggaaggcaccttcaggaagaggagccctagctctgtgaatactggatatgctcagaaaagattctcagtaaaagagttaactttcttaaaaagttgtacctggttacacaggagcttgatctccctttactgttaaacgtgcagcagtttacaaaat

SEQ ID NO: 5912 - DNA, 1058 bp, Homo sapiens
tttttgttctatattaatttttctttccttttttgcctctactttaatgaatctattacttttaatatttcagttatccctccatcaatttgttatttatacaagttgtgcttctttaagtggttactctagagagtacaacatgtaatacatgctggcattagtaaaattagaggtaagtcattacatttattaatactcagacagtgaaatgacctaacaacattcaactctattagccccttactctcttttatattattgttgttagatgttattgttttatatagtaataatttatatacatttaccctcatatttgtcctttctatgatacttacattttctttaaatctttgtgctttcatgtggattcattttcttttaaaagatctgaagaatacattttattatctcctttagtgtgatcagtaggtaacaaattctctagtttttatttctctgaaagtatacctatttacctttattttcaaaggatatttttgtcaagtatagaattcttcgttgtcagattttttttcagccgtttgaggctaccattctattgtcttatggctttcactgcttcagttaaaaagctgttatcttattgttcctttgaaggttgcagatatttttgtctgtctgctcttaggagttttctgtttttcattgtaacagttttactgtgttatacctaggggtgtgtgtgtgtgtgtgtgtgtgtctgtattagtctgttctcatgctgctaataaagacatacctgagactgggtaatttataaaggaaagaggtttaatggactcacagttccacatgggtggagaggcctcacagtcatggtggaagacgaaggaagagcaaagggacctcttacatggcagcaggcaaaagagcatgtgcaggggaactcctctttctaaaaccatcagatcttgtgagacttattcagtatcatgagaatagcacgggaaaaacctacccccatgagtcaattacctcctaccaggtccctctcacaacacgggaattatgggagctacacttcaaaatga

SEQ ID NO: 5913 - DNA, 1410 bp, Homo sapiens
agtctctattgaaacaataaagataggtttaaaaaaatacaaataagctattaattttagctcatagtggtatttcagattttgacaatcaactcaaaatttttcttaaaaactttgaagcacagttttagagaaacattctgtttttctgatttttaacttgaaacaaaatttggcaaactttatacattattagaaaaatatgccaattgtttgcttgaatgatttcctatttttccttgttatgggtatgttgaaaaggatattaatagtgccgttcattaccagtaagttaatagaatacttcactcaagtacagctgcgtcatttaacaacagggatacatgctaagagacgtgcctttaggtaattttatcattgtgcaaacatcaaaaagtgtatttacacaaacctagatggtatatagcctattacacacccagactatatgatatagcgtattgctcccaagctacaaagctatatagcatgtgactgtactgaatactgtaggcaattgtaacatgatggtatttgtgtatctaaacatatctaaacatagaaaaggtacagtaaaaatatggtataaaagataaaaaaggtacaactatgtatagcagcttcattagaatcttacaagaccactgttgtatatgcggtctatcattgacagaaaagttattacatgatgcatgactgtacgttaataagagtcattttctaaattaggttattacaagtaactataaaagtggcaagcttccatttgcatcactatcgaaattttataattagagcttaattttttgaggatctgctaattaatgtcaaaaggaaaccagtgttatttacctgttatttttataatgattgtgttaaacaaagacacacggtgctcaatatggagtagaacatttggacagtagagggtgcaattgtacctttagttctgtattttagtcattagaaattagtatttaatggctgagagataaatttgaagaatgtactgtttgttgaagctgtacactatggaagtgtatttgaaataaaatgagtcatgtaaagaaggagtacaaatttctcttgtcatgtgatgctttgctttaccttgtacttttaaaaaatgaaacatttaaatctcaatcagaaactatttgctaaaaatattatttttaactgaataaagaatatattttctacatatagaaaggcatatcatatcaacatgacatttttctgttgtggagctttattaattttaattacatatgtttttcctcttgggaaatggtgcttccaaaaggattaggtatattgatgactgcctcatgagactcccagtttgtgagaggaaaaatctaattaaaaccactaaagataaatgatgcaatgccaagagggttttta

SEQ ID NO: 5914 - DNA, 1037 bp, Homo sapiens
ttatttattcaacgcaattagccagtatagtgagcgccttcctgttctaggtgttgatgaacaaaatagacataattctttgctttcatagtttacagtctaatgggagatgtatctatctaacaaatatttatgcaaatattagggttagtgttagggttagaatgcgtaatatataattatgcattgtgataaagtgcttttagaagggaaaacattatggggatgattctgaaggattatcagagagagtttttttagggaagaactgaagatttattgaataaatgactcaagagatgagaggcggtaatggggaagtgatagggctaggatttgaaggcagtgaaaggggttgagaataggtcttcacgggcaaaaagagaattcccattggaagctatgaaatgttaagacgtaattgcttaatgcttggagaacttaaagaactaaaggatcactgtaacactttggtaattaattactcatcaaatgctctaccttattttgatcccattgtagtccttccttgaacattttcacaacctaagcaataatcctgtgacccagtctaattttaaagggaggaaattgattatggatcaaatggcaaggctaatccttcctgtaggcaccaaatttgttatatgttcatggttttctgtcatgtcattggctgtggccacaggctgggcaaattgtggtttgaaaggggagatgtgagtagttgacagtactgtttgtgggacgagaactgtgtgttcttgtctcagatattgctgtgtatgtagatagcaataggggatttcacaaatggagaaaatgcttgtactttctattaaattgtctaactgacttttaaagtattaaatgccatgaatactcaggttcaacactgaaagtattagaagaaggaaggtttagttgttaaacaatgtatatatttaccatttatttacatggtatatacagtatgtaatattttatgtatttactgtatatttattttggaaattcataatacatactggaatgtt

SEQ ID NO: 5915 - DNA, 1031 bp, Homo sapiens
aaatagaccaaacatggaaacactgttatcttaggtaagttttagttctgtgactgctgagagaatattacttgctgttttctgatggagggtctaaccagtggaaactggaaaatgaaagtaagcaattttcactaagttctctatgttcctaacagcagcaattgcttttaatattccacaaataaacattgtgaagatttccctgttattttttccacttaaaagttgtagtcaacatagatgattttctaaagaaactagatgattagaattttggctgtattataatctggggaaaaattagatgaattttccataatgactctctacattaactctttgagtaaaaaatttgtatgtaatacagtgactctagacagacactattttgtgctaatatcaaaaaagtgtgaaatttcctattgtacatttatttatatggtgcattgaaactatatgatactttagatattgctgctttgggtaacttcttcattatataggtgtttgaacatttgtcttttaagtttaaatctggaacactaatatttattctttacctaccagattaaatgcctgtgctttcaataatgaatttttaaaaatccagtctagaccatgaaggaattactgaatcttctctaaaaacctacattaggcaaggccaatgataatgttgtagttagttacaaatacatagtgaatgtatgcatctcctgggccccagcctggggcttctacccttgtttcaagaataatacgtggcaatatcttggccctggaatgatatccatttgctttactagcctactatttcatttgcctgtcgttagaaaagtggatttctggatttccatctcatgatgattatagaaaagtcacaatttgaagattccttaatttgaagctaggtgatatttacatgcccattaagttaatgagagtggagatctccatgtatttccctactatgtctttttgcctgcaaagccccctctcccttgaatcactgacattctcacaatgta

SEQ ID NO: 5916 - DNA, 2065 bp, Homo sapiens
aggatgattgctttcctaaaacatattaacacaaagtaatgtataagtgggtttgtaatgtgcctaaaataataggtattatcattacagatcttccttggttttacttttctatcagtaatgtggaaagcaaaatttgaaaatatttataaactagagaagctcagatattttgaattgaatagggtgaccaactctcctggtttgcccgagactggaagattcttagaacttttagttttaaagacaggacaatttcaagcaattttaggattagtacaatctctggcaaatgggttcaagttacttaccctgagccagaatgtaatcttgttgaaataaagacaggactgttttgtgaaaaggaactttttgaaaaccttgttgctgctctttcaggattttccaaatttgtcctcttcacctccctgacccctaagtcaagcaagttgatgttaaagacactcttctctctctggatacagaataggacagtagcaacacttataagttctgcagaaagtaatgaggggtaggggcctcagctctacatcacctagtctggatatgaagccagtctttgccattgattaggtgaatgattctgtgactccattttctctaatattaatagaatattaataatattgaacttatagggttgtatgaacaatacctatcatgcattaagaagtcaaggaagttagttaattttttgtgatcttgattatgattagcaacttagaacagaccgtcatgtctgccagtaatagctttaaaatctagattcctaggaggacttgttacttttagcaatcttctgccagaggaagcttctgtctcctgaaaggctcagctatatatttgtttgtttattttttcccattcaagatatacacatgaaatgacagaagaaaatttcaaaacttaagattcttccaggaaatacagtgtcagtggaatggataagtggataaaattagcacagttcttttgggctaattatgtttttagtgaaggatgacaaattctacagatttatttttgaatagccagtattataataaagctactttattggaatagctcattaaatgattctgagaatccattaaggaaggcatgtcagtttttattctcaattatgaggattgggtgcaagactaaagagcatgttggagttcaacaggccacagtttggtctggctaccagtagaactttgcttctattaaagttatgaaaaaggaagactgctgaaaaacaggttgtgagttgtttctggaattctagagtatgaagtcagttccttcaaaattgcattgttctaactgttagcatctaatgtcaaagcttcatctcagataggcagtggggcagggctcagatcaagccattctcctctactctatccctgaaggaatctgaggtagacacttcctaattagcagaaagtagacttgtgcctgatctttgatcttgtaatttagccaattaagtttactacatgacacttagtaaagataatttgtctgttaagacgtaattgcaggactttgatttttcacatagggtttatttccagcatttactaagtacaacgcagaagatgtttaagaaaatattggaaacactcaaaaggttgagatggaaacctggtcgctcaagatctaaacagctggtcaaaagcatcattgaaaaacatacttaaaatatttatttttactttaaaaatgaaagagaaaaggctagaatcctggattttgcatatgaaattataaagcatttaaggggaagtcaatttaaaaaaataacacagcctgagataactaaatatattctattccttgaacaccttttaaagtcaattgtaaaagtcatgtcttttcagctttttactctatttgtgtttgttataacagattcctgactctcaatatcagattcatcctggaacagattttatatcatgagatgtaaatttaaaatgaaaatgtaatgtgtatacatcctatagttgcatttagatatgccagcttaaatactgataagtatttacataattta

SEQ ID NO: 5917 - DNA, 1088 bp, Homo sapiens
gcaaattggaatctgtattccactgctaccaaataactccttgagaatgtaaaactactaaactatatttggaaataaactgagcaaataaacccttaaaatgaaaaacaaaacctaagcattcattatgtgagatcagatagcctgttgattgcctatatagaatagttcttatggacttaagtaattttatttcatgaagtttcattcctgaaattgattctatatcatgttagaacattcagtctctgaaattttgatctaaaccccttatcttttgaaaatattcccaaatcttttccattttcatgtcacagggtttcagtcatttcagttggattatatagacttgagttcctaaaagtggttagtgtctttgtatttttgtaagctgttgctttcactccatgttctattttgtttcctttctttttcctttgttgttgttgttgagacagagtctcactctgtcacccaggatggagtgcagtggcacgatcttggctcactgtaacctccgcctccagggttcaagcaactctcccatcgcagcctcctgagtggctgggattacaggcacgtgccaccaatgcctggctattttttttttttttttttttttttagtagagatggggtttcgccattttggccaggctgatcttgaactcctgaactcaggttatcagcccacctgggcctccaaaagtgctgagattacagatgtgagccaccacacctggcccctgtttcactttttcattgcgaagtactttggaggagttgaggataaaaatatttatttatatttatttatttatttatttatttatttatttatttatttattgagacggagtctcgctctatcgcccaggctggagtgcagtggtgccatctcagctcactgcaagctctgcctcccgggttcacaccattctcttgcctcagcctcctgagtagctgggactacaggcgccagccaccacgcccggctaatttttttgtattttcagtagagacggggtttcacagtgttaccaggatggtcttgatctcctgacctcatgatccgcctgccttggcctc

SEQ ID NO: 5918 - DNA, 1031 bp, Homo sapiens
aagacttccaggggaaatgagaattcctaaaccctgtggtcagacctcactgctgcccctattgccagctctgtgtgtctttcctgccctctgtccccttagatccttgttacaaagtcctcaaggtgttgctaatggtctctgctaggagcctatttacatttgtaatttaatcattaccttctcaggtgaggatcagccaatatagcactttatataagcaatgaaaatagctaatataattgcaaatactttttgataaaaataatcttagaatcggagtcagcaaggagcttttctgtcttttccccactcctaaaatatgaaaatgtattcagctgacagatagtatgttaaaacagaatagatgtaataaggctacccggaggattggggacattaattatgcagggaagttaatcataagtaaagtaaacactttcattatgaatccagcttcatggagtgcatttggttattgcgcgtaattggggagggataagaggaattagaaacaatgaaaaacatgaccaaaaacatgtgtttaattattatgacttagcagttagaagcagaatgataggcagaagttggtggtaggacactgggaaaatatctgtgtctttgcattcttttattccaacctatgaaaggatgggagttcatataaaaagaagaaattagtgacaatttactaccaagatatactactttcacctgcatcaaaaataaaataatgttaattacttttgcctttctaaagatcataaatgtaaattaaacttcagatttgctttaagatagatgtaatttaattcacttctacatagaggtggagagaaaataatgtaagctatttacttatgctttggctgggcataaaacatgagtaaataccttacattatttttatgtgattataatatgcatcaaaaaacagatctaatgttattgaccttctaatatttagtgtcattttctcacttttagaccctacctactgttaagaagtaacattgtacttctttgaa

SEQ ID NO: 5919 - DNA, 1025 bp, Homo sapiens
cttttagagactagcgtgccttagtataatgatagttctttcaataatactgtattgctactatattcaattttggtttgctgttttgttttgttttgagacatggtctcactctagtgaccaggatagtgtgcagtggtgcgatcttggttcactgcaacctccgcctcccgggatcaagcggtcctcctgcctcagcctcccaagtagctggaattacaggtgcatggcactacatctggctaatttttgtagtttttgtagagacaaggtcttactgtgttacttaggctggtcttgaacccctgagctcaaacgatccaccagccttggcctccaaaagtgctaggattacaggggtgagccactgtatccaacctctatattcaaatttttattaaacacaactacatatacctaaagcatttctagctgattcatacatagaaagttttcctcatcttgtacttgagtattttgtttgtttttagtttaaaatttttaagtagcttcggcttgttcctcttgaatcaaatttccattttgaagaaacattacctcaattttccaatggtttacttcctcactgatttccctcttttcccttaaatattaatgtctttaatagaaatttttggaaagtttatcaatgctttctgattctttattctggcagttaataaaaatttctatggattggttttcagttttttttttttttttggttcaatcatttaccaaatatttgttaaggaactaatatagggtaagactatagtatatgtgtcttcttctcgctcacatagcatttaatatctgaaaatcagtggttgtaggttatatgctaaaaaagacactcctttgtttcttccaacatggattggacccagcattcctaggttgggattgggcttccatttctcagtgtttgggtttgtggtgccgtgtacattttttccatatccatcagagtttgaatttctatgttttgactgttattggttaacaactacttcccccagaaa

SEQ ID NO: 5920 - DNA, 1046 bp, Homo sapiens
tcaggttaacaggcaggaagtgtcaagcttcaggagctcctgatcctgactgaagcaaagccagtatctttgggagtgacttcatgtagatgaacttgatagcatacctactaggtatgaataaatgtattgagaggaaagcgtctggagtaagtacatacacaactaattacctaaaacagaaatgaacacaaaaacaacagctgctaacaatcagaaaacaaaatgctcttcagaaaaggacaattactcataatgtactgcatggattggctatgaaggacatttatagagtcataacaatgtgagcattcagtaatgatctcaccacatttgatatttcatagaactgggaggaagacatagatgggaagtctgtgtgtttgtttgtgtgtatatgaatgtgtgtgtagtaggagtggcaggaaggggaaagagggctgaatcattttcttctatagtagcaagtaaatagataattcctaaacagaaaacaaacagtagcaatataaatatgttagtcagatataggagacagaaaaaaaaatcatcccccacaattaaaagtggttatttctagggtgcagaatttgggtccagagtgggaaactgctgttgtaacaagccttatggaatggtttgactctttgtacaatcttcacatataactttgctaaaaacaaaacccaaattaaactgtatattgtgatactgaaaggcattactgacaaaatgcgtgacaagagatagttgtatataagatgtaagtacgttaagacactgagaggaagtggaaagcctttggaacatatttttgatgcttctgaataaagctgcagtctttccttttttcttgagatggagtttcactctgtagcccaggctggagtgcagtggtgcgatctctgctcactgccacctccacctcctaggttcaagtgattcttgtgcctcagcctctggagtagctgtgattacagggggcgctaccacacctggctaatttttatttttattttatttatttatttatttatttatttatt

SEQ ID NO: 5921 - DNA, 1040 bp, Homo sapiens
tagaatctaacaaaattaaaaaaaaaaagataattcttcattatccccactggtgtacatcccatgaatgtgagattggtttaccatttgaaagtaaatcaatgtaatttaccaaattaaccagcaaaaacaagcaaaacaaaaacaaaaacaaatcaaaaacactatatgatcatctccattggcacagaaaaggcattggacttaagccagtacccattcctgctgaaagctctccacaggaatagaagggaacactcttaacttcataaagggcagttacaaaacccccacagctaacatcatacttaatggtgggcgattgaatatttttcccctaagatcaggagcaaatgaggatgcctctctttccacttcagttcaacattgtactggagcttctagctaatgtgataggcaagaataaaaagtatatttatattggaaaggatggagtataaatagctttttttcaggcaatattatcatctaagtagaaattcagattgattatatagaaaagctactagaactgggaaatgagtttagtaagatgcaggatactacatcaatatgcaaaatgtatttctctatatacactcagaaattgaaatatatctcttacaatatcataaaaatataaaacacttagtgataagtgtgacaaaagttgtaaaaaacctgtaaactggaaactacagatcattaatgaaataaattagagaaaaataagtaaatggaaatataaaatacattcatgtgccattcatagtattgttgtcaattcttcagaaaattgatctatagttttagggcaatcccaataaaaaaccaaggaggcatatttgtagaaattgatagactaattttaaaattcacatggaaatgcaaaggacttcaaaataaccaaaaaatgtttaaaaagaagaaaaaaggtggaggactaacaccacttaaggtttattataaaccttcaagagcatagctgtgtggtgttggcataaatataggcaaatagaataatggaacaaaatagagag

SEQ ID NO: 5922 - DNA, 1310 bp, Homo sapiens
aaaaaaaaaaaaaattactggaggctctgagactgggtaatttatagagaaaagaagtttaagtggccaaggttctgcaggctgtacagaaaacatggtggcatatgcttctggggaggcctcaggaagcttacaatcatagcagaaggtgaagtggaggcaggcacttcacgtggtgaaagcaggcgcgagagagtgaagggagggaggtgtcatgtacttttaacgggccagacctcagaaaaaatcactcgctattgtgaggacagcaccaagagaatggtgctacagcattcatgagaaatccacctccatgatccaatcacctcctttcgggccccacctccaatactggagattagaattcaacatgagattggatggggacagagatccaaacactatcatgctcttttcatccgcattcctcagagaagatatgatctgggggtcaatctacttttgatcagaacctgatcaagctactatccttaattcttaatttccaagtacttctttttctctgattatcttttcttcattgtgttttcttagacttttgtcagcacactgtcctttggatattctcttttgtggacccaaatttgacgtaattattatttttattgatgatgttatttcaaatcatttcttgaccctgaaatactatgtgtgtgggggtgtggagtgggaggatggagagggtctttttctttccctttcaccttatagaagtgaccttgattacctatttacgttgaggagaatgaggatttaggaaagttgacccatgtttgtgggtgtgggacttgatagcgtgggagggagataactcacatgattttgatccctaaaggccagaatgctgaaggttttgttctaatttgctgatgtgtagttgtgtcttcattggaagcagtcatatatgaagcttttatgtatgaaagatcttatgtatgaaatttgttcttagattgacagtattacttcaccatgtaaaacaagcatggctttagccctaattgttctataatccttttgtttgcttacaaaaaaacggggaaactccaaacgggctgaatgaaagacttgagttaatttgctctttagttacccatccagtttgcatatccttgccctccctgaactcttgggcaaaactactcagaaatagcctattattgtgctcatctgtagttctaccacaaagatgctctcctttgagttgacatatgacctgcaatgttctaagtgctttatgtattttaccttgtttaattttcatatcaaccctgagtcaacttagacat

SEQ ID NO: 5923 - DNA, 1081 bp, Homo sapiens
agaatgggagaaaatttttgcaatctatccatccaacaaaggtctagtatctagaatctacaaggaactgtaatttacaagaacaacaacaacaacaacatcaaaaagtgggcaaaggatatgaatagacacttctcaaaagaagacatatttgttgccaagaaacatatgaaaaaagctcaacatcactgatcattagagaaatgcaaatcaaaaccataatgagataccatctcacaccagccagaatggagattattaaaaagtcaagaaacaatagatgctggcgaggctgtggagaaataggaacacttttacactgttggtaggaatgtaaattggttcaaccattgtggaagactgtgtggtgattcctcaagaatctagaaccagcaataccatttgaccaagcaatctcatcactgggtatatacccaaaggaatatacatcattctactgtaaagacaaatgcacacatatgtttattgcagcactattcacaatagcaaagacatggaactaacccaaatgcccaccaaggatagactggataaagaaaatgtggtacatatacaccatagaatgctatgcagccataaaaaggaatgagttcatgccctttgcagggacatagatgaagctggaagccattatcctcagcaacctaacacaggaacagaaaaccaaacaccacatgttctcactcataagtgggagttgaacaatgagaacacatggactcagggagggaaatatcacacaccgaagcctgttcaggggtggggggcaagggaagggagagcattaggacaaatgtttaacacatgcagggcttaaaacctagatgacaggttgataggtgcagcaaaccaccatggcacatgtatacctaagtaacaaacctccatgtttggggcatgtatcccagaacttaaagtaaaataaaaagttaagaaaaattaaaatgcaaaaaggcgattaacattttttctttgctttaagaaatgagaggtttttgtgatacttaaaaaaaatccggatagacttaggaatataaatatatcaattcgctatctaatt

SEQ ID NO: 5924 - DNA, 1069 bp, Homo sapiens
actgagttatttgagtttcttatttattttgggtattaaaccctggtcatgtgtataggaggcaaatatttcttccattctataggttgtgtcttcattcttttgattgtttccttaactgtaaagaggctttttttgatgtaatcatatttgtctatttttgtttttgctgcctgcgattttgaggttttatccaaaaaatccttgcctggatcagtgtcatgaaatatttcccctatgttttcctctagtagcttcatagtttttggtcttgcatttaagtctttaatccattttgagttgatttttgtttatgatgagagataagggtctaatttcattcttctgcaaaagtgtaacattcctacctttgaaaaattagagataaatgagtggaacatttgcttttggatttttataagtggaataatttattcaaattgtcagtgaaattaaatattgtgggcttagaagtcaaacagatttatctttaaatcctgactctacctgtcacttactattgtgcaacattggacaatttatgtaattctctgagttctactatggcaaacttagagagtcaaaaatgaatcttaaatgagggaaggctctttgtacattgtggaacacagaataactacttaataattatgaatagtggtaataataaatattaatagtagtaatactactactataataatgactaatgttattgtcagtattgggttaatttttcactttggttaagaagcttggtaaccacagagcttttatgactaggagcatgattgtttgttttaaacttttagttattttcaaaattaatataaacaccatctcacttaaggcagactgtaaatgtctaatgtattaaagccttacgcaaaacaatggttggaggtaaaactgaactgagtatgtcagagtagaaaatctgccttgtgagacatgtaggacattgtaatgaagcgaaatttggctccaattttctggaattaagtgaattgagtaaagtagccaagtcaccattatcagtcaagagaaagtgtacactttgggataaggg

SEQ ID NO: 5925 - DNA, 1028 bp, Homo sapiens
tcttttataaatataaacagtagtaatagtatttgttctggaatgttgaaattttattcatgtttattcttaaactaaattacaaactttaaagtatgtatccattggttttctagcaatctttgtgattaagaaaaagtctaaagcaaaatggacttgtatgattttgttggttggttggttggtaggtcacttattcattaaatgatagaatacttaaaaaaaattcttagtgcctttttttttttttttttgttttgctgccatggacatactttgttctccagtcttccagaaaattattggattcctaacaagaaaatacatttgtggtgtgccagagcactctatggcgctgctaaacctcacaaactatgaaagagcttgtcagatgtgccagtaaatcttccctctcttgccataggtccaaggatcttataaaggaagctatccttgacaatgactttatgaagaacttggagctgtcgcagatccaggagattgtggattgtatgtacccggtggagtatggcaaggacagttgcatcatcaaagaaggagacgtggggtcactggtgtatgtcatggaaggtacggtttgtaactccaatcctctgacattcaaatattcttttttcatcttatcagctgcacacagatggcaatgcattacatggaaaattccatttttccttcttttattgagaaattagtttgagaagagttgaaacactacttagataaagtggttaactaattatgggaagtgtttgtatttagagtattaatatgagaatccagtattttttcagacatggaaaagttaaaaatgtgaaaaaagaaatatagtttattacactgaatattcttcatgcagtcaggtcactgagcaaacatacaaagcttcagcagaagctcaagatcactggaagtatttttggccgataatttaagcatcttcaactctccccttaacttttaatatgtgactagttttcctgctatgaagcttctgtaaaaagaaaatg

SEQ ID NO: 5926 - DNA, 1071 bp, Homo sapiens
taacttgttttgttttattcatttaattgatatacaatagttgtaagtagtcatgtagacatggtggtgttttgatacatagaatgtatagtgaacatatcagggtaattggcatatccatcatctcaaacatttttcattttctttgtgttgggaacattcaatatcctccttgtagctctttggaagtacataatatattatcattgtctgtactcatcctacaatcctacagaatactagaacttaccaatttttttcatgaggtgtttgttaatgataataacttttgttagttaattatatgccatgtactgtttagtcactttctaggtcttaaatttttaattctcataatgacattaagaggtaggcattctgttatctacatgttaataaatggtaaactgatgcctggagaagttaataacttggtcaagactatgcaatcagtatgttgaaatacacgtcttagccttggagtccccatgcctaaggaatgtgcggtgctaacttttgaagtacagattagaagtactgttgttacaagtttattatgtatattcaaacttgaggagcccataaaagatgcatagctttaaaccatgagattaaaaaatgatctgactatttgcaagaaataaaacttgaacagcaatagttcaaaaagaaaaaaaattcaagatatttcctataagtacttcttaggcctctctgcatcctttgaatattaaacttcatactgacctctctgtagatcatctggcatccattcctcttctcttattagttccttttttcttattgaaagaatggctatgatttggcttaattcttggtccacctctgtgtccttatggtttagaattaaattccaccatgtaccttggaggccttattttctatctgcaatcaatagcattgattttgtttttctcacaggtttcatttttatttttattttttaagaaggaacaattctttcaagttattacacaaatgactcttttaatggagcatttgtatactaactctaagtgttatgtgattattcacatctactctcaaaag

SEQ ID NO: 5927 - DNA, 1043 bp, Homo sapiens
aaaatttacttcaaccatcattacataactgttgaagagtttgcatgctgaacacttcacacaatctacaattgttatgtgttcattttaaaaaacacatagatatatttcttcagggactttaacatgattttcagtgatttctttgtggagctggatagactaatgcttttaatatccatccctctaatgagaaagccttgaatgtttagtaattgttttggcacactctccaagggcaggacagataggagccacttcccagcacaggggagcttactggtgtggctaccatggcaacagcctaccccacccccaccacagagaacatccgaattggtctctgaagttcttatttgaattctcccatgtctccacatttgagaaacacaggctgtaattgcacctacttcatctgaatttaaccactgtagctttggaaggctgcagttttaatctgatctttatatttaggcccttctataaactcctttctgataaaatgaaaatatttttgtgctaaggctccaaaagtagtacacagagatttagaattatggtggatgacgtaaaatggtattaaaatcaatctgagaattcacactttatgtgtatttaaaataccaaggaattattattgagtatatagttacattaatgatttgtgtagaatcttttatttgtctaattcatccaactttactgaagtggatttttttccttgtatcacaaaacacccataagttattcataagaatatataggaggagatgcttttattttattttaaatgttattttattagttttgagacaggatctcactctttcccatgctggaattcagtggctggatcatagctcactgcaaccttgaactcctgtgtttaagaatcctcctgcctttgcctcttgagcagctgtgactacaggttcatgacaccatacccatctatttttttggattttttgtagaaatgggctctcactatgttacccaggctgttcttaaatttctggcctgaggtgattcccttgcctcag

SEQ ID NO: 5928 - DNA, 1032 bp, Homo sapiens
ttaatatcaaatagagtaaacatccatagaagtaacccacgtaatcaaaagcttcttaaggttttcactaatatttaatagcataaggaagtctggagactaagtttgagaaccatggccttaagccatatgacttgagggcatatatgaccatgtggttgtttgtttcagaaagtagaatgtgattagtttaaggttcaacatatcagatactgatgtttctcctccacatcacacatatctagaaccgtgttacaaaagaaatgtctcttaaatagtcttgataaattagaagcagaaaaatttctgtaaaggctaacatttaaatctagtgcaaatagccaacacagatcaacaataggcaagtcaattccattgaagtgcttattgttctgttaattacattccatttcacagtatgaaaggtatccttgatacattttgtgggttctgtttgtacactttctgatgttcaagatttgggaattggattggattccccaatgcttattctgagttagcgtcgcagaacattgaaattttatttttttgtagttagacttacagttctaaaggaataaaggaaaacagatattctttgaattcaaccagcattttggagagaggaaatggttttatactgtgcttatttttcacttaaaataatcttagaagatataacatttcatcttttgaagtctcagtacaataacttctctaataccataatgttttcaaattaaacaagataatacattactgtatacatggtcccagtgtagtactctctgtgtatatgtaaacctacattgtgagctaccgattggatgtctcttttaaagttttcttgctaagtaaatgtttgaaatgtctacatatttctcttgtgatgcattttgcaaagagctttttcatttgctagtacctttgcttgtttttgatatttcagcaccattagcattttcttgggataagttaaattttttaaaatgctgtttttacttctttttcttggaaaaacaactttcttct

SEQ ID NO: 5929 - DNA, 1723 bp, Homo sapiens
aaaaattagagaaactgtattcgggtttaacatttttaaacaaaaggggcataagctatataacatttaagaattaatcttggaataaagactattttgaagataaaatttaataataaaacaaattgttaagacaataaagtattttttagtaaggcaactgagagttgacacacagaacatattatgaatcttttggaaagcttggatttgtgctatcaatatgaaaggaaagtacctactttttaataatacaccattttgaaaattggccctgtctttttttccaagatcaattgatctatctgtatacctatgtctgtctatgtatgtatgtatgtatgtatgtatgtatgtatgtatgtatgtatgtatctatctatctatctatctatctatctatctatctatctatctatctgtgtatattttgttaggtcatcatatgtgtggaaaactgcacactattttccaaataccttcaatgggaatgcttgaacttctgtgcacatcttcaggcctaggtctttgaatcaaatatacattcttaatttactaatacaaagaattaaatgaagacatggatattaaggaacatttttagtctaatgtattctaagttccatgtgggtagaaaccttgttggtgttccccgatgcctagccctgagctgacacatggatggtgttttattcacttaacaaataattagcatttgaatcttacttgaatgccaaatatacttcttgacactacaactccacaaatgatttgcagtttatttcagggactacatctgctcgtttttaaaaacatatcacatacacaaaactttatttaattcttttcacatctagaattatcttcttataattataataaacaatacagcttttgaaaacatttaagcaggatgttattaagcatctggcttattttgaatattatctacctgttttccctctatgaaatttttattcatttaattgtaaaaactcacacatttagtttgttaaggtttctaaaacttctgttgaagtataataagccagagctttaaaaaattatttgtttgacctaacataatatcacttggaccatgtaaattttcaattaagatcattagagttgggcagtgtgtgtgtgtgtgtatttgtgtgtgtgtgtggtgtgtgtaaattctcaactttttaaagatagtgaggagattcacaaaactatgtgtaaaactgtcatcaatgtggaagtatatgtcattatgctcaagagataatttattgagctaatcttcatcctaaggaaataaaagaaaattagaaaaaactttgaatagaaatgtttagctttcgatgtcttctaatcacttgcctgtaactaaaatgaaacttaaacttttatcatgcatgacaagtgtattccttcaattcctcataccaaatgtatttctttctaaaaaatacccatccatatcataaaattactagatttaaaaggagctaaaaaaataatcaaatttttcttgaggtttgtatttaaaatcaggctgtatgtcataaaaaatttgaaagaactggatttcataaaaccttttactattgagagtgtttttccttatgcttaaactaatacaacctaaaactctatttttaaattaaattatttttattgttaaaaaatagagaactggttacgacttctgttcaattatctttgttctcaagaa

SEQ ID NO: 5930 - DNA, 1033 bp, Homo sapiens
gaaattctcagattacattccttcacaatcatacttaccatttgatataaagtctgcaatacatgtagaatggaaatgcagtggtttgaatcactgagcaaaatggatgaatttaaagtgaaaataagttgtaataaaaaccttatgtaagatctaagtaactctttggaagacactactaactacaaatgtaaatatttcaatttaattactttttttctgttaacaaactttgcttatttctgatatgactaagggtagtaaacagtggctgctatttgctctactctaaagactccaagcctttcaatgaccacatcacatcctctttttctgtttcctgaaactagcagaaaacttgacattaataaccaccactagtgtttgctgaatgaatggttgaatgaagtagatgttaacatgtccaaccaaataattgtgaattattgttattccaactctatggaaatggaatatcatatacaatgtatttaatttttattatagaaatcctaagactgacattaattcctgatgtatatgttatgcatatatatttatactataattaatttgggattaatgtattaaatttaacctaattaatgtgaatagtatcaatatgattacatttatatttaattatttttagaaattctgactgatattaattcctaatatatatgttatatgtatatacatatatactataaccatagtgcccacaaccatcaaaaatttactgtgtaagaaaagtaaaaaatgttgtaataagctaacattgctatattgctttaaaatgcaagtttaaaatcatttgcttgtatcatcattgagatatagtatcatttagattcacataaaatgaaatggcaagggaagacagttattttgaaaaagcaacactcaaatgtctgtctgctacacattcacagttgacaggagggagaaatgtttctacgtagatatattgagtgattaaaaaatatatttacatgttaaaaactggatattaaccttaagtctaaatatg

SEQ ID NO: 5931 - DNA, 1048 bp, Homo sapiens
tcctatttttcaacatgtttatactgtggtggaagttggcctgagacatatctcatatatcattagtctttgtaaaatacaaatttgctagaataagataattaattgaaaaaaatgacaagataacatatatgatgtaatgaaattattgatgatgtaactatagagaaaaaaagccttaaacatatcttccaaatacactgaccttctaataaccaatataacatttgtatgcataatattagtacactagactgaataagagagcttaatgcagtaaaatgaaaactgatgctctccatttttatattgttgaaatgtagtttttattatgtatgagcaaatatattttgttacttccataaagcacccagagaagctttcactacagcttcatgagatattgatgacttgcgcttaatgatgccaaatttcagtcaaccagggattatgaatatgtaaattggtgctcagaactcagttgtaaatactaagaggctactattatcaagaaatacatcaaaaagtaaattctttggactctgtagaacatgcactagctttatccagcatctatttcaagactagtcaagaagacatctcctgcatctaatgttttgctttcttaaaaagaagtttttaaaatggattatatagaatagtagctgcagacaaaacttaaatgaagctaaaagtgatgatttagagaaggttataggataatatgttgataggtcatagctaattatcggctttatccgtacatattcgtttaaagtggtcatctaactgatttgttcatatcttcttgtactttctgacagaatagaatatgacagttggaaagcgttagtagcctgaaacccgcagaaccactggaaggctgaaagtttttgattttattcagcacgctaatcatgtgataatagattggtcattcttcttgattcctccttcttaatcaggagttacggattatggacaaataacccttacctttcagtgctccagtccctcagacacctgttaccaaaaggtgttctaggtt

SEQ ID NO: 5932 - DNA, 1028 bp, Homo sapiens
tggattatgcctgagaatggatttagttgattttagagatatcatatcaacagttccaaaggccaacaggttcctgtatcccagggcagctatggtggtatccattttactgtagccacttccctttagcaatagatctttgcatcacgtttcagccaggtctgtttgtggccaaatacatggatgcaaaccctgtcatcctggtctggggcttactactgcccatatttataactgatagcatgtcacaggggttagagtgggtaatgagacccagcttgcctaggagtgcatgtgtgcaggcctccagtgggttatggcaggtaatatagatctagacaggtaatgggtcttaacaggattttaacaaaatctcaagtggcagatttgcatgcaagatccagcaaggctgtcaggtctagagtctataaggtctgatgtcagcatgcccagcaactttaaagtccaggggacaccactcagcttggattccaacagccttcaagaattgtcgaattcatacttaggcataagtctttttcttttagctttgttttatccttgctcctgggaatgggcagtcctggcatgaaagggttgaacctaggcccaatttcagtgggaaaaaagtagaatcacaataattctattgattttggacatatttaatattgattaaaaagaatgacttctggaaactatgttataagacaaaatctggtaagaaaaaaagactaataacagtttttctggtccttttacctccttaaagtgttgctagatggaaaggggctttttggtagaaatattcaagttattatcaagaaataaaataatagcacaaccaaaataataattatcctgctttgtatgtaatgacaatgccacccaaccctgcaggctctagtgaaatatgcagttagtgctgggttgtgggaaagcatagataaacagcgcaaaaagggattcattaccgagtgaagtgaatcattttgcttttccctgacataagctgttctgtgttgtac

SEQ ID NO: 5933 - DNA, 1362 bp, Homo sapiens
tttcctggaaaatgtgtaaaaggaacttttaaaactggttccacctgtaaataagggcaatgaagtaagtcccatttaatttgaaaaacttggctatttcttgagaacaggatacctgcaagaaaatataattttactacaaaatgacaacgttaaaatcttaagttgtaaaaatagactagagttatttaaaagttgaccttttttccttgtattggtttctctcagacattcagattttaccatgtatttgcttgtcttaccacccaaattcctgaatttgtttctgagtgtttggctgttaagtgaatagcttgggcaaaccaaattcaaattatttaggtagaaattagaataatttattttcatgcctcagtgatgggtctaaaatgtggcccatcattcttctaataaattatcaatattgtgaatttcctattacagttctacagacatttgttgtttctcagaacataaggctacaatgcctaaatatcatagctgatataaagtttagaatgaacaataggaattctctcctcttttatgaaaagattatttttttatgtgcttcagttccactaggatggttaaaattacccaaaacttgttagatcttgcttgttttgatttcttgaatatatttgacctatgagacaaaagttactctgctgatagggaagaaaattatgtaattaagctttcatttgtgtcatggttcttattggcacaatgctttcatgtttctgtcctctgttgctcctaagtttagtacaatgtgaatggaaaattaggagtatagaattttcctagttgatttagtctgaggctctaaacacttaatgccattttgtggcactatacgatgaacactgacaaggaaatgaagggatgactgagacagctgtgtttattggctgccctcagtcttgtctttataaaggatcttttagttataactgacctcagctagccatgggctattttttgatgacacagattctaaggagaatagcacacgtgagtaactttagaaatacatgaggcttttcatgtactttttccatcttgacaaacaactatataccacaattataggctactttatttcagagtctcttttacattaataaaaactaaacaaagtagtttttcaatgtctatcttatgtgatatataagatcatatatcatgtttaatgatcatgtatcatgttttcattaaacatgatatatgttcaagtatatttcccatgtgtcagctttttattttttcaagatacaattgcaacaaattgatgaataaaaccacgacaagaagatccttcagaaaacaactcgagacacagtcacattttaaaat

SEQ ID NO: 5934 - DNA, 1032 bp, Homo sapiens
ctcatagcaaactgaatttccaggttttaaaaaatatttccttagtcaaaataacttcttgctcttgaaagttttgagttttctgacttctataaaacaaacagaaacatatgttcttattaggaacaaagtaggtatataggtaagaaagacacagggaaccgaattaaagaaacagtaaggtttgtaggcagacatgcaggtattttagccattttgctttatggtactacaaaattcctatgagcaaataaggtggtggagaataaaactagttccctgtggcccatggagctcacccatattttgtttttaatattaaggctctaaaacccatatttataaacacaaaatgcagaagttgcataataaactcctgtgtcccagttgtttgtttattcattcaacaaatatttattgaatgcctattaaacacatggccccatttgaggacatagcctgaatcagatatcatttctgcatagttactaatatatctggaattaaattaaaatattatgaatgtagaattataattaaaaagagaacaagactaattatataaacaataaatgaatatgcatttagagcctaggtgttgaacactgtgctatatattttgtatttatttattagctcacgtcatccaaatgactctgtaagggtggcctactgtgcccattatgcagggagaaaactgaagattatagttgtggagtgccttacctaaggctacagaaataacaggcagggtccagattttaactcagatcttccgactctttgtccagtaacctactatacatgcgccttagaaatgtgaagtcaaagcagttggttatgtgtgtgagtggttatatgtgtgactaaacacttgagttcatacgtaacaacattgttgttgtcatatctatagtctagaagtagttcatcttttgttttttatatttcaacttttattagtaactgtacaactaattacatgattacttgtctgcaagtaaataataactaaataagtgagtaaaaaga

SEQ ID NO: 5935 - DNA, 1493 bp, Homo sapiens
taacttaaggaaaacagatgatatcttagctctccatttctttaagacttaagactatggttgttcgggtatacaatttattttatgtctcttagaaaattgtcataagtcttattttacttgaagaagataaatatgatgatagtaacagaacaatcagaagtggttattcttttatactaaatttcaactaatatctattaagtacttatggcatgccagaccctgtgatatgagctggagattccagttttatagagagatacagtgtttgtggatgactttatgtttaagtctgggttgggtagaacacattttccacttgagctgcagcaggattccaactgaaaacatacttcaatcttgtaaattctaagttctagtgtatacttgatgattgaagggaaaagaaagagaagggaggatccttgctataattatggtcaagaagtagaaaggagcaggagggatagtaggaaggagaggctatagattggtctttagtaggacaaggttggtgtttagcattattgcctttgcaggaggttaaaacctttctgtatcccagatgggagttagttttatcaactatgttgaaaactagtatatatgtgtatgtatgtgtgggggagagggaagaattgcatgtatttgaaggcttatatgaattagatttatttttatatacttttacaagtaatatgcacatatacattcaattctactatagcaaaacatgtacatttcttattaccaccatgttaggcaaaattgtacaaaaataatcacagtgcttataggaagaatgaaattagggacacaacactagaaacctttgtcagtgacagataataaagaaaggaacctaataaaaattgtaccaacttttatgcatgttaattgcttagaacatacataaatactacaataactgtgatactttaccttgaaaatgccttaagtttgataacagaagtgagcatgagaaatatttgggcttgtgaactgtgaagtaatagaagaaaaatgacctgaaattcagcagaaagtttaaacttcaggtgtggataggtgtgactcataacacactgaagcagatggtaaatatttgagttataaacatgtgtatattttttgtactcttaaacagctcagttcaagttggccactttctgcagatgaaattgtgcagaagcaaatataaaatttgttttatcctcaaattgtttcataatatatgaataacagtggaatgaatttgtgtttcataacaagcataatagtgtgtagagatatatttcccttctcttgcaaagtactcaacctgtcttgactttggcacttctgttctgcttgtgttctgattatttacacttatgccttttcctcaattaggtattaagcttttctagggcaaaggctgtctttggtatggctttaattggtacagtacctatttaagtgacttacccatttataaaaattattaacac

SEQ ID NO: 5936 - DNA, 1083 bp, Homo sapiens
tctgggcctggctttgtttcttcactgaatttcactgctcatctcaaggcagcctcctttgccagctctcttctttcaggtattggtaataattctctccctttgacgctttgggctagggctggtgacagctctgctgttacacatcctgggttacagtgctaaatcctgtgtctcccttatattctaccccaaattctgatgatagtcctttcctaaatgaacactcctcaagtgaccctaatgcaagagagctgtttcttcttggattctctacgtgttatttaacaatataagtcgggtaaaagaaagcctacaaaacactagggacatacaaaagaaagaaggatcgcctcttctgaatagtaagtatcaggacacacagctcaaagtggtggcatgtgggctaacacttgaaggatcagaaaatttatgaggtgaaaaatacgggaaaaagcatacagagtgggaggaaacacacttgccagaatcacagaggttgtaaattcaatagctagttctgggaatagttaaggatgtgtggttgaagcctaatatgtgtgaaaggaaaggatgggagacataaagatgacagcagcaaaactagtgtgtatcttttctaccaagatctctgtgcctagcacaaacatgatgttcaataacagtttgctaagaaaataggtaaatcaataaatacaaaagtagacaggaggcagattatgaagggtttgaatgctaaggaatttgtacttcacagctaaaatgatagagacatagaaaatgattttgaataggggcttgatgcattgtaatattcttcctttcagttatcagtacatttattgtctcccttaccagattgtaaccatgttgaaggcaggaaacaagtcttattgatctatatacccccattatctctgaatgaaaggattcatacattgttggcacccaaaatctgcttgctgaattattgcaagtataaattacatgcttggagttttcatagcatgtgcattttattttaaccatttttattagagcttttaaaatgaaaccatactgattttatctcaaacattgatt

SEQ ID NO: 5937 - DNA, 1030 bp, Homo sapiens
gacagatatacacacacacaaaaaaagacatagactcttctaaaggaatgcgtagtctaacagtggaatatgtttgtaaataatttcaactagaatatagagtgagttaaaagaaatacaagggtagtttatggggtttaaacaaagaaattcttcacatagattatggataagatgagaaatccttgaagtaagatgatttgagattcgtttgagaattgcaagtaggccactttgtctgggaaagaagtggaaggttatgatggagccataatgtggcatgccttgaaagctaggataaggtgtttatttttaatttgaaagcaatggaaagccattgagtattttttgagcatcacattgattctgttggaactgggcttctgaagatatatctggctgactatatagaataaatattagtggcagaaaatgagagttggagagaccagtaagaaagctaatagacaaacgagaaacaatgatgtcaacggggtgagatataaatgtgagggacattttaggagtagaactcataagacttggcaagttattgaatacagagggagagagagagagagagaacagtgtctcaaggatcttgggcctacttaaatggtcacttattaatgccttccccaaagtggaattgttgcactgaaggatatacgtattaaacattctgttataaaatgcacacactgagttttgtcccttttcaaacattggtgacaatttaatggcaggaatgatattgttattttcattcattctgaaaattatgaataaaaggaaacacattaatgtgttttgttgactatacccatcatggcattccttctgttatattttcgtctctccttgagtaaattcttgctctacatggtttgatgctgtgttatgaggaccatgatgacttatgacagtttgagacccattcagactattttctgactaaaaaccaagaggaaatggaattcccaaatggaattttctaggcaattgagggcacagctggatgtgctgcaat

SEQ ID NO: 5938 - DNA, 1031 bp, Homo sapiens
atctaggcttcatagcaatttccaccctgcctcctgacatttcgtatgacttttcacattttgtattgggtaatagggctttttttaaacttttatttcttgagatagagttttgctcgttgccctagctggagtgcagtggtacagtctcggctcactgccacctctgcctccagggttcaagtgattctcctgcctcagcctcctgagtagctgggactagaggcgctgccaccacactggcaaatttttgtatttttagtagagatggggtttcaccatgttggccaggctggtctcaagctcctggcctcaggtgatccacctgcctcagcctcccaaagtgctgggattacagggaattatagggttttatttttgcatttttaaaaacctgttagattataaatctagatttttctgtacccttctcacttaagtgagaattctctagtatacttgtaagggtatactaagtgagaaggataaacagcaaataggagactggtaaacatgtgtggatgggtggttaaattttctgcctgtaatgaaattacattcataatttacattcaaagtgttttaaacagaagcagcagggtaaacagtcaattttagtttttcaaagttctgttttctgacttttcttgtattcgttctggtgaaggtagcttacatgcttactttgtaattctgtttttaaacacatcataaactgtgaggggctacttgcctgtcaagaatggagccattaccggctgggcgcggtggttcacggctgtaatcccagcactttgggaggccgaggcgggtggatcacgaggtcaggagttcaagatcagcctggccaagatggtgaaaccccgtctctactaaaaatacaaaaaaaattagccaggcgtgggggtgggcgcctgtaatcccagctacttgggaggctgaggcatagaattgcttaaacccgggaggcggaggatgtagtgagccgagatcgctccactgcactccagcctgggtgacagagcaaaact

SEQ ID NO: 5939 - DNA, 1036 bp, Homo sapiens
atgtaaaagaacagaaattataacaaactgtctctcagaccacagtgcaatcaaactagaactcaggattaagaaactcactcaaaaccactcaactgcatggaaactgaacaacctgctcctgaatgactaccgggtacataacgaaatgaaggcagaaataaaggtgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaggaactagagaagcaagagcaaacacattcaaaagctagcagaaggcaagaaataactaagatcagagcagaactgaaggaaatagagacacaaaaaacccttcaaaaaatcaatgaatccaggagctgattttttgaaaagatcaacaaacttgatagaccactagcaagactaatatagaagaaaagacagaagaatcaaatagacgcaataaaaaatgacaaaggggtatcatcactgatcccatagaaatacaaactaccatcagagaatactgtaaacacctctacgcaaataaactagaaaatctagaagaaatggataaattcctcgacacatacagtctcccaagactaaaccaggaagaagttgaatctctgaatagaccaataacaggtctgaaattgaggcaataattaatagcttaccaaccaaaaaaagtccaggaccagatggattcacagccgaattctaccagaggtacaaggaggagctggtaccattccttctgaaactattctaatcaatggaaaaagagggaatcctcccaaactcattttataaggccagcatcatcctgataccaaagcctggcagagacacaacaaaaaaaagagaattttagaccaatatccttgatgaacactgatgcaaaaatcctcaataaaatactggcaaaacgaatccagcaacacatcaaaaagcttatccaacatg

SEQ ID NO: 5940 - DNA, 1467 bp, Homo sapiens
ttattcatggtaagaggtgctttggtcaagaagggatgaaaatgttttcatgtttataaaacagtcattgatcaacattctttgtctctccctctccatccctctcttcttcccttccaccttccacttctttctttcaccagtatgacaaaaacttggtagcctaccattctggattctgtctatagaactggaaattcctctatatacagaacttacattctagtagttataacagtgataggtgtatgtagaaaacctaaagcagagtaagaaatacagagccctgaaaagcactactttttagaagtgttcatggaaggtgtctttgaagacataacattagaggagagagaataaagtgaggaaacaagccttgaaatgacatagaaaatagctttccaaatggagcaaatattaagtgccaaggccctgaggtagaactgtgtttgtctgctattagtgctgggccttcagagatgagtgcttgcaggacttggtataggacctggcccacaggagtggctcattgaatatttgtgggatgaatgaatgagcagatgaatgaatgtaaaccccatccccaaagaattcccactgtagcagaggatggaagtctgactaaagataactacttggtagcaataacaacattcagcattgctcttcattgggtagggcactaagatctttacataagttatcttacataattcacaaagcaatactatggacacatgttattgctcccattttgtaaacagaaagtcaacagagattctgttataatgtttaagtgtttggactccggagccagactgccttgatttgagtaacagtacttccacttgccatctttatgaccttaaacaagttacttaacttctctgtgcctgggtttcctcactggttttaaaaaacccgaatataaccgtttcaggacattggtgtgaggattgtgtgaattaacatatgcaaaatacttaagacagtaactggcactatataacttttcttataataaatgctgtcatcatcattttcaagattatgtaggaaaatagggatgctaactgcttgagaattccacagaggtcttcataaataagatgtttgaactaagatttgaatggaaaggtaggaattctaaaatgtattcaagtggtatgggtgtgtgtaaatatttcagctaattcagcattgattttttcagggggatttaaaaagtatatttggtagtaaattgtctcctttttgctgaatatcaggctactataatataaattccaccttgttcccccaaatgcttctagacttacaacttgtatacatgagaataaaatcattgtcattttccatcttataagacaaaacataaatctagcctggtttagcctccattgtcattaaataaaaaataagaaaatgatctcctgtgcagatagtcaaattgaaaagctcatgggt

SEQ ID NO: 5941 - DNA, 1024 bp, Homo sapiens
agtaactccctagttagttctttactaattgatgctttgaaaagacaatgacttttttatctgatgtatttttaataaaatagtctctcacatcacatttctaatgaatgcattaaaattctcaagtgactaaagggagtttaaattatctctgtattattatgtcagccatctagatctatgatatcaaaatatatatatttaagatgtgcacaaattaattaaaatgataagtttctaaatctctctttgtataagttccaagaattataaaaatagcactattttctgatcaaacagttaacactaaattttacaatgtttgtaaatgtggcttagaggccagtctttttacatggttccttggtttacaacagcagccaccatgataatttcagcaagtcaatacaatgtgttctaaaaaaaaaaaaaaaaagattggcaaactttttttttcctaaccatgttctgcattatttaactttaaagtagagctcatctttctaaagaggaaaatagtgagcagtaaataaatctcttttgataagataacaatgaaaggtagttatctagtccaaccagcagtgcctcaacaaaggctaagcatcagaggcagaaaataataaaagaggagcatttttcttcccctttatatttttgtttcatatttttcttttctttctttttttttttttttttgagagggagtttcactcgtcgcccaggctggagtacaatggcaccatcttggctcactgtaacttctgtatcccgggttcaagcaattctcctgccttggcctcccgagtagctgagattacaggtgcccaccaccacgcctggctaatttttttgtatttgtattagacacggggtttcaccactttggccaggctgttcttgaacttctggcctcacgtgatccgcgcccccccccgaccccagcctcccaaagtgttgggattacaggcatgagccaccgcgcccagcctgtttcatatttttctatggaaaaattggattg

SEQ ID NO: 5942 - DNA, 1607 bp, Homo sapiens
ttatgaactaattacctcccgaagaccctgcctcctaatcccatccccttaagggttaggattccagcatatgcattttgaggagacgtaggtattcagtccattgtgcacaccaaattatgaattaatgtattaatatataattgtatccaaagaaaggtctaccaggaacccatatttgtttgctgatttgcttgtttaatatgcttcatttcctcaaaacaaagggaagcatattttagcttattttcctttttaatcttttgttttgagaatctctgccattgctaaagtagaaaattatgttttcttaactttttgtttattatacgtaaatacattattattaataatataaattcagtgtgtatgtatttctctatagtgaaggtgttgctttttaagtgaatgtggctataaactgagactttaaaaaatctcattgtcattaaaaaaatactgatttagaaaagttctagattcactgtatagaactcacagaatatagaatagttgctagagcacagaaactagtactcttttaacttctaagaaaaagtctgggaataatgtagatcccctcatctttatttaagtaatcaaaattgattctgtgctgggcgcgatggctcatgtttgtaatcctagcactttgggaggccaaggtgaatggattgtctgagctcaggagtttgagatcagcctgggcaacacggtgaaacaccgcctctactaaaatacaaaaagttagccaggtgtggtggcaggcacctgtagtcccagctactcagaaggctgaggcatgagaattacttgaacccgggattcagaggttgcagtgacccaagatcactccacagcactctagtctgggggacagagtgagactctgtctgcaaaaacaaacgaacaaacagaaaaatgattctgcataatgtggggcagattatttatttacaaaattattttttaggaaagaaaaagttgattactaagatttagctagattcactatgatcaagtcatggagtcaaactttacgttgttgttgtttgcatgagttaattggctgatagattactggaaagtcatggatgttgtgtatctggtttttagcaagatgtgcatcagtgttccctataatgtctttatcaatgagtatgagggctgtaagctgagtgataattttgttaggcagatctttggctgtttgaataatcaactgtagcaatgttattcattaatgccaatttgatgaaaactttggtctggttcaatatgtttattaataaattcacagagaagcttaatagcatactaatacaatttgaggatattagaaactaggagggttagttcctatcttgaataagaaggcagatccaagaactccacagaaataaactatggagaataacagttatttaattttttcaaattatggatgtggaggaagaaatgaattaactctgaaatgagagcaagacataggactaacagatggaagtttcaggaaaatatattttggctcagtaaaagaaataaattactaagatttatagtagtctgaaactgaaattgagaatttttcaggagatactcaacta

SEQ ID NO: 5943 - DNA, 1045 bp, Homo sapiens
gtcatgtaatgacatttattagagaatctggcaaaagcccaaataaaaatacaggttttcacactgtttaacaatctgaggttttatgtctttttggtgaggtcattgaataccagtctcatttttactgcctctatttttgaaaacagtaaacagtcatatttttattgtcctacgtggttgcacaaactgacacattgccaagtggttctgactgaatgcttttcacttggcaaactaaaggtactaaaaagaggttcacagtggagacttatgcatgtaggggagcaatttctgtgggcatgtgtatgtacaaaataaatctgtgaattccagtagagccagtatccaggactctaaaagtagaacagactgatttatttgtgacaatgtacttcagctgaacctctgtgctagtttgttggcaaaacctaacatatggccttttaatgagagacagattaataattgcagatatgaataataaagcagaaagattggctgtgccatcttttattctaataaggaattagatttggttactgaaggagcagctgtttgccaggtatggtatgctactgtttgagatagacactttgatgcaaaatgggacgcttgatggtgatggacttgaaaaaatggatatgcgatgtgtgtttaaatttctcaagccctataacaataaacattttacaccccaatgattattattctataccgtcattcaaaaacctacaaaaaagacacagtgacaatgttttctgtcttgttgttctttgagagaaaagacctatgatggtacctcagtgcaatggaaaaaaaaattcttgacaaaaggatcaaatagaagtggtggcacagtttctggaatatatgacattatgtttaaaattgagtgcaaattcttgtcctcccctgtgctagacacgtttctttgcctgcttgaatccacagctccttcaatagaatcaacctgcccctaccttggctcctagaagtgtcagctgcacttatcaggtgacccatttccatttctagctatgat

SEQ ID NO: 5944 - DNA, 1036 bp, Homo sapiens
catatttgaagaggaaagataatcacacaatttaagacgaggaagctcatcttaatttaagccgagggaggtaaagtaataccctgctttaagtcagtgaattagcagcagaattagaatctgaactctgatatccttatattagcctactgctaattcctcctaaggcaagaataaacagctttacagattaggcctgcaaacccaaacctataaagtgacagcatatgtcacaattcacataacagatgttgttttaggttgcaattgttgtcaactactctttctgccaaagtctctcttttttagatcatcagagcccatctgacaacctgtagaacttcagaggcagagaaaagaattatttctccctgtcctgtgctgtccttaaacctgagagggtcatgcctgacctgatgaaaacacccttaaaaaatcaaccatccagtagtccaaagccaatttcaaaactgctttatttgcataagcaatatttagaaccctggataccaaagatccacatcattgccagtggagaatggcttttttgccctctatgctggaacaataaaaaaaaaaaaaagatgaataatgtaacagtctggcttgaaacaaaaagattgctgaataaggtgggaagctcccagaactgaaattcaaatagaataatagcatggattgtgatgaggaaggcaagggaagtcgtcctatatataaatgactgggtgagaaattctctaatgagcacatacaggataaaagacaggaggctgggagaagagcccaataaccaagcgcaagtgtcagaagcctgtagaatgtgtcaaagggagaaaatgccaaagatgagaaaagtttataagtatgttcagaacaagaagatagaaggtgattggatgagtcaaccaaaagcccctctaggataacaagtcctactttgtcttcccccaacacataacagtttctctatcaaaggaaataaatattagattggatagggtataatactagtgagaagaagctgaagcccaaagat

SEQ ID NO: 5945 - DNA, 1084 bp, Homo sapiens
gcagtagttaaaagtaatttagagatgtgcacactatcttccttactctgttaatactgaagatgttgtaaattcagtgtgtcaattcaatacttctcttctttgagcaaggtgttgtgttagacaccaggcatgtagcaagatgaatgagatgcagtctctgcctttgaggagtggaacagacatgtatataatttattgatataatcttaagcagaatatatatattaggttgccaatatttgacctaaaagtgtaacaacctcatatgatacaacctagtaaaaagtgttctcattgtgctaagagaacactgagactgaagaccttaactgtaactgttggaatttgagaaggcttcatgggaagcatatcattttagtaaggcttcataatatgggtggaactggattccccttaaaccaacctccttctgtactagagagtaggaagcttgatcaaagaaatgaagagcaaaagctaggagttatacttagataatagcaaacaatccagaatggcttgagcaaataattcataggtggggcaagggaggacaaatatggctgagacagtacattggtatcagactccattgtattattaggctatagagaagcctcaaaggttttgaggaagggagcagcaaattcatagctatgcacctaccattccactgtccttgagatttgcacttgctgctccgcaagatggactgactttctctgacccagaaagttaatagacaaatttgacattatcttataacagccattttgaaacaaatatcaacatttataaacgagtccaaagtgaggtggaaaaggaactaataaaaagttgttttgatagaaactgaagctgaaaagaaatgggagcagaggttgcaaacccacatgcccacaggatccagacagcatagatagagagatagcactccacaaactctggcccaaatccagcccacctcctgtttttgtaaatgaagttttattggaacacaggcctattttttttcacatattgtctgtgactacttccatgctgcactgcaatagcagagtttagtatagacactgacagt

SEQ ID NO: 5946 - DNA, 1144 bp, Homo sapiens
cgttgtttaacttgtttattcccaaatcctcaggggccagcatagtgcatccccatagaaggcacctgctaaatttgtagaatgaatgatacatcaatgaatgagcaaatggagccccacctatatcccatattgctgtgtcttttctttcatttctggcctctaaatttgctctgatggcgttcttttctctctcttctgtttctcttgtcttcctctcccattcttttaaaaactaaattgattttttcctacttttggccaagtcatttactgatttccattttctacctgtgcatgaaggtcacttcagcttggactctttctcaactctctcatgtaatcttcagtttgtgtctgcctgcttacattgctataacttgaattactgtgtctgttaacaacaacaataaaggtaacggcaaagtggtaggggaaatgttaaacaacaatcgtaaaagggagtaaatgaacccttaggtagaaagttagaaggactgaatttatctgtggctgttgaaaaactaaactacatacattgttaagctttaagggttgctcttgaaaatgttctcaggctgcccaggacagttattgacctatagggcacactcaatacatattaattctctgctcaatgtagtatgacaaagtcaggatcaaatattcatacatccagatcttccagagataagatggattgtaatatctatgtttcttctaggtcttgtttcaagtgcatatcaaaatattggtaatatttgggttggaagagaatagtttgcatattattattaatgttttattaaaaaaatcgctcttttagacctgcaattcaaaatggtctgtgcatttgtaaccatgatattatattcaacttcacattttctcatctaagtacatttgcagttgtcgaaaagtcagcattaaatcaggtttgtacaattatggtatcttatggttaaaattaacagaatccatttagttcattctcttaatttttatgatgagaaaactctgatcacagaaatggtctctatggcaaactttattgaactgcatttatatatttaaagaagtgctaactgaaatagtgcaatttaaagtttcatataaaagtgcatggaaaattgtaaaatttatt

SEQ ID NO: 5947 - DNA, 1066 bp, Homo sapiens
tagaacatatccacatgcatttatgtaattcttatcatctagggtactttgtttattagaggagaaaactgagaccctggaagtcttactgacatcatgagcctacagttactgaatggaaaagtgaggcttgtccctctcattgcagggttgctgtggtttaactccccaacctaccctaaacagccttttggcaaaagaccaatttattcagtataccttgggagaaggcagatatctaaatttatcttgcttttggcaagaaaatgaatatttggtggcataaaaatgatcacagtttgagaaatactaggaaacattctatgagaaactaatgtttagcaacgtatcaatttatgacatttgaaagaactaagagtgaatgattgcttgaaacctgaattggactgctgatcatagaacaagtttaacccatgggaaagtgggaagtatgtttcagaatgatggaataacctgtcatgcaaaagcaaagacctttcatggagactggtgaattcccagtctcagactttgatggatgattttgtcagctgttttctctctgaatgtgttgtgtctcccagcttactactgaagcaaggaggttcactggaattcacttttccaaaagcagtcagggacacaccatcctttctttctaaagtttgtgcctttttcagcttagaaaagcacttgcctttctatctctgacaagtgactgtgcaaaactccatctatgacaaaatggaattgtgcaagagtaatgaagggatgagaaatgcatctcctttgacaggccatgcaaacccctttactcacattattacagtgatagttgtaaaaggaggaggaagtagaagaactggtattgagctcctagtgtatgtgaagccctctctatgccttccagccctacaccctgtgttggtagtgttactgttattcctgttttatagataagaaagctgaggtgctgggagaatacagaactagagctgcgatgttttcccctcctttttatgttattgtgtattgcctcctgcccaactctacagacagattttac

SEQ ID NO: 5948 - DNA, 1052 bp, Homo sapiens
cattgcttcgacttagtattttatcagcgaggtgcagaggaggccagaacatagaagtgcccatcaggatggaaagactttagaacttttcatccctttaatctttgtaaatgcaaaatgtgttgtgtcaaaggaacgtagatcttatactattatcatcaaaagatttgaagttatttttcttctcaaaaggaatctgtgatatcaacagttgcatattgtttttctgttgtaaatcaaacagcttggaagaaaaatgttgccatgttttttgaaagggcagcacaaactatgatcattatggataaatttgagagttcatcctcatgaacttttaatgtttcaactgagtggcagttgcaaataaaagcgatgtaagatcaaagtgtttaatattatacacacatacacacacactatattcaagattttaccatttgtattggaatagattgtttaaagaaattttatagttgaagcattgattgatttttccaagagtttcttttgatttacaagcttgtaagtattctaacataattttcctaggaaaatttagctcttttagtattttgtacacctataaagtgttctaattttcatgtctcgctcatattgttatccaatgtatacatttttgcatgttattgtgaaaatattagattattagattttttgcattagtcataagggaaattattgtactgcaggctaagtactctcagtctgatccaaaccttcctatagggctccaaattagccattctgttcaaccttttcaccaggcaattcagtaaggggaaacaagtcaatctaaggggtgaattttgtaatcacagactagtaaaacaataacaacaccttacatagcagcaaagaaagctatggaatgcaaaattaattaattccttgcttttccttagagaatttggatttatacttaattgagctaaagtacctgactagcctgggatgtgctcatttgtattcatagtgattttagatgttgtataaagatggaaagcaactaagtcattatttatttctttaga

SEQ ID NO: 5949 - DNA, 1050 bp, Homo sapiens
aatagatctatggtatgctctttggcccagattaataatatgacaaacatttggattctgttccctttgatgaactgaaggaaatgtaattcaggacagaatgccccaaataataacgtcgattttgttagtcagaattagagtgatttctgttttctcaactatggatgtaagtgatgattttaaaataaaaacatgataaaataatttgttcaataatgcagtggccttccagcatatatgaatgctttacattgaattaaatcaatattaagtgccaagtataagcagtaataataatttatataaacatacagaattttaagaatataaataatttgtggaattcaatttctacatatgttttgactatgaagagctgggaattacctcattcattcacttcacttggcaaacagatgtcttaatttctaggtttaagcaattgatttcatggctcatatctttgtagtaaaagaaatcatttaaacatgtagaaacacagaattttagaactgcaagggcttgtgtagtccaggctctctcaagaatcagccaggatgcttttgggagcagataacagaaaactctgctcgaactatctcaaactggcttaaacaacgacatttatttatcatctcacataaggatttttgaggtaggctggactctgggtgtagtatgaaagtttccctgatgttcttgggatttggatttggtctctacaaagcattgctttttctgctgagattgtcaataagatggatgcagtagccatgcctttgatgttcagtgaaagctgtgagagagtcgttctttcctgcactgttttttcgggaggaagtaacttcccaggtgcttcccagctgaggcacttttattaaatggttaggctttatgccagagatgagcaaatactgtgatttatataaagagatcctgaccatctttgggactgggaataagggtctactttcctgagtcacatgatggtgaacgtcaacttactaaagctggggtttcatttgagaggaggaaaaggagacatac

SEQ ID NO: 5950 - DNA, 1032 bp, Homo sapiens
ccactttgattttctcctttctcagggaagagatctctgtcttcccaagagcccccacagacctctgcttcttagaacttttcacagaggagttttaaattactatgattacttgattacaagtttttccttttagtaaatattatgagataaagcccacttttttttagtactcaacaaaagaataagcaaataaatcctgagatttttcattcccaaagctataaaacttgtttaagcattgtcgtgtgttccaagatgaatgtactgtacttctaggtaacatgtagacatggtctggtcccatgtactgagatagcgtggtagaaaggctacataaaggataggcaaacagaagaatatgaggtagtctgtgtcatatgccagatgagcactacaaataataaatgccctcagacttcaggaaagttcagtgaagagggccatgatgtttggagactacttcatagagaaaggaaaacttggactgggaattgaaggaggagtagaacatagacaaatagaaagacacagatccaatccaggaagatgcactaagaaagaaaagttagatttactctaggagtgatagattagtttgatgaggcattctctcagtgggagtagaaaaaatgaaatcggggaactagaaagtgagggagatggtagagactgtccagtctgggataagacgttggactatgggggaagctattgaaactctatgggcaggattttgacataaaaaaatcaatgtttataaagattaattttcaaaccatgtgtagaatgggatgtgagagagaaaaagtagtcaagcagtaaagtagcctaagtataaataaaaattcaaaattaaaattaaaaaaattcacatgaagagaagaaagcgataaattttgaagaattgacaggacaagataactcattggacacaggggctcagatagcttaaagcaaaattcctaggtgtcgagctttaaaaaaatgatggcatcattaactgaaatagcaaagttcagagaagggttt

SEQ ID NO: 5951 - DNA, 1224 bp, Homo sapiens
agcagcacaacttgcaattgcagaagtatggaaccaacttaaatacccatcaaccaacgaatggataaagaaaatatattatgtatacaacatggaatactactcagccataaaatggaatgaaataatggcatttgcagcaacttggatggagttggagaccattattctaagtgaagtaactcagggatggaaagccaaatatcatatattctcacttacaagtggaagctaaactatgagggtacaaaggcataagaatgatataagggactttagggactcaggcggaagtgttggagggggatgaggactaaaagactacgtgttgggtacagtacacactgctagagtgacaggtccaccaaaatctcagaaatcaccactaatgaacttatccatgtaaacagaaaccaactcttccccaaaaactattgaaataaaaaaggaatcaaatgctatctttaaaaagataaatgaataatttattgttagatacaacattttaatgcagtttggatcagggctttccaacatgtttcacttcagtgcacatagaaaaccacagagattgctcacagcttgaggtgaaggaggtcagtattttgactgtctgtaaccaataactacatactcaggctgaggccagattatcaaggttttttattctgtccttggcattcttgtttgttgatagcttatgcttgtagaaggggagactaatttcacagtattaattattaatatatcattacatctagatttgtaaaatgtattcatgccttactttgtatcaaatggacataggttatgattgaaatatttagggtggctaaaatattgatttgttagcctatttaatggcaaaattaatgcactgatttttaaaaggtagattatctttgtgacagcaagctctgatcattcattttggattttttaagagtaatttggtggaggatcatctaaattacttagatttttggacatcttatgccttcaaatacctttccatagttaaataccccctttgaagttattatgcttataaaatttccaagccattcactaaaatcaagttcataacatgaattggagggatttaatgggtggatcatatagtgagttactcctggatcactcaacagattggaaactgtgagtagatcacaaagattcatgcaagcaggatttaaatctttctggttttcactgttgtatgct

SEQ ID NO: 5952 - DNA, 1045 bp, Homo sapiens
atctctttgtgacaaactttgcaaaaagttttgtcctataaattgagatgtgcttatattagtaatattatggatataagatgtatcacttagacactgagcctttaaagtaatttaaagtgattaactttaaatggggttttcagatctagatggcttttactctcacagaatattttcaaaatattttaaatctatggtctaatgtgattgggaaaatctgaatattactttcatgtgttcttctgcatacttccttaaagtagtctgggttagtttgctgagaatgatggtttccagcttcatccatgtccctgcaaagggcatgaactcaccctttttatggctgcatagtattccatggtgtatatgtaccacattttctttatccagtctatcactgatgggcatttgggttggttacaagtctttgctattgtgaatagtgctgtaataaacatacatgtgcatgtgtctttatagtagaatgatttataattctttgggtgtatacccagtaatgggattgctgggtcaaatggtatatctgattctagatccttgaagaatggccacactgtcctccacaatggttgaacaaatttacactcccacgaacagtgtaaaagggttcctatttctccacatcttctccagtatctgttgtttcctgactttttaatgatctccattctaactggtgtgaaatggtatctcattgtggttttgatttgcatttctctaatgaccagtgatgattagctttttttcatatgtttgttggctgcataaatgtcttcttttgaaaagtgtctgttcatttcctttgcccactttttgatggggttgttgaaaaccaaacaccacatgttctcattcatgttgaacaatgagaacacgtggacacagggaggggaacatcacacactgggcttatcgtggggtggggggctaggggagggatagcattaggagaaatgcctaatgtagatgatgggttgatgggtgcagcaagccaccatggcatgtgtatacctatgtaaca

SEQ ID NO: 5953 - DNA, 1027 bp, Homo sapiens
cctttcctagatcctgtagacttctgagaacttgttatatatcaccttataactttcatgtccactgaaagttgcaatttggctttgatttggattccgctgaagtttgattactgcacactaaaaaattgccctgaaatgaaaatgagaagaatcaagtaataattgttctaagtgcaattgaaacattgtatctcctagtcattctctctgagccttagtttccccagccatgaaattgggatgacagtgttttacaaagtagtaaatagagtaatgctagctccaatagggcataaatcccaaaatgaccgtgctcaacactatagaaagttattgatcgatcctgttagagtggtgagtgtttgaagacagagcagggctgctcttcttcatgcagtggctgatgccatcttacaacacatcttaaaaagttaaaaatccattcctagttcctaaagggaaacagacaatggagaaaaattatgtgagaaattattatgggtcaagtttggaagagttgcactttatttcactcatacttaactgcaaaaaagtgggcagtatagtccctctctatggacaggggagtacaaacacatggaggatggatagttgtctctgccacaacaagcaatgctgtgagagttgaaactccaccatacctgcttcctggaggctttcagcaagtggtggctactcttgctttgctgctattgcaatggtgttattgtcattattaggccttaaagtgccgtgaatgactcagtctttctaacaggaaaattgaaattaaattcgatagccagtggcctggaatttgaggttctctaagagtggaaagggtaaagtattggacatgacatccttatttatctgaggaccacacttgtcaaaataaagtcctatgttttttcccacattataaagttgtctttattgtctaccatcatctttcccagctcttatgtgttataattttaattgcctatgcagtttagagttcaagataaaagccagaatgtga

SEQ ID NO: 5954 - DNA, 1008 bp, Homo sapiens
atgaaattttcttatggcctatcatttagggcctccatggtaaggggtaggggcagtgacaagcagggatgctgcagaaatgttatggaccagattgtgaaggggcttcttaatttggaaactaaacttgggctttctcctgagggaagggggtagcttcaaaagcagtgattctctgctcattagagtcacctgtgaaactttataagcactctctatccctgagcccatctcagactaatgaaatcagcatttttcatagtggtgctggggtattaatatgtttaacaatctccccagataatttctaatgtatggctagttgcaaactattcttctaaatgttagtaagcagagtgtaaagtgatgcaatgccaacactttgaactggaggctcataaaaactgaggcaatgtgaagatgcaaacctgacatgctttgacgttggaggacaaagagagtaaaacaggtaggatgttccttaagtttccagttttttgagcttggaatagatgttggttaagttcaacagagtagaaaatatgacaggaatatggcttaatgaggaagacagaattttgtcccattgagcctgaaattctgtgagacacatctagaaggctcttagctatacatgtctgaagctcaagaaacattttggttatatatatatatagagagagagatgtagagtcaccagcatataatgagaactgaagtctcaggagtaagcaacaatgcttacagaatttgtggtgtgagaattgggataattactgagtcctgaaaatcatcaacatttaagaaccagggagaggagttcacgaaggaaagcaaacaactggagacaaaaggcattcactgtctgtttaaatgctgggaatctatagtttgttccatgggagaccttttaaataatacagaagttttaaacagcaaaatttacttgacactgcaaattttaaaaactagtttatatccttttactaaatatttcccaatggaaac

SEQ ID NO: 5955 - DNA, 1028 bp, Homo sapiens
ttttcttcctatttttttattttttaaattttttaatttttatttttttattattatactttaagttttagggtacatgtgcacaatgtgcaggttagttacatatgtatacatgtgccatgccgatgagtgtgcttttcgggagtcacatggagaggctaaaatgctacttttttgtggggattttaaacttctattgttatgcactgaaagagagtataaatgtgttactgaacaatgtatttgcaaatattaggtgctgcagtaaaatgtaaagaaatttccaaggcctgattttatgcatttagattaattattgatgtttctcctaattctgctacttgaaaatgggtgtgaagaacaaacttgttttcaatgcagttttaaagggactgagtctttggtagctttatggacccacagtcatcaaatttctcatcatttgaggttgttaatcattatgatagttcaaggagattctgagtgaataagaaatgaaattctattattatcttatctttgactgtgaagatatttgaccacaaaatatttaactgcttatacatctcaacatactccattgactagaataataatgagtttaataagctgaaaagattacaaaaatgaataatactacttagcagcagtactttctgaaagaaggaatgacagaggggagcaaagaggtatgtgtagttattctgtacatcttgtatgtggttgtgtggtttaaatgcctttagttttatttagaagtagatttttttacttcagcactaatttctggggtgtttctatattcatgtgttgcatgcatgattatgtatgatatgtaaaattatatattaattaataaagggcttagtgcataaaatagatttgcatgtttaattagactcttattatctagaatggaaaggctaggaaaatgacaatcagggaatatcataaatgtgaacaagaaagttccactagataactaactttaaaaacataataaaaagaaacatgtagtacacttgcac

SEQ ID NO: 5956 - DNA, 1028 bp, Homo sapiens
tctcttccctgagtgcactttaatacctttaaggagtatctctgtccaaattaagagattgtactagatgtatcatttttaaccctgtaggcagcagagtcacctaggatacttgggaaacacagtttcttgactctacctaagactttctgagtactaatctctggtggtagattccatgagagagagagagagagagagtttgtggggtgtgtgtctgggtggtggatgggtgggtgtgggtggttaggtgggtttttgtgtgtgtaatatttgtaaccagatactccaagaaacattcacacagacaacccaacattgttctcagaccaaatttgagaaacacaagtctagatggccttaagggtgctttaacttcgagactgcatttcactctgcagctttaaagtgaagttgtggtagtctcattcacctttgaatttatatgatgtccatgcctcctttttggatggtattctcttttgcaggttcagtttttgacttagacacctttgaaactacttgaattagggattattctttgataatttgctgtcatcaagtgaattgagataaatatacattcagagcatcattatcaactttgaggaaatgtaggcacttgtgtgttcatgttggacacaggaggctgagatgagaggatcatttgaacccaggagttcaaggctaaagcgaactatgattgtgctactgcactgcagcctggaacacagagcgagatgctgtctcaaaaaacaaacaaaaaaaaagacgagtaacaaagaattatacaaaatttgtttataatatttgataccattaaatttacaggtgcatctgcataaatgctgcattttgtgctcagataaccaaggacatggcaaaagctaatcagcctaggaggcaggaggattacttgagcccaggatttccaaaaatatatatcactatgatatatcaattttttattctatttttcttttagagactatttttgtaatggtctgacttcttacatcacaatatgt

SEQ ID NO: 5957 - DNA, 1084 bp, Homo sapiens
tggattcgttaggttggtgcaatagtaattgtggttttgccattacttttaatgttaattagtgtaatttaaagtaatgggaataccacaattacttttgcactaaactaatacttctgggctctttctgttccattggtcaatatgtctatttttatgccactactatactgttttgattattatagctttgtaagatatatttaaatcagaaagtgtgataccttcccctttgttcttcttgttcaatattgctttgagaggccaggcacagtggcttactccagtaatcccatcactttagaggctgagacaggaggatcacttgaggcaaggagtttgagaccagcttgggcaacataacaaaactctgtctcttcaaaaaaatttgaaacataaaaaaatttcctgggtatggtggcacttgcctgtagtcccagctacttgggagactgaggggggaggattgcttgagcccaggagtttgaggctgcagtgagctatgattgtgccactgcactccagcctgggcagcagtgcaagaccctgtctctaagaggaaaaaaaaaaggattgctttggctattgaaggtcttttatggttccatatgaattttagtatttttttctacttttgcaaataatgccactgggattttaatagctattacaccaaatctgtagattattgtgggtagtatggacattttaataattttaattcttacaatccataaccatgtatgtctttccatttgtctgtgtctttttaaattttcttcatcaatattttataatttccagtgtgtaagtcttttgcctcttaagttcatcctaagtattttattctttttgttactattatgaatgggattgttttcttaattttccttttagatagtttgttgtttgtgtatagaacatgacttattttgtatactaattttataccctgaaacttcactgaattgttttattagttctaacattttttttctttttttgtagtctatagagttttctacatatatgatcatgtcatctgcaaacagagataagcttatttcttcccttcctaattaga

SEQ ID NO: 5958 - DNA, 1029 bp, Homo sapiens
tctgaggcatccattgtaatatcttctctttgatttctgattttatttatttgagtcttctccattttttcttattagcctagctgagtttgttgattttgttgatgctttcaaaaaatcaactcttgtttatggatttttttattgttgtctgtttcttatttgatttacttctctaatctttattaattccttccttctgataattttaggtttagtttcttcctctttttctagttccttgaggtgtaaagtcatgttgcttatttgagaatgttctttcctagtgtaggcatttatgttgtatttttgttttcatttgctctgaaattaaacctagttacattgccgcctctgcttttccatgttttctttagtctgctttttagctttacctttgtctattctttccctctttatttaagatctcttaacttgaataaatataacagagtgaacagtgaaggggttatttcattccttttgggaggatattcctctgttttaaccttggcttctaggactgactggtcataaaaggaaacaataaatgcaaagcattgagtccaaaagtggagaaaagccacagttcatcttccctggcaataatatgatagtattattttaagattcagtgaattctgttctgcgagctgtaagattggttgatttgtaatagggggaaaaagggcatgttgtggggagggtagacatttagagaaagtaaatgaccttgagggtattgaactctgtgaatcaacttgttctctaaagttaggggacataccacttctagatggtgaacctgtgggtgttcatttgaacagtagagtcatagaaaaactttactatctggaatataataaaaatgctgctttaactgctaagtcgccatctgttaccagctctttgctactggtttatcttttttccttttaaaacgtgaattcttggattttcatattataattttatacttaccttaaattaggattgagaggaaactttgacaacacctcttaaaagaaa

SEQ ID NO: 5959 - DNA, 1048 bp, Homo sapiens
gaatcaccagtgtggggaccactttcccgtaagaagccctgttgtaattgatcctgtctcctgagcctccccggctgccactggacattgcaggtttggcttcctggctattggttttgcagtcagaggagttcagttcagtttagtgtgttgagtatgagcaaagcagtatgagccgtgaggtatcaggatgagtgtgtgactgccttctcttctcatgtgtcatctgtgtgaattcttcccatgtatcagcctcttctaagacgtgaccttaactagtccagttcctggtgctctgacctctctcaagctacttcactcagagtgctgatcaaatggtttggaaccacagtgttagctatgtccttgttccatttagtctgtaaatccactgaggatgtatcttatacttcttttgaaatacactccgccattagcacattgaggagcactactaggggtttaattgacacctgttgattgactggtacgttaattaatgtagggccttataagcatgtcttccagagacgtttaaaaacttttattcaaattgtatataacatctacttgacaaacatttttagtaaacgtgataatgtagaaacagaattattccctgtaaaatattattcattttagtaatttgagataaagagttatttgctcactagattttattcacttggcacctgtttattaagtgcctatggtgtgtcataagcactgatgatgtaattgagacctaataatagcctaggaaagtatgaaaaaatatgaatatcttcaatgttggttctttcaggccaatatttttaaatgactcattggtagcaaaacatcacttttttttttttttaacgagcagatatttataactgctaccaaaaccaggaatagtttactaaatatgggggtttgaagatattgtctttagctgggaaaagcttccaggctacaagagaggataaagacagtgagtaacatttgagatgtactttatttcattacctaacaaacacctatccagcactcacaatggacaggc

SEQ ID NO: 5960 - DNA, 1075 bp, Homo sapiens
ccccagggaatggatgctgtttcaaccgggttaagattggtttgaaaactggttaagattggtctgtttgcaaatatggggcagtcaagaatatacccagagaaagctattccacaagggacataaatgtaagatattaacaaaataccattctctgtccaacattaaaattttaggaagatacatcctcctctattcttttctctcaaggacttcccaagtttccgtgcaatgtttgctttaattcttttaatatgaataatacaatatgttttacatggcactaccactttatttaaatctcaagattttctaagagttaaatgttcactgctagtcttcacagcaatcatcaaacaggcctattcagtttaagatggcctcatgtgtgcgctgtcagtgacatctgccaaaaccatgtcttatttgtgagaaatgccccttgtctctgcttgatggaaaactgatcagcctcttttactctttcaactcaatgattagcaattactgctaacctagaaaacttcgctggatatttatttaaaaattctcgtcttactgggcatgatggatcttatttgctttttaatataaacagtgaaagtataaatacattcttactttttggagaagataataatattaaatttaatttttgtctccagtgttattgcatttttctaacagaaaaactaaataaaacatatctttagaatttaattctctttaagatatcacaaactatttttcaattttaaaataaaactatatctatatatatatacacacacacacacacatacatatttgagacagagtctcactctgtaacccaggctggagcgcagtggtgtgatctcagctcaccgcaacctccacccccaggttcaagcaattctccttcctcggcctcccaaatagctgggattacaggcacccaccaccatgcccagttaattttggtttttttagtagagatggggtttcgtcatgttggccaggctgttcttgaactcctgacaccaggtgatctgcccacctcggcctcccaaagtgctgggattacagacatgag

SEQ ID NO: 5961 - DNA, 1035 bp, Homo sapiens
tgatgaggcttgttctgggagtgtagagaaagctggaaagtgggaccaactgctgctgcccatgtgaagttctaatcctggggtaatgtaatcaaaaagacagccaagcaggaaggggtaagttccttctccctctcttgccttcttgcctcccccagggcttcttctggcaggtatgaacagtcttccagttggtcaagtgcaacaaatgtagtctgctgaaccatgaggtctgcatcagaaaacaaagaacagaaggatgggtttagagataagaggcaatatcttagtaaccaacacaagtgtctttcaaatcccagtctctttcataaactcctattggattaaataatcaacagagtgaacagagagcctacagaatgggagaaaatacttgcaaactatgcatccaacagaaaactaatatccggaatttacaaggcactcctacaactcagtgacagcaaaaacaacaaaaataaccccattaaaaagtggacaaaggacatgaatatgtatttttcaaaagaagatatacaaatggtcagcaagcatatgaaaaatgcttaacatcactaatcatcagaaaagagcaaattaaaaccacaatgagttagcatcttataccagttaggatggctattactaaaaatacaagaaataacggatgtcgatgaggatgcagagaaaatggaacactcatacacaattattgagaatataagttagaacaacctctatggaaaacagtttggagatttctcaaataactacaaatagaactaccattcaaaccagcaataccactactgggtatctacccaaaggaaaaaaaaattgttatatcaagaagatacctgcattcatatgtttattgcaatactattcataatagcaaagatatggaatcaacctaactgttcatctacagatgattggataaagaaaatgtggtatacatatgtacaatggaatactattcagtcatagaaaagaatgaaattgtgtcttttgcaactacatggatggaactgg

SEQ ID NO: 5962 - DNA, 1035 bp, Homo sapiens
tgtgctctgggctatggaggatatagacatgaataagaagtttttctgtcctcacacagtttaatgaagaacaaggttaacagaaatcattccatagcaaacgcagaaagtacttagaaggaggaatgtgtcctggctggtgagattcaggaagagttcatggaaggataagtaaaaattcacattcaatagtgtggcctcttatacttggctgacttttcactatacccatatttttatttttttatttttttgctactatgtaactatttcctgtttagccttcagtgtttattttctgtatactttttttctcatgccagtcacttagacatatggccaatgttactgagtgccttctatgggtgctttcagctagttgtaaggatacaacattgaacaaatgagacaaggtgcccccattatggaccttgccctctaggtgggtaggcagttcttaatattaaaaggtcacccaaatgaatgcaaagttgcacattttggttggtgctgggaaagacaggtgcaaactgctatgctagtagggtgatcaggtttcattctggagtcacaaatggcttccctgaggtataggtgttaggttaggttgagtcaagaaggctgtttccagcctgtgcagatctcggaacagaagaagcagagtatgcatctgaggaaaggtcactatgggtgcagaaaaagggaatgaggagtgtgtacagcacttttcacacagtaagcatttctcagggtcaggttcaaaaggcacctcctccatgaagcctttcttaaaatacttgaacactaaaaagatcctccctctttttagctcttaaccattgtgtatctctcatgagggtgtttattacatactgccttggtttgtgattatttatgtgcaagtttgattgtctgtgctcaactgtaagcttctagaaaccataatttgtctcatatccatctttgtatccttcagtgtcatgagttcttaaaaaatatttgctgaataaggtcacttcctcagtatgcctgctg

SEQ ID NO: 5963 - DNA, 1027 bp, Homo sapiens
ggcttgttctgatttccatgtcattagacaaggagaagatgatcatcttcccgtagctaaacacttggattccatcagaggttcttctgaaaagtaaacatactatggaaaggagggcctgggggaagcaccacacctgtaggccttctttctgttatttttttttcgtgggggatggtgtttcactcttgttacccaggttggagtgcaatggcatgatcttggctcaccgcaacctctgcctcccgggttcaagtgattctcctgcctcagcctccctggtagctgggattacaggcatgtgccaccacacccggctaattttgtatttttagttagagatgggttttctccatgttggtcaggttggtctcgaactcctgacctcaggtgatctgcccgcctcggcctccaaaagtgctgggattacaggtgtgaaccactgctcccagcccttcctgatatcttctaagtctctttgcaacaacctgagtggacccattctcctgtgctcaggacctagctctaggtattcccttatctttcttagaatatggtcattcactggcatctatgatggaacagaaaaatagctggaaaatgaaaactacaaaactctcactcaacattattttacaatagtgtaggagttaatagttgtggcagaactgcatcttctaaggaaaactgcgctatgacaaacagccccagagtgagaggcagtcaactcactgtcagggtgacccataagtcctaatgggtgggaatgatcattatatgaagactataaatctgattaatgtgcactctgagatgaggtataacatttcatgccaaatgaggtaggggtaggtgagaaaggatgatagaaacagctggttctgcacatgtctgaaggaccatagtaaaattacagtgacatagagagataagtaaacaaacatagggaatgttcagatggatatatgtgtgtgtgtgtgtgtgtatttcagtgtttatataaacatatacctaaacttatttatag

SEQ ID NO: 5964 - DNA, 1051 bp, Homo sapiens
ttacttatgtgtcctcagccttttgttcagagactgtggcatggtaggcattcagtagatatctgcttgatgtgtgaaaatatggaaatttatgtttcttagcctggcagtcaaggtcctcttccagtctcactttctaaagataaaatgtcataaggatttggtaagcttttacttttctagggatgtaaaatgaggatgataaatgtgcctacttcaatgggttatcatgaagattaaataaaatggtacatgtaaaacattcagcatggtgtcaaattgttgacaaggactcaaatggtattgactagtatcattatatgacacatttttcaatatagataggtttttaagattatgtaagaataaataagtataagtatatggtaaagactttcagtgctgtggaaatactgaagaggatcacataaaggggtggagtcgggtaaggagtcaacactgtcaggcatctgaatgcagagtagggaaagcagagggaaattccaaggacaagaaatcaagacaccagatcagggggatttaaagattactttcattgaaagaatttttttcataaaaatctttaacagaggaggaaagctagagtatattatgtttaaataagctgaaattcttgagtattttgtgaaagttcttctctgtgctcagtttgacatattttaaattagaggctatcttgataaattgcttagaatctgagcttaaatttcttcccttcattttgttgacagaagtcctacattgctgatttgctttcattttgtcttaagtcgggacatttcccatgacagttaaataatttctgtaataacacttcatgcataactgctggctaactatagcattatccttgccatttctttttataagcatataccatgaaaatttgtgacaattttgttaaaatatacagtctcaaattggtttcttacacattcctgtgaattctgaattctcttctttgaaagcttcctagatagctcagcattcactgggttctccacttactcccttgaaggagattttgagt

SEQ ID NO: 5965 - DNA, 1091 bp, Homo sapiens
agtgacagctgtgcttttctacgttactaaaagaaggtttggcatcaatgtttaaaaaaatataaaaaagtgcatctctcatcctgagagtcaacttgagcaaatgcaatcagtcagtctttctctaacccttgtgtaaatctggaatgtgtttctttctgcagtttgacatgagacccgtctctagattgtaaaaatcaaacaaaactgtctgaccctgaaattgattctgcagcctttccaagtccaaggacttgcttccctgggcaattgtgaggctctcgttttagtgcctcagagaagcagagaaaatacagatacagacagaacgagataatagtaatagcaatagaatcaataactacactttcactagcatacgttctagcattttctgaggcctatgtgccaagaagtgtgctgtcttagatatccatcatctgatttaatagaatatagtattttaaaaattggatctcctgaggttttacagaaagacccttatttagatgagctcttttaaaaactaaggtcaatcaaattagatacagcactactagcttgcattgtcaaccacattaaatgtaattttcttaaaggatacctttctaccctcaaaagctcatgcacactaaggttgacttttctttataatcttcctaactacagaatattattactgttattttaatgttcaatttttaaattatttgaaagcatttattgagcagttacaatatgctgggcactgacctaagtactttatctacattatctcatttaatccctatggaaactaaatagtagacatttatattgtcattatattcatttgttagattcatttacatatggaaaaatagatgctcagtgatgttaacaacaaaatgaagaaaaataagccacttccattttcacaaagacactaattgacagaggtggaactcaaacctgaaaaagtttttgtgagcatactattagcgaataaaatattgctacgatatgatatatttatgcatagcacagtaatttgtttcctcaaaaattatatgaaataattacctttttatctcttcatcgtggaaaaatta

SEQ ID NO: 5966 - DNA, 1072 bp, Homo sapiens
tcccacgtgtgaaaggaaacatgtgatgtttgtctttctgtgctgtgcttatttcacttaacacagtgacctccagttccatctacattgctgcaaacgacaagattttatcctttgttatagcccattaaggttccattgtgggccgggcgcggtggctcacgccaggccgaggcaggcagattatcaggtcaggagatcaagaccatcctgtctaacacgatgaaaccccgtctctactaaaaatacaaaaaaaaaaaaaaaaaaaaatagccgggcgtggtggcgggcgcctgtaatcccagctactcgggaggctgaggcaggacaatggcgtgaacctgggaggcggagcttgcagtgagccgagatcgcgccactgcactccagcctgggcgactgagcgagactccgtctcaaaaaaaaagattccattgtgtatatatctaacattttctttatgcatgtgtccactgatagacacttatgttgcttccatatcttgactattgtgaataatgctgcagtaaacatgggagtgcagatatcacgttcatgtactgatttcctttcagcagtgagatagccagatcatgtagtagttctctttttaggcttttgaggaatcgccataatgttttctgtaatagctgtactaatttacactcccaccaacagcataaaagagaacccctttctttacatcctctccagtacttgttatcctttctctttttatagccattcgaactagggtgagatgatatctgtttgtggttttaatttgcatttccctaataattagtgattttgagcattttttgaaatacacctgtttgccatttgtagctcttttttccagaaatatctattcaggtcttttacccacttttaaatttgatgataatgatttttttgaagtgattgaattgtttgagtttgttttgttttgttttgagacagagtctcgctctgtcacccaggctggagtacaatggtgtgatctcagctcactgcaacctctgcctcctgggttcaagcaatctttgtatttttagtagagacgcagttt

SEQ ID NO: 5967 - DNA, 1087 bp, Homo sapiens
gttagccagtcctggtggtgtgcagttgtaatcccagctactcgggagcctgagataggaggattgcttgaactcgggaggcagaggtctcagtgagccaggatcgcaccactgtactccagtctgggctacagagtgagactcaatctcaaaaaaaaaaaaaaaagtaaactaaaacaagatagcaaaaaatgtgtttctcttttcttttttaaaaatgtttttaaaaaattaaagaattaacagataaaattgcacgtacagacatgtgtcacttaaggtcagagatatgttcaaagaaatgcattgttaggtaattttattgtgcagacatcatagagtatatttacaaaagcctggatgctataacctactacacacctaaggtatgcaatacagcctattgctttgaggctacaaacctgtacagtgtgttactctactgaatattttaggccattttaacacaatgataagtatctgagtatataaatatgtctaaacatagaaagacacagtagaaacacagtattacaatctaattgagatcaccatcatatatatgattcatcactgaccgaaatatcattatgtggcacatgactgtatttaccatgcaaaaaatgatagtttgaagtatatatacattgtggaatgactaagtctagctaattaccatatgcattaccacaggtagttaccatttttgtggtgagaacactttatatctattagcatttttcaagaacacgggaatattattaaccatagtcatgaggttatacaatagatttcttgaccttattcctcctacattactgaaattttgtatccttcgaccaatatcttctcaaccgcttccaaaatccctccccactccagcccctggtagccaccattctactttttacttttgtgagataagttttttagattctacatataagtgagatcatgcaataaatttctttctgtgcctggcttatttcacttaacgtgatgtcttgtaggttcatccatgttgtctcaagtgacaagatttccttctttttagaaggttgaatagtattccattgtacatgtttgt

SEQ ID NO: 5968 - DNA, 1037 bp, Homo sapiens
agaaatgcaaatcaaaaccacgatgagataccgtctcatgctggtcagaacaatgattattaaaaagtcaagaaacaacagatgctggtgaggttgcggagaaataggaatgcttttacactgttggtgggaatgtagattagttcaaccatttggaggagggtgtggggattcctcaaaaatctagaaccagaaatagcatttgacccagcaatcccattgctggatataagcccaaaggaatataaatcattctattacaaagctacatgcatgtatatgttcattgcagaactattcacaatagcaaagacatggaatcaactcaaatacccatcaaagatagactggataaagaaaatgtggcacatatacaccatagaatactatgcagccatatggagctagcagccattatcctcagcaaactaatgcaggaacagaaacccaaacactgcatgctcttacttgtaagtgggagctgaacaatgagaacacatggacacaaggaggggaacaacacacactggggcctgttgggcagttgggtaaggggagggagagcattaggaaaaataactaatgcattctggccatacctaggtgatgggttgatgaaaatgaaatatgtttgccttaatacctaggtgatgggttgataggtgcagcaaatcaccatggcacacatttacctacgtaacaaacctgcacatcctgcacatgtaccctggaacttaaaataaaaaattaaaattaaagaaaaataagggtttctaggctaggggttagccacactgaaacagtctggtaggagggaggaagtggaaatggagccacatagctagttatgagatagatgccctataaatacatggaccaggggccatggaacttgtgtcagaattctcaatgggaagcatctccctggattgtgtaaaatgagatgcttacatgcagcgctgccattaactgggtagtcaaggatattggttcttttattctaaagtagttatcattagtcttaattgaacttcatc

SEQ ID NO: 5969 - DNA, 1053 bp, Homo sapiens
ttgataatttggttttattacagttttttactttttaaaaaaactctgtaaatatttttgctgcttaatctctggtcatctctgattatttcctacagataaattcctagaagacttgctgagacaagatgttatcacatttttaaggcttttatctttcaaaaagatttcaccaacttatacttccatcagtagtatgatgaactgctttatttactttcagatggaataaaagcctctgctagtggatctcagctttataaccattttataggagaatcagtcttaggatgattatccattgactttttgaaatagttgccactttgttgtgtctacttttgtagcattagccttcatttcattatgtcaggttaaagacatttttatgtattaagaaattctaaagaaaagaaacctatcgctctgatattttccattgatagcttgaactgctattctaacatgtttataactctaaaccatttgttttttaagaggttctttctaagaatatattgtacttaactgatggacaaggttttgactttgccaaactcatttctaatcatttaatccttttaaatcatcttcctcttatcagtttaatctatgttaagattgtatttttattcacagtttgcatgtctacaagtttccaaatgtttacttcatttcaaagtacttgctactataataatgcatgttaaacatagatgaatatgcaaagacttaaagccatttggatttagaattgcaaagtctcttttaggtcatgagccaggcataatgccctactaagagaagaaattactgcatcaaatcactcctaagccaaaccaatacatatctcatcatttcatgaaagctatctagcttcagagaacacctaacttaatgcattcagttgtctggaaaaacagccgaggagtttttctttgagaaaagttcagtgcctgataatcaatagaaaaccatagacaatatctgaagtctcaaaagcatatgtctggaatgtcgtgaataagacaatctaatggggcagatggggta

SEQ ID NO: 5970 - DNA, 1082 bp, Homo sapiens
tggaagtattatagaatactacctcatgatacctaatcttcctctgttttatttgtggggctctcttaaattgaataaagactttgtggctctcttgtgtaaaccgcttcactcaaaccttactcagtaacaaatttattttacagacatagaatgggcttcaaagctcagtacaatcagtagcttgatgatgttgccgaggacctgggatgcttccctctcacctcgtggcctcagcatcctgagtctggttattttcgtggccacagatgaatgccaatagccactgcggccacatgcttccctgttcatgaaaaaaactggtttttttttctaccaccaagacaatttagaatacttgcacacccctggatcaataagagtcactagaagaatgccaacacactgattacctgaggctaatgagttatatgcccttggagttggggttaagcacctcgccctggatcatgttgaagaagagtgaatattgaagaagagtgaatatctgaatacaattagcattcttttaacgacggaaaagcttagaagatggaaggcattaggtatcaatagactatgtacaatattctttctaacgaagaatggatacttcagttcctcagttcctggaactcttgatacttttatataacttgatcttatgaatgaattgcttggtaggaagatggttgttggaataccagccagacagtagtccccctaaaaactggtaatgccatttttagtgaaaatgtgatagtttctcgttggttttcaaataaacttttttggtccttttatggatagtcagatgaacttgtttacccatgtctctgggtctaaaatgaaaataagattaacagaaggctttacaatcatcgttcttcttgaaatcggtaaacattctcttctgggattctcagtggtgtaacaggccagatttagcaccggttatcagaacataaaagtcaacaaaggctgggcgcggtggctcacacctgtaatcccagcactttgggaggccgaggcaggcggaacacgaggtcaggagatcgagaccatcctggctaacacggtga

SEQ ID NO: 5971 - DNA, 1317 bp, Homo sapiens
agcatagaatatttttccatttgtttgtgtcctctcttatttccttgagcagtggttctatatgccagcagtgaacaatctgaaaaggaaattttaaaagtattctcagttataatagccacaagtaaaattaagtacctaggaattaacaaacaaagaagtgaaagatctctacagtgaaaactataaaacactgaagaaggaaattgaagaggacacacaccaaaaaaatggaaagatattccatgttcctgatttggaggaataaatatcattaaaatgtctatactacccaaaccaaatactactcaaagcaatctacagattcaatgcaatccctatgaaaatactaatgccgtccttcatagaaatagaaaaaaaatcctaaaatttgcatgaaatcagaaatacccagaagagtcaaagttatattgagcaaaaataacaaaactggaggaatcatattacctgacttcaaattatattacacagctacagtaactaacacatcatggtactggcaaaacaaacaaacaaaacaaacaacaacaacaacaaaataaaacagacacaaagaccaacggaacagatagagaacccagaaacaaatccacacatctacagtgaactaattctcaataaaggtgccaagaacattcattggggaaaagacagtctttcaataaatggtgcggggaaaactggatgttcatatgcagaagaatgatgcttaatccctctctctcatcttatacaaaaataaaatcaaaatagattaacaatttaaagctaaaacctcaaactgtgaaactaccacaagaaaacactggggaaactctctaggacattgatctgggcaaaacatttcttgagtaataccacacaaacacaggcaaccaaagcaaaaaatgaataaatgggatcacatcaagttaaaaagcttctgcacagcaaaagaaacaattaacaaagtcaggatacaacccatagaatgggagaaaatattttcaaactctccgtctgacaagggattaataacgagaatatagaatgagctcaaacaactctacaggaaaaaagtataagaatgtgatttaaaaatgggcaaaagatctgaatagacatttgtcaaaagaagacatacaaaatggcaaacaggcatatgaaaaagtgatcaacatcactgatcatcagagaaatacaaacgctacaatgagatatcatctcacctcagttaaaatggcttttatccaaaagtcaggcaataacaaatgctggcgaggatgtggagaaaagagaaccctcatacactgttgg

SEQ ID NO: 5972 - DNA, 1050 bp, Homo sapiens
aaaagtagattgagtaaaaaaaatttttggagactctgtattgataagcatgcccccttcagactggctgcccagtatattacactgcttttacaactttcttttcatctctcacggaatctacctatgtatatactttgatattgcgaggagaagattgtgaatatcagctgattcatttctttgccgaactaaatcaaatatagagagaaggaaaaatgcaagtatgtggatgtaaaaaggaacaagaagggggaagtgaaataggtaaaattaaatagaggtgtcaaataataccaggaagcctcccaggggacttagtgacttcagtttatgtattatcttgttattggttaactacggctgctgtttattaattcagatcatcattagagacacgtattgttgtcctactgctagacagcttaaggtgatggtggtaggagtcgtgagtcttttcaccatgactctgccaccctgcactactttaagaaaagtcaaagcatgtgaaccctgtggtacccattagtcagtccatgtggagctctctgcccttctctgccctgaccacgtcaacgtaaggttttttgcatgcacaaaggcaaagtacttttaattgaaaagtttcttatttctttagagtgagaatgtgcatactaaataataatcaaaataagtcaaatagctttgttctgtacaaatggaaatttgagaagaagacctcttagaaaatgctaaaccaaaaaaggtgcatttgatttgaataatgacagagaaacactgacctctcttttcctgggctgaactaaaaactggcaggacatgctcagccttcttagcacaagaattagattaaagtcactgcagttttttattagatggctaaggggaaaatatcatccacgctaaatctcactcttagctggtttctctatattttagtccatttacttgaaactggatcttcactctatccactctatggttagctttttgtaagtgaccattcatttagcctgtctgctgtcttaggatgggctcttcagcagt

SEQ ID NO: 5973 - DNA, 1009 bp, Homo sapiens
attggatggggaattttaaattcattaatttatcatttaagaaaaccagtgagggattacccatttgttttactaggtttttcctctctttgagcagtttcatttagaaactaagactcttttttttccatgttgtcagaagagctaaaaagaaagtattttcagctccacggatttcaacagggaggcttttaacagttatgctgcacgtatccaattagcttgtgaaatcttatctcttctaccagtaaaaagggctcaaaaagaaaacattgaaattccaaaaagagcaagagagtgtttttggcaacagggtaactcaactgaaagagagcttactagttaaaaatggtaatttgggcattttgttttcctttaaagaggtgtgtcgatatgcagaagtaggaaccaaatgtgcgtatgtacaaatgctgctgagggaacatctcttatgatgcccagggctggaatttactccttttttcttttttcacacttaacaactagctccataaaaggaattagacaagagtctttctagtgatagatactatgttttccttcttgttgcgtctgtcccccttatttttatacctttcatcctttttaaagtcctttgatttgctaatttctctattccatctaaagcaagcaaagactgcttatttttggagtagaagaacttcaaagtctctaccaattttgagatgtaaattgctcttctgtgacctaatatatgattaatacagcacaactactaacacagtgttttttggtccagtagtaaattggtattctcttaatcagaaaatgtattccctacgtaataaaatagatcttttctgttgacattcagagcactcaaagatccagtccttaatttacattgcttattacacctcagcttgacccctctgcccagccaaaccagtctacaaactgttttacagggcttccctctcctttctgattatagtgttttgctgattttatttccttttgtagaaat

SEQ ID NO: 5974 - DNA, 1033 bp, Homo sapiens
gaaaaaaatcttagaaatgagatagtctctatgattctaaaagtgagattatatacctggagatttcgaagcccaaggctcgtgtttcttcagctgaaaatcactgccgtaatgcacaataaatgcctgccaataggaggcgctcataatcttttttttcattagaagcgactgtttctgaatggagtgtcttattctgttgggcttctataagaagaataccatagactaggtggcttataaacaatagaaattcatttttcacagttgaggagacttggaagtccaagatcaaggcattgacagattcagtgtctggtgaaggcccacttccttgttcataggtggcgccttgtcactgtgtcctcatatggcaggaggggtgagggaggtctctggggcctctgttataccatctcactgggaagtaggtttcaacatatgaatttggaggagaaacaaacactcagcctatagtagggagtatctcatctctttcatgtctggaaggtaaacaaaggttgaacaccatcaatttagaagatcttcatctgacagaggggctgtagggtgtagaagagttagtaattccccaaggctgtacagcttcttggttgcacagcaagaactggaatccaggtctcttggttggcagtccagtgctgtttgcttagcatcacactatccaattaatagctcctctccatcctttgactggccttacaactctcaccacctttattaaatagagggatttccaagtcagtttttgcaagaagctttaggaccatgtgtcccctatgcaccttatgctctacgacatcatctctgagagaaaaagaacgcccatgaaaaatatccatctacactaaagacatttatgtataccaaaatgtggaagcccagctaaaatgggatagcctgaataacaatcaaatatgagtttattgtttacttttttctttcttgtactaactctagcaagccagctcaagccactcagttttggagtgattgctgccttctggtgttt

SEQ ID NO: 5975 - DNA, 1041 bp, Homo sapiens
ttcttttgcttatattttgtttaggattttttaacttatgttcgtgacagagagtttactgatgttttctttttcttgtaatgtctctgacaggtttaaggatcagggttattttagcatcttaaaatatggctctaaaggctaccattatgtctatccatccatccatcgattcactaatcacacaaatattttttgagaggcaatatagcatagtggtttaaaatagagattctagacttcctacatttgaataaaaaaacttactgtaactatatgttatctatttctgtataacaaattttcacaaacttagcaacatgaagcaacacaaagttattatttcacagtttctgtggatccagaatctggaaatcaagaatctgagccctctgcttctgggtctctcagaaaactgcaagtaaggcatcagccagggatagagtctcacctaaggtttgataaggaggtgctatgattcaaatgtgtcctctccaaaattcaggtgtttcttttttaaaaaataaaattagttccagggtacatgtgcgggatgtgcaggtttgttacatagataaacgtgtgccatggtggtttgctgcaccaatcagcctgttacctagatattacgcctggcatgccttagctatatttcccgatgctctccgccaccccctaccctcccctgacagtccctagtatgtgttgttcccttaatcaacccaaatgcccatcaatgatagactggatttttaaaaatgtggtacatacacaccacagaatactatgcagccataaaaagaaacaagatcatgtcctttgcaggaacatggatgaagctggaggccattatcatcagcaaactaacgcaggtgtttcttttctttcttttttttctttatccatgctgtctcttttcgttttttaaaaaattatactttggctgggcatggtggctcacgcctgtaatcccagcactttgggaggccgaggcaggtgtatcatgaggtcaggagttcaagaccagcctggctaacatgg

SEQ ID NO: 5976 - DNA, 1033 bp, Homo sapiens
catgtatgcaaaacactactctgtagaaattgttgcagaaaatttgcaaaccgacaagaggttatgctcaacagagacagtaaaaagttaatctagaatcttggattaagctgagtgatgccttgggtatttatccaaatttgggttgagttaaatccagctgcagcaaatgctactacaacaatggaccaataaaagcagttgaaaaccccttttcttttctaaactattcataattcaattaattaaacatgaaatcatcccaaagcttaatttgtttttccttctagcttacattttttacagtttatacatagttccaatcacaatacagttgtgtctctttctcttttctcagtgtttcattagagaaatatattgttaccaataattattagggattcatttttaatgattaaatctttcaccatattggtatatcaaaaatacttggtcttattctcctgagcagtttggttatttttatcttgtttgctattgaaaaaaattggatgctgttaacacttctgagataatacctttttttgtattttaaattagttttagaataaattctcaagggtgggttacttttccaaaggacattaacattttatgaagcccatttatttcaagtcacatttactagggttttgtttgttttcttgtttttctttgttgttgttttttgtttgtttgtttttgagagagttttgctcttgtagcccaggctggagtgcaagggtgcgatctcggctcactgcaacctccacctcctgcgttcaagtgattctcctgcctcagcctcccgagtagctgggattacaggcacctgccacaacgctcagctaattttgtattttttttagtggagaaaaggtttcaccatgttggccagactgtttttgaactcctgacctcaggtgatccgtctgcctgggactcccaaactgctgggagtacagtcgtgagccactgcgcctggccagtccatttttaatggtaacagaaatatcaccatcaattggtgata

SEQ ID NO: 5977 - DNA, 1026 bp, Homo sapiens
aggtatttgataatatttatcagtgtttgattcttcaaggaggggcctagctgccatggctaatgcctgtaatctccgcactttagtagactgaagtgggtggatcgcttgaggccaggagtttgagatcagcctgggtttcatagtgagaccgtatctctatcaaaaaagaaaagaaaagaaaaggtgtaattaactgggcgtggtgacatgtgcctgtagttgtagccactcaggagactgaggcaggaggattacttgagaccaggcatttgaggttacggtgatcgcataactacattccagcttgggcaacagagtaaaaaactgtcactgaaaaaaaaaaagagagagaaagggatacaagttgtattggatcatttctattaatttagtacccaagtaagtaaaactaaaagaagttccttcaagagtattaaaacatgttgccctggacaatgaaaagcagttttccttagaagaaactcgttagatctttcagtgatggttagcgctgtggaccactgagtctaaccacagggagttgaatccaggcttgaccacagtctggcttttctgagttaccttcaccaaggagctccaggatgctcagctgaaaaacgggaaagtaacattcacgtggagatgttgtcagagtgaaatcgataatctgtataattctttttgcaaattatagtattttcacaagtgtggctaacaataacattttgaactgttagaagtagtttgattccagagggtatgtagtagggcgggtactggggtgaactgagtgaaacaccttgggtggaaaatttaagggggtgccaaagactcaatattcaagataaataatattttaatgcaatattttaaaaatcactacaaaataagtccatgaaaagaaaatatcaatattttaattacaggcaggatctgactctgcctcattcgcctagtttcaataaagcttattttacgaaagcaggcagccagcccatgaatcggagttgctgttttgatttt

SEQ ID NO: 5978 - DNA, 1045 bp, Homo sapiens
aggagcttgaactacaggtgtgcaccaccacgcttggctaattatttgaatttttagtagagatgaggtttcaccatgttggccaggctggtctcaaactcctgacctcaagtgatcagcctacctcggcctcccaaagtgctgggattacaggcctgagccacggcaagtggcctacaagttaattttgaatgctagataattaaatttgacagggtttaatcaactcgtttaatggtatgataaggaatgtttaggtaaggacaggaaacttacagaatgaagttacaggaagttaaaagaaaagttacataatgttaaattcacgtttctacccactgcttttggtatgtgtcaatttgtatgtgcatctgcccgtgtgtgggagaataacggataatggcagggggacgaggtggagagtaacatgaagcagagagaaaggttcctctaagactcagcatcattcctgtctgtatctgatgatgccctgcactttaggtaaagcttagcagtttctcagcaagcttcaagttgtaactttgatctcttttctgtccgtttttgctttagactctgatcaaaattacttatatttttccttcagccagaacagagcaaagcccttcacccatatgctcctcttgaatattttatgactatatttatggcaatgcgtcagtacaaagttgctattggggatcattgtgcttctgaatgaaggacatggatttaaaaccaactagaggattgtggctggaaaacacattgctttggggaggaaaagtaacggcagcactgaaataaaataaaaccatagcatgaggtataatatttagatttgatttagaattaacttattttcccacacttaaacagaaaagtgtctcattatctgatattagtatctatgaataatgtgtaattaaattgacaatatttctcttatctttcatcacattatgaaatactcccatacatggattctaccaggttaaacttaactatgaaatattttttatttaagggaccaagctgattaaag

SEQ ID NO: 5979 - DNA, 1032 bp, Homo sapiens
acaagtctttgttgaagaaacagtatttccacctggctgccatgtgctgcagctatggcactctgtgccttttatttcttgtttgtttgtttgtttgtttgttttagaaacagggtcttgttctgtcacccaggttggagggcagtggcatgattatagctcctggcagctttgaactcctggcctcaagcaattttcccacctcagcctcccaagtatttaatactatgaggcacatgtcaccatgcctagctaattttttaaaaattgttttttgtagagatgttatcttgctatgttggccaggctggtctcaaacacctggcctcaagtgatcctcctgccttggcctcctagagtgctgggattacaagagtgaggcactgtgcctggccccgataccttttagataggtcataatctctccaggtcaaccctgcctggagagacactttccccagttcctcgtttttcttcatggcaacttttcaggctctcagagccctggtaagtagatgaactgaactcgcctttttgttatctatcctccatgtctgtctcctgcacacttgctttggtgccctctccagagcatcatgtcataatgtctcctcttggatgaatgatttgtaatgtattcttcctttaagttcttgactcacacagggcaaagatactgaattgttagtttgagttatgttgcccactcattctaagatccctattgaaacactgatatggaaaaatacttgtgtaggagtcaggagctagcctgtttctgctacttactgctatattgatactgaacaagtcacttaacctctctgaatcttagttttccacatttgtaaaatcatacaatttggagattggaccaaatgtcttttgaagatgcgaagacagcatcagccaccattactcattcacttcacaagctctatttatagagtgtttgcttactctgtgccaggcacccttgagtggagaagagataatgaaaaggcaagttcagttcatctacttaccagggct

SEQ ID NO: 5980 - DNA, 1049 bp, Homo sapiens
aacttgtggcaaattctattaactgaggtaatttaggaatatcactaatcctggcaatctcaaaaagcctcaatgagttaactcttattccctggtcttgtttctcattcttttgccaaagtttagcttcttggaaagttgaattttaatatcatttatggcttcactaaatcttgatgaagccatgaaaaagaagtatagggatttctagaatgatggagggaggggcttggcaagccctccacccaaaaataaatttcaaaaaccctccaaatatttgataaaacaaccatttcattactctggaaattggccataggcatacaaaaatttgagaaacatttattaagaaaaacggctgaaccctgggtaagggcactatgagtctatagcatttttgcctggggcttcttttattatttccaaatacttcactgtggtaagtctaccaggaaagggcatactgtgaaaaccagtactcagttgctaaagaggactggtttggtttggagcagaaagtgaaaaaaacgcatgcccctgtgcattgtcagacacaatagtgatctgggtgacaaaccaacagactagtatgctacagctagcctgacagcatggtcctggttgggacaaacaaaaggacagtagattcaccaaaaattaaacagggagatctagtgaataagacagccattgtgtgcattgagggctcatacatccctatagttcttaaagtctgtacacatgtgcaaatttgcactcacagtcagaagagactacagagctatctatacatcccttgctggacatgagactatgttccagtgcagaaacacaacagggtccagtgtgatttaaactgcctgaactttgttccctaactgacacacagatccattgggaaaagtaagagcttattggctcaacatgtttgagcacaacctctggtcaatcactggttgaccactaggctattctgacacagcaataatcactaagaagccaaattttaaaataaaaataagattttttaaaaactgagcagagacata

SEQ ID NO: 5981 - DNA, 1028 bp, Homo sapiens
aaaaaaaaaccctgcatatttgctcactaaagttcactttttacattttgtgattattgtgaaatagaaagtattcactaatcaatcacttaaagttggagcaccttgtctaaaatcaaacttttcctggaagttccagtttttgaaacaattcttatttaagtgctgtatctttgtcaattctaaaacattaaatatttttaatactaacttactcaaaattttggttttaatttttttaaagcaaatcaaattctatttagaatttgtctaatttaatcatttagctaatttatgatggcagttctgtttcaaaattagtactataatagttttttagtgactctatcctacctccctcatttgtaatagattcagatatggctacaacataaatgacaatttttcagcatatctctgttcttatacaacaaatgtgactgaatttatcaatgacagttaagatgagtgaagaagagtgtataatctgaagatacatttttaatggatttactcagtatagtcattgtacttataggtggcctagacatgtggattaaaataaatgaggctaatctatgaattttagaaaaaatacattcctttcactaattgaggggagtgaaaaagcatgtcttcatttattgacaaacttctattcaactaaaagcatttactttaatagaaaaagtgtcattggtccacaaccaaaaccaaaaatttctctttatgctgtagcatagccaacctcttagtggcctagaacaagtcattatctctaacagttctgtgggttacctggattcgggtgtttcttgtgtgggatctttcctgtggtttcagtcagatggcaactaggcatagagttacctggatacttagacagaaagcagaagctgccaggccagcaccatttccattgtattctattggtcaaagccgttgtagtgcctgagcagatttaaggatgttgagaagtacctcttgaaggggacattgtttaagagcatgcagcatgagatatattg

SEQ ID NO: 5982 - DNA, 1690 bp, Homo sapiens
taatagcctcaaattttctttattaactgtgatctgaaaatgaccactttgtatctttccaatcacaaacattcccaatggcatggggatggggaaagaatcgcttgttatagttggtttccacagtaccaattaatgttttcagtattgtttgatttttttaatattttatctaaatattttgaaattgtatagtgaaaggagttttgccatccgttttcaaccccacaggggcaagaatgtctcacatgttgtttgaataccccttacttactcagttcccacacctggaagcagatcattatcacgttttcctaaagtgtcactcccgggtgtgatttcacttttactaccctcacagctatagcaatatcaatttgcacttaccctgggccttgcttctgtgcccaaagttcttcaaaataacaaaaatggagaagttgaagttactggaaacttaaaaggaaaaggcgtttcatttacaatgagagggattcagtgacacatgttgaactcagagtacttttgcctgtaaacattaaattgaagccctacttctcttactttgagtttcagctctcagtgcctccagacctttggtcatgtactattcaaatggtctcattcaactaaactccaatgaaacccaataaaaagcacttttcaggaaaacatcttggtgcctggtcaatataatcaccacagaaagttatctacaaagaacgtctatggtgggtgtggtagatattttatgacattacttgggcaaaatatctgactaattatttctccttaaattgttaataacaagtatttaatttttttctttattaaaatacttcattattaatgccaaagagcctaaaaagcctacaagaaatctgacaaattgatgactttaataatgttgggtaaaaaactatttttctgccttggtttgaatctttttaagtttacatacttaaactttcctaggatattagtaaaggggaagttgactaattaagatattttactaagtgtcatagatgttttaagagcaaagtttaaaggtctggagttttgtgtttatttttgtttttaaaataaatttgagtctatgtagtgaaatgtctttacattcccttgcagctgttttaagcattacattattcaaactgtatcagaaaaatctgctgactgtcgaaaacctaaatgatgaatgagaattaagtaataggagattcaactgaattttttgctgtaaatacttttacatgctataaaaataatgcctatacctaatacatatgatctatatctcattcatccacactatgctttttattggtaaaggaacaaaagacaagaatgccaatttttactgttaatgaaaaggagtcattgatgaagttcttataatagctgcaaacctgggaaatttcttaagatgcctaaaccaagaagtaagcaatcagatacttttttagaaaatatcattgtagagcaccatgaagtattagatttatgataaagacacatccacatgtgaaaatgaagcaacactgtccatcagcacaaacaattgctagaataccattattcctgggttttcatgagcacaagtacccaggtactgtcatgcttgctgtgctatagcaaaagagcagaagagataactgggctaatgagacagtctctgttctgcctt

SEQ ID NO: 5983 - DNA, 1031 bp, Homo sapiens
agttaaacaattaggcccatgttcataactagtgagaaggaggaccataagtctgacactactttgctatattgctctactatcacaagcttttaaattttgcctgcaatgtttcattttgcttttaagcaccagtgtatctgtaagactacttctattggtctgaggactccgctttcacaaaaacttatacagcatgttatggtttcgaaaatttttaaatattagcacttggacccatgttaagtacatctgttgtaaaaagatgaattctgtaacataatgatgagaaggtcataagtttaatgccttagagacatacaatgggcaatcagaacctattgcaggatctactttttgtaatgcattgaaacccttatggatgtttcatgagatgaaacttcatggttcagtgtttgagacattactaagtagctacatttttttacataaaatatgttagttaataaatttcttcaaaggaggaattaggaaaatttaaacagcagctaaagacaatgaatgaagactgggaaaaaattattatgttttgttatataacaaaataaaaggataagctgagtcatgacaagtgtgtttgccttcattttccccttcaatttcctctgactactgaggaaatgtaaccttagcacttcgttggtgaatctgaaaagactgctttgcttatgagatgttctttgttgactaaatttctaagtcatcatgataataatgctttataatttacaaactgtcatcccatgcagtcatcccatgcattatgtaatgtaatcttcaaaatacctcaatctagtagatgaaagaggttgtccctgattttccagttgagaaaatgcaggccaggatcatgaagtgcattagtgtagttcattaacagagtctctgatgcaaatttaggtagcagtaatttaaagcccttgctataagcacctctcctttactccttctgctccctacctctatgtgtggactcctgaataaggctcttaatatgcctactacccata

SEQ ID NO: 5984 - DNA, 1035 bp, Homo sapiens
ctttacctgagccctattagcagtttccgcgtaataaaagcaatcattgtctttactaaaggccatcgactttcttccctgtaatctcaaagagaaatcccacatttatttactttttaaaagacattttatcttatttttaaattttgatctatgtatttatgcattttgggaccgggtcataagactgactaatttttgtatttttggtacagaagggattgcaacatgttgccaaggctggtctcaaactcctaggctcaagcgatccacttgcctcggcctcccaaagtgctgggattatagacataagctgcagcgcctggcccccacatttattgtcattgagcatttttaatgtatactctgtttcaatcaaagttttattgagcacctactatctccaagcccccacgtgagactcaccacttaaggcagacttcctctactagttaaccctagagtgctaagaatgtgccctgtaaacatgttctttaatttgactcaacaaaaaattgctttttaaatctgaattgttatgcctgagtattttttgctttgtacagaaagtcacagtcagctttttccttcttagaaatacttgtgttgctgctgttgttgttctgttaagtacgtccagattctatctggcaatatttcttctttcttttaaagatagagataattagcactgattagcaaagagatatatgtactaataatcttaactaggtagttgcaaaatccaaaacattgaatactagggaaatttgagcttcaggctgttccaggttgttaaggaatagggccagaagtttttttcaacaaatagaaaatctaatacaagccttttgctcaacattttaaatgaagttgagtttcttaatactgaggtaccttttgggccatattagtaaatgccaattaccttttatttttattttttaataaagagtatgcagtgtcctggttatcctctttacattcttggttaactgtagttacattgataagtatctgaatcaattcctttgg

SEQ ID NO: 5985 - DNA, 1051 bp, Homo sapiens
tgctggtgatggtttcacaattgtatacttactccaaagtcatcaagttgcatgtattagatatatacaacttttagtatgtcagtcttaccttaataaagtggcttttaaaatacactaaactttgccaaaggtttgattggagtgtggcatttccattctttctggcttttgaatggctacatgtgaatagccctccacctattttgagtaatctcaaaatcaaaatagctttttggaggaaaatcttccattccgtactatttgagtttctcatttaaggactggcaaagctttaacttttcaagcgactgctgagtaagaaaatattgagctttcttagtatactttaccatcattaacaatttagggttcattggcttgaaataatattttgcttatctcacaaaaggattttaccttctaaatcatttaactcaattcaccagtgcttgctatattgtcactctgtaattcctaatttctacagtgcggtagttattttttctgaaggatattgtccttcaagaggtgatctgttgtcaaattccaattaatattcagattgccacaggcttttttctctctctttcacatttgttaaagggcatcactagatcttgagagggtattaaagagcatttgctagatgtaaagagtgcatacaccaataacttgacttagtaggttgaaaggggaaaaagcaaagtgtagagttaaaagtacgtaaaccttataaatactgccaagccagtaacacctgttcaagacattaaaagaaaatcttataatattgagaatgtaaacccttaaagcttagaagttttaagcttctgcatcttgcaattaagaaaataagaatacatgtttaaaatatgaatattaatctgacatatttctgctagaggagattatattaataatttaccaggatattttgagttagtatttttttgagtgggtactcttggtatttaacatttactaatatataagcatcttgaaaaccagaattgtatttacaagtatgaactctatagtcaaataaata

SEQ ID NO: 5986 - DNA, 1609 bp, Homo sapiens
acccctcttcctatcttttggccccacttttagggatggccactggaaacttttctttgaagaacacttaaaatgtaagtgttcctcccatacaagtgatcagtttcatttctaaacaagatgaaacagttgtttaggtatttgtctctggtatccagacacaattatatcagagtatttcctctggtcttgaatcagaattccctttacagctctgactgatttgaacaaagttacatgtatagcagagaggattttctttatggtgtaagcaataattttattatttttctgactaaaataaaaacaaataggaaattatttaccaattcttctggtgattccacatttgtggttcttgcatttataggtaaacacttatttattacatttactaatatgtatttagcacgtactataatgcagcaacataagtgaaaattatctcatgcatactttaaatatgtaataccagattaggatgatgatgaaacaggattcaagaatcactgtgttctcaacatctattgaactctcttatgcatcagtctctttgttcagtactttacatgcattattacttaatcctcaaagctcatactagtgttttttatttcaataaagatttgagattatagaggttaactagcctgtcactcctaataaggagctgagactatttgagcttcagaacagtgtgacaagaaagcaaagagaaatactgtccgtttttcatagatcgttctgaaaaagaacttcaagaccatgttaatacaggtgcagagagatatgagctctcacatattcttggtgtgaatataaggtgatatagtttttcaggaaagcaaccgggctatatctatctagatggaagcataaaagtgtccatattgtttgatttagaaacctcatttctgggatttctaggaaactagtttatggaaataatttgagatgcatcaaagaaacatgtattctgatgtttttcagaaacacttgaaatggaagaaagggtttggatagaaaggaacaccccaatatgaaaagtgaggccctacatcagtggcatcatgggactccttctaggtgatttcatagaactaggttctcacttttcatgttggcgtgcttctgcctatccaaacccttgagatccaggaagactttgatatgtataatagggtcattaagtcaaggataaatctgatgaatctccttgaatcatcaacttaagttgatgatttggagtgaggttgattttatattacacatagatgttgtattagtagaattaggaagtatataaatgttatgacaaagtgatggacttcaaaaaactttccaaccactttgagatacactactgtcagacctcctaaaggaattttctctcctttgctattaagcatggcagatacctcagatggaaaatttgacaggtgtgaatttaaatgaataaatgttgttattaataaaacaataacatttccaagaattaaaaagtagagttataaaaataatacctacggaagccacagagtcatcaaacccatttgacagatgaaggagctgagagctagggaaagtcagtgacttattcaaggcgtta

SEQ ID NO: 5987 - DNA, 1048 bp, Homo sapiens
ttaaagtaagtcatcactattatcataataatgtgtgacaaaacaattatactgcatatgatgacattttttccatttctattgccagaaaatattttttagctattgactgatttttttagatgttgactaaacagacacaacatactataacttaatctgctgctctgctttgagagaataaatgagtcaagattcttcgcttggattgatagtggttccactggcaattgtaggaaatgcaatggaattttagtgaaggaaaaaattgaaattgtttgtcagcatgtcaagtttcagctgctccacacgattcaaaattggagctttgaccctgcctaagaccatgatgaacagtcatttcttatttgtgccctgttttacctactagaattcaaattctattagagaatatatcatcatttgctcattaaatagttaaatgaatggtccattgtgagaaaactgaggattccttccaagagtttgaaataaacctctggagagctaattcagaattacagggactatagatttcaggttcttaggcatgggcaagcaactttgaatcagataggaatggacaccagttcatactgtagctattttttctacttaaaattgtcttacctgtgcttatatattgattgattttttaatttattatttgttattctctttttagagttggggtcttgctctgtctcccaggttggagtgcactggcagaatcatagctcactgcacccttgaactgggctcaagagatccttccaccccactctctcagttcactgggattacagacctgaggcacagcactcagctctatagctttgatttagtcttagagaaacacagaaaaactagagtgatttcaaatccattgttctattttctcttgaaaggacacatttttctgcacagtgtattctaaatagttgatgatgcaaaagaaaaagaaaaaggagctcattttaaaaaatgggtaactattgccagtatctgttaactactggtaaaattgtctttcaacagagaaaactga

SEQ ID NO: 5988 - DNA, 1672 bp, Homo sapiens
gtagataacatttaatgccctttacttcaaagggtatgacttcttttcccaaggtgctcactgagtcattgttgatcagaaacgcctcagtgttcagaccattactgatggccatcttcatccaaatggtctattttctcaggcctttgttttctgtaagtgtcataattagtaataatgctcatattgataaataatatttttgagtgctgtgtgttttgggttagtaaaaccctgttaaattctcactggttcccagttctggaatcactttgaagctatattctgagttgtcttgtcataacaaattaacagatgtaatctaatcattctacgcaccttctaaaagtaagaatttttgaaatgaaatgtaacttaatatttccttcattctaaactgattcctgtttattttagcaaaatgacttcaataagttaaatgggcctgtcgtcgtttatcagaatgagccatttgcttgtatttgaaaacatgtacttacggaaagatcatttgaatgagagctctgagttttagacccacatacagtactagctagttgtgataactacattaagtcaattcacctttctgaactttagtttcattattgggataaaataaagggttttctttgatcatcagttttcttaaatttacaactaattcttaccttacaactttagttgacttaacatagttatctttcctctttagattttctttcttaacagtccttggacacccaatacttttcccgtgaatcatccatccaatcatttgataaacactaattgagcacctattatgtttcaagcactgcatgagatgctaaggtcacaacagtggaaaaaaataagtggcccttctgcagcttgtagtctagtgggagaaaaaaagattaatgaaaaaaatcagactatttaatgtgaaattacaaatgtgatgcatgctgcaattagagaagagtgtggtcgcatgataatgaatacagagaaattttcaaaaaagaaaggtaattgctaaggcaagtgttaaccagtgatgtgtctgatggatgtgtctgtgttgatatttctgacaaagagcaaataggagcaaggtgtgcaaatagattagagatcaggtaggagtcttgtaaagtatcagttttatgatcctgtctattctctgcagaaatgttgatttagtgtttgggacaaaatctaactctcacgggacttataatttagaggagcaatctaattaacccaaatttggttatccatggctttctgtgagctctttcaattacatttagaagaatagtatgggaggaaaatccacaaattctaggcatggttccatctggatgtgtttgtgtgtagagattatttctggtgccatattagtatctactaatatgtattagtatgtatggctacctgtccttatctctcaagtctgattctgttcagcataggtaagcctttttctgaacctcaaggagtgctttaagcagtgggacgctaggagtttcttgttcatgggttagtgctaatcagtttaacaaatatttggagaacctattcggtgtcaagcactgtgctggcaataaaggctatgtagatgattaaggatatgtgaagttcataatttagtaacttcctaatttaataagctcaaagtctaatt

SEQ ID NO: 5989 - DNA, 1052 bp, Homo sapiens
ggtgtctataatccctgagtaaataacatacataagtgaagcaagttttttgtccctggaagttttggttgaatgagtaaatctcttaagtgggtgaggaagtgcactaaatccgaatgtactgaggttgacttgggtctccgttctctgaatactcttcttctgcattacagcagtagatggttctcttacctaatactctttcttcatgtttttttcctaaccttctttagctatcatttcttaaatctatttacccttactctgtcagaaaaaaaaaaaagccagcacatatacacaaggaaaacatcttcttgcccccagtagagtagacctgacctgtcttagaggaaactagtcatgactctgttctgtcaagctctgacctaagaggtaaagtgagaagaatgttaatttataatattgaaacaacagttttgcatactttttcaggtaaggaggctttggttcctgtaagtcaaaccaaagagacataacttaagaacactctatgagattcctctgggagttgggacaagagctctgagtacatgcagaaggggtcagtgctgtggtcaaagatacttggccttctagaagaggcagctgtgcaactctatgagtgtagaagagaactacaggtatagccaatacttggcattaccataggatgtgtcaggattaactagaaggcactctcaaagccttccagtaaaataaccaaaacatcaggagaaaataagcgtaagaaagatgttgatgagaggcactcagaaaagggaaagatattttgcacattataattgagttttaaatcatctagtggaattaccccttaaaagggaattttatatcatgtaattttatctaattatctacttaaacatgggagccaaattcacttatccacagcctctaatgttcattttaagtgtgaaaataggcaacaaaaaagtaagcatatgagtacaaactaaacaatttccccgtaatattttggtagtacacatcactgtgagccaagtgtggtggctcaggcctgtaatcccagc

SEQ ID NO: 5990 - DNA, 1289 bp, Homo sapiens
cagcgtacgcaacataaagaaatcccgtctctacaaaaaatttaaaactattttttaaaacaatgaaacattagttgggcttgttgatatgtgcttgtagtccagctactcagaggctgaggcaggagaatcacttgaacccaggaagtcgaggctgcagtgagccaggatcatgccactacattccagcccaggtgacagagtgagaacctgtctctaaaataaaaagaaaagaaaacaacaacaaccagcaacaaacaaaaacataatcttgggcacatggaagatctctctttctttctaattatattcctgctcaaatattatgttaaggattcaatatttatttttttattgttcatgaaagtgttttttattgttctaagattagatgtatccaagtttattctttcttcagcatttgctttttcttgacttcatgtcagaaattaaatacatctgctttcctagtagcagagaggatttgaatgaagatcgacatttctggctgtcctttctgaataatgtttccacttgaacttggcagtttaacaatacttccaataaatagtgccatagaataattcacttactgtttaatgccactgttttaaaatctcctgctaccacctttctccatatatggtcttccctggatcatattttgtatttgtgagcactctgattgaaagttagtgtgcggaaaatcttgagctattcaataaatacagtttagttaccaaaaacttaggttcaggtatcagacattagattgtagtcccagtttctaccaatatccaggcttgcttagagcttttcacacactgcatgaaccttatattggggctgatagtattatatagagcctggttatctttcaagtgatccccaccctatctccctgggggaaatctctgcatttattctgttgttctggctaccaaaatcccctttctctgttttgattcagcatttctccctttacattggctcacttcatgtggtcctggaggagctatcaattaaggtgttgccatccccaaagggtaggcacaggactcaagcttggccacttggattctcttacttctcaatttggttcttaaagtgacacacaaggatgaaaacaattggagctgcatttttctttaaagtgactgtccattgatttattaggttgatgcaaaagtaattgtgttttttgccattattttagtggcaaaaaagacaggacccagggaagttctgagcgctacgtttcacattattttggttcaaaagtaattgca

SEQ ID NO: 5991 - DNA, 1024 bp, Homo sapiens
ttaaagtgcttggactgaatctagatcataatttcgaagttcagggagaagaaggtttctgcgggtatctgctggatacttttcatcttgggtaggctatgcaacctgctggatggattcctgtagaacatcttccactgtagctggcatgtgtcttgtctaatgggagtgctatgctgacatccaagctctctccatctgtgcttctccatgaatctctcctttgtttatttctattgtaccagccatgtttgtgctggctccttgtccatttcccaatttagtgaaattttcaggatagcttacatagtatttgttatttggcaaaagggcttggcattcctttagaactgatgttattaacactttggcaaaactccctttctttattcaagagggcagaacagagtactctttatgtgcaagcaaattcacccaactttagtttctttttttttttttttttttgtcagttttggctcttctcaagcatctatacaaagttatatcttgaccaaatatgggcacagatgttcttttactgtacagcaaaactgctgatcgtgataagaaggtatctgtgggtaggttgtgtaggtccaggaattctttgtgatttcatgcagcatttgatgtggcatatacttttataaaaagagtcagatattatgagattttcaatgtttaataaataaaaacaatttaaaccacaaataaacaaaaaaatacttaaaaacttgacttttctattaggctatggaatatttaatgtctgaatccgtattaggaatgaatgaatctctatccaggcctgaggtcattccaaatttgttagaatagaagtgggcagccatattccgagggataacatgctggatctctgttatgccaccaatttaaatacatgccagggaggtgtagaaaagtttcctggggcactcagaataatcctatccctggtgtcactcaactgcctttggaggcattgcagcataggttcttgtgctcagtttcatcaagtgcc

SEQ ID NO: 5992 - DNA, 2369 bp, Homo sapiens
ttcaccatggaatactatgcagccataaaaaaggattagttcatgtcctttgtagggacatggatgaagctggaaaccatcattctcagcaaactagtgcaaggacaaaacaccaaacaccacatgttctcactcataggtgggaattgaacaatgagaacacatgaagacaggaaggggaacatcacacacctcggcctgttgtggagtagggggaggggggagggatagcattaggagatatacctaatgttaaatgacaagttaatgggtgtggcacagcaacatggcacatgtatacatatgtaacaaacctgcactttgtgcacatgtaccctaaaacttaaagtataaaaaaaaataaaaataaaaataaataaaaaagaattcagaattgggtgaaaaagatatgtcaggtctttttctattcccaaatagttggctaaatgagctatctgaagaaaacgtgtgtgggaatttgtgcttgtattcttgctcataattctgcttgtgtgtataactcaataatcttagctagctgtaaaattatttcatatttggttggcttgctttgtatcatgagtacagtgtttcagagatggaaagtccttagttgcagttaaagattttgtaagtaccactccctaggacactgattaaacttttacactaggtttgttaaggaggtaatccttctgcgggtcatgagtgacctggttgagagaaaagagctgactgggcacaaatccacttcccaccccagtactctccacacagtgaagatgactggaatagccaaactgatgtcgatggagcactttggaaaaggaaggctagagctctttcaattacaccatcgaagatgttctccctgaccattaaatgcttttgacagtttccatgtctatagcttacagtttattctgcttttctaataatgaactcttctttctgttttaggaaatacaaaggtaaacagttaaacatgtgtaattttttttaaacttaaataactccatgtctaaaacaaggaattgtgaatatactattgagagacagcaatttaatgattaagtgtatgggctgtggagtctgatagtccagattcaagtcctagctttgtcatttactgtgtgactttatgttacctcatctgtaaaatgcagatgacttatagataccccatagagctagaacaaagattaaatgagacggtacatgtaaagcatttaaacaggacctggcaaagtgttaatgctcaagaaagttagttattgatattgtcagtataaatgtatcacaagaagtgcaattgccacacaatatacctatttatcattaggttttactttctatgtgaaagaatatacgcatggtctgccttggtaattagggactttcatgataatatttttaaaaataactacagttacttaagctggaaagaaccctgggcaagggtgtggctatgccatgcattaatgacaaactatcaaggaatatgtgcagcattctattaattttaatggcatagatatataaaattagcagattgccttgaaatattttttaaagcagtcacttttatcttgtgagaatgactttttttaaaaaaaaaaccttaaatcttttgctacagccaaataatctaatcactcttgtggatatggccaacagacataaatttttctcataatagatctttctcaaatgacagaaaactgtctcagtacttccatactgctattattttagctctcttcattcccttccaattctgttctgttaattcaatgtgattgaaaagcattgacatttattcttacagatctctttacccaaactgaccaaattagaaggcatttaatctaccttgtataaaagtggaagcaatagaagggggaaatgagttgtttttaaatcccattttattattacattattacaacggtattgctattagctatattgatcacagctgacttcatggctgtgtgttgaccacaaaatgtaatctaaagggcatttcagatttcaaatgactttctagagtatctgagttaaaattgttaacactacatgacaactgctattatttcagtgtcagccaaatataaaagaacattaatattcattagtaatgttacagctggtgactccttaacaacattgtaatgatttgaatagttatttcaaacagtgtgttggaatatacacacaataagccctgattgacacaatgcattaaaaaacaacccagtaatgtcaaggaaaaaaattaatatgtatgcctgtatattaggctaagtaactaaatgctttagaaatacacttcagctgataagacctaccagtatgcaaggagtgac

SEQ ID NO: 5993 - DNA, 1044 bp, Homo sapiens
tcctataacatttacgacattcactcttcttggataaaataaggcttgttgcgggggatcaggcctgaatgcatcatcaaatatacaccaagattcaggaatttatgaaacacccagctaattccactggattttactgatcaaaaacacaacttaaaggaaagactgaaacattagactacattaaaattaaggacttctattatcagaagtcacaattaaaatgaaggtacaacccacagattgggaggagctatttgagtgacttacttcccacaaaggatcatatacagaatatttaatgaagccctgcaagttggtatatgaaaatgataatatgatacaaatgaacaataaacttgagtaaatactcataaaaaaagaatatccatatgctcagttaacatatgaaatgtgggttaaccttattagtcatagtggaaatgtatattaaacttataatgaaatatcagtaacactacaatggttaaaatgagaaagactggctctaccaactgctggtgagccactggaactcacatccattgcttaggagaatgtaaattgttaccctctcttttagaagccatttggcagtatctattaaagctgaacacataccaacagaaatgcatataggtagcaacgatcatagtcaagaatattcaaagcatatctgtttataatagtcataaagtagaaacaattcaaatcagtgatggtcgaatatataaattaactgtggtgtattcatacactgaaatactgcacagcaatgaaaataagcaaattgctatgcatgacaactcaaatgaactaaaaaatagatattgagcaaaactgtcagtcataaaatagtatatgtcatgtgattccatttatacaaagtaccaacattggcaaaactataatccagtagtcagaataggagttattttctttgggaaagagggtggtggtaggactgtgaggggacacagagagtacttctctcattctaattaattttttttttttttttagtttttttttttttattatact

SEQ ID NO: 5994 - DNA, 1089 bp, Homo sapiens
tttctcctcctctgttgaattttaatattgccatttttcgtcacagtcttttgcttagcccaattcttcacacacaatgagtacccaatcaagttccaatcaacgcaggatattttcttgactcctttgtgaaactcgcaacaggggtcccctgtttatttagcctggcccactcaaccccttgcaggagggagtacaggagcaaatgagggcaggaaccggccgaccactttggtgcctgcaggagcaaactccatgtgggccccgtggcagtgtccaggtgggatgctaaggccccggagggtgtgttaaaatgctctcttagctccactgtccacagacagcattgtgttatcagctcagtgggccctttgccttgtcatgtggggcagctgccttctgccagggaggtcaaagggccagtgtgacagtctttttgggtacctgcacttggtgcaacctgaattcttgtctggtgcccaagaggaatggggtcacgtggatgaattgaaggacggtgaatgcagagaattttattgatctgtgaaagtggctctcaggagagaagggagctggaatgctggaatggggatgggaagggaaggtcgctctcccctgaagtcaagccacctctctgcctctctcttctgaagccaggttgcctctttccaatgtctagctgctgtctccgaagtcaagttgcctctcctcaatgtctagccatttctcctctctactgaacctgcagtctttataggcacaggatgggaggtggagtgggccatagactgttttggaaaagaaaacattcaattggaaaaaaaaaaattcaaaaagaacaatcgggagagagcaggcacacagggatagaagttcccactttgggccatgggtttcaagctttttggcttgaaggtggggttttgccagggacccactgctttctgcctagaatttctctgcctcctgtcgctatcacagtgacactgcattatggaaggataaataagaaggaaaaagacacaaaggaatgaatacctggtgggtacagactgggtcttgggactgaaacaccttctagctgcaaat

SEQ ID NO: 5995 - DNA, 1053 bp, Homo sapiens
ctgacccagatgatacaatgactagatgagttcacagctggctgtaatcttatctcagaaagaaacaggaaatttaccagttactgtatttctactctgttctaggcacttagtatttaactatctcatttaatttttacaacaaacctataaggtgcatgctatatttatagatgatttagttgatatccagagaagtcaaatgacttgcctactatattaacaaatcctggtaaggagtagttcattctcaaactaatggtaaaatcttttgagcctaaagaactccaatatcttggttaacatagatttagacaagtcactagtgagacactgtactgaatttttaatactacattatttatataatatatacaaattaaatgtatattgtgtatatacatatatggatatacatatagagttatatatatgcatatatatgaaatatatattaaattaaatagttggcttttgcaatacatattacatatttttatatattatatgtatatttaaattatataggataatgaatgtaaaatagaatgaagactctagattatataaagtataaattaatctctaaatttcatcaacatgggagaaacaatcactacgccagtctgtaaattgcatgaggaacgcagggcagtctgtactgtatacagttatcatcaatgtctagcagagtgcctgacacaaaaatgcataataaacatttttagatgaacaaataattgatatgattaaaacccaagcaaaactcccagattatctagaaattcacaatgatagctagaggaaacctggtatccaaagaaaagaaagttggaaataaattaaataatatagataatactctacaatcctatgaatgatttttgcatattgacctcatgtttttcatattcatgaaatagccggcaaaaagaattagagggaattgtagaatgaattatgtcatacatggaagaattttctgtacattgaaagtggttagtacttggatgtattacttatgaaaaacatgcagtcttctttagacatata

SEQ ID NO: 5996 - DNA, 1029 bp, Homo sapiens
taccatctttaacattttcatcatgttcaaatacttccttcttaaatgatgttttggggacagtgaggggtgtatgtgaatgagggtgtgtagaaatcaggtgaaaataataaaaatgtgttcattgtgaatcagtttaagtctgagatttcactttaattgattgaaatcatttcctttagcctcatctccaaacaaaatattggtacaatgaaaaatctacctgcttttttttaaagaatattatgtcagtgtcaatcataggcaattctgaaatgtgttgttgctaagatgatacattcttactcatattatttacttagagactttaatgctcttaaggtgtgaaggcttttagattattactgtatttattaaaaaccaagggagacaacaaattacttgggtccttacagtcttatttaagtgatcctatcctttattgatacatttgaatattcaaaacaatgtccttattgtgaaatatttctgaacagttttgtccggtaactctgtccacggtgttaggatttcttcagattatgcaacaccagatactgcgaggttgaagatgattttttttttaacatggcagttgcttagatgtctttaaaatagcaatgttaggaatcagagggtgagattcagcatttcaatcaacatggcaacaattctgcagtcattttgtcaagggaccctgtgcttgcttggggagcatctctacttgtcaaaacagtgacttctctacctcaatctctgtgagtccatgagaacggtaataagatggctgtgtccatgatttttgcagttcagctcaggaaatgtattttctatttaagttggttagtccatactaagcagtcctccaatacattatctcattgaacatacagcaaatttgttaagttgttgacaaagtctacaaacatgaagcccagtgcttcatgacctagttatgacctagttaacttcagtgtctctaggataatattttttactgtttctctcttaacaaattttctccataat

SEQ ID NO: 5997 - DNA, 1050 bp, Homo sapiens
gctcaatatactaacactatgttttctcttaacagattcctacttaaaatacttttttggtacgaaggctcacacaaaagctgctcgttatttttcaaccattaacttttgttttccaattacatttttaatgaacagttttttcaagaatgcctatttaaaataatgtcattaaatgggagaaaataggttcatatttaattgaatttgttttgtgccaagtaaacaagaacaatgttccctaagggctttaagcagattcaagaaacatatctgaatcacctataatcagtataaagcacatcacacaaaggatgagagaatgtggtgcatgtgcacacgagagagacagagacagagagagagagagaaggaggaggaggaggaagagaaggaagaggaggagggagagtaggaggaggaagagaagaaagggaaggaaagaaaagaagaaagggaaggaaagaaaagaagaaagggaaggaaggaaaaaaaggaaggaaggaaggaaggaaaaccttaacatctagaattttagagaacaagaacgtgtttatttgaaagtaggctctaaatgttaaggtatcttcccttgcacttcaaaataatatggcgtgcatgcaataaataagaaatgcagccgggtgcagtggctcacgcctgtaatcccagcactttgggaggtcgaggcaggcagatcacgaggtcaggaaatcgagaccatcctgactaacatggtgaaaccttgtctctactaaaaatacaaaaaattagccgggtgtggtggcgggggcctgtagtcccggctactcgggaggctgaggcaggagaatggcgtgaacccaggaggcagagcttgcagtgatctgagattgcaccactgccctccagcctgggcaacagagtgagactctgtctcaaaaaataaaaagaaaaaaaagaaaagaaatgtgcagcttatgaaatgataaaataaactcccatatacctaccaccaaccttaatgtttaaaaatgtactatccaagtagagtagccatcactcttagca

SEQ ID NO: 5998 - DNA, 2266 bp, Homo sapiens
ctgtgctgattctgtttctcttaccagttctgtaagtgctctaaatctccttatgggcccggggtttggaaacacaaagccagagtgaattgcaataaatttctattttctgtcctgccagatctctccgttgagtcagtgagcacagggccaattttctgatggaatgggggtaagaagaaatcataaatacaaagaggagaaaaacataggttaatagcacaaaattgaaacctccataatggttttcaattttactcctcagtataaaaatcaatatagatcacaaaaatcacaattactgctgttgagcatctgccttgtaaatggtcctattatagccctcaatggttttactccttcctttttgtttgcctttaaattgaagtatgcaataagcttgtaaaagtcacaaatttaaaggaactatggtaactttttaagataatcttgacggtaacaatcagcattttcatggcactgtataactgtattcattaagtaacaaaataaaacactgaacataataggtacataatactgaagctccggttgtagaatttctgcttcattgaatctcatgtgtggtttcactctgcagaaataagaatacctggaataaaaaatagagaccttcacccttttcaaactgacctattattttaaactctatatttaatgtaatgtatatatttttatactagagcaaagttgccacttgtcaaagtccttcaagtttaacctttgtgaatagagacattgtttcggactacaaaaagaattcttttttttttttttttttttttttttgagaccgtctcactcttgtcctccaggctggagtgcaatggcacaatctcagctcactgcaacctccacctcctgggttcgagtgattctcctgcctcagcctcctgagtagctgggattacaggctcccgacactgtgcccggctaatttttgtatttttagtagacacggggttttaccatgttgaccaggctggtcttgaacccctgacctcgtgatttgcccgccttggcctcccaaagtgctggaattacaggcatgagctaccgtgccctgccaaagaatttttttaaaaaaatgacagtcaggacactcgatttctgctagtcccagtctgctagaaagaatgtacttttacaaaaaccagttcatctcaattttgctcactatgttagcagagtatgtctcacttgtctactttcttgtttgtttcttgagctacctgttacctctctcagtgagggaagttaaagctgcagcaggagcttggagagctttttcaactggttgacagctcttattgtcacaccttagttcatacgctatctataggcgactattgtttcagtgggttgtggtttataaagtgctaacaaggcttgagacataaagatactattatttcaggtgacactacttgttatgaatctgcagcttctcacatccctgactcttgtgaaaatactccatatacaattttccggtctgtttcagctatatcatttgacttccctgaagtatgggacttcatgaaagcgtgattccctttcattccaactcctgatgtgatttccaagtgaatttacattattttactgtatcattttacattattttaatatcttagtgagtttttaaatcagcagtcatgcctcagctgaatctcaagggacattatatggccaccaggaaaagctagtgctaattaagtttttctctggatttctcattactgacaaacagctcttgacttcacaaaaacaccagtggcttcacagaagtagcatccagtagttggtcaatgttatttctgtggttgctataaccacataaggcagctctttgacccctgaggatcttatccctggccattcctgtttgagtcagggatatacacttttcccaaatttattgactttattaagtggacaaccacctaaatcaatatctctctctccttctccctctttcccctctccccttctccctttctttatcctctctctttttttcaaatttgagagtccatgattgggtattgatgagcaggatagcttgggggcaagaaacctatttattagcaatgacctaatgtatgagcatagaaagaaaagactgaggaaagccaaagatggagaacctgacagttccgagaaaatatgactgacctcaacctgtgaggctttcatgttctcaaatgacacagaaatgactaattttcttctgttgaattta

SEQ ID NO: 5999 - DNA, 1022 bp, Homo sapiens
cctatcatactgcctctgttgggagtgttgctatttttaagaatgggctctaaagacagatcactttatcctggttgtatatttaaattactcagagaggccaggcgtggtggctcacgcctgtaatcccagcattttgggaggccaaggcaggcggatcacaagatcaggagttggagaccagcctgacaacatggtgaaacccgtctctgctaaaaatacaaaaattagctaggcgtggtggcatgcacctgtatcccagctactctggaggctgaggcaggagaatcacttgaacccaggaggcagaggttgcagtgagccaagattgcaccgctgtactctagcctatgtgacagagcaagagtctgtctcaaaaaaaaaaaaaaaaaaaaattactcggggagcttttaaaacatgccagtgccttatctccacccatggggagtattctttaattgttcagggcctgcttctagggacaggtaatatttaaatctcttcgggtaacaaacaagaacagtacactttgagaactactgatttatatgaaagctccatgagtgtctcacatccaaagataaattaatcttagctttaagctagacaaatgtataaaaatattctgctttaatgtcttcattttccaaatgagataactcaatatcagacaggttaaattatgtatctactagtaaacattgagtaagtgtcaaagctaggactgaaattcaggccttccctagtccaaggcccatttccctgtactacactgcaccatttctctcatgatcttagtagcaactgttcaaacaataatgtgtttgtccgtgtagcttaatcatgtgcataatttcaacaattgaagacaaagaagtagcattttattatttttgatgttcagtacaaaagatactcctcccaaatatttgcagcttatgtaatgcaattcgctgaaaattattaatatataatgtgatgaacattatgtatattatgatatatgatgtataatatatga

SEQ ID NO: 6000 - DNA, 1494 bp, Homo sapiens
tgtacaaatgagtttctttatagctagcttttactgtattcttaaaatattacaaacatatatagtccacgctagcaataggaaatcaatggatagttacaagaaagaatgacttcataatgatttttgacctcccaagtcaccagaagatttcaatatgagagtcccttccccctacacccccacccagcaccccctgtttctctccttctctttttttctctgaactagctttagctgcatggctcccatttatcttaatagaagttacttaatgaaggttatgcatatcgcttagtaactcagtggttaaattattctgttttgtgctttctgatctacaggtatttttttttttttgcttcaaacattcaccaatatatttcacaattgctatttgtgtttctagccagataattcatgagtttattttaaagtataattatgcttatgcaatttctgcaagacatgatattgacaacagtggcataagttccatcaaaatgtagaatctggtataaacattgttatatgtgtgtatgcggtaaatataagcacacaaaatacttctttaattttttttctgagtgactaagtagtcgtcatagaggtttagtctgaaaatggactaatagctgttgcaattgtctttttcagttcaaaaatgatagttaaaaactacactaatttgtattaattcttaccagaaaacggtttatcctcttgtacgtaatacttttaattctaaatatgtgtgtgtgtcctgtaaacttgcttgaaatactggtttgaaaatgtaattggtctttatttaaactgagacaagcctgtatatgctacaaatagtttattttagcaagtatagtctttgataatttgaactaatctttaaattcagttcaccttctacttaaaaactttaatggttttctacgtacttccttctcataaacctctgaagatttttatgcataatgaataaattttatattctaaacctagaattcagccccttgcacagaaatctcatcctacttatccacagttttatctgtgactctccaagacagaacttctcttatggctagaaaggcttcatgggcatccccacacatttgcttcttcttccctcaaacttatatcaaaaaatgcctccactttatactttgcctgcaaattttactcatagatgaagacaaggttaagttctgccttttccatgaaagttgaattattattgaatcttattaaaacccaaactgagcagttctagttgaacctcctatgggtgcaagactttgtgaccaatagcattgcttattatagatatgtaggtgttggcctctaccagtggggcagtaaccaccctgaaaacaagagcctcatcacagacaggttttatattcaccctaatatatacatacagacatggaataaatgacttttataaatttggaagtcttcaaacttgaaagtgttcagctaggtcaaagc

SEQ ID NO: 6001 - DNA, 1061 bp, Homo sapiens
gtacaatattacattcctcactgtgtgctaggtgcccagggctgtccttggatacatgtagtgggtcctccatgagcaaacatttgttaaatccatgaatggtaaagagttctatattcaaaccaaggctctgacaatacttcactgtaaagcctcaaaaaaattttttttaatataaggctagagattcttgcctcaagtgggttgttgtaactgttaagggcagtgtaaaagttccttgaaatttcaaaagaaaaaagatacaaagatgatagcattattgttaaacatgctctttatgcagcaaaggtgtttgttaaggttcatgattggttgagaatagtaagggagaaaaactgaagttatgaatcttttctttttcacttgtttttctgaagtccctaggattacttttttgctacaggaatacaagggggttgtcacgtttttctttctatgctttatggctctccagttccaagtgctgagtaggaaagatgactctttcactgtaagaaatagtaataacattttcaactcaaaactcactaatcagattgattagctgtccacaaaaataaaatcctgcaacaacacattcctatttttaaaacattttttggcattttgtattttttcattatttaatagagtgaaattttattgcttggggatgctcagttcacttgagaaaccaaacttaagaaaaagacaactagaaattgtctttattgaagaaaaaatacagagataaaactaaagagaaaaaatggctttaaatgtgttgtaacacagaaagtcaacttagttatttgggaagccacaaaaactatcatctcccaggccatagtttcagaagtttctctgctttatcgggttttacacactaaactgaaagaacagaagcctaattctgaaagaagcaccaatgaaacactaagtatgttccttcttcctgttggcaggtagctgttaaggtagatgttgaggacaaaatcaagtgtatcggaaagtttagtaaacagaaagccagaaaaactaattctacttcttgacttggt

SEQ ID NO: 6002 - DNA, 1077 bp, Homo sapiens
caggaatcaagaaaaattaagtcacaaatgtgctattcaaatagaaaacctttgtgatcaaatgaggaccatacttggttaaaaaaaattaatttatttattcctatttccataagttgcattatatctacactattcccaggatggccccaatagaagtgttcttgccgggaagacatgaattcctcgttctatacctgtgaatatgcatgggatgtcatcaatggtaaagtgagtcttcctaaatgctaaatgccaagtagaataagagcaaatgttgggcttagttgatttagctataaaaatactcagtgataaataagaatggtttcatgatacaactatgtttggtttaagaaaaacaagtacttgttcctattcgaagagacaacagctgaaatgaaaaagatttgacaaagaaagcatagtaatggaatgatttcttaaactgacgtgtagacaagcaggtagataaaaatctctgtcttgtcttcagcatggtattttagacagatcaatgaactgaaggtgtgaacagagtggaatgaatacagtagtcctctcttatccaaggtttcactttctatagtttcagttacccaggctcaacccatgtcattgtgttgtatcaacagtgcagtaagatattttgagagagaaaaagagaacagaagagacgacattcacataacttatattatatggttatagtggttctcttttattattagttgttaacctcttactatgcctaatttataaattaaactatcacagatatacatatatatatggcttggtactactcagtttcaggcatccactgagggtattagaaagtatcccttgcagataaagggggacttctgcaaaacagtaagaattggaaagcacagcatgtattacttcatcagggaaaatgccttatacattgctataacacaagaaatgataccgacgggacagaaaaacaagcaggctccattgattttccctggctcctcatattccttactaatgcacttgaggaagtaaataatgcatacaactgattgcattagaggtgactgtctcctt

SEQ ID NO: 6003 - DNA, 1070 bp, Homo sapiens
tgttatggaaaagaactaacttcttctgttaattggcaatcctactctttaggtaactgcttcccagtaaattaagaccaatcagtaagctttctttgatcaggtcagctaagagaatcaggggcatcatttttcttaggaaaaaactatttttaattatattctgttttcatcataatctcatatacctttggggcatcaggaaatcattattgcatacctactacgtgctgggtacttttttatgtactaaggagacagtaatgaaaaaataaacaggcaaaacaaaacaaaacaaaacaaaaaaaccctttttctcacatatgtactaatgggaaaaagctagacaattgataaaatatataaggagattgtattctattctttgttataatagatagtggtaaatgctatagagagaaataaaaaggcctagagtttgggggcagtggttaagattacagcttttaaggatgaaatcagggatgtatcactgaagagggacagttggataaaagttttaaggagatgagggagtgagctttgcagatattgaagacaggagcatccaggtgggaggaagcgtgtgtaaaggccctgagaatggcacgtttggaagtttaagacatgacagacgaccttgcacataggaggaatgcagagcatatttcattaaatcaatagtaggcttcaagatattaagtgtttttccgtacattatggtctaattcaatgacattctttctttacgcacaggtaataggattgaatttgacaagaatattcaaatatggttcacaaactgaaaacagtttgcttcgtatgtaggatttcatataatttcaagccttgttttttcattcactcttcatattaatgctttaaacagttgtaactttctctcataattgtgaattggtttttccaggagtgtaattggctgtgaaattggactctttttttcttctgtaaactgtcttcatgctttgtggagaatagcattctccaatttctcttccttcctttatttttgctttgttgaatagtttcacccagaagagaaagagaaa

SEQ ID NO: 6004 - DNA, 1045 bp, Homo sapiens
tgtggttagtttaaattttgtacatcagggcattcgagggagaccacattacccagtgggagtttacttggcaaagtacatccttctacaggagaatgtaagagttttacattacaggattcagccagatatggtgcaaaatgcaattaactggttatttttaaaaaccatactgtttttttgagacagagtctccctctatcacccaggctggaagacagtgagttgatctcggctcactggaacctccacctcctgggttcaaacaattattgtgcctcagtctcccaagtagctgaaactactggcctgcaccaccacgcccagctaatttttgtattttttgtagagatgggtttttgccatgttggccaggctgttctcaaactcctgacctcaggtgatctgcccacctcagcctctcaaagtgctgggattacaggtgtcagccaccatgcttggccttaaagcatttcatttgaagttttgtcagaactggcaaatattggaccctaagtttgatggagaaaggtattctgggctgctttcttgcctttcagcttgttggcagtatcattatcagaataacttcttccctgttcatggaaaaaatgtcaatggctgctaatctggaaagagaatgtgtaatttaaatgggaaggtgaatcatggtttgtcctcccaagaaaaaaaaaatgcttcactagagttgcaaagtggacttaggtattttcatttctttcccatgttgaacaatcttcacccttatgtattttcagagtattgtccgaatgagtgaaataagatgacattttattggcagatttttcggattcaaatgcatatatagtgcagggaatacatttcttaatttgattgatgaggatccgatacactcactgtctcctctgaggagcaattggttacatgtagagcataacgtaaataatttgaatccattttttcatatattttttaattgttgttttattttttttcatagagatggagtcttgctatgttgcccagctgttcttgaactcct

SEQ ID NO: 6005 - DNA, 1068 bp, Homo sapiens
ccaatgtaaaacaacaaaattaaccaacttccagagcagtataagaattctaaaagcatcattacaccccctggctttacattttacactccatatactgcaaaaaaagaaaaaaaaggaagattgtaagatgctagtataactgataattaagcgaccattggtcaacttgtaatgatcagggatggtttggaagtgggcatagaaccaatattgttgtagtaagaagtggtggctatgaggatagggaggtagtgatgctgggtgtgggccgagtagactagattatttcaggtgcatatctgtagtcaagcacataaaatgtgtaattcagaaactattacaatataatatgacttgccagtttttatgagctgttaaccctataccaaattccaatatacttagcagagttttgatttcttctttcttcttgttcaagcccatatgtgtttatgtcaggagtaaaccaaatacttggaggatataaccacctaccatgggttaagactagaagacagtagagactgaaaggcaagataaggttgtgttttctccagcaaacctttgtatttaaataactttatagcaagtattgactgtcaaaggttgcctgactaggacagcttcttaaatattgatgggtttgatacggtttgtcttagcttcttaagacatcaaaacataggagaaaggatgctgaactttggagtatttgtcttcattaaatacatgagtgacaggttaggtgatctgcttctgtgccaggttaaataatgaactataatattatagtagtaataataatatctgccttttgtaaaatgctttgtgtactaagcactcggatgagtactttatatactttatcttctttaatctaaattaccatgcatgagacagctgctgttatttacagagaagaaaacccacaacaggaaagttgtggcagaaacttgccagggtcactaagctaggaaatggaggagccaggtttcatacagagcagtttgagcatcagaaaccaaccagaactacagttacctggcattgggtaaaccatgtcat

SEQ ID NO: 6006 - DNA, 1044 bp, Homo sapiens
tgtatttaaacttaaaagttttaaagatagattatatacaaataatacatattcattgttatgaaaataatacaataaagaaaaatacaaacatattataacaattaatattcacttaggtcttactgtgtgccaggaacttggctaagatattacatcatgaggtaggctttgtttttcccatatcacagataataaaatggcagcttcaagaggtgaagtaacttgcccatggtcacgcactttgtagtgaagctggaatttgaagttaggtaccctgattacagaattgtgattctcaaccactatattacaaatccaacccaatttataactctttattagcatacttcgaaacagttatgtgtatgaatatgtgtatgcccatacatgtatagtgacataaaattatatataatgatatcttactttccatgttgttatgtacactaccttttgttcaacaatgtatcatgggctttctcctctatataaaaggattgatatacatacataatattatattctatatctcaaaaatagcagggcccttttgatgaatatgtgttatgtcctatttcacaaatagagaggtatagataatttccctagaatatccttttacagatcctttatacactgatgatttgtttccttggagtaaatcctaataatgggaatagtgggacaaaggacatacccattttatgttgtggcacatccatctaagcaaccaaacaggaaggctttgcaaatgtatcttcccagcaacaaggtaagagagcaatatcccattcctaagtgttattttcaaaattagattatatcaatatttttaaactttgctaactgtaattgtttgaggatggaattattttcttttttttaactgaattctaaatgtgatagtaatttttttcattttctattgtcatttgcgtctacttggggaattaatgaacttgtgcttttaaatagccttatgatccaaataaatatttttacaagcttaaactattagaatcccataatattagcaaaatg

SEQ ID NO: 6007 - DNA, 1019 bp, Homo sapiens
cccgcctgacctattcttagttgtcaacatttatggagtgtctgggggaaagaagaaggggcagagagaggaataacaaaacaaattgtttctgagtacctaataaatttcagttacttatgtctacatgttttatcatttaatcttaataattatctggcaaaataggtttatttgtgcacgatttacagttcagaaaattgaggctcagagaagggaaagaacttacaccagatagttcagttaggaagacttaggcttctctttaccaagctactttctttctgcagcatcatataacctaccagttaaaacaaacaaacaaaactctataatagcaattcagtacaaagaagaattactgtaggtgttttgagaggatttggttagtttcttttcattagtttcctttatgatttacccccgataagtttaagaataacaagtgatagaataggtcttattagcaaaatgcatgataaaatggagtaatcaaatcaccattcaataggactcctggtctcttctgtcaagaaattcataaacttaacatgagatgtagataaacataatgaattataaaacagggagcatcaacagtaaaatttaagagtgaatcttctctttctgtgactactgtcttcttcataatcacttaaattctttctcaaaagggtagtttgatcaaggaaaataaaactggaaagataaggtaggatcatgctcctttgcataatttataaaagaataatattaatattcaaagctgattctggttgctaaaatattttggtgatttacacaatattgcagtaagaatatgtttcccatatgacgttacactttctcaaggagtaacaacttggtgcattattttattcattcaaaactaaactaattgtcttaattttaatattacctacagatggcttaaagttatctaagaaacttttataatatgtttataacataaatacttgcccattttctgcgaattccaggagctttctcaatgaact

SEQ ID NO: 6008 - DNA, 1062 bp, Homo sapiens
aatgaatagcagcagttttattcttccttaaggtgtatttgcatagttgtaaattacgcatgtcaaacaccaaacaaatcctcattccgtgtcaggattttaactccttacccaaagccaagtgtacattacagtgagtccatagagagtctatgtttttaagttaatccttacattaaattaaaggatgaagtggaaaggtttaaagcagtttcctctgctattgaattccaatacattaatatctaaaaattaagcacaatatttgtatagtgttactttagtattaaatattgtatagcttcacatggtaggattactctctagagcaaatgtacacatatatagcttgcttttcatttaaataccaatccattggcagcatagtacaagagaaatggttttgaagtaagttggctttgctaatcctggctccagaaactttggatttgacctggacgagtttcaaagtatctctgagcctcaatcttctcatctgaaaatgggaataataaatatctacttcagagaatgatgttttgggattatgtaagagacaatggacatactaagagattactcataaactgttcatacttttctataccatacaaaacatatctggattaaaacagatgcagaaccttcactttattccctggtgtatcattgttgctcagccttactttccccaaggtaaccaatcattaggaagtcaaagacagaatggttcagagatgctgatcgaagcaagtgcaaagttcattggccatatcctggagggactgtctcttgacaaacttatcagagattagaacatgctcattcatttaaaccagaaaacacattttgaatcctaatgtatgttagccattgccccaggcattgagtatacagtgcacatttttttttagcatcatcacactttggttttggtacatcttggaaaacactatcatccatacctttgacatgatcgtatcagtttcatttgttcctttggataaaagcacctaaaatcttttatctagaacagagatttggaaatttaaatataaaaag

SEQ ID NO: 6009 - DNA, 1082 bp, Homo sapiens
ttaagacggagtctcggtctgtcacccaggctggagggcaatgatgtgatcttggctcactgcaacctctgcctcccaggttcaagtgattctcctgcctcatcctccagagtagctgggattacaggcatccactaccacacccaactaatttttgtatttttagtagagatggagtttcaccatgttgaccaggctgatcttgaactcctgacctcaggtaatctacccgcccttggcctcccaaagtgttgtgattacaggtgtgggccaccgtgcctgtaccccccatttttttttaagaattagggtcttactctgttggctaggctgtgagacagtagtgtaatcatagctcactgcagtctcaaactcctgggctcaagtcatcttccctgtcagcctcccaaggaggtaggactagaggtgtatgccaacatgcccatctaattttttaatttttaattttgtagagatggggtcttgtatattgctcaggctgatcttgaactcctggccacaattcatcttcccacctcggcctctaaaagcactgggattacagaattgagccaccatgcccggccaaggcagtttcatcactaaatacctgtaaagcctaagacatttgatcatgttctgcaggtagccataaagtctagaaacagttgaatatacataataaatggtttgttgatattacatcacaataaatgttatattcaatatgttgtctcatattaccactgcatagtttagtgcaatgtgcaaaattacaaggaacatcatgtgtgagcactccatttacatcaatctctgcatgtgtatctgtgatatgttgataaggttcctcaaatttcactaaataaacttttgatatgtttcctcaaatttcactaaataaactcttttcctttagcctaacacaaactcttaaatcatcaatccagttttgcagattatcactcagtcatttctatatcacagtggcctgggggatgtggtgtgctgtgctactggaaccactcagatggctttctttagcacataaaatggggcattatttgatcacttgaattagc

SEQ ID NO: 6010 - DNA, 1104 bp, Homo sapiens
gctgtgtgaggagaaccttatccaaaacgatttcacagaaaagagcatttgttttgctgatacgggagagtttctttattccaatcacaaggcatgtgacaggggtgtggctcacttcttcggtgcccactgctcaaaaccctagggggagcatgcagacaggcaggtgcagaggccttggggagtgcttttgggatctggcccatggcagtgtccaggactcccaaagcccaagtgggcgtgtgttacagtgcgctctttcagctatgccatctgcagatgcctgtgttagtcagctcaatagaccctctgccttattgcaaggacagggggccattgtgacagcctgagttcttgcccaatgtactggaagaatcagaccacatatgggctggaaggttgagagcaaggtttgattgagtagtggaggtggctctcagtgagatggattgggagccagaagaggggatggaatgggaaggtggtcctcccctggagtcgggccgcccaaggctatactcccctcggcatctgcgttgttctgccatcactggtctggtggtgtctgttggtgtccgcaggtctgctcctctgctcctctcaacatccagctgcttgtgtctgtgtcctcttaagatctcaggtttatatgggcacaggatgggggggcatggtggaccagagtagtcttggaaaatgcaacatttgggcatgaaaacaggagttcctgttctcacttaggtccgtaggcacaggcccgagggtggggccctcattagggctccctgcccttctctacctagcacttccctgccccactctcgtatcactgttacacaccttacattgcaaaggtggttgctttctgccttatcctgggaaacagacatatgtgcttgctgagcccttcgctaaatttacaagagtatatacactgaataggaggcagagaaacaaacataatactttactcattctcagatttcctcccattccaaggaatgtaacatatactgctctgggtacaagagagtgtaaccattccatctaataccatcctgcaaagtgctttagaaagtagaatgacaatagagccggcctttg

SEQ ID NO: 6011 - DNA, 2678 bp, Homo sapiens
cttttatttctttatcttgcctgatgcactggctacaacatccggtactttcttgagtaagagtggtgaaaatgtgcatccttgtcttgtttcagtttaaaaggagagtctttcagattttccccatgatgatgtttgctgttggtttatcatatagggcctttattatttttatgtatgttgtttttatgcctcatttggtgatagtttttatcatgaaggaatgttgaattttatcaaatgatttttctgtatctattgagatgatcatatgctttttgtccttcattctgttgatataatatgtcacatttattgatttgtatatgttgagccatccttgcgtacctggtataatcccacttgatcatgacgtattatctttttgatgtgatgttggatttggtttgctagtgttttgttgaaggattttgtgtgtatgttcattacggtattggcctgtagttttattttaaggaggattgatattagtacttctttatacatttgatagaattacactgtgaatccatccagtcctgggctcttctttgtttgaaaactttttattactgattcaatctcattactcactattggtctgttcaaattttctgtttcttcctgattcaatcttggtaggttgtatgtttttaggaatttatcagtttcctctagattttccagtttgttagtgtatagttatttataatagtttctggtggtcttttgtatttctatggtaccagttgcaatgtctgctttttcatttctgattttgtttatatgggtcttctctcttcttggttgatctagctagtggtttatcaattttgtttatctttttgaagatccaacttttcattttattgattctttgtaatttttttagtccctatttcacttagttctgttctgatctttattatttctttccttctgctaattttgggtttggtttgttcttgcttttctagtttatttgaaatttttctactttcttgattcagcatttatttctgtaatgttccctcttagcagtggttttgctgtgtctcacaagttttggtatgttgtttccatttttatttgttttaatttttttattttcatataaattttttcattaacccaatggtcactcaagaacatgttgtttaattttaatatatttgtgtactttccaaagtgcattttggtgttaacttctagttttattcccttgtggtctgagaagatacttgatatgatttcaatatttttaaaatttgtttagacttcttttctttttttggcctaacatatggtctatcctggagaatattccatgtgttcatgagaagaatgtgtattctgcagttgttggataaaatgttctgtagttgtctgttaggtccctttcgtctaaagtccagtttaagtctaatattttgttgttgctttttttgtctaaatgatttgtctaatgctgagagtgggctgtagaaatacccaactattactgtattagagtctctttctttagatctagtaatatttgctttatatatctaggtgctcttgtgtttggtgcatacatattttgaattgttatatcctcttggaagactgatctctttatcattataaaatgacaatcttcatctattttttactgttttgccttaaagtctgttttacctgatataagcagagctactcctgctagtttttggtttccatttgtgttgaaagtctttttccatccctttactttcaatttatatgtgtctttacaggtgaggtgagtttcttgaaggcagcatatagttgtatctttaaaaaaaaaaattagcacagggtcagtattcaaggatcatttttttaaatgtattccgccagtctatactttttaagtggagaatttaatctatttatattcaaggttattattgatgtatgagattttgtttctatcatattgttaattgtttgttgcttgtttaatgtgttccttgtttctttctttttcttttattgtttgtcattgtggtttggtggtttactgtagtggtggtatttgagttctttctctttctcatctgtgtgtttgctttaccagtgcatttcatacttttgtgttttcatgatggtaaatgtcattcttttagatttaggattctcttgagcatttctgccaaagctgacctagtggtcatgcattttctcaagttttgcttgtctgggaaatgctttatttctctctcatttatgaaggatactttttctgattatagtattcttggctagcagtatttttttctctttcatctttgaatatatccatctttgaatatattcaactttgaatatatccatctttgaatatattcaactttgaatatatccatctttgaatatattcaactttgaatatatccatctttgaatatattcaactttgaatatatccatctttgaatatattcaactttgaatatatccatctttgaatatattcaactttgaatatatccatctttgaatatattcaactttgaatatatcccattatctcctggcctataaggtttctgctaataaatctgctgttaggctgatgggttttttaaggcattgatgctttactcttgcatctagtcttttttagaataattcctttgtctttgagtttagac

SEQ ID NO: 6012 - DNA, 1022 bp, Homo sapiens
ttaaatttttagtgttcagggctctttttttgttcattattcattagttcattcattcactcaaccagccaatgtttatgaaaacctaccatagtgccaggtactgaaagtatggaaatgagagacataatctctaccacaagagattctctaacaaaccaactgacagtaaaaatataagttctattatggagaaaaggaagcaaggtagggcacttaacacattggaaaaaggagtcacggtgactttctacatagtctttcaattaagccttgaagaaataaatcagttggaggagagagagaaggaaacagaaagaaatgcttatgccaagttgtagatacacaaaataacatggtgggttttagaaactcaaggtagttcagcttactaggaatgggatacatggaaaaaaaatgatattggtgaaagcttgggcaggttgtgtaaactgtttcttccttatcaataaagtggagacagtggatacaggttgcttaacagagtacagacatataatacatgcttcaggtttctttagtggtgaaagtaagagtttcatataaggactaaggaaaacctcccaattaattttcaatcttttcatgaaattctaaagcctgacaatttggactcagatagatgtatgcttcttgttaatgttttgaagtgtttactaattatgaggggtctttgttcatttttttgtttgtttgttttctggaatcattaggatatagcaattacagttggaaggcagaacaccattagtggttgataggtcaggcttttgaagtcagacttgcaaatttcttgtttctaatctgcaaaatggggataataatagtatatctaactcactgtttttctgagacttgaaagtgcttggcagagtaccaagcacctagaaagccttctgaaatggtagaatggtagctgaaagtcacaatcttcctctcctttcctttcctttcctttctccttccttccttccttcccttcccttcccttccttcccttc

SEQ ID NO: 6013 - DNA, 1033 bp, Homo sapiens
gtgactcattaatcttctctaccagttgtgcctcagtatcctctgctattcatcaaatcgtctagttatgttgctagccgaaagaggaacgtgtgctatctttcgaactgcagcctctcctaaaagttcatgacaaatgtccttagcagcaggcaggatcatctgtttaccaacagtaaagggcttcggagcttcagcgctgtggttagccactgaatgatgctgtcagtgcagacacatttgatgaagtggtggccttcaatgatttcttctgttctttgtgttcacgtgtttttctattgaaaaactccaaaggcttgtcttttaattcagcatgcttggtctccatgtggcaaagcagttttgaaggcttcatggcttcttcgttggatagccggtcaccacatattatacaaaaagggcttggagaatgtaaatcacctgttgtgctgaacccataatttaagtagtattcttggtattttattttaaatgcaactttccttttgttggcattcttagagtcttctgctgtctcatcattgggtctttccccctcttcaaagaaactctccagttacatttgttttcactcatttgtgctagggttagcttgtgggcttaccaaaactctgactgagacaaatgtgcagtgcagggaaagaggcatggatggagtggtaaataaactaataaactaaataaactaataggtgggccatgcatggactaaaattagtgtcggattctgacttaaatcctgccaccagatgcagctgtacaattgaagtacatcaacccacttgccactataaagcctgccaccagatgcagcttaattgtcacttaccattcactgatagggttttgatatgagtctacaagcagttgatttgttatggtctctatgcagtcaaagctctctgctaaggttaatctgtatttgaagccactcccctcagtgttggcatcactgctgcagttccacctctgatcatcaggcattagattctcataaggagcatgcaaccta

SEQ ID NO: 6014 - DNA, 1004 bp, Homo sapiens
tgcttgcttgcctgttactcacctcatgctgtgtgtgaggaacatgtttgtaaccagtacctctccatggcccaggaatagaggacccctgctgtaaaggatagaaaagcaggttacaagtttctcccttatttgcattattatcccagattgcagtaacatctaaatgaagcttgtccaacctgcggctggtgaaccacatgcagcccaggacagctgtgaatgtggcccaacacaaatttgtaaactttcttgaaacattatgagatttttttttttgcaatttttcttttaagcttatcagcaatcgttagtattaatgtactatatgtgtggcccaagacagttcttcttcttctaatatggcccagggaagccaaagattggatacccctgatcctagcagattagaaaacagtaaagaaagagtttgttataaacagtgacccccatgtgattttaaagaatatactgtacaggttgttttggggatgcaacgggaaaaatgctgtcattcaactgtctgctggaaactcagaaactcttggtatttggaattatgtaaataggactttgaaaaataggctgaattttttccaatgattttatgagcttgtgcacgtgcacacccatcgcagtcaagtacagatagctttaggagtgggaagctcaggaagcaaactttgcttttcccctctgttcttacattagcatccattctaattgttgcttatttggggcagctaggttaatcgtatctatctgttgtcccctactgagctgatattttctttcactgtaaggtgtttcctaattactttgtgaataaaattttttagattgagtataaaattgagcccaaagttatgcttgtagctaaaaatatgctctatttaatggttcagttggggccagttgttttatgtaaggaactctgattgggctgtggtaaaactgcacttactgacgcatgcctctccttgctggtgaaattaatttggaat

SEQ ID NO: 6015 - DNA, 1745 bp, Homo sapiens
gatgtagaatcaatgtaaaggttgatcaatgatagactagataaagaaaatgttgtatatatacaccatggaataccttgcagccgttaaaaggaacgagattatgtcctctgaagagacatggatggagttggaagccattatcctcagcaaactaatgcaggaacagaaaaccaaatactgcatgttctcacttacaagtgggagctgaatgatgagaacacatagacacatggggggaaactacacacactggggcctgttgggcagggggtggaaggagtgagagcatcaggaataatggctaatggatgctgggcttaatacttaggtgatgggatgatctgtgcagcaaaccaccatggcacatgttagcctatgtaacaaacctgcacatcctgcatgtgtatccctgaacttaaaatagaagttgaagacaaaaagtgattgtcagcctgggcccttggaaatatgaaataatgaaagtagctaagtgcagttgagtgagaaaggaaacaagacgagagatccccaatttgcctagatataagtaagcattgtaggtctttcaccaattaaatgatcttaacaatttagagttatgattgaaaattctattggctagtactaataaactttttacaaaagtaaaaattttacaggagaaatcatatggtctggctgaatctctttttctgtgaagtttctgaaaaattgactagcagttttattattttagataagtatactccattttggaatctcatcttaaaatagtaatggaagtcttattttgaagtcacagccgtaaagacacactccaagcaattctcacagtgctgagtctcccaaatgagtgagcatgtggtgtgtgtagcttggtggtgagcagatgagcagaaacgtaacttagctgctctaagcaatcacaaggaaagatatattataaatattcaatatttgatatgcagttgaattttattatgcattcatcaaatcattgctgtgccaaatgctccagtttggaaaccacaaagagaaataagacattgattctttgtcgcaagctgtctctgatgttcatgtactttgactgccgtcttcaaaaggcatatagataaccaagaaattctttgttataatatggaatataaagcacaagagttacaatgggaataatatgtgcaggagagcctgtctcttcagtggaatcatggaggagaaggaagcaggaagtaatcatttgtcggttcagctagttaatttgaaataatgacacattgaaaccattatttcccaattaactaagacttgaaagaagaaagtcaactaactaattaaggttaagaataaaaaggatatactcattattaatgaatgaaaatgaaataccttaaatggcccatagggacagacaaggacatgcctcttcaaagaagattgtaagttctacataagaacagccactatctttatacactacagaattaagaaggaagactgtggattgaccttaaacactgtaatgttttttaaggaattgctttggatttttttttcagcagttttaaaataatttttatgtatcttagaatagaagaggtgaggattgaggctatttataagtcatatataaaacaagacatgagaggctgggcacggtggctcacacctgtaatctcagcactttgtgaggcagaggtgggcggataacgaggtgaggagatcgagaccatcctggctaa

SEQ ID NO: 6016 - DNA, 1081 bp, Homo sapiens
atattaaaaaaaaatcactgcccagatcaatgtcaagaaactttttgcctatgttttcttctagaggttttataattttaggttttatatctaagtctttaatccattttgaattaatatttgtatatggtgtaagacaaggatccaatttcattcttctgcttctggatattcaatttccccaatatcatttattgaaaagactgtccttttctagttgtgtgttcttggtaccttttcaaagtttaattgactgtaaatatgtggatttagttctgagctctcgattctattcctttcatctatgttctgctttcatgccagttctattttgtattggttactgtagcttcgtcatgtatcttcaaagaaggtagtgtgataccttcagcttagtgcattttgctgaagattcctttggttattcatggtcttctatggttttttattagttttgagatttatttaaggaaagaaaaacacacacacacacacaaccaaactcaggaggctgcttattaatagaatctaccatatctttaaaataaggttttccttgtgtcatctctgtgaatttaaacctattttaatagctaaaaatggacagttggataacatattcttcatactttttatatttttaaaagttaataaatcacctatttattcttttactcagatttggataattccaaattttttgattaatgtttaaactttaattatttcggtttctcatctctgttcactgttctaaatttctctgcacattttaagcatgaggaagctgacagtgtacacaaataccctcctactgggtgcatgtcttcttgttagaaacaaaacaatcaagagatttcaataagcttttcaatcttttgtgaggaaattatttcagcccagtttagaatttctgtatttttcctcccatcttgggttacttgttagactctatacaagtgtgtaaatcttgattggagaagacactgctgatggtgcacatgatttattataaccgtgaaattaagtcctgggccacatgcccagtatctaaactaaatcaaggagggcttaattgaaa

SEQ ID NO: 6017 - DNA, 1032 bp, Homo sapiens
ccacccatagtcaacattttatttaagacaaatgtattgtgtcaatcccttttctcttttgtaagccaagattctattttgtacctaattgtacattttaagacaacatgtttatggtcaggatatgaaggaaaaagagattaacaactgaattttgtggtttttgaaatgttgtttcaacagtttttatttttattttttttttgtctttctactcatccctccttctatttcttgatctccttcttccttcattttttaaaatgtatgctgctctgtaaaagaaattatactaatctcaagtctaaggagaatattaagatataagagatattgtcatcgacctcaacggatttttattttggtagaagagaaaaaaaattataggttgattgctaaatagaggtagagagagctagaggtatttatgaatatgtgtgtgtgtgtgtgtgtttgtgtgtttgtgtgtgtgaaacaacacaagggaaagcaatgtcctgggaaactgtgattttagcaacacatttattattaaaaaagaaatgtaaatgagctttaaatgatcaatagccttagagaaattaatggaaatcaaggtgttgacaaatgaaaccttatgtttgtatgtaccatataacaggaagatttcattctacatggaagaaatgtggtgacatccgtattatgtgtcctgtgactccagccctagctcccctttattctgacaagcattgctagggcacaatctctgctgctaaaatgtagatgtcaatagaaatcaagtatatctttggctgcctctccaaccacaagcccgacactaagttggccccttgatggtttttgacacatgaaagaatataagcaaacttacataaggagcagatgacactggctgggaattaaattggaatgattcctttgtaagattctctagtggtttgagaactaaaagtgagtgaatccttgtgacacaagtttgatgtaaacaagtggccttttccttattccattatgcttaatttactccat

SEQ ID NO: 6018 - DNA, 1049 bp, Homo sapiens
ttaaagtataataaaaaaaaaaaagaatacttaaaccccaaaatctttgtaaaggaggcccttgagccccttgctcgggcccactcccgccctgtggggtgctttcttgctttaataaatccttgctttcgcttctttgttcctgggtttcattcctctgttactttgtgcattttgtccaattattttttcaaaaccccaaggatctggacaattcacactcaaggcctgccttctgataacaatagcagcatgctagtttattccaacatcttgtctcatacaagtcctctgtctagctctcactaactactctcaattttcaaaactcggttctgtttcaagaaaacttccatgatgacttatgaattcagattctctttaattgtgttcctatagtactatggtgctacagtactctgtactttcctttaatttggggactaagtctttctagacggtctagccttcttcagaacaaagcatatgctcagaggaactgggacaaagtagatattgaataaatacaaaaatcagtgggagcaggatccgttctggttttgctgaatcctcattgcttgtaacatggtggcattagacaaatgttggctaaaagaaagatgagtaaaatgagctagttgtgcttttatttcttgttttctgagcacttcttattatgtaaggatctattaaaaacgaggtgcattcatttatacaagtacacacgtactaccagttgactacctgttttaataatattaatgctacaaatcagtgatgacattagttagttgatccatttatggttttgaaccattacccaaaatgttatctagtcataagataacttgtgtcctttttatctgtgctagtcaatctgggagctgttgcaatgaattaattaaatttgagtaaattttaaaatgtatctattcaatttcattagtgacaggctaagttctcaatagctttatgtagatagtggctgccaaaccagaaacacaaatacagaatattaaattttatatagaatattaaatttaaatcaa

SEQ ID NO: 6019 - DNA, 1021 bp, Homo sapiens
accatggccaactaatgaactaatttttgtatactttatagagacagggtttcaccatgctgctcaggctggtctcaaactcctggacacaagcgatcctccagccttgggctcccaaacagctgggattgcaggcgtgagataccttgtctggccttgagcaagtttttctatgctacatttgtcaaactagacactaatattgatccaatctaataattatgtttttatactgagtaaaagcaggagttgtaagctcgaaggctaggaggaggttaggcttgtggccaaattggagaatataagctgcttctacaggcatttaagttcaaaattttcaagaaaattgactggtcaaataaaacatatctgtaggctcaattggtccacagatcaccaatttgaggtttcttgtccaaagatatttaaaacttttagggaacaaaacttgaataacattgacaataattctacaagtttcaatagtgtaatttctctgatgcttaaaatagatgaggatcttttcctctgatgattgataagcataaaaagatgaaatcattttggatataggcttagccaaagataggaaatatattgtattaatagttgatggttgtatttactctcccatacaaggtttgtgtctggcaatgtttttagtcctgatttatgtcactatattgattaacatgagaacaagagtgatatttccgatatggagtatgatttaataaatgttaaggcaccaagcaagccctatattggcctttttaaaaaaaaaaaatcacattatgaattcaactataccatttctctgtcacccaggctggagtgcagtggcgcgatctcggctcactgcaagttccgcctcctgggttcatgccattctcctgcctcagcctcccaagtagctgggactacaggtgcccaccaccacgcccctggctaatttttttgtatttttagtagagacggattttcaccattagccaggatggtctgaatctcctgaccatgt

SEQ ID NO: 6020 - DNA, 1031 bp, Homo sapiens
ttaaacattttttcatctgtaactagatattggtttttcttctccatagtaagatcacctgatatttgataatttatgcttttattactacttgttttatgataccaacatttatgttcacatcctcaaggctttattttcaagaaaaaataaagtcgtagtagcacaatgtgataagctccatcttccaaccaatttttaattgtctcattggtatgtatattaggactaaatggctgtattccatgcaaaaagtaaaatgagcagtaagtcaagtgagtattcaggctatataaaaacttctacctacctgggccttgattattcctggtaagatgattaatgatagaaaagtagattatgaaataagaaaactaaaaggcatgttaaatgctctttaaaggtttttaactcctgtctggtggagcaaatggacaccatctgtataagaaagccagataccaagaaactgagagttttacttagtgaaaccttccactacttatgaaaagtcaaatatcatgtataactcatccagatcaactagtccctagacactgatttttgggaaggatgtaagagaattactgactcagatttagggtttaaagactattgagaaataggaaggtattgagagattattgggtttcatcagagcagacttaagtagcctggttgattttagatttgtcacagcaaaatcatgcttggatgctcgaggcctggcagaaccttgctggtctctgtagggtgggataagtgaagcaacattaaaccaggtgcagtccttaatttctcaggtaacataactttagaaaaaacaattctaatacaagttaactcctgtctggttgagcaaatggacaccatctgtatacaaacgtcagataccaagaaactcagatctttacttagtgaaaccttccactacttatgaaaagtcaaataccatttataactcatctagatcaaccagtccctagacactgatttttgggaaggatttttagagaattactgactcagat

SEQ ID NO: 6021 - DNA, 1035 bp, Homo sapiens
tctgcctcctgagctcaagcaattctcctgccttagcctcccgagtaaagactacaggcgtgtgccactactcatggctaattttttgtgcgttttgtagagacggggtttcaccgtgttggccaggctggtcttgaactcctgagctcaagcgatctgcttgcctcagtctcccaaagagttggcattacaggcatgagccattgcacctggcctcagactgatttttgaacttctaccctgaaattgctttgggccttcatttataagtcatactagaaaatcggtacattaactgaaaagtatactttatttttaacaaagaacaggattatgcaacaaaatcacccaacttcctgaccagatttggcaaaaatatcatgcttagctaattccaaatatcaaaccttacatcagaatacaaaaattctatacactttgaaggaattttttaaaaaaagattcactatagagtgtaaggaaaaaagaaaagattcactattgattcagtagacaaattccaaagacaagaactacaaatattttgagtaatgacagtcatttttgaaataagtgtacgggtccttcaaggaatagctcaaataaactactccacaaagctttctatgacctttctaccctttcccctaggttagaagtaattttgtttttctttggatataaaccttgatataccttgtacctttctgattatagtaactcctttacctttcagcaaaattgtgattttccttctaaactgtaaaatcattatatatccccctttatcagttaactaagtgcctcaaatttattatttcattccatcaatatttatttcaagcactgacaatacagcagtgaaaacaatagtctgccagaaaagaaggtctgtaaatgtggtccttggttcagtggcatcagcatcaccaggaaacatcttagaaattaaaagtttggggccctactccaaatctattgcatcagaaacagagaaatctttgaacaagttttccaggtaattctaatgcaagc

SEQ ID NO: 6022 - DNA, 1062 bp, Homo sapiens
tatatttatttgttttatattatgttgatacttattaagtatctactgttttataagtgtctttacatggaaaatttattcatcttttgcaataaccttatgatctaaacagagctgtgcctattttatgtattacaccaacattcagagaggcaaaatatttcacctctatggcaaagaaagcatttaaacctagtttatctctggctctaaggcatctattcttactggaaaaccatagtttgttttcatggaacaagtagagcagtaagaaagcatacaaatacatatatttatatttagaattctatctacatttttcaatgttgatagtcaaggattataaaagcatttatagatacaagagagagttatctcactgctaaaggactgattaaatgttaaatctcagtctcgcagaaaagttcataatccatgtaaaataaacaggtagaattcttctgcctacttgatctctctccaagtggaaggatttacccaaatgaacgtgttctctgtggctcatccagccctttgtttagaagttttctttcatgaaagtatgataacatcaggttttggctcttttatcttcttttgttattgagaaaattatgttaacctgtttaaactgaatttgatgtttttgtcataagtggtcaccataccactttctgtctgaaaggtagatatgtcaaggtattataataatcctgattaattgagtttattgcagcactgttcacaataagaaagacttggaatcaacccaaatgcccatgaatgatagactggataaagaaaatgtggcacatatacaccatggaatactatgcagccataaaaaggacgagttcatgtcttttgcagggacatggatgaagctggaaaccatcattctcagcaaactaatacacgaatagaaaaccaaacaccacatgttctcactcataagtgggaattgaacaacaagagcacatgaacacagggaagagaacatcacacaacagggcctgtcagtgggtaggaggctaggggagggatagcattaggagaaatgcc

SEQ ID NO: 6023 - DNA, 1079 bp, Homo sapiens
aaaaagtgttatataagtatcagctattgtaattacagagtgacaaataaaaggtcggagtgctatggttatggaatagaatgatgagaaaggaaacttccaggagcttaggtgtactttaagtgcaggtatcaaatattgatgcttcattatggcaagggggctaacaagttgccagtgtgtcacaagtcaacatgcaggcaaagatggaaacattttccagatctaaaatgtagttaaatatgttgtactttggaatcgtatatgaactttattcccctttcagaattacaaatctcttagaaagccattttatttctttctgaaactaagttatgatcatctactatttagcacagaaataaaagggagggataaaatctaccaacccagcaaagacacatcttgctttgcatatcttgaggaaggccatcagcaaaatggaaagatgactctctgttgattactctatgttgagaaccttaagattcagatggtataggattccagctaggcagttgtgaactgtccatttgtcttatgcaagaaagtctcttcagctttctgaacttttctgtatttcacatactcattctagttcatgctcatgttcaaagcttggctagaatagcatgaaaaagtttccaaagtaaactcagcataactcaaacatttttctagggtttattatctctagtggaaaggtgaaaagatagcttgccttttatttttaaacactttacctgagtgataaaataacccaaaagccactgtcaagaatgagaaaaattgactgggcacggtggctcacacctataatcccagcactttgggaggccaaggcgggctcaggagttcgagaccagcctgaccaacatggtgaaaccctgtctctactaaaaatacaaaaattagctgggcatagtggcgggcacctgtaatcccagctgctcaggaggctgaggcaggagaattgcttgaacccaggaggcggagtttgcagtgagccgaggtcatgcaactgcactccagcctgggcaacagagtgagactccatctcaaaaaaaaaaaaaaaaaaa

SEQ ID NO: 6024 - DNA, 1048 bp, Homo sapiens
gaaatggaaaccacgcaaaaacaaattgctcacttccagacagattagctatctttatgtattgtttgctacatgtgtttcttttatgaagaatactttctagggtcaatgtggagaagtgaaaattccttgcgcagagttcagtttctaagtccttggtttagaactgaaatcaggaattgtcatttgagcttgatgtatgttttatttatgggtaatgcattaggatttattaacaaggagtaaatggtaattttctatgccaattagttttgccttttgtgggaagaaatggattttcctcatcttaatgtgtgaaactctacagtatcctgtttttcatggttcccagaagggaatgaggacatttggataccaataattgaggaatcatgccttaaagaaacacaagaaatatacaggcattcctcagtatttgtggggggattattccaagactgtccttggataccaaatccactcaagtccctgatataaaatggcataaatttgcccataacttatgccaacccttctgtatactttaaattatctcgagtagttataatacctaatacaaaatgtaaatagttgttatactgcattatttaggaataatgacaagggaaagtctatatgtgtttggtacagaggcaatttttttttcaaatgttttctatccctggttgtgtaacccatggatatggggcagggggcctgactgcatatatatatatatatatatatatatgtatatttatttatttatttatttatttttccctccaactttaagttgtcttttttttttttttttttttttggagtgcacgactcactgcagcctcgaccttctgggctcccacaatgctcccacctcagcctcctgagtaactaggaccacaggtgtgtgccactatgcccagctaatttttgtatttttgtagctatggggttttgccatgttggccaggcaggtctccaactcctgggctcgaacgatccacctgccttggcttcctgaagtgctgagattactgccgtgagt

SEQ ID NO: 6025 - DNA, 1093 bp, Homo sapiens
tcagcttacatattattaactagattattaacaacttttaaagattatttacaaacaggtatatttgaagtttattatcaagtacactttcagcctaaaaaccaccacaaatttgaccactgtgtacctaaaggaactactatttgaataaagaagtctgggagccttctggctaccttgagaaatcagttatggtcttttcatcttcccccactcccacattcttcccctgccaattgtttttccatatagctactgcttcacatgcccactagacactgatgtagctcaaacgctttcttaccgttcatggtatgattctaaagagcgtgtctctgcttcttcttgttctttcaacccatccttcttgaaaatgcctattatctactcaaaacagattggagagagttaaagcactgattttgttgttgcctggtttattgctttcaatctaattgagagacgttaaatggcagggagtcacattgttgtatttcccattacataaaggggtaggtttcactggtgtcgaaggaatgactggatgttgtcggacagggactctcactgcagttcattgactgttgcttgcctggtttgtgcaagtcatctacagagctattagaaaagtttctggttcctgccctgatctcaagaaatctggacttctggtctggtagggagcctaggactctatatttttatttatttatttatttatttatttatttattaattattattattattattattattattattattattttctgagatggagtttcactcttgttgcccaggctggagtgcaatggcaccatctcggctcactgcaaccttcatctcccaggttcaagcgattctcctgcctcagcctcctgagtagctgggattacaggcacatgccaccacgcctggctaatttttttttgtttgtttgttttttgttttagtagagacagggttttgccatgttggccaggctggtctcgaactcctgacgcccacctccacctcccaaagtgctgggattacaggcatgagtcactgcacccggctgaattctgtattttttaaaagctcccaggat

SEQ ID NO: 6026 - DNA, 1026 bp, Homo sapiens
tagggacctgccaccacatccagctaatttttttgtatttttagtagagagagggtttcacaatgttggccaggctagtctcgaactcctgacctcaagtgatcagcctgccttggcctcccaaagtgctggggttacaggtgtgagccaccgctcccagcccctcagtggcctactttaaaaagaagtaagaaataatgagtatagataagactggaacaaattatagataaaaggctttgaaggtagtttgccctaggatcattgaggaaatatgtaatgctttcaatactaagggaagacactactttacaattttgtttaaaataatgtagagttgagttgtccaatatggtagcagctagccacaagtggttactgagcacttgaaatgtgactagtctgaattgagatgtgttataagtataaaatgcatactggatttcaaaaatttaattagaaaaaaagtaaaataacttctaatacttgttatggtgactatattttaaaatgatatgttctggatatattgtgttaaaaaaattacaattaatttcacctgtttctcctttttatatggctaatagaaaagataaaattaaacctttggcttatattgtttttctgttgggtagcactactataaaaagtgtcagtctcttatttttagttgtatgctacctgagtctatcagttgcagcctaggagataaccgagaaactcagatggtaattttgatctggcatttgttcctttatatgtaagttttgtagatactactgtttactctgcaactgtctataaattcaaagtaaagtagcgtgctaagaaaattacacaatttatcacatatgaagttttcaaaagcctaggatgtaggaaacagtctagaaaaaaaaatttaaactatgtgcttatgtgatattattgtttaattgtccgtgtacgtacagtctattactgcagttatttctcaacagactgttccaatggtgggtggagagtaaaattgacagttcttctaat

SEQ ID NO: 6027 - DNA, 1050 bp, Homo sapiens
ggttatataggaagcatatatataacttttatagatagtgctatataattttgcacagtggttgaactaatttatgctcctaaaaaatataaaaaaagaggtttgttccagatcctaacagtatttagtattgtcaatcttaatttatttggttaaaatattttaatcaaataaaataccacatagtctgcaaatattttgagtgtacaccccattaacaatatttttagcacgttgacctatatatttatatttagcacattgacctatatatattttagcacattgacctgtattgacctatatatattgaccttatatatttaagacattaaatacttaaatgtctgaactaatacatatacaaaataagatttatgaaaagataagatattaaatagaattgagagcccagaaataaactcatgcatatggtcagttgatcttcagggaatctttatgcactgttgatgggaatgtaaattgttacagtcattatggaaaacagtatggagcttcctcaaaaaattaaaaatagaactaccatatgttcaagtaatcccatttctgaatacatagccagaggaaatcaaatcagtatggtgaagagatatctgcactccatatttactacagtgtattcacaatagacagggcatggaattaatctgtgtccatctacaagatgaatgaataaagaatatgtatatatatacacacatatatatatacacacatatatataacatatgtatgtatgtcatatgtatatatgtatatatacatatgtcatttatgtgtgtgtatatggtgtgtgtatttatatgtgtgtatacacacacaatgaaatattattgagccttaaaaagagaaaatactgccattcgcaacatggatgagcattgaggacattgtgctaagtgagataaagccaggcacagaaagataaatactgcataatcctacttaagtgtagaaactaaaaaaagtagaactcctaaaaacaagagcgtgaactgggggtttatagggctaggaattggggaaata

SEQ ID NO: 6028 - DNA, 1044 bp, Homo sapiens
atgaaatctcactctgttgcccaggctggagtgtagtggtgcgatctcagctcactgcaaccttcatcgccccgtttcaagagatttttgtgcctcagtctcccgagtagctgggattacgggtgtgtgcctccatacctgattaatttttgtatttttagtagagacagggttttgccatattggccaggctggtcttgaacgcctgacctcaggtgatccgcccgccttggcctcacaaagtgctgggattacaggcgtgagccacggcgcccacccaatttctattttagatacaggggtacatgaacaggtttgttacacgaggatattgcatgatgctgagctttagggaatggatcttgtcacccaggtagtgagcataagtatccaataagtagtttttcaacccccacgccctatcctcctctagtagttcacagtgtctgttgtcctcatttttatgtccatgtgcactcaatgtttagctgtcacttataagtgagaacatgtagtaatttaatgaacctttttctctttcctttatataacatactagaacaatttcctttgtatagtgaatcactccttcttcaagaacaaatgagagttttctctagtctctttgaaaagttgtgtatacttacaggtatagagtttcttggtcaaaaatctgtccagaccaaacacagtaatctcaatattttcctaggctgtgttttgaaagacaagttcaagtaatttacttgactttctaagtgttcactgttattgtcactgtagtatactctacttatcccatatttgactcaaatcgagacaataaatattagagattattttaggactcagatttattttgatagagaagccatttttagtttgtaaaataggagttttaggtgcaagtatggaacagaaaactctgactttataaactggttgcattaatctctatactatcccatatagtactgtgaaaatatgtatttgaattaattgaatgtatttgagtctattctgagagtctaggatgtacctggg

SEQ ID NO: 6029 - DNA, 1050 bp, Homo sapiens
ctaacaggcacttgagttttctacccttgagctaattcaaccttctcattgactagatgtgaaactgggttagtttaacagactttggaaacaaggtatgaaggagggaaaaaacaggagcagtagttatacaacaaaatagttgcataacttatataaactataataattataagactataaaaatatttatgggagtaagatacttttaaacaagatgggatattttttcctgccccctccccaccacaccccccaccaaaaataaccgttttctattttttctgttcatgtagtgtcacattgattctatatcgttacccacagtgccacctattggtaaaataaagacgacgtaaccagtttttctgtaacccatatttggtaccagagtcttaagaaatctgccctggattttcgcaggcagatgttagaaagcagattgtctgtgatccaactgaaatgggagatgaatcacgtgttttatgcagagatgctcaagcttgtcatttagaagaactccaaataggatctcaaaagcatgatatccgacttccccagttcgtggttctgccaacaaagagcctgtgaaactgcttagggattctaagaatttagattgttcccacatattgggatgcaaattgttttatatgccatgctactcaggcgtgattgttgctttttagcgacagcaagttgaagtattgagctcatttgatatgtgttctgccagtcttcatgttatcacacaggctattaagtgccaaaaaaggcattagtttcactgaatatatttaatttttaaaagttagttttataaggttagtgaatgtaattttctctttcttcattataagcttttctagagaaggatattatttctacagaactaacataataccaaatacagttgtcttgatattgtggggggaggattggtttcaggatccccttaaatactaaaatccatgcatgctcaagtcccacagtgggttctgctgaaccacagatatgaaaagttgaccctcgtgtccacgggttttgcat

SEQ ID NO: 6030 - DNA, 1027 bp, Homo sapiens
gctctatgtttatattaatatcttcaaaatgtttgaggctacaaggaatttaatcggtgagatgagtgggggaaatgtgaattattatggagtaggtttatcttaactattttgtgtggaaaacagaagctgagaaatctttctagtttgagtttatcaagaaaggctggatgctctcagtgtagttttgtcatttatcatagtagaaatgtacacctgcttatttattttatgttttggcacaaactttttttttgcaatgaattctttctgtagcaaaaaggtaaaaaaaattaactggcggatttctaaaaatttgataatgaatgtgtaacttgcatacagcattcattagtatttactatttactgtggatgtattgaaatcactagctacatggcaacgaggagacccaaatctgctgaagattcaaaaataggcagttgaattctccacttcaaaagttgatagttattttaagaagactgttcattaagatgatgatttagcacgtgctaaagaagcacatgctaaagctacaaaagatgtgtttttatattactgtgaagcagttttcatttagatctagtgtcttattttaaattaatttcattcatttttatttttatttatttattattattttttaagagagagtcttgctctgtcacccaggctagagtgcagtggcaagatcctgggtcactgcaacttttacctcctgggttcaagtgattcttcctgcctcagccacccgagtagctgggaccaccatgcccggctaatttttgtatttttagtagagatggggtttcaccatgttggccaggctggtctcgaactcctagcctcaagagatccacccactccagcctccccacatgctgggattacaggcgtgaggcactgcgccagcctcacttatttttaagtttccttgtgcacataagaaaaattaggtaaaatcttcaaaacactgtcccttctggcaaaagataaactttgcaaacattcaaatgattctgat

SEQ ID NO: 6031 - DNA, 1029 bp, Homo sapiens
ggctgaggcaggcagatcacgaggtcaagagttcgagaccagcctgaccaatatggtgaaactctgtgtctactgaaaatacaaaaaaattagctgggtgtggtggcaggtgcttataatcccagctactcaggaggctgaggcaggataatcgcttaaatccaggaggcggaggttgcagtgagccaagatcatgccactgcactccagcctgagcgacagagcaaaactccatcaaaaaaaaaaaaaaaaagaaaaaagaaaaaaatagtaataattaaaaattgttcatcccaaattatgaaaacagaatctgcacttcaatgagaacactagataactcatacatataataaaatttgagaggtattttctaaagtagtggtttttaaagaactgttgtgtgaaatcactttaatgattctaaaacagcagcaatgacaataaaatggattaaaatagaatacatagaaaatatcagggtatgattaaaaaacatggtaaatgttaacattggtttgggaatttttcagtaatatttgtgtgtgctcaattatgatataaagtaaatttcttacttgggtaaaaatggttggtaaatctcatctagacaatttttcagtagcaaatgcaaaaccaggctgaagaagtctactcaatttctggcatctcttgtcaatcctgccttcatttctccctagaaatcttaatcatcatcatgcctcataactttgtgagaaagaaaaggtggaactgtgattcattcaagtgagattcacacaaaacccatcagagtacagataaaagtactacccattggtctaaagtagaatttctaagtcttttctgagaattattcctcagagaataaggatatataactcaagccttttccctgtaattttggagtttctttgaaaccactttattttcctttaaaatttatgcaaagtcatatgaaagaacttttacaaatcaataagaaaaagacaatcctatagaaaaatagcaaaaagtctcaaagtgtta

SEQ ID NO: 6032 - DNA, 1024 bp, Homo sapiens
ttgtcaaaatattttgagcactccaatataaaagaataaatgttaagagttttattcactgtctttacagctatatgagtaattacttcagtctactgttgataaaaatgttgatatatctatcttttgttaatggatcaagttgctcttgttatacagtgaactgaatggctctttacctcttacacaatctcacaggaacacttcatcctaatgtacacttcattttattatagcaccttgtcatgtgcagtaaaaatattcattttgtcatagagttgctgattgagtgttcagccttgaaaaaatatttgctattaaaatgaactgtgcaagtcagtcttaaaaattaagtactatttcacacatgcaataacacagtttgtaggcatccaggaatccactatctagatataacgcattttaccattttgccaatttgctgcagatctttgttaaattaaattaaatgaagttatatctacagattctttcaaagctttctgtttcctgtcttattctccataaatgtcttctctcttcttccctccctccaagtacaattctcctgaagttagtgcatgtttttacaattatgttcttacccttttatgatatgtatgagcatgtgtaataatatgtttcatatgtttaacattttttacataaatggtcctatactttgtgtgtatatatatataatcttttgcatttactttttgcacatcttatatttgggatcagatagtttaaaagtattctgtttgataaatatgcaataattaacttaaccattcccatattatcagttgttaaccactgtgtgctattgcagcaatgctgttcttgagctgagtggttattgcactgcggtcatacctctggtcatatactgaaggtgagattgctatgctgaatcatgtcaaatccaccttatttctttactagctcttacctgatggctaagaagtgtaccaatttatacttataacacgtggtaaatggaagttctcatttccctaca

SEQ ID NO: 6033 - DNA, 1004 bp, Homo sapiens
gatttctctgtgaatgttttgtatttctccttgtagagatttttcacctcactagttagctgtattcctaggcgttttatttttttactgtcatttggggatgggactgcattcctgatttggctcccaggttgactgttgttcatgtacaaaaatgctagtgattttttgtatgttgattttgtttcctgagactttgctgaagttgttcattagatcaaggagatttgggctgagactatgggttttctaggtataggattatgtcatctgcaaacaaggatagcttgacttcctttctttctatttggatgtgctttatttctttctcttgcctgattgctctggccaggtcttctgatattatgttgaattggagtggtgagagacagcatctttgtcttgtgctggttttcaaagggaatgtttttagctttttcccattcagcataatgttgtctgcgggattgtcatagatggctcttattgttttgaggtatgttccttcagtgcctagtttattgagagttttgaacgtgaagagatatttaattttatccaaaggcttttcagcatctattgagatcatgtagtttttgtctcttgttctatttatatgatgaatcacagttattgatttgcatatgttgaaccaaccttgaatcttagggataaagcctacttgaatgtgatggatacgctttttgatgtgctgctggatttggtttgacagtattttgttgaggatttttgcttcaatattcatcatggatattggtctgttttttttttttttttttttttttctgttttgtctctgccaggttttggtatcaggatgacgctggcctcatagaatgagttagggaggggtccttcctttcaatttttggaaatagtttcagtaggaatggtatcaactctcaactcttctcctttgtatatctgatagagttcaactctgaatccatctggtcctgggcttttttttttttttttttttt

SEQ ID NO: 6034 - DNA, 1042 bp, Homo sapiens
gactctgtctcaataaataaataaataaatagcaaaaaataaaaaaaagaatatttaatactggcccccaatctcttctggcttgtagggttctgctgagtggtcccctgttagtcttatgggcttccttttgtcgcttatctgacatttttctttagctgcctcaagagttttttctttcatttcaaccttggagaatctgatgactgtgtgtcttggggatgatcttctcgtgaagtattttagtgaggttatctgcatttccagaatttgaatgttggcctctctagctgggttggagaagttctcatggatgatatcctaaaacatgttttccaagttgcttacactctccctgtctccttcagggacaccagtgagttgtggatttggtctctttccatgatctcatatatcttagaggttttattcattcctttttatttttttctctatttttgtctgactgtcttatttcagagagccagtcttaaagctctgagattttttcctcagcttggtctattctgctattaatacttgtgattgcattataaaattcttgtagcatgttttcagctctatcaggttgattacattcttttctatactggctattttgtctgtcagctcctgtatcattttattgtgatttgtatcttccttggattgagtttcagtgtattcctgcatctcaatgatgttcattcctatccatattctgaattttatttctgtcatttcagccacctcatcctggttcacaacttttgccggaggggtagcgcagtcatttgaaggaaagaagacactcaggctttctgagttgtcagagttcttgagctggttctttcttatctttatgggctgatgtttcttcatgctttgaagtcgctgacgttttgatttattttcttttatcctatttgatgacctcgactgtttgatggtgctataaggtgggttcagccaactggctttatttctggagtattttaggggacaaacactcagctcccaactcctggattgtgttctgtaa

SEQ ID NO: 6035 - DNA, 1065 bp, Homo sapiens
acaccgtctctactaaaaaatacaaaaaattagccgggcacgtggtggcgcatgcctgtagtcccagctactcaggaggctttgacaggagaatcgcttgaacccgggcagtggaggttgcagtgagctgagatagcaccatggcactccagcctaggtgacagagtgagactccatctcaaaaaaaaaaaaaaaaaaaaaaaaaaaagataacctacagaatgggaaaaatatctgcaatccacatatcagatgagggattaatatccaaaatgtataaacaactcaactcaatagtaataaagcaaataacctgattaaagaatgggcaaaaggcctgaataaccatttctcaatagaagacctaaaattagccaaaaggtatatgaaatgaatgcttaactactaattactaataatcagagaaatgaaattcaaagcataatgaaacatcacctcccaactgctagactggctgttatcaaaaagatgatgataataagtattggcaaagatgcatagaaaagggaacccttggacactgtttgtgagaatgtaaattagtacatccattgtgaaaaaaagtatggaagttcctcaaaaaattagaaatggaacccccatataatataacaatcttagtactgagtatatatccaaaggaaacgaaatcagtatttcaaggagatatctgcactcccatgtacattgtggcataattcataatagccaagatatagaatcaacctgaatgttcatcaagggatgaatgaagaaagaaaatgtggcatatatacaaaattcagccataaaaaaggagaaattctgttatttgtgataaaatgaaggagcctgaaggttattaagtgaaataagcctggcacagaaaaaagtaccatatgacttcactcagatgtggaacctaaaagagttgatctcatgaaaatagagagcaagaatgttgattaccagaggctgggatgcttggggggtagagggcatgatggaaagatgttggtcaatggatccaaaattttagttagataagagaaataaagctgggcg

SEQ ID NO: 6036 - DNA, 1047 bp, Homo sapiens
agacccacctcatatacaataacattcttaggctccaaataacaggatgaagaaaaatatacaaagcaaagaaaacacagaataaagcagagattgtaactgtaatttcacacaaaatagactttaaaccaacaaagaccaaaaagacagtgaacagcattatataatggtaaagggctgaattcaacaagaagacctaactatctaaatatatgtgcacccaatataggaacacccagattcacaaagcacattcttagagacttatgaagagatgtgaattcctgcacaacaatagtggaagtcttcaacactccactgacagtattaaacatatcatggaggcagaaaattaacaaaaatattcaggacttgaactcaatacttgcccaaatggacctaatagacatctacagaactctccacctaaaagcaacagaatatacattcttttcatcacatggtacatattctaaaatggtacacactctaaaatcagacataaaatagtactcagcaaatgtggaaaaacaaaaatcacaccaaacacagtcttgggctacagtgcagtaaaaattgaaatcaataccaagaaaatccctcaaaataacacaattacatggaaattaaacaatctgctcctgtatgacttttggaaaataatgtaattaaggcagaaatcaagaaaatctttgaaactaataagaacaaagatacaacataccagaatctctgggacacagctaaatcagtattaagagagaagtttctagtactaaacacccatatcaaaaagttagaaagatctcaaattaacaacctaacattactagcagaagaactggagaagcaagagcaaaccaacctcaaagctagcagaagacaagaaataatcaaaatcagagctgaactgaaggaaattgaaacgtgtaaaaccacataatacatcaacagatgtaggtgttggttttttgaaaaaattaataagatagacgactagttagactaataaagagaagaagagagaagattcaaataagcaccatt

SEQ ID NO: 6037 - DNA, 1208 bp, Homo sapiens
ccattcatgactgctacataaagaataaaatacctaagaatacagctaaccaggaaggtgaaagatctctacaatggtaattacaaaacactgctcaaacaaatcagaaatggcataaacaaatggaaaaacatttcatgcctagggataggaagaataacatcattaaaatggccatactgcccaaaggaagtgtacagattcaatgctatttctatcaaactaccaatgacattcttcacagaattagaaaaactattttaaaattcatatggaaccaaaaaaagaggccacataggcaaggcaatcataaggaaaaagaacaaatctggaggcataacatactcaacttcaaactgtagtacaggcaacagtaaccaaaacagcatagtactggttcataaacaaataaatagaacagtggaacagagtagacagcacagaagtaatgttgcacacctacaaccatctgatgtttgactgagatgatgaaaacaagcaatggggaaaggactccctattcaataaatggtgctgggataactggctagccatatatggaagattgaaactggacctctagcttccatcttatatcaaaaatcaactcaagattgattaaaaagttaaatgtaaaacctaaaactataaaactcatggaagataacctaggaagtagcattctggacaaaagaatgggcaaagatttcatgacaaagacacaaaaagcaattgcaaaaaaatcaaaaattggcaactggtatctaattaaactaaacagcttctccacagcaaaatagactatcaacagagtaaacacacagcttacagagtaggagaaaatacttgcaaactatgcatctgacaaatgtctaatttccagaatctgtaaggaactttataagcaaaaacaacaaacaatcacattaaaaagtgggcaaaggacataaacagacacttctcaaaagaaaacaaaggatataaacagacacttttcaaaagaaaacatgcatgcagccaatacgcatataaaaaatgctcaagatcactaatcattacttaaaccaggggtgttgaaaaactaactgctgagtactatactcatcatctgggtgataggatctttcatatttcaaacttcagtgtcatgtaatacacccatgtaacaaacctgcacatgaacaccctgaatgtaaaataaaagttaa

SEQ ID NO: 6038 - DNA, 1028 bp, Homo sapiens
attttacacattaatttgagaagatctggaggcaagtttttattctgcccaagaaatgtggggaagtgttggatgtaaataaatagagtgtcccgagtggaagatgagatgtagcgcttaaatagaaaatctctatagtatgagagatgcgtaattcctcatacataattcccgattatcccagatgtccagtaggttgggacagggtggtgatggtatgaggaaggaaaattagaaaaagtgttccaggatttatttattcttttgatatcttggttaatttgtggatgatgatatgaggaacaaaaattttcttttagaggataggaaggagagcatattaaaattatagcctgaatgaagttatctgttatccaagaaaacagttcatagcagaacaaatcctttcgacaatggtttttccatgagtgagaaatggcccatttatgacaacttttgtgcactgaaaaatattgctgcactacttctgtgatgaaatctgtggtgaccatggattggagatcagagtgagaagaacttctggtttacagatgtgatagctaactggctccagaatagattttacctaaaaccttatattccaaaccaccaaaatctaaggatagcaatggtgagaattttatgctgttatgaatagctttcagtcgttcttggcatctctagataatctaggaccagtcatatctaatggacagagctttaacaaacacaaaagtccacagtcaagaaatgtcttgctggttgcctaccttactagcatggtttttgattaatcaagctgtttgatgattcagttctacatgaaaaggtcttgcctttggagtaaatctgggatattagggagaggtaagaatttcctttgaggaactgactgattttggccccaaaaaggcagatcccaatattttaaataatgttcttcatcttaatataggactcttcttctgagatatatcttctgaaagaataaggtacaaaccatgacccaagatcatattgattaatct

SEQ ID NO: 6039 - DNA, 1031 bp, Homo sapiens
tgatatactaaattcctcattttctttaagtcttggttcaaatatcactctctcaatgagaactactctgacaccttatttaattctgctcccttctcccacatgcccagtgcccttatccctaattattttatcctggtctctatattgtttccatagtacttatactttgatatattatgtaatatgtttatttattttagttgttcattttcacctcctaactgtgccctccctgaaccaccaaacatatgcaaaatagaatgtaagcaccatgagggttgaaggcagggatctttgtctcctttgtttattgttaggtcccaaatttctataaccatgcctaacagtagccatttaataaatatgctttaacaatattaagtgaatttatgtatttaatattgagccagttgctagatgcagaaatgaaatctacagccccatcatcctaaggagtgtgtagcctagaaacaaagacaagcaaacaaatggcatctattgattgcatatgatctgtgagtactttggagatacattgttgagcaaaacccaaggaggttatagctttcatgttgctcaaatttagctagtgatcaggtttactacgaatgtaatgtactttctaactagtgatacgttagtgatatgttagccttgatatgcaaggtgctgtgggaccatagctgtgagtggttgaagtagtcagagagtgattccccagacaggtagccctgggaagtgagcagtctgtaaggcaggcaattaagtgaggagtctgtgaacaaggagtctgggggagagcattccagagggagcaacatctgtacttagaggctgtagggtctctgtatctattcccaatttagtgccttacttcttggctcctgtcactgatacgttttgtactctctggtgctacatcttctaagaattcctctttaaacaaaggtctcagactgtaggctttagatgtgtttttgtaatcaacctaatgtttataagcgttaaaaccaaaatttaaacatcta

SEQ ID NO: 6040 - DNA, 1217 bp, Homo sapiens
tttgttattgggacagtctaggaagtagagaccaagaactagcccagagtaaatgcagtgtgatagagcataaaaattatgaaattaggaggaaatgtcaagcatgagattgtagggcattgcaagtagcaatctctgaaactgagatatctctagatatcagggaagtctgggttaccatgtttcaagtttttgacctccccaaactatagtcacctgatatattcatgccatatatttaaaaatgtaccaagactctcaccataattggggagcaactcataagatcaaggttgatcccaaggtccataaataataaagtagcaaatatattactgaagaggattagacacagagaaaaacgtcactggagttggcaaactaaagactattccttgacacccagactggagcctaagtattaaaactgggtatgttttaatagatttggcattagagctagactaggcaatttttatatttatttatagagaaagataacaaggaatgtctgattcctgtgtcaggtactgggatactgagatgaacaagacacaaattcaaaataggtttgaaaactgaatatatgtatagaaccagctcaattagagacaaattggtgtctgtattaaaatggttttttgttcctttaccagtactagtaggaaaacctcagtgccttccacatgtagcctctgtttagaactcgtttgtaactctttagccacaacagcatcagtccccaaggatacagcttctgatgctggtctctatctcaatctcctcccagccgcattgcttacggtgagtttgtgtcttcctccatttcctgttactgcgtttattcagatattcaactccaagttccaggggcaaagaaacagaaatactgaatccatgctctgggataggaagatcacacagtgaaccagccatgcaggaacctgcatggccattggaacccagagtgccaaatgggatagaaatatgtggagaaaatagtatttatgtaactcttctcagggaggtgctattggtgtttctgataagcaacttgggattggggggtaaagctcaccaaggtgcatactcaaggtagaataggtgatcactaaactgcctggtaggttgcattaagtgtgggagttttatcttctgagtggggtctccaggcatgactctattatagaactacatgactcggacaaggggttggc

SEQ ID NO: 6041 - DNA, 1058 bp, Homo sapiens
gtaaatcaggacctaggtctgcattgtttagtaacatcttctgaaatgcctcagggtcagctagcttctagcaaacaggaagtttctaaatgcacacttgagtacacaggggttgctgttttgaacatgctgactgaaatttggggctatcttattggtgtgttttttttttttttggttttgtttttttttttgcctgacattttcaagtgaagattctagtattcccataatcttatcaacaatttacttaagacaacttggtcttgatctaagcaattctcagggaaatgatcctggaaaattgttttcccctatggaacgaattcaagtgagcaatatcctcttccaaaatgggaacgatatgtcaattaaatagacaaaacactgagaatggcattgtgaaatagccctcaaaccagaattagaacttgctgactatctgcagggtgagtggtcagaaggcagccccattttctcagcaataaaaaatattttctattttattgcagggcaaaatataggggacgaaaatatttctgcagttggccctgaactaatatgctggctttcagtctttcaagagctgtttttgttttaaattctagtacatgtaatcagactaggcagaagtatacaatggtttctaaggccaccaatgctgatagattaatacttcagcaggatttgtgactgcagagaatatcaaaatccaatgctctttcaagtgcagtgagactgattcagttgcttttttaaaaaaaaatgattttcaggacaaaactactcggccttgaatagaagtatttttcttttatcaaaatttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagaggcggggtttcaccttgttagccaggatggtc

SEQ ID NO: 6042 - DNA, 1049 bp, Homo sapiens
cttatcaagatgtgattaccgtacttcaaattttaaaaaaccaaagagatagtataaaactatagcattaaaaataattgcattatatgggttgtgtctctattgctcatgtttttggctatttatttcattcataagccacactaggaaatcataaaaattaagtaaaaatgcttcctcctccaagaagcacacatattcccagcgacatgtatttccaaataatgaagcacatatattcctagataatgttcaaaaatagtatgaccaaaggcaagacatatctgctttatatgattttatttttatctacattgttatatcaatgcatctttatttttaattgatatatataactgttcatatgtacggggtatataatgatgttccaatacatataatgtatagtgatctgatcagggcgattagcatattcatcatctcaaacatttatgatttctctgtgttgggaacattcaatatcaccctttagctatttgaaactatcattaactgtgtcatcctacaatgatatagaacattagaatatattcctcctatctagctgcaattctgtgtcctttaacaactctccttgtccgccattttctcctaatttttccagctcctagtttcctttgtttgactttttaattctatgtgatcaattttgttttcagcctccacatatgagtgagaacatgcagtgtacaactttctgtttctggcttatttcacttaacataatgtccttcagttccatctatatcgccacaaacaacagaattccattttcatgactgaataatattctattttgtatatataccacattttctatatccattcatctgtttttgaatccatatcaacacccaggttgattccatatcttggctattgtgaatagtactgcaataaacatggggagacagatgtctcttcaatatactgatttccttttctttggttaaatgcccagtagtgggattgctggatcatatagtcattttctttttagtttttttcgtggaacttcatactgttct

SEQ ID NO: 6043 - DNA, 1038 bp, Homo sapiens
ctaattttctctatatcacaaagcggcagcaccatccatccccttctccctcatcacccatctcaaatccatcagcaaatatgcatgcctgttccttctaggagtccctggctgccaccacctattcataccaacactctctctcacctgaaccaccacgttaattcccagttgacctcccctccctgtgaccctctcctcagcaacaatccatctttagcaacgtatcttgagtaaccatttgcaaatcagaaatctgatgattgtacacatactagctgcaatcttagccaagttaatgcggtaccttaagattccatttcctcttctgtaaatggaaggagcaattatccatgcttctgatttgatgtgaagattaaatggctaatgttaaacatttagatgatgcctattctgcaatccctatttgatgaactagggcccataagatggtagctactatcatcattagtattgtcatcatcattgtcactctcctaattaaaacggattgctgttagaataaaatcaaaacgtgtcatctcttaggtcttgcagaagctatctgcctctccttgcctgccttatgtttgaagcttgttaagtctcggccactagatcttattttagtttctcatgcactccaacctctccaggaccgtcacagctgcaccctcctattcctgtcactggattcttaatgtaaatgtcacttcctcagagaagccttccctgaccactcatttaaaaaatattttccacaaactcacaccctatgcaatcatagaattctgctcgtttcttttataacaattctcacggtaggttatttgttaatgcctttatttctatatttttattagaatatagcttccaggagaaagataagcatgcctcctccatcactgtgtgcaaatattggtcttctataaacatttatggaataaaacaaagaaaaatgaaatctcagagatatctgctaattttattcaaattctgatacagtcatttaaattcatcaaactctaagtggtcaat

SEQ ID NO: 6044 - DNA, 1049 bp, Homo sapiens
ttcctttttatagcatccacaatattatagaagtagcttctcaaatccttactcatctacttgttagcactgaggtgggttgcagtcggaacaaagaaaacactttgtttgatacataacacttttatttagttttcacaggtaatctgtcaggatatccccatatgatagatgaggaaatgaaagcagagagagtttgagtaatttgtccaagagaacaagcaaaaaaacaaaaaaaaaggttgagattgaaaaaaaattagtcaaatgtcacactagtcacactctcaaccagtgcattagcctgtacacctaggagattaggacagtcttcaaaggaagacaaatctgaggaacatgcataactatctaggctagtccttggcaagaggcagaagaaaaatatgcactcctgttctccttttttgctggctgatctctttctctactcgaaagtaatttcatagctctaaccaacttgctaaaaaatcatcatcatcatcatcatcatcatcatcatcttaaatggacacaagtggactttgtataattaatttagacaacaggaaaaataaaaagcaaactaaatgtcaccttacaattcatcatggattaggtttgttaaaatatttttataataaaacctagtatcttaggctcaacaaatacaaattgctataactgactcagagtttactttaaaaaaaatttttgtggccagccctgtaagaaggtaatagtgtggttcagccccagacctcaataggttgttatgctctgtacaatttctcaatatctttgcattcatggaattctagttgaatcagaatcaattagaaagattcagacaataataataaatagctattacaatttaaaagagacttgcaagttttttcatgatgagagttttacttttactcattgtaaaagcaaggtatgaggattgttcaaaagttaagcaattcaaaaagtaaaaagaagtaaaaatcaactaaaaatctccctaaggaaaaatcattgttaacgtattgatgaacacatttctg

SEQ ID NO: 6045 - DNA, 1075 bp, Homo sapiens
cacgaagtcaggatcatatctcaactcttctgtaaactccacaatgcatagcatagtgttactcatgggaagaatcaaatacttgtgattgaaatgggttaacattcttctcacgttaaggaacatacttcttttattgtacctgttgttacgcagggtgtaagatttattcttttccccagagttgatatcaatactttaaaaatatgtaaaaattgaagataaatggggaaacaaacaatttatgaaggtcaaaactatgaagtaaatttcagttcatggttatttggcagaaatactaggttggagagtatggttcacatatgagaccaaattaaatattatttaatagatttatttcatacttagttgaaggaaagcaagaagtaaaaacttagcttgaccaaaaacctgacttgcttttggcaaaaattgtggtggagagagaagagagagagagagagagagagagagagagagagagagaatgaagaaagagaatgaataacctctaccctgtgagaaagtctttccattccaaatgacacaaatagagaatctaatgaatctgagtctaggaaagtcaaaaaggaagcagattggtatccaatcattgaagacaataaacctgaacactaagaagacatgactaaataaatgtcaggttctaaacaattaaactggttacttctcttacactgaagtaaacagagactggaaatctctgtctcaactctccctatcaactcaataccttggagtcgaacatagttttccaaataaaaagataatgaggcagaatatgacaccttgattactaaatgttctagttcatattgaatatttccatctgaacttgaaagccaaggtctcggggacccatttttaatgtgcttttcaaaaaattcatattaattactttatatgtaattaacaaataattagatatgaggctcataaatgaaatatttatgttcatataatatggctaatgtatggtaacaatagtattaaatctatagatctatgatgggagatttactagaaaaacaatagtaggtctcccaacccatga

SEQ ID NO: 6046 - DNA, 1031 bp, Homo sapiens
gaatgcaagaagaatgggatttaatgactaggagagattattttcacttatcatgatgagtttcatgtagaaattcctatagtattctctttttaggtcatgaaacaaattaaccaatactaaccaattgtagttctttggatctcaggactgtttgcaatatgcaggtgccatcaaacaaatatgttatgaagtactttataattcacctaaaaagtaaagtgtaactaaaatcgacagcattaaggaagttgcgttattttagtcttttgggatattgcccccctttaagtttgtactaaagatgatgttcagcaaatgttgtggtgcatatactatgcaaagcagcattttcgcccattttgtgataggtacattagctattcagagtggctttccattagctaagaagtggattgctacagctcctggcataggaaatgttttctcaagaaagttccatggtaaataacattagaaaggaagatcatgaatctagccagaagtcatagcaaaattgtagacctgcttggaataaccacagggtaataccatgaagcagcactaaagttggagataaatctacacataatgtgtacctacttaaaaaatgtcttctgatgaggccaaaggtttgaagctgtcaggtgatatattaacttaacttgtcttctcagtcatgcaggacctgggaaagacgaaacattagtgtttattagggaattatagcaagaaagaatgataatgctacgggaaggaaaacagtataaattaatttgttaagaaaaatactaccgtggttgaaaataaaatccaaggaacacattaattagaaagtgaggataaaccggaagaggcagaaattatgctctcttacgagatgagcaaaatgcaggaataagttagataaagtctaaattattaaataaactagaaaagaagaccaagatacaagagactgagaatgatcctttatattacagttttagaagattaagctccagttttatgtaaggtactattaggtatgg

SEQ ID NO: 6047 - DNA, 1035 bp, Homo sapiens
caaccaaccaacaaaactgctatccaagtcagcttgttttaaaccagtgtgcacatggtgtatcatacataactggggagatatgtggtacttggttatttcaaatctggccagtgctctgggagaaagctgctataaagacaactaaagtttctagtgtttgtcagcctggaagtcctggtgattgcccttggggcaatgtggggacaacaatcatggaattctaagtcagacttaaaatcagatccctgatctgcccctcattatttgagatcttgaagaaattattctttctaatggttaattttatgttgcaatttgacagggctacaaggtgcccagatatttgttcagacattcttctgggtgtttctgtgagtggttttggatgagattaacatttaaatcagtagacaaagtaaagcagattaccgtccctaacatgggtgggcctcattcaatcctttaaaggcttcaataaagcaaaaatgttgtccttctccaggaagagagaattcttcctgcttgactactttgaactgaaataaggaatcttcctggatctcaagcctgcctactttcagactaaaactataacatctgctctcctgtgtctccagcttgctgactcaccctgcagatcttgtcagcctccgtaatcacgtgaaccaattcctaataatctctctccatcctatttacttttttatcatgtaaaagggagattgtccttacccttcaagcattagagataatgaatttaaatatctatcacagtatctcgcacataatatagactagcttagcctccttagcctaaaatcatgtcacttgctaaaagtagtacaatgattcagagttgtttcctacataattttaatatggagaaatgattgaacattggcaaacttgttaacctcctaaaacaattttggaaaaagaaaatttttagaacttttatgcatgagagaaaaaatgaccattttatagtaatttctacaaataattattgttggcttaaagaaagaaactgag

SEQ ID NO: 6048 - DNA, 1051 bp, Homo sapiens
ctgacaaagttttgtatgactttactttttattttgcttttaagcttggctgtaatattattactgaacctgtgacacttcacttaaaatgtcaaatcctttagtggagagagtgttatttccttgtcttaatctttttatatgccaatgattgtgccccctaggatagcaaataaaatctgtcaataaactgactgaacaatgctatccaatagaaatacaatgtgagctacattttaattttaaatttcctagtagccacgtttttaaaacgggaagtagaagcaagcaaaattaaatttaatgtgtcttatgtaattccatattcttaaccacttcagtacatagcttctcttatccacatgaactcgtatctattgtacttaaactggaagacatagagtcaaatgggtttatgggatataagtgctttgcaaactggaatgttctatacaaatgtaaagtggtgttataattaagaccttggcatatttgatcattttcactgacacattgctcaaatgtgttgattgtgcttcgcaaatctctgctccaaagtaacacatgctgagatcgtttaacattgtaaatcagtaatataactttgatcatctttgtttcatcactttgaatttctctcctccaaaaggattttgaaacattggttgtagttcataaatgctctgtcaaaagtatcattgcattgtgaagtttttatttgagataactttttgaattgacagagtcatttagttcctgtagtggttttgagtagtaaactgttcatattatgagattaaatccaagactccagttctttctagaaagaatgatacaacttaaagaagcacggtatttatgcattttgggataaatggttttccttgagatgagagcgagatagtgttctttctctaataagccacgatgtaaatttttttttaaatctttgtaattaagctcagtctttcttttgtccttgatactgtatttttctttcttcatcgcaatagaggtataaaaaaatgaggtaacctatgacagttaaaaa

SEQ ID NO: 6049 - DNA, 1029 bp, Homo sapiens
tcccagaactttgggagaccgaggcagaagaaacacttgagcccaggagtttgagaccatcctgggcaacatagtgagatcccatttattttaaaaaaaaaattaaaaaatagctcagcatcgtggcacgtgcctgtagtctcagctacttgggaggctgaggtgggaggatcacttgagcccaggaattcaagattacagtgagctgtgattgtgccactgcacttcagcttgtatgacagcaagaccctgtctcaaaagattcaagttaatgcatttatcaaacaccttctgatacaaggcatatattaaatgcagtaaggagatgctagttatgtagaaaaacaggtatcaccattatctaagaaatttaaaattaataagtgtaagaaaagtcctgtaacaactagatggatttaggaaagtaccaaacagaaaatacaatatatttaaacaggaagggagtcaaagatgggagaggccaaatttatttgggaaaatcaggaaaaactgtggagaagatggaatttgatataggttgggaagactggatagcattttgaaagacttaggggagccaggcttgtagaggaagctacggaaatgaagacactagaatatgcttggcttatttgggaaggagcagataatcctgcttttgggaatcgttcagaaacagtagaccataaagcttcatattgtagacaaccttgaaggcctgtgctgagaaatatgtacttaatgcagaagattggggaagccattgaaggtttttgagtaataggagctaatactttttttttttttttttttagacggagtctcactctgtcacccaggctggagtgcagtggtacaatctttgctcactgcaacctctgcctcccaggttcaagcaattttcctgcctcagcctcccaagtagctgggactacaggcgtgcaccaccatgcccggctaatttttgtattttttagtagagactgggtttcaccatgttggtcaggctggtctcgaacccctgacctc

SEQ ID NO: 6050 - DNA, 1070 bp, Homo sapiens
attttggcagcagtgtataggtagaaaaataggaggacagtaggtaagttaagatattgcacttaagtgagatccaaagagggtctaagctacagtgttagcagaggacattgaaaagagggatatatgacaaaaattacagggtgtttgtaccacctggcccttttgagttggtgtgatccatctatgcctacaccttcttggcctttcaagtcaagtatcacaggctccctggtctaggcaatctcttcagattcctccttctgttatccagtctggtcccagatattaagattgtctgcctggctggaacctttgggttcttatcctaaactacctctcctctggcttatatcagactcttctacacgttggacctcagctgtcctatttgatgggccttctgggaccctttcagagggagggatctagacagaaggagaatctgaacaatttggtacttttcaaattgtgaaggagtgggatgtgaagagaagaattagatggtaactccaaggtttagagtttgaattactagaacgaataaatgcatttttactgtaagccttcataaaacagattcaaatacagcttttacttggctactttggatttgtctaaaatcgatttttatttatgtaattcctctgatggaaatattatatgtagagagtgtgatcaagagtccgccatctaaacaggaagccatgtttgaaagtagaggcaagatagcattttgggaaattgaatcattatgcctggtgcagagaaaactgggggaaagtggttgagatgtgaggcactgagtaaataatgtctgtaattctgacctcaagcttttattctaaattacactcttttttttttttttttttttgccccgagacggagttttgctctttttgcccaggctggagtgcaatggcacaatctcggcttgctgcaacctccgcctcctgggttcaagcgattcttctgcctcagcctctcaagtagctgggattacagacatgtgccaccaagcctggctaattttttatatttttagtagagacgagatttcaccatgt

SEQ ID NO: 6051 - DNA, 1050 bp, Homo sapiens
aggactggaagttgttctgggtaagtcagcgagtaagtggtgagtgaatgtgaaggccttgggcattactgtacactgccgtagactttataaacactgtacatacacttagtatatacacatttatatgaaaaatatttttctttcttcaataataaattaaacttagcttactgtaactctttgtttataaactttatttttttaactttttgactcttttgtaatagcactttgcttaaaacacaaaacacattatatggctatataaaaatatttcctttttaatatccttgttctataagcttctattttaatttttttcacatttttttcactttttaagcttttttgttaaaaactaagacacaaacccacacattagcctaggcttacacagggtcaggatactcagtatcactgtcttccacctctacacctccacattttgtcccactggaaggtcttcagggacagcatggagttgtcgtctcctctgataacagtcccttcttctggaatatctactgaagaacctgcctgagtctgttttaccgttctttttttattttataagtagaaagagtacatgctgacataatgattaaaagtacaatgtagtaaatacatgaaccagtaacatagttgtggattatcactgtcatttattatgcaccatacacagttgtatgtgctatacttttataggactggtaacacagtagatttgtttacaccagcatcactaaagcatatgagtaagacattgcagtgcgatgttaggatggctacaaggtcattaggtgataggaatttttcatctccattataattttatgtgaccactatatatgcaatcagttgattgagacattatgtggcacgtaactgtatattatttgaggtagggggatcaaggttgttttttcctcatatggatacctaattgacccagcaccatctattgaaaaaaaactttccctctactagaaatgtcattgttttcactttttaatttttgagttctgggtttcacatttcttttttttc

SEQ ID NO: 6052 - DNA, 1065 bp, Homo sapiens
ttcctccctcagtcatttaaactattttaataattgtattctgctgctagagaattggaaggctgtcagttccctttatttgaatgcttactatgtgccagagactgtgctgtacacttgacatgtatcatttcacttggttgtcatagaaactgtggatggaggtagtgccacttgaaaactgagctttggagagagaaaaaaagatttttcccaagatcatgtgggaagtgagtggtggcacccagacttgaacttcaaagccttgctgcttttacccagcatagttaagtcaaagtctgaaatctgtttccttattgctttttctttttctttttttttttaaatgcggtcttgctctgtcacccaggctggagtgcagaggcccaatcatagtttactgcagcctcgaactcctgggttcaggcgaccctcctgcctcagcctcccaagtaattggaattacaggcatgaatcagcctgcttggtccgttattgcttaactgtaacatggaccaaagaagcagctaaccctgttagttaattcttactaggaagagaaaccgcaccagctatttaaaaaaaaaaaaaaaaaaagcaaaacaaaaatgaaaataccaaggtatactggaaaataacattgagcttagaaggagacctgagtttgtacctggctcagtcacccagctcatttatcactttcttaggaaggcctttccctgtcacaccctccttcttgtttgtctctattagagcactgaactcattgccataattaccttattgcagtgattctaaggtggacatctttcacattttaacttttctaaagtgtggatgcattttacaattgatggtgttttaaaataaattggcagcattttttcttaattattggtacttaaaataaggatgtgctgtacagttgatgacatcttagatttgattaagtgcatatttatttttgtgtgttcccacaaaaatgtttacatcattctcatggttttaaatatcagatatatgcaatgattttccaatttctatccttttttaaggtccacccct

SEQ ID NO: 6053 - DNA, 1026 bp, Homo sapiens
catctaccacttctatcttgttgccacttctccaatctaagcccccatttttcttgcctatgcagcaactaatattgtagcttctcctctttcccatgtctaatccagtcacaaccatccattaaatcagaacatgccacttcttaagacctccctcaccccctacctaatgcatttggtataaaacaccacatcattaatgtggtctgtatggttgtctgtttcctgcctggcttctgcccacatttccagcctcatcctctgccactctgcctcccagtatcactcttttcctccaaaagtaactcctactcatcctttagatttcagcttaaatgtcacttcctcagagatgattattgatcttccaaactaaattaagttcttcagttatagtcctttatattgaatgtatgcctttcttctttgggatgatcagtttctcccaaactgtggctaaagaagtgaagtaacttccacaaggccaaagagtgagatctattagaactggaattctctctgttagaggaaaaaaaaaaatccaaaaaagagaaaagaagaaaaatggaaagaactggaattacaacccaggggcggggtgaactctaaagctgtgtcctttctgtgatctttgctgccttgagggcaggaaacagggtatgaatcaatgttctaagtttcaaaacatggcctgactgctgctcgtttatttcccatttcaagttgtccttaaatgagctgggtgcagtggctcatgcctgtaattcaatactttgggaggccgaggcaggtggatcacttgagcacaggagttggagaacaacctgttcaacatggcgagaccccatctctacaaataaaattagccgggtgtgctggcacatgcctgtagtgccagctactcggggtaggagtgggggcctgaggtgggaggatcgcttaggcccaggaggttgaggctgcagtgagctttcgtgccactgcactccatcctgggcgacaaagtgagatcctgtctcaaaaaaa

SEQ ID NO: 6054 - DNA, 1047 bp, Homo sapiens
tctgtttgttcacttaggttttttttttttttttgtacttaccaataattcaccctcaaactcctcggtattcaccagcttttagtaaatttaggatgtgtttttctttcagtttaactctgaaaactggggtttgttccagtgtgactgttgccttctaatcctagtatacagctaacatcttgagattgccttcattatccttgtggtgctgcttttgcttctgttgtttacttttttggtttactctgattcttgtatagcatctttcccagtaaaggtgcatgggagattaaatttttgagttttgcatgtctgaaaatgtctgtatcctcacattcacttgttagactgggcatagaattctagtttggaaaacatatttcttcaaaatgtaaaaattccttttcttctaccttattgtactgcttttgagaaatctaaaactgttttgattattggtcctttaaatgtgatctggtgctttttttttcctcccctttagaactcctgctacatgtatatgcatcttctgagctggtccttattttcttatttttttccgtactgttttcctttagtcttctttcctttttttttgttttgttttgttttgtttttcctgaactgctggatacattttaacttaatctctctgcttttagtatggtaccatttccctcaactgtacctgtacctggttttcacagagtgacactattttactctctagagaggataaatgtcctaaaatttgccatggtagaaatttaacctcttttttttttttgagacaggcagcctgttatacaggctggagtgcggtggcactatctcagctcactgcagcctctgccttccgggctcaagcaattttcccacctcaacctcttgagtagccaggtctacagtcatgtgccaccaagcctggctaattttttgggtattttgtagagacggggtctcatcatattaccccaggctggtcttgaactcctgagctcaggtgatccacccacctcagcctctcaaagtgctgggattaca

SEQ ID NO: 6055 - DNA, 1026 bp, Homo sapiens
gagtgacagagtgagaccttgtctcaaaaaaaaaaaaaaaattctatccctttaattttataaatgaagagccaagcccaagggaggtaaagtgaccttttccaggtcatataattaagttcaactaagtagacttactggacttgtgctgtattgttcttattactgcatctaaacactgaagcacagattttcaaataaaacctaaagctacagggaaggaataaaaacagactttgaagttagtttatgacaacacatagattatacctgaatattaatatttccgaatcaaaaatatgtaccttcattcagttcatttttgtaaattgtaacagtttgatagtttttgtttagagagaaaagatgttaagaattgatgaggctttgcctgtaattcttggtatcttgagtttttgttggaatgaataataaaggtcactgaagtccccatatctaccttaacttaaacatatattgttttacaggaaaagctgaagactgtaaaggaaaactggaaaaatctgtctgactctgaaaaggaagtgagtattacggttgttagtctcaagtgtctacttaggatatctgtgagagaatgtattagggcaaggcttgattcatgtgaagacaaccttgtattactaataatacaagtattctaaaattattttcatattctcagaaccagtttggcatttttctcttggtagtttttgtctgcaaataaaattggtatttgaaaccacagcactcataagcctgagtgtccacttattcagtggcagtgataccctgctgctgcccccttcctgcacctcaagatctgaacttgtaacaatttcattcaaagagataacagtctatctcttacattttcatcatctaacttttatctcatgaaaatatttcttctccagtctgcctttatacatgtagaatggtaatgtaatttctaaagtatatacagaagcattccagaaattaattgctattttaaataatcattttatctcaaaaaataag

SEQ ID NO: 6056 - DNA, 1003 bp, Homo sapiens
ccatggtctatagtatagtgtgatatgactactgttccaatgtattgaagtgttgggatagttttttcaaatgttttcagatgttcttgttttagaatcattgtcacctttaagaggaaaaaggtcatcactagataatctaaacaaattgttgcttctcagtgttagcaaggaaaataatctagtttcaaattacattgcagtataatgaaaaagatccatatactgtggaatgatattcttttaaaattatttgctatggcttggtaaaaatgtactttttccagtagcacatatcacaagaacctcactgtagttgaaagccatctttctttagtatttgtttatccttttaggagagtcaagcaaaggttttcaccacctgtttgagcagaataattctcatcagttcacagatataggataactcaatttatatgcactttatgcgttatgcaaaatatttagaaattgtagattctagatctccagaaagactttgaagactttgatgtcacaaaaagatgacttgttatatgctgagcttgacaaaggtaggaatgggagagaaaaatagtagcttatgaggaaatatgaggctttaaatatataaagttggatattttaaaataacttttccctgtgggagcttctcactctgggtgcagacaggacagtgttggccattggtgaaatagataggatgggtttgaggccagagcagtctgggagtagggggaaagagaaggaggtgtgctagtgtctatcacaggctttctcaattaggtttgcaggagaaaaagccctaagtccctgtgtcatctagaatggtactaattatgtacagtccctaggagaatggagaaaatcataactcaaatcatcgactcaattctgttctcttcagatgagctcagagagcacataggagtgtttgtaatgaggggtatgtaatgattgagatagaggaatgagttacataaacatctcgggacaaatgcag

SEQ ID NO: 6057 - DNA, 1033 bp, Homo sapiens
tactgtctcacatgatggataaagatttcaaaacactagaaagcaaatacttgccaagtctttttttcttttttcttctaattgcatgtgaatcctttgtgtatgtgtgtgttgggggggggggggtgtgtttgatgtgttttagtgaaagtcttcctcaaaaaattagaaaagtttgttatgacaatttatttgatccagagagcatagttgcaattaaaattgctttatagattaagtgaaaaaacacatcagaggttgtatagcttggcagtaaagagcccaggagctgctttcagactaacttggattgaggaggtcctcactttgcttctcgtagagttccgtgaggatgcactgagaggggcagtaaaacctcacgctcacgggcatggagcaagcactctcagtcacttatctctatgaagacttggagggttttggtgaagttgatcattgataaatacatagctagagaggtttgttataccaatgacttttacaggcaagaatgtatttggctgcgactaacaggaaacctgacacagagtggcttaaacaagccaggggtttgtccttctcacctaatgagaagtctggggctaagcagtccaggctccaagagctgctcaagggcatcaggagccccgtgtcttccctcttccctgcctccaccatcttcagcctgtggctttttgccttatttttgcactgtggctgtggctgtgttttgaggtgtgtctggtttatgcaggaaaaaggcggaagaagaaaaattattttctcttagagattttgcatttttatgtgacaaagaattctctctcctggaacttctgtctgtacttctttggccaccttttgctgcaaaagactctgggaatgtatcttctttttccagcctcactagtggaagtaggcaaagaagaagggggtcagaatggatgctgaatgttttaccccatattttcctcacagtgggcaaagtggaggagcattaggactcaaaattgcaaattgtgactgaagtcaa

SEQ ID NO: 6058 - DNA, 1030 bp, Homo sapiens
aaagtctcaggttacaaaattaatatacataaatcagtagcaatgctatatgcactgagaaccaagctgagtatgaaattgagaactcaattccttttacaatagttatacaaaaatatttaggaatatatataaccaaggaagtgaaacatctgtacaaggagaactacaaaatactgctaaataaatcacaggtgacacaaacaaatggaaatacaccttatgctcatggattggaagaatcaatatcgtgaaaatgaccatactgcccaaagcaatttacagattcaatgtaattcctatcaaaataaccaacatcgttttttcagataattagaaaaaaaatcataaaattcacatggaaccaaaatagagcccaaatagccaaagcaatcctaagcaaaaagaacaaatctgaaggtgacatcacattacctaacttcaaaatacactacagggctatagttaccaaaacagtatggtactggtaaaaaagtagttacatagaccgtggaacaaaatagagaaccaagaaataaagccgaatacttacaaccaactgatctttggcaaagcgtacaaaaacataaattggggaaaggacatcccattaaataaatggtgatgggaaaattgaatagccacatgtagaagaatgaaactggattcctacctgtcaccatatacaaaaattaagatagattaaagacttaaatctaagacctgaaaccatgaaaattctagaagaaaaacttttctggacattggcctaagcaaagaatttatgaataagacatcaaaagcaaatgcagcaaaagcaaaaataaataaatgggacctaattaaacaaaagcttctgcacagcaaaagaaataaccattaaatagacaacctacagaatgagagaaaaaatctgcgaattttgcatctgacaacatacacggaactcaaatcactaagaaaaaacaaataatcccattaaagagtgggcaaaggacatgaatagacagttttcaaaggatgatttgca

SEQ ID NO: 6059 - DNA, 1030 bp, Homo sapiens
attatcattatgtaaatatttgctgtggaatcaagtagtatacttggagtgattaagaagaaaacaatcttaaattactaagtatgcagttcaaaaggtaatggcctaggcatcaaagtccgaaagagtgtcagttttgtccttttgtctgtttcttctcagtcatatgaggcttccatttaaaaagaattctcatatgtttttcttgcattactattttttattctagtgtaacatctttttaagtggtttcttcatatgaggtgtgtggttagtagaattatggcccctaaaggatgtctacattctcattccaggaattcatgaatgttacctcgcgttgtaaaagggactttgcagatgtgattaaggatcttgagatgcaggattgtccttgatagttattttttctctgtctgaaggatttcctttaacatttcttatcctttaatattctcattttgcctttatttttgaaagatgttttcgttgagtaaataattctaggttgacggtgttttaaaattgcttttaagatgttctactcttttctggcttgcattgtttctgatgagaaattggccatcaacattgtctttgttgccttgtagataatgtgtattttttttctctagctgttttaaagattgtctttaacattggttttaagcaatttagtgatatatgacagcgtctttttttttttcatgtgttcagtggagttcattgagcttcttggatttatagctttattgttttcattagatttggaataattttaaccattatttattcaaatatcctttctgtttctccttcattgggaactccaattacacatatattcgactgcttgatgttgttccacagcttattgatgttctattcaattttttccagtattttaaaaatcaccatttaactttagataatttctgttgctatgactgtaaatccaatctcacatttttttctcacatagactaatgtgctattaatactttcagtgcttttttaccccaaagatgta

SEQ ID NO: 6060 - DNA, 1052 bp, Homo sapiens
tgccaatccttaggaaacagtgggaaatgttttactttaaaaatgtagggttttgcttttacaaaactgatctttgaccaccggttctctcaggctttgccttttctagttcaatgatcttttctactagttcccccctcccttccctcaaaggcctgaatagacacttcccagtttgggaaatagaccttcattagttacacctggctcagcatttttttttcttttctgcacatctgcttagcatcatgtatttgaaggtgccacatacatgtttgctaacgttgctttagatgctgttgagtcataagaagataagcagtgctagggaggattcagtccagcttgatattcttctccacaagtgtgacttgggtagggaaagggggacactttctttggtcaagacggaaaaacagattcatgttacctgtcattagcatagtaaaaactatgggaaatgtcttagtccattccggctgctataacaaaataccatcaactgggtggtctataatgaacaaaaattcccacttctggaggctgggaagtcaaagatcaagcgtctggccttcaaagatgtgccttctctgtaacctcacatgatggaaggggcaaaggacctctctaggttctcttttataagggcactaatcccactcttgaatgcttcctcacatgacctaaccacctcctgaagaccccacctattgataagtatcattaccttgggagttaggttttcaacatatgaattttgggagatacaggcattcagaccacagtggaaaattaagcttaactgatggggagatttaggagatgcagtgagagagctttgttgtgctgtgtgctctgttctctcaatattatgattttaggaaggccattgccttctcaagagtttaggtatgtgctgcaagcactcagctttttataatttacatccttcctctacggatggttgaatgaatgaattgctctgaattcttgtacctatttctatttctggcctgtgcaattgagtttaatgttcgctaaccacatataaa

SEQ ID NO: 6061 - DNA, 1040 bp, Homo sapiens
gtaactgaaacagcatgttactggtaccaaaacagagatatggaccaatggaacagaacagaggcctcagaaataatactgcacatctacaaccatctgatctttgacaaacctaacacaaacaagcaatggggaaaagattccctatttaataaatgttgttgggaaaactggctagccatatgcagaaaactgaaactggaccccttctttacacctatacaaaaatcaactcaagctgggtcagagacttaactgtaagacctaggaccataaaaatcctagaagaaaacctgggcaataccattcaggacataggcatgggcaaagacttcatgactaaaacaccaaaagcgatggcaacaaaagccagaatttacaaatgggatctaattaaattaaagagcttctgcacagcaaaagaaactatcatcagagtgaacaggcaacctacagaatgggagaaaatttttacactctatgcattgacaaagggctaatactcagaatctacaaagagcttaaacaaatttacaagaaaaaaacaaccccataaaaaaatgggcaaaagatatgaacagacacttctcaaaataagacatttatgcggccaacagacatatgaaaaaatgctcatcattactggtcattagagaaatgcaaatcaaaaccataatgagataccatctcacaccagttagaatggcgatcgttaaaaagtcaggcaacaacagatgctggagaggatgtggagaaataacccttttacactgttggtggacgtgtaaattagttcaaccattgtggaagacagtgtagcaattcctcaaggatatagaaccagaaataccatctggcccaacaatcccattactgggtatatacccagaggattataaatcattctactataaagacacatgcacacatatgtttattgtggcactgttcacaatagcaaaaacttggaaccaacccaaatgtacctcaataatagactggataaagaaaatgtggcacatatacaccatggaatacta

SEQ ID NO: 6062 - DNA, 1044 bp, Homo sapiens
atagaccaatggaacagaacagaggcctctgaaataggtccacatgtctacaaccatctgatctttgacaaacctgacaaaaacaagcaatggtgaaaggattccctatttaataaatggtgttgggaaaactggctagccatatgcagaaaattgaaactggaccccttccttacaccttatgcaaaaattaactcaagatggattaaggttttaaatgtaagacctaaagccatagaaagcctagaagaaaacctaggcaataccattcaggacagtggtatgggcaaagacttcatgactaaaacaccaaaagcaatggcaacaaaagccaaaattgacaagtgggatctaattaaagagcttctgcctagcaaaagcaactgtcgtcagagtgaacaggcaacctacagaatgggagaaaatttttgcaatctatccatctgacaaaggcctaatatacagaatctacaaggaacttagactaataagaaaataactccatcaaaaagtgggtgaaggatatgaacagacactttcaaaagaagacatttatatggccaacagacatatgaaaaaagctcatcatcactggtcattaaagaaatgcaaataaaaaccacaatgagataccatctccagttagaatggtgatcattaaaatgtcaggaaacagcagatgctggagaggatgtggagaaataggaatggttctatactgttggtgggagtgtaaattagttcagccattgtggaagacactgtggggattcctcaaggatctagaactagaaataccatttgactcagtgtgcctggaattggttccttccggtgggttcttggtctcactgacttcaagaacgaagccgtggaccctcgcggtgagtgtttcagttcttaaagatggtgtatccagagtttgttccttcagatgttcagaggtgtccagagtttcttccttccggtggtttcgtggtcttgctgacttcaggagtgaagctgcagaccttcacagtgagtgttacagctctctctttcttt

SEQ ID NO: 6063 - DNA, 1024 bp, Homo sapiens
caatgaacaactgggtcatctttcagctccagaacattaaaagttgtgacctgtgccatcccaggactatgtacaggattccttggagtcataaggaatgttcttcattcttccagccatttcactctgttcctggcttttggctctgccccagtagttatgcttagccctacttgccctgtcagcagctcctgaaccagttgcaggttcagttggtgacttcaagatggggacactggcttacagactggcagtcaccagaacacatctgtccagagccccggttgccccggtcctgttgaaacaggcgctgcaccttcaggtctctattttccttgcacctccgattactcatcatggtggagtctgggtaagaaggaagttgaagagatgaaagcagatagagttcctgaggatctcattgccagtcgtggctgtctattccctcccttggcagcccagtgtctcatttgaggttagacacctgtctggtgcagatgtaaactgatatacctacctccccatttgcagcaggaatctggagtctcctatggcaattttgtgggggttgattttgggagacttttatctagacatttctgccttgtttaacgtgtggcttactttcctgttctgtgcatgttattatgtattactggcataataacatgcacagaatgcatgttatttccttttggagcacattgttgcaaatatcgatcatgcaagacatgtacatttgtggcagactcttaaatgtgtaaggatgcagtgaggttttacttagcctgatcgttccatctgtgacttccacttccttgccgtccctgccctactacaattcccaactgcagactctgcccagatgtaattcagcaaacattttaaaataccaaattttctctctacctctgtcttgactgtggtcctcattgtgcttctttcaagtatggatcatctagtctccatccttgtttgtgaagttgtcctgtccttcacatatttttaagaggggagaggagca

SEQ ID NO: 6064 - DNA, 1024 bp, Homo sapiens
tttcaacatgttggccaggctggtctcgaactcctgacctcaggccatccacccacctcagcctcccaaaagtgctggcattacaggtgtgagccaccatgcctggcctggtagtgtgtatttttaaatgtgtgcaaagtgggcttccacaggacctatgttgtttgaataggacctctcttgcctaaacatttttatttacattcattcatctatcaaacatgttctttaaagtaacggtgaactccagacttgcacaaaatttttatattattataaattagtgaagttcacattaataaggttgtacgtgataaactccactgtaaatcctgaaacatgtgccctgtcaagacgggagaatcccattaatatctaagatttcaaaacttagcaacaattttggacaggccaaatcataaatgaagtagtctaacattttaccaactaaaattttgtattctaagatgaggactcacagggcaaaaaggcctttcctcttgttctgaacagatacctctggtgctctgcacttactaataatcatgtcaaaaaagctgatgccaatttcatttttcctcttaaagtcactctattaaaggaaaaaaggttctgttaaaatttaatcaacaaaagcaggtgttacagggaggggtagattcgttgaaagctgccagtgaatccaaatactctctcttttccaggcacacaataaagttagtccacaagggcacatgaaatctttccagcccacaatcatattagaatttgcattgtgttactggaagcagcacagaaatattcccttttggctcacttcagttcttcgtcaccccctgaagctgcctcctgctgattcgaaggtcttgatagtttctggcaggacagtggtatcactctccagttatattgctgcttagcatctggtagttgcagaggaggtttatactgcattatgttccaaaaaaaaacccaatctgtgaaccacattaaggccaaatctagtcttggatatagtgccatg

SEQ ID NO: 6065 - DNA, 1057 bp, Homo sapiens
aaatctcttaggactgagagattaggatccttcatttctactttatgagaaaaacaaataatacacagttggggtgaggaataatgcacagttggggagaggaataggcatattgtgccagtatatgtggcttcatgaaaaaactattaacagctgttgttaagctagtctgtagaaagtagagtgagaagaaggcagataggcattttgcaagtgataattttctttaaggaccacttacctaatattaggcctttttaatttttgtgaatattaccaactttgagatcacgaacaagcttgaaacacagtctttagcacacagagtcaattgaacctataattagctgctctttagtgtaacatataaaagttatatgtaacaagtgtaacatacaaaacaaagatgagaaatgtaaagaattttaatgccagtctcaagttgctaagttatttttagaatcgaattcctaaaagttttgctgtttcctgcatgtacctgtaattgttccttgaatctcttcaagagacaggttttccggtttctaaattcttatctgagtagctcagacataaagagatcatgtatatggtatgatgtggtcacctttttatttacgggactttcttagtctaatgtgtgtgaactcttaaatgcatagtgtcttactctgtaacagcaaccagcagttgtgtgttaagatttttcacgaagagtcccagctgttgtaaaaaggaacaatctgccctggctacagattacagtgctttgggtttagactgcaggcaatacctctgggacctgtcatgcacactgtgaacatcagtattcctgggagagagaaggcaaattagtcacttctggctcttagaagttcttgcataacttgctgttatctcagtacaatttcctggggatgctttatcctggcatgtgccccctcctttatcaaaaggaccattgagtattggactgggatgccattgccattgcagagggctggtgttgtttcctcctcttcatcctggatcctcgcattattgtttttgccatgtg

SEQ ID NO: 6066 - DNA, 1059 bp, Homo sapiens
cttaatttagaatctggtaacttgaagcttttctaagttacccaagagttgataaggctacttacatgttttgtgtgtgtgtgtgtgtgtgtgtgtgtgtgtgtgtgtgtgtgtgtacatgcccagtgtaattcagaaattgtttagactacttactatatgccatctcctgcgcaagctggagagttaaagaagaggtgcctgtgcttttttgtaaatactttaaggactgaactgtctcaagttcagcgttcttggaatctctcctcagagtgttgtaaaatttcagtaactacatgtagagtaaaaatttaatggaataaatgttttttttttttttctgagacagggtctcactttatcaccaaggctggagtacagtggtgtgatcgtggcttactgcagcctcgacttcctgagctcaggtggttctcccacctcagcctcccgagtagctgggaccacaggcatgtgccaccacacctggctaatgttttgtactttttgtagaaatggggtttggccatgttgcccaggctggtcttgaactcctgcgctcaagcaatccacccaccacagcctcccaaagtgctgggattacaggtgtgagtcactgtctccggctcagaataaatcttttattaagtgctagtaagaatgaggaaagaggaatgtttctacattagtattgttgtttaaactagcacagccactttgaagagcgatttctgatcatcgcattattctaagatattgattaccctacctgcagtagttctacttctgattatacactctgaaaacacctttgcaccaagagacaacacgagaatggtgttgagtaaaaaaagtatattgcatcgtagtatgtagtcaatggcagcatttttgtgtatatatatgtctgtacatttttaagtataaagcattgtttagaaggatgcacacaaaaatcatgatgagttgcctttggggcaatagaaaggaaaatggaacaaagtaaacaagggagatgttctatttatttaacaaaaatccgaaataagaaaataacaccat

SEQ ID NO: 6067 - DNA, 1060 bp, Homo sapiens
atctattataacatgttaaaatttatcaaaacctcacagaccatatatggcaccactggcagcagagagaaatgtaaacagacaaagacattttaaatcataactgcataaaattaactgtgttatatacagtactgctgtaataatttcatagccaccttctgttgctattgcagtgagctcgatgttacaagtatccgcttaaagcactatatgacactaatttccacctgagcaattaatctctccagtaagttgcatataacagttacaagtgatctctcacagttcttgagtatttttcattgtgtttagtacaataccatagaccttgaataacaccgtaggacccacataaagtgccgctaatgctctcaaaagcaaagttatgacatcatgggaaaaagttgaattgcttgatatgtaccacagattgaggtgtgtagctgcatttgcccaccacgtcaagataagtgaatccagcataacaactattgtttaaaaaaaaaaaaggaaaaggaaatttgagaagccattgctgcagctagacctgcagatgcaaaagccttgcactttttgcaaaataccttttttatcttgcattgaaaatgcagcttttagagtgggtgcaggattgttataaaaaagcatacttattgactccatgattcaagaaaaagcaaagtcattatatgacaacttaaagcaaaatgaaggtgaaggatctaaagttggagaaattaatgacaacaaaagatggtatgttaattgtagaaagaggtttggcttaacaaatttgaagataacaggataaggagcttttgtcaaccactagataccacatgagttcccagacacggttaagaaaatcattgaggagaaagactatacacctgaacaggtttttaatgcagatgtaagtgtcctattctggaaaaaaaatgccacaaaggatttttattagtaagaaagaaaggaggccgggtgcggtggctcatgcctgtaatcccagcactttgggaggccaaggcgggtggatcacaagatcaggagatcgaga

SEQ ID NO: 6068 - DNA, 1028 bp, Homo sapiens
taaggtcagataccactttaaaatttatttgtataattcacttcagtgaaaaaataagctctcagcaattagtagccaacctagatatgttcttttgaatacaggctccttataaataagcacctcctgtacaaggcttaattttaaatagttgccctgagattcctttcttaaatttgagttttgagtctcttccattagggaagctactacgtcttccccagtttttattatagcaactgaaattatggaaggagttttattttgtgaaacagaggtcaaaaatgtttgctggattcttctctcatatattttttttccccagtcttcaggatgtgcttatgcaggattccaggttatatctcatctttgagtttctttccatggatctgaagaaatacttggattctatccctcctggtcagtacatggattcttcacttgttaaggtaaaagcttaactaattttattaatatttatgcactgtggatataaagggactatatatagaagtccctgcattttgtgggaatatgcttggaaaaagtgttagaataagaaaaagtatttcatttttctccctcatggttagtttatacaggttagagatacccatgttattaccagatagtgtttctagtaagtaaaaattagtgcctgagataacatagaactggtaggtattgttggaagctagggtagtctggtctttctttggctgtcagatacatgtaaaacaaagtaatgaaagcctagggcagagtggtggttgtaggtgttttattccagttttgaacatgttttggtcaatttattgtagacatttattatatttcaggtaaattataaaattgtatagttttaagtactgaagtatataaaagtgtcttattcttgcaccagttctaccaaaccactctgcagaggtagcgctgttagttttatttgtaatcttacacttgtatgtatgttcactttgtatgtatataaagatttttttttttacacaaggtggacttatttgcat

SEQ ID NO: 6069 - DNA, 1059 bp, Homo sapiens
tttacagtaaattattggtaactgtagtcagcttacagtgctgtagaacactagagcttatttttccttttgagctgtaattgtatccataaaccaacttatctctgtcttcctctactaagccctgaataaccactattccactctatggccattagatcaactttttacgttttcaaatatgagtgaaaacatgtggtatttatccttctgtgcctggcttatttcatggctcatccttgttgtcataaatgacagaatttcattctttttttatggctgagtagtattctagtattccattgcgtgcacgtatgtgtgtgtacactacattttctgtatgtgtgtatgtatacaccacattatctgttgatggaaacaggtcgattctgtatcttgactattgtgaatagtgcttcaataaacatgggagtgcagatatctctttgacataattgattttatttattttggacatatacccccagcagtgggattgcaaaattatatggtagttctagtttgtagttttttgagcatcctctaaacagtttttcataatggctctactaatttaagagcccaccaacagtgcgtaaaaagttgccctttctctgcatccttatcagcacttattttttgtcttttgatgataattactctaactgggtgtgatagctcattgtggttttgatttgcatttccctgatgaatagtgatgttgagcactttttcatatacttgctggtctttgtatgtcttttgagaaagttttattcagattgtttgaccatttttaaaattggattcttactattttttttattctggatgttaattctttgttgtatgaatgatttgcaaataatttctcccattctgcagattgttgcattattctgttattctgttcattctgtttcttttgctgtgcagaagctttttagttcgatataatcctgtttgtctatttgttattgctgagacagggtctttctctgtcacccatgctggaatgcagtggcgtgaacagggctcactgcaacctcaacctcctgg

SEQ ID NO: 6070 - DNA, 1334 bp, Homo sapiens
taaactaacatactaagttgtgtgactataattcatttagtgactcatttttagctatttttataacacattgtgctatggggggttttggaacttgctggaagctacatcagaaactgccatagttaattgccatttcaagaatgttgtaaataactcaggtggccgtttaattctcaatgtaaatataattaactagacgtctttcctatatttgtgtctcagttttaaagctatttctggatgcttgagtcttaccgtaattgataacaaaaagaggttattgagaatatctatgatttacagagtaagttattctagacctcaagagtgaaatgtaggggaggagacatttgtgtgttaaactaatggaaatgctcatttaatagatattcactgaaagtattagttttggtttattgctagaaaagttgaggttttatggagatttttgtaaaaaatggtttatttcctaaataaatatctctttttcttttttctcccagaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaat

SEQ ID NO: 6071 - DNA, 1030 bp, Homo sapiens
tcctaaaaatagaaaaattagctgggtgtggtggcaggcacctgtagccccagctactcaggaggctgaggcaggagaatcacttgaacccggcaagcaggggttgcagtgagccgagatcatgccactgtactccagcctgggtgacagagcaagactgtctcaaaaaaaaaaaaaaaaaatgcaatccagacaggccaagaagcaccaaggttggggttgccaaaaccaataaaataggacaggcctacagacctctcattagcactgaatctccagacaaatcatcagaaacctgcctcaaggttgaaaaagccaaggtcatcaaagtaagatgcagttttcagtccagctggttttcctatctcatttaggtagcaatatccccttttatgtgtggaattctactgcttgtggtcctcatggggctttaaatgccggctttccactccttgttcacaagggtgacccaggtggaatccgtcacaatatgccataacccagcagtagtaaattggtgcaaggcgtaggcaaatgacctcacaagacacagggccctttttgctatagaaacgttgagaatgaagtttaggagactaggcgtggtggctcacacctgtaatcctagcacattgggaggccaaggcaggaggatcatttgagcctaggagttccaagaccagcctgggcaacatagcaagaccccttctctacaaaagaggaatgaagttctgccaaccttgctaaattgggatgacatgactggagagcctcagaaacatccctattctggagctagctgagacgagaaagattcctaggagcatgatgtccttggtctggtcctgaggccctggttcctgcaatactgccttactatttgtgagctgcccagtattcctcctaggtgcaggagggtatgtgtgtatgtgtgtgttgtctgaacctactttcagttggatttctgtcatttaaacctcaactaatagtaactaatagttaacgagtagagtcccaatggatacagctg

SEQ ID NO: 6072 - DNA, 1089 bp, Homo sapiens
tattatgacttcaaaaccatgctctacttctctgttgaggaaataatgcaattacaaaagcagaatgtatttggagaattcatttgctaatgagtattagtagttctttatatttctaaagagctttataggaattaagggccacatgctatttcaatagacagaagcttcctatactctaaaaattctctgaactataaaactacaagaataagtacaccgtaacacattctttctaatgcagagagaaaagatacatttcccaactgaacataaccatttgtctcaatggttttggtatcatgacaaatgtatttatgtgcaagaaaatataaatgtattcttcatgaagtgtgttcactgcttctaggatccaaatgggaagcagagcatttgctccatcttaaatcttgctagaatctgaacagttttagaaatgtgctttggcttcttgtttaaaatacttctcatgcacaagcagtaatagaaaatggctcagaacataaaaagattgcaatttcccagatgaacacaaaatggtaactttttgaccagtcaacattggtctgaaaccccatgaactagctgacaaatgtaatgtttgggagctcttaattacccatgctaacagaaggtcatggcagctagaataacccccaagagcaaacacctcacctccattgcaccaaattttggcattcactatgtaacccacctgcttttagcaataaatctcatttcctacttagtgaaatcaaaattttaaaattgaattggatgttgaacatcattcaatgcagtctttattttcccagtgaggagccttcagatctcagcaacagtgataaatagaacctgggttttctgatctccagtttaaaaagatttctactctgttttagataggcatcatgaggtcaaggaagaaattgtgtattttgaggataaaatatccaggaaaaagagaatccaaatgaccagtgaggagaaaatagaagagaaagttacatagaatgggttttcagtgaaatttgaagtgtaaaggcatgcacagtgtacagtgcaagtagctatagaccaagcatgttg

SEQ ID NO: 6073 - DNA, 1048 bp, Homo sapiens
taaaaacagccttccagggagtgaataaacaatactatatttggctagcagctgcttttggaaaatgagatgtcagcaaagctgaatattgtttaaagaaaactaattatccagctacctttgacttggatcagagtaaataaagcacttcctgatttgcactgaaatgttttgtctagaatttaaatattaggtattagtcagatacttctcttcttccttcgcttgccttgtggacccaatggatttaaataagtaccctttgtgtttggttgtgctgccagtacccctttatgttttctggagtgcctagcatttgttgcttcttttcttatttgccatccactagttattgtgttaggtgtaaagcagtgtgtttatggttacattaaaatctaggtaatctatgataatataggatggttgcatttgtatacatttaattatgcaaatgtaaaatatatattttatgagtaatttttaaattctatttaaaaattatgtgtagaatttgaatgaatgtaaataccctccatttttgaaaattcatttcaaggttagcaagccaaagaagctgcaaactggtttatactattgccacatggcactttggccagtaaagagaaattcctgcagccctttttcagggttgcatgcatcagcctgcagtgtccttggatcacagctcctgcaagtacctgtggtgatacctttctacttgttttaacatttactataatttgaaatacttttatattctaaagcaatctcacctgagcactcattaagtgcgggtgacatagtgggcctgagaattaggaaattttgaagaacttgagatgttattttaatgtcacaaagaaggccaaacaacttccatagtacattttacagtgagcaattcatacaacagtatacaacagtgatgatcttgagaaaaataaaaagctgcattaaaatacacatatacaatagttacagatttcaaggaagtgtctccctacttaatactttactgtggaaaaatttgtgttgaattgtgcaagtt

SEQ ID NO: 6074 - DNA, 1017 bp, Homo sapiens
actctcatatgagccttttgaaattagcagacattaaaagtacattttaatgtgataaactggtactaagcctattattcccttgtgatctctaatgtaagtaatacaatttcaaaagtagcacaggaaattttccaattaaattgtgttatttaaatatataccaagcttaagactatgcacaattatcagtgtacacatacatatgctcacccacgtagaccatgtcctttccaaaaagactgatcatttgggggttttaatgaatctggactttaaaaaaatacaaaattttttaaaagatgtaaagaagtgctatgcttcaggaaaaaaaatcattttataatggttgagtcagatgaatgagctagttatagatcttagattattatctaccctcttaggattgtcagcttgcacatttttcaacttcttggagggccaggtattctcatgacatgcaattcaggatgtgctcaatcacttagtaacaaacagaagaaatcaagttgtaacagggacttaattagcagtgttcatttactaagatgacacgctaattcgctgcttggtggaaactccattttccgttttaatgaaagcagagtttctgtagttcatggggaatatagttgatgcatagagctgtgtcattcattaaaacaagtcctgcctgccacccatttgtgctgattgggggtgtcgtatgttagatagaaaaatggcaagattctctcttgtggtctgttcccaaggccaccactttttaggtaaatactgaaaggttcttctcagatcaaattctttacaatgttgatcccccaacagctaatcgcttatggtgtcatttctaataaattctgtatccaaaatgacttagccagtagcccatgtagtcaactgagccaagcagttctgaattatttcctttcttgccaagtctgtcagaaataaatcataagctttcagtagtctgacgtttcccatttgttgtttgtggccaatacctagaataga

SEQ ID NO: 6075 - DNA, 1031 bp, Homo sapiens
cactgctgatgagcaagatgggaaatgacttttcaaaacagcatcttgttatgtttgacctgttctcttaattaagagtggtgtcatcgggccggcgcagtggctcatgcctgtaatcccaccactttgggaggccgagaggtggatcacccgaggtcaggagttcaagaccaacctggccaacatggtgaaaccccgtctctaacagaaatacaaaaaattagctgggtgtggtgacaggcacctgtaatcccagctactctggaggctgaggtaggagaatcacttgaactcaggagtcagaggtttcagtgagctgagatcacaccactgcactccagcctgggcagcagagtgagactccatctcaaaaaaaaaaaaaaaaaaaggcaaaaaagaaaataaaatcacacaaaaactgtgagggaatggacatagaaacaaggattgccagagagccaagaaagattcaacatgcataggactgccgtctctgaaggaaacagtagaacgaatggaataaaaaatcattcaaagacatcattgaaataacatttgggcaaggaagaaacgcaggatctgaagaacaaaaggaaccactgttctaaaagaaaaagatgaagaatgacacactctgagatgtggtcttacaaagttattgaacttcaattttttttaagtatgcaagcaataaaaatgcatcaccaacaaaggaagaggtaaaaaataaaaaataaaaataaaaaaaaacactgacttacaaattttagcagctttacatgcaaaaaaaactgtggaacattgtcaacaggattttggaagaaaagagatttgaattacatactcagtcaaactggcatttaaatgtccagatgataggaaatgatctcaaatgtacaaagtctgaggaagtatatctcccacatatccaggtaatgtttttaaaaaatctacttgtcacaatctagccaatatacagattaatccaaataaaaacgacaggaatgggaaagtcccaggatgagaaatgg

SEQ ID NO: 6076 - DNA, 1003 bp, Homo sapiens
cggccagctttggtttttaaatgttcatatttcccgacgtccgcctgcaattttaaaaaggtgttgtttggaaatactgtgaaaaatcctgcaacctaccaacaggttgagctctttccccctcccaaggtctggctcggccccctcccccgacccaactttcctgcgcagctgtcttcctccccctccctctccccctcctgatttcttattatttgcttttcaaatttattacttcaacatggcctgtgatctggaaaagggaaggattaaatatccagaaaagaactggtgcttaacagacttctgactaagtccaggaggaaattattcagtgttttatgggatattttgtggtcactcttttttggggggcggggaattgaaattgggatgttttttaaagaccctgagttgaccccacttggtacagttttaatttttgttggtgtaattaaatggtgaattctgatttaagaataaaggctatatttgccaaacgttgcatctgctagaagtgttgacagtgaatagatatatttttaaatacacgatttctttttaattgttcattatggggaattgaaagggaaccattgtaatgatctgtgcatttcgtcactgctatatgagccatacctgagaaaattaatcttgccatttaaaagtaaactctagggggtttgcggagggagatggctctatttataatcctcagctgcatatacatcgtctaatattatgcatgatttgttttttaatgctaacacggctggtaattagctgtatgattatacttgtatatttcattaggactttggctgatgtcattgtgaattattcagccatattaaaacaattttcaattgagataatgacacgcctcaaaattatgcaaatgcagactgcattgtgcaaaataattatgacaaatgtaaagcaggtagaaagtttcccaatgcagatcggttttccaccctggtgatgtcatttcccccctggc

SEQ ID NO: 6077 - DNA, 1035 bp, Homo sapiens
acacacaataactagtcttatgacttgcggtaatgctgaataatacatctgttgtgttactttcctaatgtatgatctaagttgtattaccattgtcttatgttttccttaacattaaaacctttcttttgtttgtttaattttgtgtgtgtgtgttatggaatatactgttactaataaaaaattaaacaggaaacccacaggggacaaaaggatgtgtagatggttaagcttgatgtcacacatataaacaagagtatttatagcaaggtttatgtttaaaattgtgtttaaaatggataatttattaatgaacaggaaaataagtctaatttcttaattccacccaaagaaataaaaggttgatcctcttggattctaaaaaaaaagaaggtccatattctacctttttgcagttgattccagaagaaattggtttatagtgaatattcacagtacttgcaggtggtttggcctggaaaatctagatgagtggtttttaaatttagttgcttattagactcaagaaagaaatttaaaaaacaatactgattactgagaccagcttttctagattcttcattcagtaggagtaaggaaaggccaatgaatgtgtattgataaaaaggttcctggccgggtgcggtggctcacgcctgtaatcccagcactttgggaggccgaggcaggtggatcacctgaggtcaggagttcaagaccagcctggccaacatggtgaaaccccatctctactaaaaatagaaaaattagtcacgtgtggtggcaggggcctgtaatctcagctacttgggaggctgaggcaagagaattgctggaacctgggaggcagaggttgcagtgagccgaaatcatcacacctttgcactccagcctgggcgacaacagcgaggctctgtctcaaaaacaaaacaaaacaaaacaaaaaaggcttttaggttgagtctgattttgtttgtttgttttggtctcattttggagacagctttatgattagtgctgaagaagggaaaatga

SEQ ID NO: 6078 - DNA, 1051 bp, Homo sapiens
tgtggtcagctctgacttagattttctttttgaaaggcctagtcatcccactaggaacttatacttagttcaaacccagctttccaaatagaaaccctgtgcttgatgttaaatactgacctttttgttgtctccgataagtgcatagtggttcattttgaggttgtctggttaacagaagaaatatgtatattgtatattccttgtcaaaattcctaatattccaccaaagctctagcacttccatccagaaagtgttctgaggagttgaaggctctttcttattttgatttattcagtttcatttgcttcataattatgaagactgtccaggcctacaaatggctgcattggcaatgaaaggctgtcagttgaagctcagaatgttaataatttatcctctcattcactatccatgattcatcactgcaatattttcatattatattcttagggtacaacctacaagctaggggaaaacattagcaattttagattgcaaatgatagaacctttccatgaaaatgtcaactttttgcctagttatattcatggttgcaaatggggctagtgtggttaatcaaattgtttcatataaaacaatttctcctgaaggcaatgttagtggtggatttcacaaaatcacagaattcaccttgggagaactttgtggctgaataaaacttctgtcacatctctgtctggggagtgaaggtagggcaattttatctagaatctgtactacacctaataggttcagtgtttggcaggagatatactgataatcattattcccccaccccaccttcaaaaaaacctataaattgggctacatgtcaagtgcctaaatgttctgctgggaaataacctgagtaataggatcttaattaagaactgatggataatttttgtggagatgctaccccctgccaaaatctgcatgcagaattttatatgtaaacacacattttcttgggagaccattcatagcattcatctgattctgaaaggtattgatgatgattttaaaggttatgatatacccttttaa

SEQ ID NO: 6079 - DNA, 1032 bp, Homo sapiens
gacaatctaattctgacagtgtagtgaaggccatcttcaatttgactgtgctccactctgttatgctgtgaaagaaaaagataattcagctgagcattctgccgttggctagaaacaccgcagttctgaatacaaatattatgcaggtaaatgaatcattaaaagaatagaggcataaaatatctgacagatgaactcctaaagtttggactagaataaattttcccatatatgagcagtaccttcatccatcgactaacagtgttagttatccgttaagtcaccaaaaagcatttatggtcttagagtaaatgattggtaattatgacttacaaggctataaatacatggaggggatttggtgatatcataataaaccacgaaagaaactgcagtggtttttaatgttagtagaaacttaagaaatatttagagccgtgttcgcagccctacagttgttttttttcttttttctgggagtgtgtgattggtgttttgtcaaaatgtgcaactctaccaatggactcaactcaactaatgtaaattagggccaatgagagtgtccgactgagattagtcctcaatttgtatgacatgtgtctcaacaaatagaaaatattcttaaagaaaaataagatattcccgcatgtctctcttttttagttccctaatttctgattcctttcttctgaatgagttttctgtaagttaaaaaagacaacagtgaaaggccctgttcctctcagcttcttaaccccagtttgcctggtttatctcctgttttagattctaaaaaggaaaacattaatcatgcttagccctggactttgtttccctacctgttacctcctggtctaatggcagagatactgaaaggggcacagacccacaccagccaactgacctagctcatagccacaggaagagcggcatgtccctggggcagtgagagcgagactgcacccagaaccactgtctcatgacaccaccccacatctcaattgaagatccagatggacagctgacctatat

SEQ ID NO: 6080 - DNA, 1967 bp, Homo sapiens
agaactggaaacattcattccactatttgtggcttttttgataaacaaggataaattgaagttttaatagactggggctacatttgttgctccaggttcctgaagatcattatttttagtcatacttaaattcacacacacatgcatacacacacacacacacaccagatgccagtgtaaaaaatgggaggggggaagcttttaatctttattattgattttctgtgtgtacaattttatctaaagagtatggtttaccagccattgtggagctaggctttaatgccaataaaaagctttgcttgatccttagaaaataaaatgagatattcaggcagctagtttattttatttcttttcttttccacatcaagacagtatttcaaataattaggttgatttattattacaaatagtttgaagatgtaagatgcttttacagtgcagtgcgggtttattgtatctggccttatccaattataaaatcgagtttagtcatgtaatgattctctaactaaaatatcaatcacagtgaatggacttttgcgatgtatatactgtgaggctattttgagcttctctctttaaggcacccgcacatctgaatatgcttacttggctttactctttaacatataagaacacatgaaactttggctaaatttagcctctggagtccaatgcacatgcttggtgacagcaaagggagaggttttgacaacaagcaggatatgatacaccagagtaattatttccgcaagacaatgagcattctacattatttgtacaaataacgcaaagtgattatttggctgtgccattgtaatgagacaatgaagatcatatttaattttaaaacaatatcttctagggtcttttttgttctgagtattctggactactaaaacaaacttgatttgctgctatggttaacaatcacattttaagtgggggacagagagaaagagagagaggagaacaaatctttccccctcttcccattaactctagcattccagaaatcatgataagggtatgtgggacaggaatgttgaaataagtcacttatttcactatttttccatattgttcacataaccatttatttataataatttgagtaatctcagagttcctcctaaaggctttttttggcctggataaaaagtacagctttaagatatttctcctaaaataaatttgagacggtctcatttatagtcagcagtgccttgattacttgcagacacactggaaatttacatgcgcttttctcctttataaaacactgatctgttcatatcattagttccctcatgactagtgcttggctgcttgccaagcggtctaaatctgtagttgtaaatcgtgagttgaaatagcagaaagtggatttgtaacttaaaaagtgtaaacagtttggaaaatgaagtaattttggagtatgattgattgccttgtgattgtactttaaattagcctggggtctcgggggcagatatgtgctctaactgcttattacacattttcagttttcgaaggaataatagcattgttggtaggcttttaaacaatgtatgcatctcctggagtgaccttttaggaaatgaatagttttattgtgtgtccattactttgcctgaaacaacatttttgagttattaatttgacttgttctataaataaagaattcaaaatgcaaagcagctgtgcaacccagagcatagtatatcatgcttcagaaccactgtttgagatggataatccatagaacaaatggtttcttgggtgatacattaataatgtttctggagcctctggttaccaaagattagcccctcaatattgcagaagccaaaaattattattaaggaggacaatcgattagttggccttccaacacactggaagtagaggtctgcgttttttaaaaggatcccagttcacttaacagcataaatagaaag

SEQ ID NO: 6081 - DNA, 1049 bp, Homo sapiens
tataagacaaatggcattttaagctgtttttctttttgcaggtttggaaatcttatttaaatcaatgtaatgagacactttgaacaaaatgtaatcattctcacttctccacgtgttggaagaagcagtatagagttggagacttggggttagattagagctggctgtcttcacagatttgcatccttgccgtgtgctctgagttgtcacagtgtatcagataggtgggatgtttttgcctctgtgctaagtaaattacattctagaagaattaagagggctgttatttcatggtgattttttaaaaaaagtcagacaccccagaaccgagctagaattgttggaccagttttcttcccttttcttcttggcctccttcttgtcaagaacaactgttctccagttttcaagaaggctctgttgaagtggaaacataagcctccattaaagtataagggtttgcgaggaggtcaagggagtcattactttgtcttttacaacaaggatgtatttatatattctgagttaaaaaaaatgcttttaaagaaggtgtgagcaaagataaaaattatttcttacagctaaagaaaagtagtctcttcatcgttatccatgagggaataactcattgacacttataaaagagcgtcctagcccaagatatcatgtggtgggaaatttgattggaagaatctcttccactaacttgtgcatgagaatatttgttccagctccaaagccttagaagctgttagagaaaggtgggagggtatttggctggccttgggaaatggtaacctaacactggaagccccttgcttttgttctccttattgtacataagaagatgagattttatttccagatttcaaaacacggaccaacttgcaataagaaataaacccccgccaaggtgatgaattatgttgctttttaatttagaaactggccctccgatcagaaagagtaaggatgactttaaataaccagattgatttgcaggttggggcaaagtagagggatctggtggatctcagagactctttctt

SEQ ID NO: 6082 - DNA, 1050 bp, Homo sapiens
tttgcccatctgaaaaatggggctcataataacttccttagggctgcccaaaggaggagagagaatgttcatgactgacaggctggaaagattaatgagtcatggtattttaatctgcctggggagtttctatgtatccttcaaaagttagcttgaggggtttctcttccctgcgaagactttcttcactctctttgctaccaagattctgcctctgctgtgactcttgtcagaacacttacttgtattaggttggtgcaaaagtaattgcggtttttgcaatcctgtttaatgacaaaaaccgcaattactttttgcaccaacttaatacatctgttcacatgcccaccaccttttctaggctatacacccctctttaaagagggatggtggcttttggtctttatcctcttgccacctgctacttcttaatccacagaaggtattcccttggtgtctgaccagccaatagatggaagaccattttgatgttaaatcctttttttttaaccacatattatgttaatccatttatatgaaatgtccagaataggcaagtctatacagacagaaagtagatgagtagttgccagggtgttaatgggtatgaggtttccttttggggtgatgaaaatgttctaaattgattggagtgatggttgcattgtgagtgtcctaaaaaacattaaattacatatatgtaatcgtatcatttttaatcttatctttttgaggatacaatgggtgcaattgtgtgagctacgtgtgtatgatgagaatcaggtggttgtggatctttgtcccgggatcaaaagaggagaagtaatagagagaaataataataccattgtcttcacttaggctgaaatgtgctttctaaggggttaaaagtaaagaattgtgctggcgaggtgtgttctgtgcaatggtcatctgtttttgagattatcttccaaataaggcaacaccaagcttcacttagggattgttttgaacacaagactggaagagattctttaatactgcaatctgaaaccagaaatttgcgtc

SEQ ID NO: 6083 - DNA, 1050 bp, Homo sapiens
gatcaagggtcagcagagccagatagtaaatattttagatttgtgcaccataaggtctctgaggcaaatgcaccactctataatcacacaactgtgccgtcgtagtgtaaaagcagccaaagacaatatgtaaatgaatgtgcatgactatgttgtaataaaactttatttacaaaaacaggtgttgggctgaatttggcccatagtttgccaaccctttcaaacagaaataaccttaaagaaatatctgagagatacccagaaacagggatctgtagcactggtaactcatggtatgaaaccacagaactatcactggaattaatatagtagtcacgagcaatttgtttattgtcttttatgagaaaagagaggtaggtttggatgttagagattggggaaaaggggatatttgctgtggaaatgattttcagcagatggtaggtactttgggaaaggtggctaaactagagccatcctcctcctgtcttacatcagcttactcagtactaaccctgtacaaaaaggaagtaaaacagagcacatctgtatcatcagctttcaatgatgttcttccatggtgcactgtgacagcacattagaaggtgccggagtttttatatgactgctttgccgtgagattaaatagtggtttcagtttccagtaggtttcataagtatctctttcagctgttaaattacttttagtaatgtgcacactagaaaaagaaagaaagaaatatccattctgaacaactgggtgtcatgacagaaaacagagcagatggttttgtggacatggcaccaagtgaacctgtagctggttacagcagaaggatatgtttaacccagaggagagggctctcaccaggtcttaacagttgaagcttttaagagattattattttactttgaattgatttttgttattcaccagaaaccaaaggtggcaagcgagaatctctactaaaataactatacttgctaactttgggtctttgttggggctttggggtatcagaacaatgaaataacaggcactgtgaggct

SEQ ID NO: 6084 - DNA, 1083 bp, Homo sapiens
gatgataggtgatagatatccatgtcctgaattttttcatacactcatacacacacatgcacacgtacacgcacattgtgcccaccaaagatggatacatatcttaatctgcatctctgcctagctaactggtcacgtgtctctacatgtagacagaaggggaggagaagaagatatcacatcaccagtttgggaagccttacacggtgcagtagatggcgagatgcaagccaagatagtcgttctcttacattatcactttctcatctgtttgttgaggagactggatcatatcagtggttttcagcaggctgggcagggatgtcagaataccctggggtagccttatcaaactgcttgtgttcctgggaatttctatacttagaggcgtgaacccctaccactctcaccctaccccttctctggaatcactaccacagagtgactgctgggatggctgagccctgctgaatccctcatggctacctgggtgaagaagaggttgagacccttagcctggagagagcatagggtccctttgaactgaaacattccttgattttgttggctgatgttttcctgagaatcactagttggcagattatccagattcaggttactctgcttatcctttgcagaccttggtatggtttcaggagtccactatggcctcttaaatttgattcttcatgattccaacagccctggtgctgctactagagaaattttgcaagtagctatgtgaacagagttggggtgaggatgaggagatggcatatgatgatcaagaaggaagggaagacagagagaggaaggggaaccaaatgatctaagtccattagattctaagagccatgacattttttccctctaaattgtgtttttggatatctctcacaactctggcttatcaaatgactgtcattctgtaagagggcaacactgtttgtatttattttttcttcttcaaagaaatttatttattgtcatatttttagtattcaaatatcctttgacttcaagtagataaatgtatgcaatacatttttttacaatgccctctcttttcagatcagcatttac

SEQ ID NO: 6085 - DNA, 1093 bp, Homo sapiens
aagaatggcactttttaagagagctatttctgatctccaaatcaagccacaaatatttattgaatagtgactgttctgccctgaactgtgccctaggcacattgaaggacacagactgtttgggagactaagtaaagtagtcgttatgatcagggtcacatacgtgtagataaagtggtgttccctttgagtcttggataccgataggcttctgtatccacacaaagatatggaaaactctgatttaagtgcctgccccctctgcagcttcactttcaagccttgatttccctagttttaaaatggggatgataatcctctcagcacagagtgccttattcatccatccatctgtacttctttctgtcaaggccatcgttcatcaattcaacaaatatttagggataacttattatgtaccagataatccatgaggccctgattaaaccttatggaattaaatcgacatgactcatctgccctaattctagagcctgggaatgtgactagtaagcaagtaaatagatacatttatatttgtacacatacacacaaagagaaatatagaacttaagagactcctaattttgactaatacaacacctgttgtctttgtagcagccagtgattactgcacatgctcaattcttgagtttaatggtaacacaaccactcctttttctttgaggcttatttcagaaaccagagtggaagggaacctttctgttgagtttataatagcaattacaagctgataagggcaaaccattcatcaaaggatcatacctcgggactttatctctttgggtcaaatgtttcctgattgatattgactaccatatcttaagcagctttgaacagataagaagctaggaaagaaattcctttgaaggagatttgacaaaattatattttctgatttttttttctttcgggaggcagattaacttcccattgttcttactaagaagtacaaagttaccaaaccaatgaactgaagaaaatctagaaaagttttcacgggtagatattgattgagtttccactagagacgaatgatcatctgtattgttattcttttcgggttctgaaa

SEQ ID NO: 6086 - DNA, 1050 bp, Homo sapiens
ctgcaaagagaaatctgtttgaaaaaaatatatttgcaacatcacacaggccagttaggggactaagtgggttcatgattcaattcctctctgaatgaatgtcttccttcccttttatctgttgtatcactgtggcctccacgtgaaatatttgttttcctactcactgccagccaccacatgttggtgaaatactgtatgaacctttaatatagtgctgccatcagacattctattaagaaggtaatcgtatattaaagtggctgttatttattgattatggagagttcttatatgagagaagctctatatattactgtttaatcaatggcgtctaagggtcgaacaagaccaaccccagttttgagagcccatgctttttcccaaagacatctaatttagcttctcttgctctgctgatgacagtaggactaaaactcttgcctttatcctaaaagtagaaccatttttgtagctttatgactgtttcttaagaaatgttttaagtggtaataatagattctgttgtcaaatgccctttgggcaaattgtttcctaagaacttagctctctggggtactttagtatttctttttttctctttctcgttgaaaaaaaaaatgttttaattgacatttcttggaagtatgttaatgcaatgcttatctaaatacttattgtccctctaacagttaacctttggactatgtttcaagctgctcaaaaactgggaggatatgaaacagtaagtgtttaagcaacttaaatgaaataattttgcaatctaacttttcccctctctttgaccaaaatggagaacatgcaagggcaaaacatcactgactgccttttcaaatggctctacacttttgggggtttattgggccgctttggaaacagtcccaattagttccaggtttggcaaaattgtaaacttgtcgtaaaaactacaagtggaaaacatatgtaactctcccctgtcagggaaattagttgggtctgtaattttttcccatgttgagaaagggctattattgtacaacaagccaa

SEQ ID NO: 6087 - DNA, 1025 bp, Homo sapiens
ctgcggctacacctgtaggaagttcatatggggaccttttgcataacagcatttaccctttagctgctataaatcctcaagctgcctttccatcttcccagctgtcatccgtgcaccccagtacaaaactgtaggctcagctctgcccagcagtccaaagcggcatggccaacagagcttcactccttacccaggagtgctggcttatagagttagaagtcagtatttcttctaatctgaggctatgatcagtcccagctgtaggggcccagaggggaggtgaacatgcctgatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaagggatgcccctctttttcataaaactctccaaggttcaatcaatgcaatgtatagtgaaacttcaatagatctttcattttgacactattaaacaatccagagaagtaaacactgttaaattgactgtatatatttgcttcttaaaactacctgtatcactgtttgctcacctaatttatatacaggtagttccattttctcccagttccttctcgtctttttttttttttttttttttttttttattaaatggtattgcttttgtttgcaggtctttttgtttttgttttgtttttgaggctgactgactgtcctagttgttgtgtgtttgtaatttttccacatcttattttgagcagctttgggtggtaaagttattgtttacaaattgaagcaactgattctagtggaacaaatgaaaaagaaacagtcaagcacacaatagtgcaaagaacgttcctttgtagatccgcaacttaaggatttt

SEQ ID NO: 6088 - DNA, 1046 bp, Homo sapiens
ccagcggcccctgcatcctcacaccgcaccgggacaacctgcaccagatcgacgccgtggaagggcctgccgccttcctggacatcctggccccgccctacgacccggacgatggccgggactgccactattaccgggtgctggagccggtcaggcccaaggaggcctccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcatgcccttatgcctttttttcttatagttttttaacttattgactgtgcatgacccagtggtttgaattgtttttagttcaagtcattggtaaaaactaggtttaaggagatgagctactgtttaaagtgagctggcctgcctaattaattccttgtgaaaactaaatgattttttcagtttggggatcattctcacaacataactatgcatgtagaggacaagatttattttctttcctccctttgcccagtagccacatctggtttactcaggcagcatctactaagaaattcagcacctgcatatctctgtgacatggtcacttagagcttatcttccctatgaatctccagatctgtgagtcgagcagatttcatg

SEQ ID NO: 6089 - DNA, 1055 bp, Homo sapiens
gattacaggcgttagccactgctctcagccttttttttttttttttttaagttctggggtacatgtgtagaatgtgcatgtttgttacataggtatacacgtgccatggtggtttgctgcacccatcaacctgttgtctacattaggtatttctcctaatgctatccctcccctagcctcccacccccgctttttttaaaaaagaaatagttttgccactcaagtgtactggagttatctgctgtagggccaagcatacagtagatattccataaatctttgggtgtttttatggtgagagggctttgtacagtattaaacatgtcaactagtgctctttaaatctttcctaaaccatattttgttatgaatcagattgttaaatctgtagtcactacaaagacgatgtaccatgtttaactatttaagaaaaccatgttttatatggattccctagtgaaacaataccttatgtaacccaaaatggtcatggttacatatatataacatatgttaagtggagtgaatcagcatatgttaggcactgagctatgggatgttatgaatatataaagagaaggaaattttagttgtaacctaatccttgtctttgaagacttaaaactgatgttgggcttcagttaaccactccccactccagaaaaatacggcaaactgttagatcacattagcttaaattatagagacagaacttaatgtgattagtaaatcccactgagttgattgggtttccaacttgtgttttagaatggagttgaaagttgacgtggttgaaatgagctcactttttgaaattgacttgcatctctagggcttataactggtcttggaaggtatgggttaggtgtattctgaaaggaagcaacttattatttggaaatcattttagagatgtgacaaggaaagatcaacatctgagaaagactaataggaaggaaaggctgaactgagagaatttaagggcaaacagaggggacctgggtgtccacctgtcaaagatcagaggagattctgagactaaaaaacttaccgtg

SEQ ID NO: 6090 - DNA, 1123 bp, Homo sapiens
cactgcactccagcttgggtgatggagtgagactctgtctcaaaaaaaaaaaaaaaaaaaaaatttaaactggaagtcaagtcagaggaaatacagcacagaggcaaagcaataaaacagtaaaaataatatacagttgaccgctgaacaagagaggtttgaaatgcataggtatgcgtagtttttaatagaacatggatcaaaaatacagtgttcatgggatgtgaaacctgtgtatacagagggctgactttttatgagtgtgttctacggggccaacttcaggacttgagtatgtgtggaatttggtaaaagtaggctggtggtcctagaatgctattcggagttccactaatggaggaatggtattgttcacaacactgaacaaaaccaatcctgacgactgtattcatgggacatacagtctacgaggagagactgatggtcatcaaacaacataaaatatattacatttcatgtgtgataaatgaagttaggaaaatttattaagtactttcctcaatcaagaccatgggtgtagacagccctttcatgaagacataaagtaatatctgaactatgagtcaagttaactaggaaaactttctaggcagagagaacagtatatgcaatagaactaggcagaagaaaatacagtatttttttgtaagaactcaaagaaacttacagcaataaattgtgaataagatttgggaaggggtcacggtaatgatggtggttcataaggctacaaagggaagaccatgcaagtcttataaatgaatatatttggtctatctactactaatgtgaagatgctaacagattttatgcaaagcaggtgaaacggtagatttttatttggaaatatattcacaataattgactgcttcctttgggaaccacaggtactttgggaatcttttttgttttttggttgagacagtctcactctatcacccaggctggagtgcagtggcgtgatctcggctcactgcaacctcttcctcccaagttcaagtgattctcctgcctcagcctccggagtagctgagattacaggcgcgcaccaccacgcccagttatttttagtagagatggggtttaaccatattggccaggc

SEQ ID NO: 6091 - DNA, 1051 bp, Homo sapiens
accaacatgctattacttctcccatcttaaaaaaaaaaactcttttaatctactatacttttcatcttatcaccccatttccctctgtctctttagagcaaaaattcctcagaagaatagtccaagccgggcacagtggctcttgcttgtaatcccaacactttgggaggctgatgcgtatagattacctcagctcaggagttccagaccaatccaggcaacctggtgaaaccccatctctacaaaaaatacaaaaaacaaaaaaattagctgggcgtggtggtacatgcctgtaatcccggctactgtggatgctgaagtgggagaatcacttgagcctgggatgttgaggctgcagtgagccatgagcatgccactgcactccagcctgggcaacagagtgagaccttgtctcaaaaaaaaaagaaaaataatttttttaaaaaaaggatagtctatacaccatcttcactttctttccttcagggtactctggaacccatacgtttgtttagacttttctctccttccactccactgaaattgcccttctcagatcaatagtgaccgccacttggccaaactgtttgatcctcatctgacttatcagcagcttttgatacaattgctcactttctccttgaagtattttcttcacttggtttccaagaaaccttgcttttttttgttttttttttttttgtttttgtaactcaacggccactcccttctcagcctacctggcacatttctccatgttccttgacttcttaaagttgttaaagttggcatgtcatggggatcagtccttagaccattttctcttttctatttgtagtcctttaaggattcccattaatttacatctccaacccagatctctctgctgaactctgtgatcatattttcagctgcgttctttgctccacgtggaaacatctgaaagtcagactgaacttaagacatccaaaactaggctcttgagcttccttccccatctggctcctctggcagctttcccccactctgttaatgccagctccacctacta

SEQ ID NO: 6092 - DNA, 1072 bp, Homo sapiens
aatgttatatagccattcataattattttcaaagtacttttcatttcatttgaagatgttttaatatatcacagtttcttaacctcagcattattcatatttttaagtggataattctctgttgtgggagactctcctgtgcattgtgggatgtttagcagcatccaccagttgtgacagccaaaaatggctccagatatggaattgacatatgtcacctagtgggcaaaactgccactggttgggaaccactgtgttaagtaaaaagggaagaaaaatatatatggagagggcatgaggctaaaaactgtgctatctcatatggttatgtgtggctatttaaatgtaaattaattaaaaattaaatttctcaatacactagccacatttcaagtgctcagtagctatgtgaatgcttatcttattctgtgctaccttactgggcagcataaaaatagaacatttttatcatcgcagagttctgttgaagtgatcctttacgagatatagtccgctcagcatctccacctgaaaatggctgtgctattttctatttgctgcttctatgtattttatgagagaaattctataatgatatttggaaattcacaagtatcttaggatagctctggcttaagaatattctatataaaaatactgttgctacttgtagaaaagaaattactgttgctgatcaatctgtcacaatctttattatttcaaaattcctatgtttacagagaatttctaaaaattgatgaaaaatactgatatagtacactttgcaaatatttttatactcacgtattctgcacatcaggtgttataatccatattttttagcctgtaaatgaagtatgacttacaagttatagtttttcctggtcttagaattgattaagacattaggattagaatacagagctgaaggttatcactatgttgcttttcctaactattaacagtgtcattgactctgcagaatcaaaactatcaaggaaatcataaaagtaaaagtcataggacaaatctaaacaaaataggtttatgctaaccaataattcaaaacata

SEQ ID NO: 6093 - DNA, 1815 bp, Homo sapiens
acctgttattttaaatcctccttgttgagatagaatttatatataataatttctatgtgtttcatcagatgtgtacactcacatatcatcaccctatcaagattcagttattatccacagtggtggttgaatgtccatttctattacattcaccattcctgataataattttatctctctctatgtgaaaagtatctaaattatttaaaatatcctcaggatatagaattttaaaagctaattagaaactcatattgctgttttctcaattcctttctaacttggggcaaggaaggagggtgcaatgggagaagccagcactaggattgttgcccagtgagagtaaaaaacgtcaacagttacattgcttagataactaataaagtataataatcagaagataaaaagaattctttaaaatcagtaagaaaaaaaattaacctaaaaagaaaagtggacaaatgaactggtatctcatagaagaggaaaccaatggcaactagacatataaaaagatagacaaaactcattagttttcaagaaaatgtaaattacaaccacattgaaattccatttcacacttactagattgcaaaaattaagaagtctgaaaataccaagtgttggcaaagatgtgtacagcaacaggatccttttcatgatgccagtaggagagtaagatgctggaactgctttggaaaacaatttggccctaacttatagtgttaatcactcacataccctataacccagcaatcccacaactagctatgtaccatcaaagaaatttggcatatgcatcaaaagacatttgcaaggatatttataggaaaatccttaaagcaaaagtctatgaaaaataatagtttacgtggacagaagaattggtaagtaaacattggtttatgtacaaaatggaatattatacaacaggaactactacttagaagcctcaacttggatgaccgttaggaaagttatagtgtttgtgttttgttttttttaaagcaagccagatatgattacctatggtatgatagcattttaaaggccctaccataggcaaaactgaacaatgtatagtttagtaatgtatacatacacacatatatatatttagcaagtctatttttcagaaaagacaataatgataaattataggataggggttagctctgagagtctgggagaggagagggatctggaacaatgatatttgatattctgcttcttaagttggatgccggattcactgggctcattttactgtgtgtgcttcataacttagaagtgtgtgtcatatattcttttcctttaatcaatgattacattaaaaacatgtttaacacttgcagtgagtcaggaccaagatatctacagtaactaaaggggcgagcttagagaagcagggagcaggtagcaacggaaaggagaggctgatcctgtcccagcccatatgcttcttcctggtgtagaggccagtttcagtgctgagccaggccacagatggaggcagggaaggggctgcacctgtcatgatgagtatgtgaacagaaggccagaacctctatgaaatcgccaggcaggctgtctcttgtcctttctttttctcaaagctggtatgaatccaaagaagaatgtccaatttcttatttacccaagggatttttgaggttctggaggtacatacatagatagccacttaaaagctttcttccccccccgacccccattgatttcttgtctattcagataacagttgttttcttgtctattcatttgatacatgggatattgctataaaaagaaaatgtc

SEQ ID NO: 6094 - DNA, 1045 bp, Homo sapiens
tgttctactttctgattgagtttctcagttttatcttctaacccttcaatggatcttttaatttctgcacctatgtgcttagttcctgagaatatgactgacagttttttggacacttttttaatttattctattttattttattttttgaggcggtgttttgctcttgctgcccaggctggagtgcagtggtgcaatctcggctcaccgcaacctctgcctcccaggttcaagcaattctcctgtctcagcctcctgagtagctgggattacaggcatgtgccaccaggcccagctaattttgtatttttagtagagaaagggtttctccatgttggtcaggctggtcttgaactaccgacctcaggtgatccgcctgccttggcctcccaaagtgctgggattacaggtgtgagccactgtgcctggccggacattttcttctttctacatagtctttcgtttgaattctgttttacatttgtttcagcttctgtttttcatgtataatttcctcaaatgttggatgatctcgggttctctgctcattttttaggataataatgaaaagctgcctggagctctgtgcccatgaaagggcttattgaacgtgatcttcactgtagagtgatctgactagactatagaatattttcctgtggctgccataaggacgtaccacaagcagtgtggattaaaacaacagaaatgtattgtctcacaatttctggaggcttgaagtccttaatttcataatcaagatgttgactgggccacactccctcagaaacctgttgaggagaatcattccttgtgaattcctagctgctgattgttgccagcacttcagtctacctccacactctacctccattgtcacataggactcgcccctcatgtctctgtgtgtctattttgcctcttcatcttaaaaagacaccagtcacataacttcatttaactacatcttcaatgaccctgtttccaaataaggtcacgttctgagggattggggtttaggactgtgtgttagtcagcttgtgtt

SEQ ID NO: 6095 - DNA, 1373 bp, Homo sapiens
cacacagcaagtccaaagtgcagccagccaaaactggatgtggtggatgaaaggtgccaggagggatgtctctggtagacctacaaagccaagaggatttttcgtgctgcacagggatgatactaaaaccagtgagaggctgggcgtggtggctcacacctgtaatcccagcactttgggaggccgaggtaggtggatcacctgaggtcaggagttcaagaccatcctggccaacgtggtgaaacccagtttctactaaaaattcaaaaaaattagctggacatggtggtgggcacctgtagtcccagctactcaggaggccaagacaggagaatcgcttgaacctgggagatggaggttgcagtgagccaagatcacgccattgcactccagcctaggtgacaagagtgaaactccatctcaaaaaatactaataataaaataaataaataaataataaaaaataaaagcagggactctgagggcatgcttcaaccagatgacacattggctgtaggccactggtgcccatgtagctgcacatgatccctgagcaccatgaaaaaatacattggcggcaatgtaaagaggaagagggtaagacaatgaaaaaggaaaaaaaaaggcataatcattaactctggggaaaaaagttacataagaaatgaaataatggagtatgactgcatttacattataataatgaacacagactaaggatttaacaactgtggttttgccatattgagagtatgggggaaagagaaggaaagtggaagagaactaaaatcctcatttgttacagtaggaaagtagagggtttaaaggagttgcatcggcagcggatgaagaggagaaggagactaagagcttgttgctttttgctataaaatttagcatttttgattttgcaaatcaagtgcatgtatttatttacacccaatgaagatgctatctgaatttttcatatttaaaagcatccttcaacatggttctatggagaaaaactgaaaattaaatttcaagttgaaaaattatttagagaacacattttagaatattgtctcaaaaaacaaagaagcatacaaatcccatttttcctcctcacttttaacatttgtgtataataatctattattctcctattttgtgagacaccattgtacatattgtgactattttgtgcagtacttgttttattttgacttgtgtttactactcccacgtagggcatcagcagtccccactctattatcttatcctcattcccttcctcatttatttttatcttacacttcgcctccattggtatttagcattctacatattatttattcagcatctgtttatttaatgcctactgcatagtaggt

SEQ ID NO: 6096 - DNA, 1035 bp, Homo sapiens
tcttttcctgtgggtttcatttgttaaattcattggattttaataatataaaagtatagctaattgttcagttttaactatttttaattatcttcttaacaaataagaagttgctttaaacattaaccaattttctatatttagctatacagagtaattgaacttaacatgtttttgtcaacaccaattacattttcagcttttaaaaatggtagcttttgtgaaatagaatcagtgaccagtatagcacttagatcccttctaactcatataatttttctcagccaatccattcacaagcttggcattgacatgtgctgctagtttataaactggcattgacgaaaatcatttgaatctcttctggctgagataatttgccaatgcaaaatacagttgtcattaatcctgcacattagaaattattagaaacatattactttttaactttaaatctcaaagagattttgagttattgaattcttaaggctttcttagcttgaactgataactatgcattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgtt

SEQ ID NO: 6097 - DNA, 1050 bp, Homo sapiens
tcagccttactggccacctggagacagtcattttgggcctattgaagacacctgctcagtatgatgcttctgagctaaaagcttccatgaaggggctgggaactgaggaggactccctcgttgagatcatctgctcaacaaccaaccaggagctccaggaaattaacagagtctacaaagaaatgtacaaaactgatctggagaaggacattatttcggacacatatggtgacttctgcaagctgatgtttgccctggcaaatgttagaagaccagaggatggctctgtcgttgattatgaactgattgaccaagatgcccgggatttctgtgatgctggagtgaagaggaaaagaactgatgttcccaagtggatcagcatgatgaccgagtagagcatgtcccacctccagaaagtatttgataggtacaagagctacagcccatcaagagagagcatcaagaaagaggttaaaggagacctggaaaatgctttcctgaacctggtccagtgcattcagaacaagcccctgtattttgctgattggctgtactactccatgaagggccgggggctcgagataaggtcctgatcagaatcatcgtctcccgcagtgaagtggacatgttgaaaattaggtctgaattcaagagaaagtatggcatgtccccgtactattacatccagcaagacactaagaacgactacccaaaaagcactgctgtacctgtgtggtggagatgactgaagcccaacatagcttgagcttccagaaacggtgctccccacgcttccagctaacaggtctagaaaaccagcttgtggctaacagtccctgtggccgtccctgtgaagatgacattagcattgcccccaacctcattttagttgcgtaagcatagcctggctttcctgtctagtctctcctgtaagccaaagaaatgtacattccaagcagttggaagtgaaatctatgatgtgaaacactttgcctcctgtgtactgtgtcataaacagatgaataaactgaatttgtactttagaaacaa

SEQ ID NO: 6098 - DNA, 1568 bp, Homo sapiens
acaggcttctggtaactttggaaattgtaacattaaaataaagaaaaatatacaggactcataaggagctgaaatgctcacaaatatcaaacaaaacaagagttaactaaatggactgaactcaggaaactgaaaccaggctgggagcggtggctcacacttgaaatcccagcactttgggaggccaaggcaggtggatcacctgaggtcaggagatcaagaccagcctgaccaacatggcaaaaccttgtttctactaaattaaaaaaaaaaaaattagccgggcatggtggcacatgcctgtaatccaagctacttgggaggctaaggcaggagaatcacttgtacccaggaagcagaggttacagtgagcaagattgagccattgcactccagcctgggtgacaagagcgaaactccatctcaaaaaaaaaaaaaaaaaaaagaaaagaaactgaacaaatctttttaacctttgcttggaatattgctgatccgtgttttgtttttcagagtcaaagaaactttgaactatttatggcctttaataattaagtaaggtatactcctgtgatcaagacttggagcatatttgtttctctctgcctggttcctctagaaattggaaactatcagtgagtatttttatgacaatatagttgtttgcatcagtgcagtaagagtccattttcaatggcggaattcttttctcactcttttcgttgtttaataattattatagcaataataataataataaataccaattattacattaactctctgcatgtctatgttcttattgcattttcttataagaacacaagacgtattggattatgaccaactctaatgatcttattttaccattttaaatatcctatctccaaatacagtcacattctgaagcactgggagttaggatttcaacataggattttgaaggggcacagttcagtctgtaacagtggttaaaaacccaagttcagaaaccaaattttctttgcacaaattgcagttttgcagattaggagatatgagactttggcaaacttgccaagaccttggtgacactctttatgtcttcttgttctcatctttaaaatgagaggtgaaagaggattaaaaattattacataaaaacaaaagacttaggatgatgatgaaatgctggtaatatatgttagatattagtattttttatctcaataaattcaattgctgtaactcttgattcctcatcttgctactgtgcaattgccctcctcttccctcagtgtcacccatcaaagggtagatagtctcattacaattcttacttctatatttcttttctgattgatcagttccgcctctttattgacactgggatttatatgcattgacttaaaaatggagaaactacaagcagcattagaggctgttttttaattaatgagtctctccgcttacaccatcaaactgaagattagctgttgatttatgagataccctcagcttgtatcttgtgccacatccagatcattgccaattcatttccagaaggaggatcagtaccattatctgct

SEQ ID NO: 6099 - DNA, 1033 bp, Homo sapiens
ttactatatttattttaaataatttatttataaattcactatatttattttaaagataatgaaagtgaggaagtcacagagcgattaactttatcacacacagctagttagttgtagagccatggtatgaatctgaatctacaaaattccaattctctaaatttttttctaagttgttttatgtttaagctatagttcttagtaatatatttatattgtgttaatttttaacacagcagtatactatctttttatgtgttattgttaataaaattatatggccttcaaaaaatgtttaaatatttttcaaagcttttttatatatatacatataatcattaaatttatttgtgatttatgtggcacaaagacaggaaagtatatatatgacaacaggtaaaagaataacaaatctaaaaatataataatggcaagaaattaaacgaatttcagaggatatcattttatatttaaaaaatcaagaattaaagttttacagtatagaaaaagaaagacatgtaatacaaaagctgatgaataggaagatggttgatagaaaaaataaaaacgatgttgaaaaataaaaataatgtcagaaataaaataccattgtaaattaacaattagagcaacaccagtattatcttaacgtaatgaaattgtataatttcgtaaaatgaaaaaaattatagtacccagtttcaacaaagggagaggagagcaagcttgttaacatttgcaaaagtacaggaggaaacaataaatagataaaaatagtcatattaatgaatgattatggagagaagataccagaaagccaacaaagatatgattggtgttcttgatgtaggaatcagaaaaggaaaaaaagaagcaacattcattcttatttctttcagccttaggaacaagttaatttgaaaatgtaaagataactatataaaaagataaagaaataccaaagtcagtataatactaagtaggtcaacatttagatatatgttggcaatttcaagcagaaaaagaaaatgaa

SEQ ID NO: 6100 - DNA, 1062 bp, Homo sapiens
tgcaggtataagaaagaatgtaacactgtggccctttgccctccattagcgctgggcagccatcccacacaacaagaagcagcagtggggctgggtcagccccagagccatgggcctgagcgaggcagaagaactgaacaatctgtaacacagctgggcaagggtacacctggcctagctgcaggctgagcacgggatctggctggggtgcatgccaagtgcagcccacatggctgaatggtccaggtacctccacccaggagcccaggaccaagcagagcccaggtgggggtgttgccagctgcagaggtctctggctggcaaagcagcactaaaaaaaatcatatgtcaaaataatttaatgcttaaactgttactatgatattcttagtttttgtataaagaagaatggaatatagaaggttagaggttcacctccacagaaatagtaagctgaagaagcagaatttaagctcagattttctaacttgaaatgttgtaatacactgtaactatctcaacagtagcaaacaaagccacaaatttatgaaaattctgctgctatttcaataagtttaaaaataaatgttttgacaatttaaaaatgaattaagttaaagctattgttaaataaaacgtaaatggaagacacaacttcacatttaaagagtgaaacaacaatatttgtaaactgaaacaaggtaaaacctatataaaaaaatgcttacaaaatttccagaagagacttactggcattgtagagatagatataaatttctgaataaaattctttgcagttattttattaacccttctattagtaacatttctaataaataattttgttgtgggaagtcagggaccccaaacagagggacccgctggagctgcagcagaggaacataaattgtgaagatttcattttaatatggacatatatcagttcccaaaattaatacttttataatttcgtatgcttttcttactttaatctcttaatcctgctatcttcgtaagctgaggatgtacatcacctcaggtccactgtgatgatggcgttaa

SEQ ID NO: 6101 - DNA, 1546 bp, Homo sapiens
tatttgcatcaccttaaaatatctccacataaaatatttattaaatacaaagaaaaaaatagtagcattataatgaagaatcacataactcctgatacaatatacttcaaaagacaccacgtagcttctttggttatgtttttctaaaaatgcataacattggttaagccatcaaacatcaaaatatcaaactgaaattgaaagacattctacaaaataatatgccagttatttttaaaagtatcaaggccatgaaagataaaacaagactgagaaactataaaggactgaaaaagactaagaagtaatgatgatacagtacattgtaagagccgggataggatctaagtccaacagtataacagtagtggaacaactggcaaaattcacataacgtccacaggttagttaatagtattctatcaatgttaatttccaagttttgataattgtatatatcatggtatgtagtgttttaaaagtaatgaactggctgaagaatatatggggattctgtattatttcaaaaattttcagtaaatataaattatttcaaaacaagaagttctagatttgctatttcctaatgactaataatattgagcatctttacatatatttattggacatttgtatatcttctccagagaatgtctatataaatcctttgccccatgttaaaataggattgtttacctttttatctatatcctaataagaaagtttttttcatttgtttgttttactgtggcaataccattgaagagcatttcactattaggtaattttcgcttttaaatttttcattataatatttccactatgtaaatgtcattgaattttgcactgcaggtagataaaatgtagttttaccaacaaaattccttgaagaagttatgaaaattgctctaaattaacatactggcccacttgaaaaataggcacatgattcaaaaagttgaaataccaacaatagtagcaaatctatgtaggagaacactgcttggatatgtctatgaagatatctagaacttgggaccttctttaaagttcttctgcaaagctaaagttcccctaaatgtttgtataggggatggaaggacctaacctgacctattctctcttctggtcctgaaagacaaaaactggaccaaatctatatgactgtaatagagaagaatgtttctgtgtcccagcaaagtatctagaaaagtagaccagaagatagcatggttacttgtttaccaaatcttactaattgaagtcattcttccttccttgtgaagttactaaggatggttaggagttagaacaagcacattcaagaagacatagtgtatattttatccattagcaccaacctgagaaggaaaagggaatttcttacctgtaactaaactggtcatatatcctggtttataactgtatgccttatattatgtcagatgatccctctttctctcaaaatttggacaataaataatatggttacactacccatatattaatataataataaataaaatgttaccatatgttcttctgg

SEQ ID NO: 6102 - DNA, 1035 bp, Homo sapiens
taggtgaatatttcagttgattacacctttgtgcttggtgattttagtaatttttctcaagaaatagaacccattcaacattgaatatacacagctagcctctaatacatagattagccattcattttgtatctttggtttcattgtaggtaatttcctgtctatatgagtgtagaaaattaacactcaattttaatcctgttgcaaacttcaaatcatggtggaaggtggaatttttaagggagcatatccatattaaaatgtatcaacactgtaaaatagtctgagttgaattgtggctcagcaggattaccagacttaaaatttgtcaatttatatttcctctgctaaaaatgtcaatgttaagtttgtaaaatttgagagtagaacaataaggggtaatgttatatgttgtaagtgccttctgaaaaaatacatactcttcttttcacctttaccatgtagtctgtgattagcatatctatctataataatcagagccatttgtttcaaaggcaacaatgttgactgtggtgaacatatgccagtctgcagagatattagttatactccatccatatagtgtgtaagataatacataattattgaggaaccatttggatgaagaaataagttgcttgaagaaaatagtcataaaattcacttctaaattataaaataataattgaaggctggcccttgcatttgaaaatattaatatgtttaagtcagctacgtgccagataaaaatataccacaggcctccagaaaaactcagcaagtatttagaaaatggaagcaacagcttacaagatatcattttaatgggtttataaaagctcatgtctctaagggactttttttgctcaagaaaatgtcatggagatgtatgtctcagacagtgtttatgaacagtatagttattcatagttttctttacacaatgcctatggtctgtgtgtcaaaccgcctgcatgcatttacgatggcttcctgccatataaaatctggctgacttaatctctgtgaacttgt

SEQ ID NO: 6103 - DNA, 1106 bp, Homo sapiens
tgccacattttcttagtctagtctatcattgttggacatttgggttggtcccaagtctttgctattgtgaatagtgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttggaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtattttggctgcataaatgccttcttttgagaagtgtctgttcatgtccttcgcccactttttgatggggtggtttgtttttttcttgtaaatttgtttgagttcgttgtagattctgaatattagccctttgtcagatgagtaggttgcgaaaattttctcccattttgtaggttgcctgttcactctgatggtagttttttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttggattaatttttgtataaggtgtaaggaagggatccagttacagctttctacatatggctagccagttttcccaacaccatttattaaatactttgtatcaaatacaactcttcaaaatgtatgacaattttcttatttgataattttaatttcatgatttacaaaattaagctcactaaatatgaagaaaattcacaactgaatgtattctaaatcctagggaaacattccctaaattgagtcatttaatagttctggaacagggatcagcaaattttggcctgcaaccaattttttaaaataacgtttgtt

SEQ ID NO: 6104 - DNA, 1058 bp, Homo sapiens
gcaactctgaacaaaaggtattccgaaataaaatcctatatctaaggtaatgtatgatgaagaaacaacacggaagccttaaaggatttgcccaagtttgcacgatttggcaaaggcattgctggctccagaacactggcttcagcttatttcttttttttttctattgcataataaaagcaatgttttccatcgtgtaaatggtggaacataattcctctggatattattatttaaaaaataaattgtaaaacatgccaaataagttcatgaaaagactacagtaaaaattaaaaaggaaaactagtgtctttattgcagccttttctaaactaaggtgctttgtgagttacaagagagggatagaggacagagcattttacacagcttcctgtctttgaatgagcgtccctttatttctgcttactgagaatattttttgagaaacatttctctcttggaaatgattttaagcagaccgtcaacaaactttcaaaagctttcttgtatcagtatatttcaaactcacacacaccttaagttatgccatatgacttgcacatgacatgcagcatactgagataccattaactgaactttcctgtattcaagtgtagggttcaagaggtgcaaaccaatgtttacttttctgttcttataaaattctggtgcttcagaagaccaagaaaatacatgaattcaggaactttcacctttaagtattcaaatggcatttggtttataacgggcactaaagaaatatgtaacacagatcacttacgatagcatcctgctgcagtctttaaaattagtcctcaagtgattgaaaacattagaggcacgtcttttgtcattgttatatgtgaaaccgcaacagcaacctacaccttccacacacgcacacacacacacacacacacacacacacacacacacaaaattaagacaattggagctaaaaaatacaatatcataacaggttatccctttttgtacttgtgcacattttttatctacttgccctgatttagtatttattttttttgctgggttcccat

SEQ ID NO: 6105 - DNA, 1082 bp, Homo sapiens
tctggggataacattacttttgtaaaacctgagatcagtgcttgagatattttacagacactgtacttgatggcttatttggtcttgtggcccccacccaggaattgactcagtgcaagaggacagctgggactcccaatgatttcatctctcaccgcaccagtcagcactccccactgtccaacccctgccaccaaattatccttgaaaacctcgatccccaggttttcagggagactgatttacgtaataataaagctctggtctcctgcacagctggctctgtatgaattaaactctttattacaattcccctgtcttgataaatcggctctgtctaggcagagggcaaggaagaccccttgggcagttacattatctcttttcttcttagaacataagtctttctccattgtattgaaaggtcattaagagtctgttcaaataactcatatgtgaaatatgacaagaattccatactaatataatgttatccagtaatatttacagcaaagttactatttatgcagtgttttgctggagccaatttataatggcacacaagagtcaactgtgcacctctcttcccaatgctacattcgatgatgtcatcaaaataaagctgagatttgccaaactcattgtcaatcagagtttgcctaaggaggtatttctaagaataaaacataattgagtcccgaaaagatatgtaaaatattcatttttaatgatactgctgctgttactgacaatagtaattatatttattttttggccaaaaaatttaattataaacttttgccaaattgtctttgtcaattaataaagtttaaaatttatcaagtatttcttctactgtgtttggaaaaattccctggatctctattgagcttactttgaataataaaaaaaaaactcttattttaatatgaggaaatcttccagtgctgactttgccctgtatcagacatatattcttaaaataaagactaaatattttatgtaagcattttagcaaatgtttccagtactttggatggcatcatgtatatatattagataatatttacttaaggatgcca

SEQ ID NO: 6106 - DNA, 1066 bp, Homo sapiens
gaagataaaatcaggagagctgattgcagcaactgtcctgtggatcttggtagctgctctgcattctgctcagcaggaatgccatgctgaggagactgtcaagtctcatagcactgcagaggttatgagccctggaaatgcctgagtccttttttgtgtttatgtggcaccttcccctgacccagaagcagctgaaatatttagtaagttctggtgctcgcaataagtcttttccaaataacaaacaatggcagagcagtgatttcactccagtgcagcatttaaattctgatacacactaagtcctccccactcaggagtcaaaagctggacagcaattaagttctgatattaagttgtaatgatctaagaccacaaaaaacacctgcaaaaacagaaagaggtgaccatctcctcaaattcacaggcatcaatataaagataaaaggattaataaaaatcaggaaaatatgacaccaacaaaagaaataaacaaagctctataatggacacagaagaactgatctataaaatgtctgaattccaaattcagaataatctactttaaaattttcagggaatcacaataaaatataaatagaaaattaactaaaatttggaaaacaatccataaatacaatgagatatttgacaaataaagaaacatttttaaagcccaaataaatcctagaaataaagaatataataactgaactgaaaaaactcaatagaaagcttttacagtagacataatcagaggaaacagcttgaagacgtatgaaattaatcagaggagcaaaaagaaaaaagaaaaaatatggtgaagaagaccttcaggaattgtgggacactatttaaagtaaactaaccttcacataataggagtttccgaatgagaaaagggagaatagacctagaacacatatttaaggaaatcatagctaaaaacctcctaaatctacatgtagaaaacaacatccacttacaagaaacatagaagttactaatcaaattaactcaaaaggaattccccaacacccttcaaattatgataaaaaaaatcaaa

SEQ ID NO: 6107 - DNA, 1069 bp, Homo sapiens
aagtaaacaaattcagggcactcaaaaactaattgggccaggtgtggtggctcatgcctgtaatcccaacactttgggagattgaggtgggcgtatcacctgaggtaaggagttcaagaccagcctggccaacatcgtgaaaccccatctctactaaaaatacaaaaattagctgggcatggtggcatgcacctatggtcccagctacttggaggctgagacacgagaatcgcttgaacccaagaggcggaggttacagtgagctgagatcatgccactgcactctaccctaggtgaatgagcgagactctgccccctcccctccaaaaaaaaataagaaactgtaagtgtatataaatcacttacatctttttttcttttctttttttttttttttgagacagcatctcactctatcacccaggtcagagtgtagtggtgtgatctcagctcactgtaacctttgcttcccaggctcaaatgaattacccacatcagcctcccaagtagctggaaccataggtgtcacttacatctttatataatatcgctttcatcttttagtatctaaaagaaaaaaaattaatgataataacaacaattgtttaagagaaagaacatgtaaaaagaagtaaaatttacatatcaaaatccaaaatttggaaaaagactggtttaaaatgtaaaaacttatgataaatacactaaaaataaaaagtgctgaaccaaagcatactagagagaatcactttaccacaaaaaagacagaaaaatgaaagaaagatagtttgctgagaacgatggtttccagcttcatccatgtccctacaaaggacatgaactcatcattttttaaggctgcatagtattccacacacatcagggcctgttgtggggtggggggaggggggagggatagaattaggagatatacctaatgttaaatgacgagttaatgggtgcagcacaccaacatggcacatgtatacatatgtaacagacctgcacattgtgcacatgtaccctaaaacttaaagcataataaaaaaaagaaagactctccaaaaca

SEQ ID NO: 6108 - DNA, 1034 bp, Homo sapiens
acaaatacatggaaattaaacagcacgctcttgtatccccattaagaaaagaaatttctgaaaatttctggagatagaaaatgaaagcctatgggatatagcagaagtatgtcaaagaggaaacactagagcaataaattcctacatcaaaaaagtaaaaagatatccaattaaaaaccatctggtgcacttcaaggaactagaaaatttctaaaaagccaaatgcaaaattagtagaagaaaagaaataacaaagatcacagcagaaacaaaaaaaaaacagagattttaaaacaatacaaaaaaatccatcaaagaaaaacaatttgtttgaaaatcaaaagaaattagctacactaagaacaaaagagaaaagagtcaaataactaaaatcagagaagaaaaaagatatattacacagaatttgtcaacagaaatacaaagatcataagagattttatgaacaactataaatcaagaaatttgaaagctagaaaaaatgaatccagactgaattatgaagaaatagaaaacctgaacaaataaagagtaacaagattgaatcagtaataaaaaaaaattctcccatcaaagagaagcctaggatctgacaaattcactgctgaattctaccaaactatcaaataactaatactaattcttctaaaactactatgttaaattgaagaagaaggaatatgtctaactcaggctatcaggcaagcattaccttgacaccaaaaccagataatgacacaacaataaaagaaaactacaggttagtatctctgaaacatagaggcaaaaatcctgagcaaaatgctagcaaactgaatccatcaacacattaaaagatcacttactatgatcaagtgtgattcatcataggaatttgaggatgatgtgttaggctcttcttgcgttgctacaaaccaacacctgagactgcgtaatttattttttaaaaaagatttaattggccctacagggtgtataagcctggttccaacatctgctcagcttctggggaagcc

SEQ ID NO: 6109 - DNA, 4364 bp, Homo sapiens
taggaagaataaattctggtgttctattacatagcagagtgactacagctaaaaatagtgtattatatatttcaatatagctagagaagaagatcttgaatgttatcaccacaaagaaatgataatgctgtggtaatgggtatgttaattatcctgatatgatcattaaacaatgcatatatctattgaaacatcacagtatacccccaaacatgtacaattattgtgtcaattataaacaaaaataagaaagaaaattcagaaggagggatttttttttaatcttgtccttttttgttcacactccaggaagatccttatgtttcaccatttacttctatttcaacagttgagtgtgatataattaattagattagaaagtagggcaggatatacatgtcaagcacattgaagtaatttgccatgattatctctttaatattttcatgtaaaatcaaagctgactgttatattcaagatctatgtgaaagatatacaccttctagtctatagttttgaacttttttatttgattgtggtttactaacattaatttcaatatatgtgttactgcctcacatatgtgctttttatatctagaaaatataagggctcctgaaatttaaaaatagtatgaaattagtaccttatagtaaaaatctctagcttgaccaactatgaggatttaaaaggtggcatgaggatacgtggttttattctaacatgttttaaaatatatgtagactgataaacttttaaataaataaaatggctggtaatagctattttgaacatcacataaacaaatgtgtaaatgtccagtggtaaaatgatgaaggcagtaggcataatgcaaaatatacgctaaagtgttaaaccagtaactcaactccagcatggttttgccattcaggctaaaggaaacacaagaattcctgccttgccccccacgtagtttttctaaagaaatgcaaaattcagattcttatttgaaatattctgatttctatatgtctctcaaagaacagttgatatttaatgactagtgtttctaggtatgtaagctttatattctactattttgttgcattctcataccactttaataagtcaggcaaaggaagcaactgaaggctcaataaaggacggtagatcaacagtaatgattgatacctaaattctgataacaattgtcccacttgattcatgaatttattatcactgaataaagagtccttctgattttctctactttgtctgaaaaattcagcagggatttttgctgttgtttatttcccttctcaacaggtgttttgccttcatgctcaatagctatttcaattaaactgtcagaatatgtttcacacttcccaaaacctggcatcttacagcaaagtgtgtgcaaccttttattaggaagtttggagagcttgtaatggatatacaaatgatttttccataaagactttctgactttagaatgaacagcactaggtaaatccttatgtagtttattgttataagaaaaatcaaagatttggtttaattatacatagatttgaaattcagttgcaatggggactgaaagtaaaggatattaagttttgctctgtaagctcttccaggaatgaattgcattggcctcttgaagtggctcctagtcatcactttcaaaggcatttaatagttgtagtagatctaaatcataacttatatgtacattgatacttgctagctgtattaaggcctgagtcagcagtggccacggctgagcaagatcagttatttggtggctttcacccaactggaaaagggttgcagctttcactgtgactatgataaatcactctcttttttggcctgatacaggagatttttgaactcgatccattgtggtgttttttgatgtcattttaggtgaactcctgagaaatttggtgtaaaatagaaatttaaatctggattttatcactaaaaataattgtaggattttgatattgaaagtaatcaagagataataaagtccaattcctcattttaaagataggacaaataggaatgggcaaggtgactgctccaggtcatatagctttttagtagccaagctgaaacaggaacatagggaaccagtttataaggccaatgtttgagcacctgtactatgctactaagtactagcatttaatatttagccatgccaatgtaaaaagaaagaacaggagaggtggaaagtcaaatgtggagaaacaacactgatcgtctttgttagtttaaatttttctttacaaggtgtctcagtaaggcaattttatgtctctcttttgctaaaaagcatctgaaaataatcaacaatttcacaaaagggacaaaatcatacagtttagaaataattacaataactgtccataagcaaggattccttcctaaaagatacttgctttacttaatctttgaccatcttctgcattcacactactttcctaagtgcagtataaatggctcccaaagtatggaatttagagttaatgaggaaataatataggttcaatatcattatactatcaaatattgtttaggcttagtaaacaacaggtgatattgctactgattaatacattcagaacaggttcatggaaatggtgacattgtatttgtccttaaatggtaataaatttttcaacaagtggaagtgagagaacaactgtaagtgtatatttcaggcagagtgagtgacaaaggcattgagatagagtggtagaggaacaaaaggaacacagcagaggtagaatttggttcaagggtattgtgtttctaaggccaacaatagaagataattttggtaaataaaagatctctagtaacatacaatggtaccagggcattataatataggaaaatgtttaaacagagaagtgatatgttcaaaactgttttagaaagataatgctagcaataggtttaagatggattgcacagtgatgatacttaaaggaaagaaggattctgagacttggatttggatggagcagtggaaatggctgataaagaagcctgtgactttcttcagagaaaaccagcatatctttataactgattcaatggggaaagtgaacaatataaagaaaagagtaacattaaacatgaatttgaaatttcaggcctttggagaatatggatataatgaacaaagattaggaaataagtaagtggaaaaaatttggaaagaaagatgaatcttctaagaagatgctaatcttactaggtgaattttattgatggcattagatatataagtatggggggcatcctaaaaatgtgatatgagaaacattgagggatatgataattagaaaaatgaatgagcatttcaagaatgtccctattgccacagaaggttgaaaagatgatccagtgaagaaacaagagaagatgtagccaggaaatatctgaagcaaactggtggattctgaatgattaaaaataataataaccaaagagaaaagaagtagtggatgaggttggcagagatgaggaactgccatttctccaaagctctgaaccaaaagcaaagactcatttgaatgttttaccaagcttgagtactttacaaaacttgaaagtgtgcaagagcaaagaggtatcatttagcacactataaatagcatcttctttaaaaatgttgtacacatttctcatatttgaaagtaaataacctgagatttaaaacatctgtcaaacaatctgtgaatgttatgtgccattttaatacattttgacattatttcatgttgaaacatactttctctgattgtattgactggattatatagaacctctttgactgacttagtctataacttgcccagataaaatgtacattgcaagtaaataaaatatgggtgatatgggaatgaaatttcaaggcaagtttcgtgtataatctgtagctcctctcaaactatattaccactcctaagacatcctttatctgatacgaatgcctaataaggagcaacatttctttttatgctataattacattgtactaattctttttctaaaatggaaatgcataccatcaaagaataaaacaaaatgttaagaatttcacacatttatatttgataaaatgacactttgtattcaaatgacacattcattttttccctactacttgaatgaataaaaacatcctttattgttcataagcattacataacgtaattttccaaaataataattatgtactttccagcaagtacaaaatctttttaaaataaactttatttggggaagagataatttaacatatcaatttcttcaatttataaaagtgataatttcactccaatatttgaagaata

SEQ ID NO: 6110 - DNA, 1026 bp, Homo sapiens
tattaaaatgctgtacttctccatacagtatttaggctttttttaattggtgtgttctagttttcagtgtatatatcatgaaaacttttatttatatctaagtattttagttttaggagattttatatatgctattaattttataatttgaaataatttgcttcattgctagtgtataaaaatataattattttttgtatattaccttgcactctgcagccttggaaaactcatgtataacttcttagaagtttttatgagttgtttgggttttctatgcatataataatatcacctgtgagttgaaaccattatttcttcctttgattcattttctttttcttgtgttattacactggttaaaacttaaaatacaatgctgaatatgaactttgttcccagtcttagagaataagcaagcattcagtcttttactattaagtaacatcacagctaaaggcattttattgataccctctattagataaaaagaagttccactgtattcctagtttgctgagaatttttaccatgaattaacgttaaagtttgtcaaatgcttccacatcttttgagattgacatatcatttttggatgataagttgaattacattcatggggaaaactgttgttcaaaattatttttatatgttgatagaataaatgtattagcattttgctaaagatttttgagtttatgttcataaatattattgctctatagttttctagtattgtaatttctgtgttgattttgatatttatgtaatgctagccttataaagtttatttggaagtattgtttcattttttctgaaagttgctgtttgtaactgtgctgtaattctccctaaagtgtttgaaatttttcaccattgaagatttctttgattgaaatatttttactacaaatccaatttttagtagatacaggactattcagcttgtctgttgtctaagtgagttttcataatttgtgcttttttggaattagttcacttcaactatttgtggaatttatacgc

SEQ ID NO: 6111 - DNA, 1052 bp, Homo sapiens
tacttgctcagtttggctagagtttcttcagttttatagatgttttaacaaaaaactatctttccatttcactgattttttcaattctttgttccaatttaattattttcatctcaagttttaatttctttgttgtttttatttatttatttatttattgatgtggagtctcactcttgtcacccaggctggagtgcaatggcacagtctcgtctcattgcaacttccacctcctgggttcaagtgattctcctgcttcagtgacccaagtagctgggattacaggtgaccaccaccacgcctaattaatttttgtatttttagtagagatggtgtttcaccatgttgaccagcctggtcttgaactcctgacctcaggtgatcctccagtctcggcctcccaaagtactgggattacaggcacgagccactgcacctggcctatttcttatttctagtaattttgaatttaatcctctatcctttccctagtttcttaaggtgaaaattttatttattgatttgacacaggtttttttctgctatatgcatttgagaccaaaagaaatctctaaacaatgctttagaataattctacacatttggatctgttgcattttcattttcattcactccaaaatatttgcaaatttatcttgagaatttcgcttgactcatgagttacttagaatacttttgctagttttcaaaaaactggagatttttcagttatcttcctattactgatatatatatttttttgagacagagtctctgttgcccaggctggagtgcagtggctcaatctcggctcactgcaacctccaccttccaggttcaagcaattctcctgcctcagcttcccaattacctaggactacagatgtgtgccactacacccactaatttcttttttttttttttggtatttttagtagagacagggtttcactgtgttagccaggatggtctcaatctcctaacctcatgatccgcttgcctcagcctcccaaagtgctgggattacaagtgtgagccaccatgcctggcct

SEQ ID NO: 6112 - DNA, 1665 bp, Homo sapiens
cagatggagcaaacaggaaataaagactaaaatgatgaacttaaattgaaccacatcaatctttacatcagatgttaatcatctaaatacttcaattaaaagcaagagattggcagaatagattagaaaggaaaaaagcaagatcttactgcatgctgcttacaagaaaccaattttaaatataaatatgcagaaaggttgaatataatggaagaaaactgataaacccacacaaattgtgcacatcagaggactggtgtatccatttaaataaaggattaagcagactccaatatcatgagtattactagagagataaataaagatcttttacaataaaaagtaagacaattcatcaggaagatataacaattataaatacgttcctataaacagtctcaagataaaagaaaataaaatggagatcaaagtaggccaaaagtaaataagatgggggactaattttaaaaaacataaattgatgaaataataaaacagacatgttttagaagattaacagtgcaaaaactggttctttgaaaagatcagctaattaccaaactgctacttaaattgatcaagaaaaataaggaggaaacacaaataactcaatatcagggataaaatatttcaaatataggtctgatagacattaaaatgattttaatagactaaaccatattacatcaataatttttataagttcaatcaaatatgtgtatttcctgaaaaatataacttactgaaattgacataagaaataaaaatagattctgaaagtcattatatctatgaagttaatggaatttatcatgaaaaaaaatcacagataggaaaatccttctggcttaaagaagtttactgattaattctatcaagtattgaagaaacaaaaaataccaaacttatactaactattttagcaagttgtggaggaatggtcactgtatatttcatttaagttgtccaatttcttaacatgctttttgagggcaacataaccctaatatgaaaaccttacaaacatgatgcaaaagtgaaaagcacagatcaatttcacttatgaatatgaatgaatatatttacaaaatattagcaaatctaaactcaatgtatataaaaagaatggtatatcacaaccaagcagcaattatttaaaggacttaaagttttaaacatttgaaaaccacacaatgaagtttataatatcaaacaacaataataaaagttacatgataattgcaatagatttagaaaaagcaagattagataatacaagattgctatacaaaaatcagctatattattttacattagattcaaaaaattcggaaataaagagaggaaaacactttaatttacagtaaagcctagaaacaacaacaacaaaaacaattagaactaagtttaagaaaaagcattaatgaactttacacaaatgttattaaagaaattttttaaaagacctaagcaattgtgaagatataccatattcatgattggaagactcagtattcccttaggatgtcaattcttggctgggcatggtggctcatgcctgtattcccagcactttgggaggctgattagggcagatcacaaggtcaagagacagagaccatcctggccaacatggtgaaaccccatctctactaaaaatacaaa

SEQ ID NO: 6113 - DNA, 1578 bp, Homo sapiens
aattagctgggcatggtggtgcatgcctgtagtcccagctactcaggaggctgaggcaggggaattgcttgaaccagggaggcggaggttgcagtgagccgagattatgccactgcactccagcctggcaacagagcaagaccccgtctcaaaaaaaaaaaaaaaaaaaaaaaaaaagtccgagtgtcttcctacctccaaatgacagcattagtgtcttagcaatggtttttaaccaagctaaaatggctggaatgccagatgtagaattcacaatatggataggaatgaagaacattgagattcagggaaaagccataacccaatccaaagaatctaaggaatacaataaaatgatacaagaactgaaagaagaaatggccattttaataaggaaccaaactgatatgataatgctgaaaaacttactgcaataatttcacaatagaattgcaagtattaacaggcaaagtgaacaagcttaggaatggatctcagagctggaagactagttctctgaattaactcaatccaataaaaataaagaaaaaaatgaagaaaacccaggagaaatatgggatcaagtaatgagaaaaaatttatgacccattgacattcctgaaagagagggagagaaagcaagcaacttggaaaacatatgtgaggatgttgtccatgaaaatttcccaaacctcactagagaagccaacattaaaattcaggtaaggcagagagcccttgtgacatactatacaagatgacatccccaagacacataatcttcagatttcccaaggtcaaaataaaagaaaaaaacgttaatggcaaccagaaggaaggggcagatcacctacaaaggtaaccccatcaggctaactgcagacttttcagcagaaactctctgagccagaagagagaaataatagtgggaggctttgccattccactgaccttattaaacagatcactgatacagaaaactaatcaaaatattcaggacctgaactagacacttgaccaaatggacctaacagatatctatagaactctccactaaaaaacaagagtatacgttcttctcatctgtacatggcatgtactctaaaatcggccgtaaaacaattctcagtaaataaaaaaaatactgacatcataccaagtgcactattagatcacacagcaaaataaaaatagaaatcaacactaagttcgctgaagaccatacaattacatggaaattttacaatgtgctcctgaatgacttctggataaacaataaaattaggccagaaaacaagaaattcttcgaaactaatgaaaacaaagacacaacatagccgaatgtctgtgacacagccaaagcagtgttgaaaggaatgttcatagcacaaaatgcccacttcaaaaagttagaaagaattcaaatgaacaacctaacatcaaacacagagaaactagaaaaacatgagaaaatgaaccccaaagctattaaaggacaagaagtaaccaaaatcagaactaactgactgcaattgagatgtgaaaaaccatacaaaaaatcaatgagtctagaagttg

SEQ ID NO: 6114 - DNA, 1013 bp, Homo sapiens
cagccgatttcagtgcctagaatctagatgctttgcacctagtttcacctttgctcacagatgctagtgccttttagaatcccaagaggccaaagtaaaactgaaaagcctaggaggacctggtgtggcaaaatctcatcatgatccatgcaacagtggaggcaatgttacgctctgcctcaggttatacttctatgcaaattaaaaataaaattcataggaagcaattatattagagttggtatttaatccagcattcttctgaattatcttacatataaacttagttcatcttaatatgagaattatataataaatttgaggaaatcttacagatttgttcaaaatatgcttgctgaataaataaattaatagtatatgctagcacagtgtatgcatgtgtgttgcatgtgtgtgtatgtgtatataatggctaatttttaatattacctatactaatgcctctaaaagttaaatcttgatatacactagagcaagattgtccaacccacagcccattgaccacatgcagcccaggatagctttgaatgtggcccaaaacaaattcataaatttcctgaaaacattatgagattttgttgtgatttttttgttttcagctcatcagctattgttagtgttattgttagtgttagtgtattttatctgtggtccaagacaattcttcttccaatgtggcccagggaagccaaaaggttggatacccctgcattagagtaaatactttgcattcataaatgaaatacaaaaaagagtagtataataattcaacaaaatatttctgcctttaatacttatgagacatatttaacctaaatttaagcattttattgggcaagtcaccatttccctttaaaaatttgtatattccaaaaaaattagccaggcacgggggcacgtacctgtaatcccagctactcaggaggctgaggcaggagaatcacttgaactcaggaggcaaaggttgcagtgagctgagatggtgccactgc

SEQ ID NO: 6115 - DNA, 2917 bp, Homo sapiens
catgttgccaaattggcttataagtaaatgattactcacaaattaagtaaatccaaatgcttttcaagttcacataaatttagtaatctttggtaaataaaaataattttaaaattattagtaaaacaaaactagaaatgcctttggaattgtaagcatacattttttatgtgggcttacagattattttatattttgcctctgctagaaattttaaggtgtcaggggttggcacaaccacaaaagttataagagtacaaacccaaccaaaaaaagaataatctttgtttatgtgaattttttgacaaataagactaatttaagattgctaattcaataaaaacacctgaattttctgagttatcagcaagatgctcatgtgtttcactttaaggttctttcttaggtgaatacttggtattccaagggtacactaaatggttaacaagaaaataacttgaaatgatgactagctttgtctaatatctcagttttcagaaataatttggataaaatgttaataattaaagaatttctgggtaaagtggctcacacctgtaatgccaacactttgggaggccaaggtagaagtattgcttgagctcaggggttcaaaagcaggccctggcaacataggcccctatctctaaacaaattttcttaaaatttaaaaaatatttttagctgagcatgttggctcacaactgtgtccccagatattcaggaaatttaggtggaagaatcacttgagtctgggagattgaagctacagcgagccatgagcatgccacttcactccagcctgggcaatagaacaaaaccctgtctcaaaaataaataaataaataagtacatgtaaatgggatacatgctcacttataaattttgtaatttaaaatcttaaaattattttgaattgaatagtagatgcttgttggatgtctgggtaattttcaattaagaaagggttatcatatggaaaacatgttactaaaaattgtggagtggtttcatctataaaatgttaacatctgagagtcaggtaacaatttgctgcttcctaaaatttaaggctactaagaacaagaattctagttaatacataattctgtaagttgtgtttttattaagaaaagaggtaattataaagttatgaaagaaggtaggaagaaacaagtaggaggaataatgcaaagatacttaaggatatgaagatgtatttttgtagggaaaattataaagaaaaaagaataattttgtatggaaagggatcttgtatgctaaatttttatcctaaagtacaatgactggttttttaaaagagagggaagtatgggaaaaacacaaagtccaaatgtcattaatggtctctgtaagtcatgataaggtttgtgaaatggaatttatgaaaggaattgtatatgtaagttcattataattataaaggaaagtatttatttactcttaataaaattataagaggttcttatttttaattctatgacctgtctccttttgaaaactccttagatttatatcttggaagttcaacttttggccaggtgctcatgcctataatcccagcactttgtgcctcatacctataatcccagcactttgggaggctgagataagagatttggttgaagccaggagttcaagaatagcctaggcaacatagtgagattctaccttcataaaaacttaaaaaaattaaaattatcaggacatgatggcatgtgcctataggcctaggtacttaggagactgaggtaggaagattgcttgagcccagcaggtcaaggctgcattgagagccacaactgccgcactgcattctggcctggacaacagagggagaccttgtctctaaacaaacaaacaaacaaacaaaaaaaacacaaaagaattttcagcttttgctgtgtatcactattttcgttgtttctctcccttttaaaaggcctgagatgatcactctctctcaacttttatcttagctcctgtaactctttttctctgtttctaattgttgttgtggcctgatgctaaaatgcttcatcttgagtgtctaacaagtaatattttccaaaaatctaacttgattttgtcctctttgcttttcttcatatttctgaatcatttcatgtaactgggaaacttctcatgcagttacaaggagtcatatattctcctgctatactcataccttgaacacactccctgtgtatggttaatgtcaaatacctttattatcaagtctgacttctaggttatctaaatgggcttcccataaggagaagcagtcacactgcaggtttttctttgcttttttcataatcaagttaagaaacaagagtttacattttatcaagataattactaggctgtctttattaggtttctgactacttacttagaaaaactttaaaaaggttaaggcttttatattgatgtaagtttttctgtattgcttgtaaagtcttttgattatcactcttgcctaaatgagtaactattattctatgttgataaaatgttgcaagccttttaacacctttgataaacgtcctcaaaatcaaaactcttaagtctctgaactagacttattactggggacttatcaaagctatacaaattaaattactgtgaggttgaagaatccttttcacaacttccagttagatcataaactccagtatcaccacctccactccccttgaaaaggtcctttatcatgtgctattaactaatcctgtgctgttaagttacagggctttgattcagagtacaaagatcttatctaaagatggcaccaactcctgccagtatctgacaccaaactttagttaaccacaggcttatcttcagacctgagaaaacataacaatcaaagtaactacctcatgagacatat

SEQ ID NO: 6116 - DNA, 1069 bp, Homo sapiens
tcttaagacaccctggtatgaatagctgaaattgattgatagtaatctcagtaaatcgtttcattctaatttttggtatatctatactgctttgaataactcttctacctacagcccattaataaatatttgcctagtcaaattttagtttgtgctatactcctagaaggacatggggtgtatggaagcgaaactaactggatatttaaggcattcaataatgtctttttgcttccgattctagctgtataacataggtaaatctcttaaattctcagaacttcaattcatttatatgtaaagtgaggagttgtaccatattggtagttattaacatgtactgtacttatgaatcagtctgaaaatcttgctaaactgcatattctgagcttttcttaatttttttttgttttctcggaaacgctgattctctaggtcttggttggagtccaggtatctgcaaattaaataagcacttgaagtgatagtatctgagtgtccgtaggcaaatgttaggagaactgaatcagatgttctttgaaagattttcatggttctaaaatgttctgatttaaaatccacaaagaaaaaaagcattgaaaatgaatcagcaaactagatgtaattaaagcttcttgcaattccattaataaactttttagaatgaattacactttatgtcttcattttttcttttacattggcatgaaagcagtgaaccctgaaatgtttcagtccttgagttcccaaagttatgtaaaagcttgataatcttaattaacccacattatctcttatcatataataatagtgctttctagaagttgactatcagatggtgaagttaggtttatatcagctggtcattacttcaagtttttaagctatagaagtctgaactaccaccaaaaagagcaactatcattttttgctcacataaagaagtaaaaatcttcaaaatattctcaggtgttctataaatatttttctctcatgttctaggaaaccacctaaagtatattccaattgataagctaaaatcacttggagtttgctaattttgaagatg

SEQ ID NO: 6117 - DNA, 1028 bp, Homo sapiens
ggagactgctaactttcttcggcccctagtgccggcagtcccctagcctgctctttcactggatacctgtgtctgaatactgctttcatctgtcgctcggtcagggtctgtggaatggacccggcaactaaatatagtaatataaatttaatttaatgtacatttattttctatctaaaataggggcagcttaataatgagagaacttcatcatgcaagtttataagggttttttttgtccaagtttccataggtgtatgcaaccttaaaagtctgatgtgcctttagagtctattggtattaatacatgaagaccatttcctcatgcagcaagccaccctgggacctgagacatgataactgaaaactttacacagaagataaagaccaatggcttagttttttgaggaaggtaacacagaaggaataagaacattaagagccaaaaagaaaaataatttaatgaaagtaggcaagtgaaactaaactgactactctcaatttacatgttttgagacaactgactcttctaaggttgaagtcaattgtcttgtctccttggaaacaagatgtctcctggataaagccctctcccctctcaggctaaattcaataacccttgctctagctccattatcaccatatgtatgtatttatcagaaaaatttcaaactttcttgccatttaaaatggtggacagaggcaatatctttagttttggaatgtcgagaatctttaacgaggtatggagaattgtagatgcttagtaagcagtcataataataataacatgggtcatttgtgtatctctttggtgaaatacataatcaactattttgcccatttttaaattttttcttctctattgaatggtgaaaatttttgtgtattctggatacaacttatttaccagatatacgattggaaaatattttctcctagtttttcactcatattttcattttcataatgatgtcattcgagatgcagaagtttcaaattttggtatagtgcagtttatcaatttt

SEQ ID NO: 6118 - DNA, 1897 bp, Homo sapiens
aagattttcattaaatttttatacttttattttttctactcaagtacacctttgtcaaatttattactatgtacttgatatttttcatatactgtaaattatatctttttctttgtagtgtgtttctgaatgttgtactagaaaccaggaggtttgctcaactttccaattaattctaaaaaattaatgtttagagtctattgaatttttaaacacacacacaaaatcctattgtctataaacatttagagattttctatttgcaatatttatactttaatttattttagttctttacagcattttccaatattgaatagaagtagtaattttgagtctttcttttgtccctatttgtacagagaaaatattttaatgtttcactttcagtatgatgattctaaaattttttgttttgttatgtttttgcttctctgtttattgttgaaaaaaatctttgtttaattaagtaagctccactctatttgtatagtaacacaaattttataagataattttttctaaaactactgagatactcaaatgatttttcttctttagcttgttaatgggatgcaacatgttgattggcttttttaggattgaccttggtaatgttgaattctctttctatattggttcattatgtttactcatattttatttagaattttgtatctggtatcttttagtttatctgtaattttctttgcctgtactgatgttctcagttttaatatcaaagttataattaccatttaaattgatttaaggggtgtttcctcattccagtctctggaataatttatttaagatttgaaatatggtttcttcaaatatttggtaagttttcccaatgaaaacattaagtcacaaaattttcacaatggtaaaatataaaattactaatttcttttctgtattaaatatataattacataagttttctatattgcttgttttatatgtgttgttaaaagctttgtcaattttatttagtttttcattttagctgaaataaattcgttcacaatatcttattgtcttattttctgctgggcctaaagtgaatcaataaaattttcttattcattcctgatatcagtgataagatttctctttctctttttctttttctctgtctcattagtcttgccagagttttatcaattttactggtcttttcaaaaaattaatagtttactttgttgatcctctcttttgtatttttattttgctttttatttatttatgctttattctttattatttgtacatttttacttactttggatccttttatttttattttctttttattgaactttgcctaacttcttggggtggatatttgactcattaatcttcaatgtttcttcttttgtaatatactcacttaacaaagttcttcaagaaattgtttttctgtatcttacaaacaatgtatggattgttttcattgtcatttacttcaaatatttatttttttgcagcttctttgaaatgtgtattatttagaattgtattttttagattttaattatttggagatttcttagttttattttttattcatttttaatgcagttgtactgcagttagagagtatattctgtatgatttcagtgcttaaccatatgttgaggtttggtttatagacctgcaattagtcactttttatcagtggcccatatgtgcttgaagaaaacatattctgcaaattttggttttactcaaatcttccttgccctttcttatttttttcaactttttcttctgtaactggaatgcacagttacgtaagtttcaattctccttcaatgattgttaatatggctacttctttctggtttctctttatctttgtttcatatgatttgaagccatatattggatg

SEQ ID NO: 6119 - DNA, 1042 bp, Homo sapiens
aagagaagattaaataaagagagtaacatactggaaaatatttaccagatatttaacattatcataaataatttaagtattctgaaaaccaagcagagggagctttgtttatctgaaatttttggagaacatttatgaactggatttataaatagatttgctaactggtactttgtaacttctaaaaagcagactagtttattttccaaaataagtgagttctttaaatgactcacgaccaatttagacttatattgaagaaacatctagaaacaaatactttccaattttttaaaaattgactttggtgtcatgaacttaatgtttattaattaatattcagaatattctaacattttaaagatgacaatacaatttactttatatacagcagtttggtaaagaaaacaacaaataatcaatttaagtgaaataacccattttgaatatgtattttaattaactcgtcagagatgttaattggctttctattattttggacagttgtggtgctttgataagctcagtttttcttctttacttttatctactttagcatgaattaatttttatattttatagatatgtaaaattttacatactttattaattttaataaagtaaaacataattcatgctaagaaaattaagtttataaaacaactgacaatgaacagtttagcatagccttcaatctcactcagactatattctctctttatttcattttaaaatccagttatttcaaactggaactgtgttgtagaagagagctttaatattactttttattgtttcttaatatttctaactattctatcttcaagatatccaaagagaaaggaatttccacagtgtataattatttattttcatgtttaaaatcttagaaatcactccccaatattatatataaaagaaatactattagaaaggaatatttttaaaacttgtttctaaagagtgaagttttgcttcactctttaatgatggacaagaacgccttccctaaacttgtaatgtggctgccgctacttataga

SEQ ID NO: 6120 - DNA, 1034 bp, Homo sapiens
aaatatgaaagattaatgataaatgtaagatgttaataaatggtaagacctgccttctttttggtggcaatgtctcaatataaaaaatatgccaagtctccctaaatgtattacttaaatttaaacaatcaaaatctcaaccagatttctcaagaatttgacaaattaaattttatcatatatgtaaaatatttacgtaaatctgaacaattggtgggaaatgaaacaatggtcacagggtcttataagaaaactaaacacactataagcattgcaaaaatacaaaagatgtataaatgaagtagaactcttccttatattttcacgaagttcacctttaattgattaaagaacaaagtatacaaaaatagaaacttatacatacgagaaattgataacattgcagtgctggaagtttctgtaacataaaaatacagtcaaccctccgtatccatgggttctgcattcatacatttaaccaacaatggattgtaaatttttttaaaaaaatggatggtcacatctgtactgaacatgtacagactttttttggtcattattccctaaataatacaatgtaacaacaatttacattgcatttaccttgtcttggatattatatgtaatctagaaatgatttaaagaataagagaggaggaggagtacaagaccagcctgagcaacatagcaagatcccaactatttaaaaaaattaaaattaaataaaaaataaattagctgggtgtggtagcatgcacctgcagtcctagctactcaataggctgaggtgctgggattgtctaagctcaggcgttggaggctgcttgagccattattgtgccactgcactccaatctaggggacagagcaagaacctttccctaaaggaaaaatgggaaaaaaaaattattaccttttaactgtggctaacttgtatgttcatttagtttagcaaaagctggaggtgccttgacatttgcagtacactgaaacagtggctggcttgaaaaatcccaaaacgattttctgcagga

SEQ ID NO: 6121 - DNA, 1044 bp, Homo sapiens
atatttttctatatatatatatatatatatatatacacacacatacacatacatatgagatatatgtatatatacatatttgcacccacacagacacacaggattcttgacacccaatttcataggagttcatgacctacatcaaatcatcacatctctggttcaacaaggagttatttaggggtttatgagcccagctttaaatatattggtggactatttggatttctgaaaacctcaagctggcataaacccaattctgcatgagaagaccctgatttcctttagctccagattacaagataatgtagatttgatataaaatacttggtaattcaatgtgaagtcaatttgagacaggaaaagtgaggttaatataaggttgaaaagacatgggataagtcttaaaagggcactcatggaatgtatcagaagatgaagacagagcaaatgcagatctcattgagaaaaaaatgtaagtgagaaaagatatatcaataccttgcttgcgttggaggtacaaagaaaaagaagtctacaacagatgtgctgaagctcagaaaatggcactacaaagtgtggcactttgacatgctaagtactttgaactaaagaagcagcctcaaaacgaagatctttctgaacttgtcttaccaccccgtctctctaccctgtttctcccctaaaactctcagagaggctttctgtgaactttcccttatctgactaagggaagttcctccagaagcaatgcaattgttatgaaccccttccctggaatccacattaaccagagaagattatctcatgtagcaagagaggagactaaaggtctttctgtccaggataccatatctacagaggctttacatccatttttctgagagttcatcagaccatgtctgtgcaaaaaccgggacaattccagtgtacactaggaaaaagttattcagcttatttcagctttgcaagaaacttctcatcaaagaaacacacaggcttcttggaaatcagtgtgggaaagacaatgaagagccaaagaga

SEQ ID NO: 6122 - DNA, 1081 bp, Homo sapiens
gatttagttcactgttacagtaaaagtagtgtctggagtgatggatatcatgaataatttagagtggtgatactgtactgaaatcaggttgttatatgaatatctgaataatgtgtgttgaggtttcctagtttctcagaatttagttacctaagcctaaactgttagggaaaaaataaaaaaaaaatctttctcctggaaatttgaacagaccaaaataaaagggataaagatactaacaatgggggaatccaatgaagcttacgtaggtctttgtcccaagcctccagataagacgtcattgtcttaagaaatttatactggcctgtgacatcctgagtataaagcctagttgagctgcctgacctcatggaactattgttttaagccactatgtgacaatctgttaagtggtgatacaaaagtcattcatgaaaggtcataaaatgatttcctccagtatccttccttagaaagtttctgaaaactgtgcactacctaaacgaggctgaaccagattcaggtttcaacaaggttgaagtcaagaaagtaatgtacaaaaggtgcataaaataagagattcaagacaaaaggcaacagaaggaaatagccaagataataagtgaagagagatgacaggtaacaactgtgtaccagactggagcagaagagaaggccccaggaaaactttcctcagttagattgatttgatagaataattcatgaatgaagacattggggaaagatttagacaattgttagaatgtttagcattaaataagtgaaaaatacatcaaaaactaagcaaccttccttctctgcatccctaaaaataagataattattaactccagaggaaaaaaaaattgaagcaggaagttttttcaatggccatagtaaaatagatggttcagcttgagtaatgttttcatacttacaacatgaatactgaaatcaacaaaaatcaaaattacaatttaactagactagatatacgggaaaaagggaggctacatgtgttggggtggtttaggggcttgaaaagggttgaaaaagacctaccttctaatattctctggta

SEQ ID NO: 6123 - DNA, 1043 bp, Homo sapiens
ctttctagtttttgatttaaagtgagatatgtggtgactcctctttccacttgaaaacttagaggccattgtaggattatgaattggcttaattttaatattgttgtgtcacaggaaataaggaggcccaaggagagggagagtgatgagggaatggctggtgagtgaagtagtcaaaacacacacaaccacaggatttatccattaagtttgcttctttataatgtcgtgattcatggcatcccaaaacacttacaataataaaaaaaatcactgatcacgtatcaccatagcaaatataataataatgaaaacgtttgaaatattgcaagaattacaaaaatgtgacaatcagaaatgaagtgagcatgtgctgttggaaaaatagcttcctatggattggcttatttgaataattttccaggctccaaagcatagggctattcctagttgtctgaaacctggccccagagtgatttgggttggagcatagtggccacgaaggtgagagctctttaatggaaatggtgggggtatggacttcattagctgctaaaaagaactgaatcacctgtagctagagactcaacattgggtcaagataccatttagttgaaacacaaaccaaaaagctccattacagtccttatccaggtctgttaaatcagaacctgtgttttgaaaatacctccagaagatgccaatgcacgttcagatttgggaagcactgctttaaacaatgctttttcaagagcagttgaaacattacaaatgtttaattcagaaaagaagaaattttagatggatatggaaagtgagtcaaaatatatttttagggactttgggtgggtctaaatatatgagggctctcataagacatttgatcccataggaaagaataagaaatatcaattacaagttcaaaaacatagattttgttaaaataagatcctggtaaagtgactacattatttgaggatcatctttatggaagaattatataaccttattctgtttgacttagccatgaacactcaacttgt

SEQ ID NO: 6124 - DNA, 1057 bp, Homo sapiens
gtaagatgcacacaatgtgagcaaatgtgaatcaactcactgaaagcagttgttttgagtctctcaataaaatgtacgtctgttggcatctcattgaatctaggcccagttcacttctctgaaaagatagctaattagtctaagtatgatagatatagatacacgccacctgtcaggaaagaactgccatgctgcaggaatgtgatcagcagacagccatcaacattcagctcctttataatcagcctctgcttcagaaagtagccttgccagaggtcatgattttccctgggcagcccacattggataaataaaaggctgggacataaaggtacagtcatttcagctcaaaataggacaactagacaggtaatacttgctcctgatctcttccctcacattggctgaatgtttgacagacatacatcagagtacgacttcttcctctaaccaatctttctttctttacctttcacaggtattaatccctaataaatactttgcacccaaaacttcatcttagtgtatggtgctggagctttccgaactgtgacatcaactaatttcttctaaagtgttattagcaaatagcagcttaatgtgccacacctctgagtacactgtagtttaagaagagacccctgaaaacacaatgcctttatccaaaaatagtcattctaaaatgctaggattcttgtaacttggtaggctagaaatttacataatgcttagagagcaaaaaaaaaaccttcctaaagtaattttaatgtatctcattaaaaggctacttattgttcattaaccatttaccaacacagctagaaaaaaaaagccacagttaattctactaaaaatggataatttcacttttgatagtatacataattattttaaaactaaaaatgtttcaggcactgtattaaattctgtaaatttattttcaccaatttattcttggagcaatcccttatgtaactttatagataagaaaaccaaggctcaaaaaaggtagatagatagatgatagatagatagagagatggatagatagacagat

SEQ ID NO: 6125 - DNA, 1025 bp, Homo sapiens
ttttagtacctcattgaaatctcctagtataaaacacaccaggaaaaacaactgagaaaaattgtttaggaaagtatcataggcagtagatagtataacacacagatcactgaaagaagacaatattacaaatgggcatcataactgcctaggaaaagttacatagctgcagcacagtgagctggatgccaggctcagagcctgttgttcctgtagagctgcaaaagcagtcatagggtttgggggagctaacatagctctaatctatcgggaacaaagtggagaggaggacactggatgtgtgagggtctgagaactgtatgtgaagggtcttcatgaaaccttgagcaagggttgtgctgagcacatgcaaggtacaactaaatgaggcttactaggaagtatctgctattgggatgggattggaaatatcagagatctaattcaactgagactttgttaacatgttaacatcacagacatctaaatgaaataccagaaggctgtaccttagaagtatgaaccacaccctacaatagggcctactctagatcctccttaaacacacacacacccatacacacacacacacacacacacacacacacacacacttatggaagaaaaaaaaaaacttctggtaaaatgttatggggagaaaatggttgggaatcctctaaagttaaaggatattagagaaaacactatttctacacttctaccctttaaaaagctcaaagacaaggctacacaagtttaaggcgacatgccaaaaactgaaatacctattaaagcaaaaataaatgtacttcagagaaagttactagaatctagaatctccacaaatcaagaatgcccaatataccataaaatatggcaagacatgcaaataaacaggaaaatgtgacactcatcaagaacaaaagcagtcaacagaaatggaccctaagatatctgaaatatatttagctgataaagatctaaaaacgtgttataaaaaggtttaaagaagtaaaaaaaaataa

SEQ ID NO: 6126 - DNA, 1008 bp, Homo sapiens
gctatatttttatataaattacttgtgcctttagagcctgtttgtgcccagtcataatataatacttcctcgatgatgcatcactactgtgaaagtccaactttaaggcttggtgggccaggtaacacccagctcatcatgggcagcttaggttaatggtaacttggctgcccatgattaagcattcagttctctatgaaggctgagtaaagagttgttccttaaaaggagtagttatttgcagaggatggcaagagctttgttccaaaatccaaatggcctgcactaccattcatctatgagggcctgctaaaggctccaaacagaatccctatctgccactgacacttcaagcaccattggatctgctgaatcatatggcccaagaggtagagcagcttgcacagcagtctggacctgttgcagagccttctgctgttctgggctccactcaaaactagcagcttttcaggtcacttggcactgtcacactcggaaataatgtataataggcaaaacaagaaaaaatgtttagccaaatatcttggcatcagtgacacaggccacttcacatgtaaaattagctgacacaattgtgctgaattaaaatggcttaattggaataggaatgataagagtgttaactaactcatagctctatgtgtcttttgaatatagctgtctatctttatatccatccaccaatttatctatctaagagataacatacgtgtaaaactaacattgtgaatcatgactcagttgaataagaacactacaaataactttaaaaactcaaatgcctttgaaaccttctgtcttcccttcaataacaaacttctaaattttgtttttatcattctcctgttttcaaaatagttttactgaaaataaatgtgttttgaataggatactgttatactttgtatgttttcaattttatattaatgatatactacatgaattattctcatgtgcctttttcactcaaaattgtttcttgacatt

SEQ ID NO: 6127 - DNA, 1035 bp, Homo sapiens
tttatactttggtgatttggttgtttagaatgacccacaaacatagtgttgaagtggaaggctgagatgtgcctagtagagagtatatgtttgttagatagataagattcattcaggtgtgacacatagtgccgttggccatcagttcaatattaatgaactctctctctctctacatatatatatatacatatatatatatatacatatatacatatatatatatatatacatatatatatatatacatatatacatatatatatatatatacatatatatatatataatttttttttttttttgagacagagtctcgctctgtcatccaggctggaatgcagtggcacgatctcggctcattgcaacctctgcttcccgggttcaagtgattctcatgcctcagcctcctgagtacccggaactacaggcacctgccaccacacctggctaatttttgtatttttagtagacctggggttttgccttattggccaggctggtcttgaactcttgaccttgtgatccacccatcttggcctcccaaagtgctgggattacaggtgtgggccaccgtgactggccaacattatgtattttaaaagatgtcttcaaatagaaacacacataaaataaggccatttatgaatcagttgaaaataaatataaaatctggttatatgaaaatataaccagagctctcagggccctaaccctgtgtttcccttaggaacaatggtttagtatttgcaaattcagtgtttgcagcaactttatatttcctaactaccatgaataataaaaaatgactctaaatagaatcatgtgtcacttaacaatgaggttactttctgagaaatatgtccttaggtgatttcatcactgggtaaacatcacagagtgcacttacacaagcctagatggtatggcctcctacacacctaggctatgtggtataacctattacttctaggctgcaaacctgtacagcatgttactctacttcacactgtaggcaattgtaacaaaatagta

SEQ ID NO: 6128 - DNA, 1064 bp, Homo sapiens
tgagttcttgtcttaattattgagttttaagatttctttatggcttctacttacgagttctttatcaggtatataatttgcagatgttttctttattttataaattgttttttaaattaatgttcttcaaagcaaatgtttttagttttgatgaagttcaatttgtttttgtcttttgtttgttccatgtgcttttatgtcatatctaagaattcatttccttacccatggtcatgaaggtgtaatcccatatgttcctttaataattttatagttttacaacttattttatgtatttgaccaattttaaattgacttttgtttatgatgagagagagacattcatatttattcttttgcatttggacatcccattgcacaagtattatttgttgaaaagattatttttctaccattggatggtcttgacattcttgttaaaaatcgaataattggcttgtaaaaactatacattatttaatgtatacaacttgttgagtttggggataagtatacactacaaaaccatcaccattacgaccatgaacatgtccatcttctttctaacttttcttctacctctgtgtgtggtaagaaaacttaacatgagatctacttttctcttctacttttcttcttttctgtttatgccctaaagtttactgtcttagtgatagcagcttaaaataagtaaatatttggtaggatgagttccctaccttgacaatattgtcttattgccttagacatttttgccttttctatttcttattaattcttatactcacctttaacttttgaagtctcattttctctctctcttttctctccctcttcccccacaccatcttcctctctctttctctcaaacacacacacacacacacacacacacacacacacaacacaagcacacagtcacaaagtttctgatagcttttataataaagatgcataataatctggatgaaatgttcacttcgcaaaatagaaataatccattcataaacattgtatacaccaccaattatttaggtcttattttatggttctcaatgattttt

SEQ ID NO: 6129 - DNA, 1051 bp, Homo sapiens
tttttgctaagagaactggataataaacactatggaatcagaaacatctaaaaatttttttaaaaattaataaaatttagtacagtgagcacaaaataaaagtaattctgtgacagcgactttagcaggagacatgagtccagtaagcaaatctgactgatttgttgaagcattctgcctgcaggtcagtgttgccttgcttgttgaaaagcccactttaacccccaactcactgaagggtacgttacagcctgcttcatgaaatgtaaagttttcaggtatggatgtttggcattttcacaaatgagaaatttgaaatgtttacaaataaaatatgctccaaatgacaaattcacttacaggagggttagaaagcatcctattttgacagctaattttactctgcttactataaggaaattttcctggaaaatcagaatctttggagcaatatctaagttcaaatcttatatactgtgtccattatcaatataagcttggaaaattaaacacctctgaatcaagtttcctcatttgtaaactaaagactgtttacttagttatgataagtgaaagacatcaaatacctcagtgctcagttagtaataaattactttctcacattcctttcaatggggacaggatattattccatgggccttatgggtaaacaattatcttacatatgtaaccagctcttagtataatggagccaggagagaatcctcctaatatatgtacttcacaattttttcctctggctacttgttttaaatgagaataaaattaagtaaaatagcctaacaattcaaaactagaccagcaataatgtatttttaaaccctggaaaatttacttattcatcttgaactccaaatttctcactgagataatatgttgtttaaacaaaaatgtctgtaagagtccataaagtgacagaatgagtgaatgtgcaaagaaactattccaagaaccaggaaaatacaagaagagttaataataacccaagcaattaaaatgatgcatatcaggtactggggatgctttagtg

SEQ ID NO: 6130 - DNA, 1033 bp, Homo sapiens
agagcaatgggagatggatattcttctcattccacctccttctagccttcctatctcatctaagtgcaggggtgggatgaaaaactatagaagaagaaacgcttgtagtggtcacagattagagacatagagccactaaaagactgagactgaacagaaatattacagaagcttccaactcccacactttattatcacacccaccaggctccaataaaataatagtggattataactgaaacaagtgaaagacacagactatctcttaggagtagtatttattggagacgaaggtcaagacaaaatcaagtacaacagaaaaatatgaagcttctgggaggcacagctgctgcaaagatgaaacatggcgcaactcttagccacattagaggaaaaaataataacacagtgggaaaagacaaaggaagcactgaaacagatccaggtatgacacagatgttgcaattatcacacgggaatgctgtaatggaagagtaggcaacttgtaggaacagatgtgtagtgttattagagagattaaaattctaagaaagaatcaaaaggaaatgctagaaataaaaatggagaagttctgtgttaaattaagtttagcctaaagctgcttcttcacatattttaagtttggcataaaagtttctctgtacatagggaactaaaacctaactggatatgtaaacagactgtaacctactcttgggccagtcgccaagtcttggccaatcaaaagtggccaactgttcaaaccatattcagataaggcaaatgccaagatgtaaccaatccagctgtttttgtacctcacttgttttctgtgtcactttcttttctctgtccataaatctttctctaccacatggctgagctgaatctctctgagcctactctagtacaggaggctgcccaacttgcaaatcattctttgttcaattaaactctgttacatttatttgtctaaggtttttcttttaacatctgtgataagctcatcaatagactggacatgactaatgaa

SEQ ID NO: 6131 - DNA, 1030 bp, Homo sapiens
aaaagaattccaaacctgcatctctacaaaaacattaaggaattttaattaacaatttgcttacacatttgtataactttctttctttgttttaaactacacagttatgccacagcatctaaccctccaagtcctcaatattttcttccttctcaccccaatctttgtagcatttctctgcactttcatctccctataccctattctcttgactctcttagctctttctttaattcttcttggtgaaagtcaccctcccgccccgtcttcttaagaagcaataactaccctttcttataagcctcccacttctcatctgagggtctatcattagtggaatctgctgtcttctgcggttaattttatctctgttttctccaatatcaaaaaaattttttaccgtgaatagaagtcttgggaaaactctctacaccagccttttgagtctacatctctctactaatccctcttctacattactgaaaaataaaacttaaaaataaaaacaaagagaccgaaaatcaacttccaaatttttgccagcataagtaggtgaggctcataacattttaagagttactttttttgtgtggataaaaattatatcggttagtttatggttaagagaagcagcacttcagagatttcaaaaaggaaggttttcatttatttaggatgtatggtgttatctatctattatctgtctatctacctatctaatctatctatcatctatttatttggtaacatggaaataaggacttgcaaaacaattggaaggtctagaggaaaaatggttaagaaaggctgccattagacctcagttcttgcctttagctctgcaatgactgaagaagcccacgtttctataaatcccttgttgtctcccacacagaaacaggttgtttctaaagaagactgatgaggaatctttaatttgctgaagcccactctcctgctccctcttcttgagaagtaataagtatcctttcttatctcataagcctcccacttctcatgcaagggtcca

SEQ ID NO: 6132 - DNA, 1707 bp, Homo sapiens
tgtaggtcaactttcatgtttctaactgtccaacagtttctaatatataatacaacatgtttgtaatatataaccatatattatatataaggttatacatagatatataatgttatatatctcattgtaaatatatataatatagtatatatcatatataaataaacgtaagcttagcattaattaattttggtctttttttgcattatgccatcatgtgtctgctggaattcacaaatcttcaaattggttttattagaacatattcttttgctatcaatttgctaaaacatagctgggaacaatatcagtaactatcactgaatggaatgtgaaatctttatcccatgggaaagcactattggctgaaataggctcatcattcctattttctgaggaaaataatgagaagaaatatatgtcaaccgcttatggggttttctgaattcttctattagaaaatacttagtgaacaaatgagccactcgtcagagatggctaagggtaaattttacaaagcaggggattgtctacatgagagtgactagaattcctactggccatggactgtgttttgaagaaacgtctttgaagttagaagctgaagatgctgtttgcaaacattaatatagttcagattttggtaaataaatgatctctggttctcttttttttttccctttgtattttgaagatgttttatgtactgtgtttacaactatggggacttcacttacattaatgaataggtgaaaccaaataatactgacatcactctgacactgattgtcagtgactgtgctggcaaacacttttctgacttctctaaattatctataataccatttgctcttctattggttacataactgcatggaagaaaaatcttctcagtgtctaattgcactagtttactgtaaattactcttatgaaaatattcccatgtatttgcctgtgcaactatgcatgtaattgcattttggcaagagtgcaaaactatatcctttttgaaaatgcaacctaaggggtgcttcaaagaactatgatattttcagcttgactcttagttgaaatttcttctgtactcataaaaccgacaagttgacagccttgtcatctgagcttttccagccacaagacaggtacaaaacagatgcttctgggtttttttctgacattgaacctttgcggacatgccacatttaacaataaagagaaatttcttgtaagccccttaagcatgccctgctgtgggcatgctcatgtacctctcaaagcccattaaccaagtcatatgcaaatatattccaaaaagcactgtttctattataaaatggatgtgaatttgaggtttggggaaataatggaagaaaactgagctgaaagattgctgtctgcatctacttatcaataacctatcaaaatgtggcaacctgagcaatcaactcattcatgagtgaatggcagctatctagagttttaagtcataactgttgaaaaggaaattttctgaaagagatttggtaaatatatagtccccttgagagtgctgaaaaattgtttttattacactatcgtattataaatatgccctacaagttatttctcagaatgtgaagtgattttttatgtgaatggttggagctttctatgatctttgttttcccagatagtcattattgaggattttacaactttagacaaag

SEQ ID NO: 6133 - DNA, 1043 bp, Homo sapiens
caaatatattgtttattcaatattttattataaatgatattgtttgtgtaaatttagttttctgtttgagttgccagtatgcaaatcaatttatcttttctatattaacttttattcagttgccttttaaaatttactcattagtttaatagtttgtttttatttatgttcctttgaattttcagtgcacacaatgatggcatttgcaaataaggacaattttataactttttccatttttaaaaatatttattatgccattgaccagaacttcctgtgaaataaaataaataggtgtgaaaatttttatttgtgtctgattttggggtgaatattcaatatttcacaaatacatttgatagtagatggaggcttctttagatattctatagcatattttattttccaaagaaagctataacaatatctattgtattacatgctttctagagtcaaattctgccctctcccctaccccgcccccaccaccaaatttggtctgggtctgggtttggtatttgcttgaacagtagaacgtggtagaagtgatgtttggggacattagagattgtgcagcttctgcctgaatttcgtggagtgcctacattccagatactttctctcagaacccatccaccatggtgtaagaaatccaagctacatggctaggctgtgtaaaggtactacaattgacagcaccaactgagttttcagtcaacagccagaattaactgccagtcatgaaacatggccactttgaacataatcgagagccctcagatgactaatagcaaccacataaaagacattaagttaagaactgtctagatgaggccatgaaaataatatgagataactaggacatcagctttaatagacttaggctactctttaaatatttactttgctgcgagtttttattttaaaagagagatacattttactaaatgtattttattcatccattgattttttaaattttattcctttgttaagataaagaattatattgattgacttcaggtcctttctctttccagatg

SEQ ID NO: 6134 - DNA, 1025 bp, Homo sapiens
aataataatatttaaaaatacatgtaaataatgagttatgtatccttctgaaaagcttcctgaataactacagttagcatcattttggagagatctttacagctttctgaagactacaaggtctactggtggcattttcttaaacacttaaaggtttcttataaccatcccctatggggcaagtcaccatgttttcataagggaagcaggccaatgtcaggccttcccacaagaagtataataactggggtatacatggtgtctttagtatttagttattatttataattattgggacctatctggtgatacatatatcagttagactgcaaatttatagtgactcctaaggaacctctcatggggcttcctgtgcatatggtaaaccttagagttcctcttctgttgtccatttccctgcaaattcaggtaacatctggtccacatcacatcactctgtggggatttgcccttgtggaactaaagtgagatgctgctcgatctgctcttttgaatgtgtgtaatgaatggtctctttttctgacccagaggtcttgtgtattctgccagtatatggactcattagtgtgcaaataaaataaaatgttagccccttcacagtttcttacttaacaaaagtttgttgggatttaggaaatttgggtaattgttttcatcaaatttggaaatttttaaaacattatttcatctatagttttttatgtcccctcctctcttttcttctgggatttcaatcgcatttatattcagccacttcaacctgtaccacagctcattgatgttatacttgtttaatcatcatcattattattatcattatcttttccttctttgtttcattcctattgctatgtctttaaatttataaatctcttttttgaaatatctaatctgaaataaatcttatccaatatattgttataatttttattgttatggtttctttctaatttgtcttgagatctctctgtcaagagtgaccataagcaaagataaaattctct

SEQ ID NO: 6135 - DNA, 1035 bp, Homo sapiens
aaaacatacattcacaaattaaaaaatatatatgagtcatacaaaggatgttatcagtagaattaaactagaaatcagtagtggaaacatgcctgagaaatccctaaatatttcgaaattaaacaacactcattcaaactatgggtaaaagaagtctcaagataaatttttttaaaatttgaactaaaaattataataaaattcgtcaaaatttgtgggaaagaaatgctaagagaatgcaaaggcaatagccaaagtttttacattagaaaactggcaaaagaagagcacatgaaatttaaatcaagaagaaggaaataaataataaaaactagagcagaaatcagtgaaattataaaaaggaaaacaatagaaaaaaactagtgaaatcttatccagttacatggaaaaatcaatataattgataaacctttagctgggttgtatcagggcagtctctcactgctaaaagaaatccttgagactgggtaatttacaaacaaaggaggtttaactggctcatggttctgcaggctgtacaggagacatgatggtggcatctgcttggcttctggggaggcctcagcaaagttataatcatggcggaaggcagaggaaggtggcacttcacatggatggagcaggagaaaggagggggggacggtgccacacacttttaaacaaccagatctcatgataaatctgtcatgaaaacaggaccaaggggatggtgctaaaccattcatgaaggatccactcccatgatctgattacctcttaccaggtcccacctccaacactggggattacaattcaccatgagatttggtggggacacagatccaaaccatatcatgcattaacgaagaaataagagaagagacaaaaattacaaatatctgaaatgcattggggtcatcaccatgattctcatagacattaaaataataagaaacactgtgaacaagtcaatgtccacagatttgataatatacatgaaatgaccaatttcttgtaagacataaactaccataa

SEQ ID NO: 6136 - DNA, 1033 bp, Homo sapiens
gtttgatttgtgtgatgattttcttatagttagacaaaaattatgtgtcttaggaaggccacagaggtaaaatgttatttgcatcacatcatgtcaagggtacatgctatcaatatgaattattactggtatgttaaccttgttcacttggtggaggtagtatttgtccattttctctaccctaatgttactcattttttttcctcttttcatattgtagtcactagaagaaaatcactatgtgaatcccacacttcaggagtggagagttacattttacctccttgaaactgaagaatctacatcaaatttttctgtatgggagacttgtctattctctcttatttatttatttatttaatccttcatgtatagcagtatgaactcacagatatttattttatactttgttataatacaatactatgttacttattttgttgctcaaattcttccagcttcagctattagggtctcttacacttggctcctatgccccattgactgacccccataatttcatttttttgagcactttcttacttcatggcactttaaggtactccatgctcattttgtttatttcccacctcacgccagccctagaatcaatcatttctctgaggagattgggttccttttattggagaaggtattagaaaagaagatatgggtgaagggtgtgtttgttgtgactagtgtgtcattgcttctagtccctctcagaggacagaaaaagaaaatatatagttacatatgagcctgtgtgtacacatgtatttatgaattttttatatgttttcaactgtatatataaaaaagctgaccttgtgttcatgctgatgtctccaactctaatccattatcatgtttcattctagccttcagcccttgcttgtctgtcaccttccactccaatatgactgtcaccattcaccatccatttacttaaattccagaatacatgtgtgatttcagagctgttaacctatatccccatggtcagagtactttatcaactagagtacagtgc

SEQ ID NO: 6137 - DNA, 1029 bp, Homo sapiens
gccctccgttcagccgcgctcctccggggctgcggttcctactgcgcgagctgccagtggattcgctcttttcctccgtccgtggcccgcctgggcggccttgttctttccgcagcagccaggtcgggagactctcgcagtcgctttaaaataagtttctctccccctcttactcttttagcatattgcttttgttagagctttttttttctttttctttattttttattttcattgcttttctcctctaccccccagcacacttaagtctgcaactttttggctgtcccgttggtctgcgttttcaattgctttttgcaaacttgacacctgtgcagtttgctttttttggtctatatttttatgactgaaattacaatttttgaaagaggaaagctgtttctatagtcacagcttgcaaaatttaaagaacgtggctgttcctgaagacattaccattctgtaatgcagttaggagtgggtatgggagagagagtacttttagagctgttcatattacttttattctaatcttgctcttgtgcggtaatggtgtttgggctaaacatgctttttttgtatgtatgtagtattgagacacaaacttaacacttctagcataatgaagcagatatgttgcagttgtcatgttcttgaaggtttctttttttttttttttttttttttgagacggagtctcgctctgtcgctaggctggagtgcagtggcgcgatctcggctcagtgcaacctccgcctcccgcgttcaaccgattctccttcagcctgccgagtagctgggactacagacacccgccaccacgcccagctaatttttgtgtttttagcagagacggggtttcaccatgttggccaggatggtcttgatttcttgacttcgtgatccgtccgcctcggccgcccaaagtgctgggattacaggcgtgagccaccgcgcccggtcaggtttcttatttttgatctgaggagtttctatccttgataggtgttcatctttatcaatatttgg

SEQ ID NO: 6138 - DNA, 1038 bp, Homo sapiens
ccaaagtgctgggattacaggcatgtgccaccttgccccacctcacttgtcccctttttgtgtagtgttcttcatccggttagaatatcttcctccctcacttcatattccttgttttttcactttattgtacacttaccacttcttgaaaagctctgtatcttactttttaaattgtgttgtttcctggtctagaatataagttctacgggagcaggaatttttgactgacttgtatactcctgtcttttcagtgcctaaaaaagtgcctggcacatagtttgtgctcaataaatatttaataaatatgtgaatgaaatgggaaagtatttcgatgtagaaagcattatcagttttttataccaaaggtataaccatcttgaaagtggatctttttgtgttctcactcttacaaatggcttgattatttaaacatagtgaagatcagtttctctttggtgtctgtaatttatttatttatttatttttgttttctcaagcctagggagctggtttgagcaatctcagggtaaaagaaaatgattagttctcagaacatcaacattgtatgtattatcttggaagatgggttaagatcaaattgaaaaattaccggaaaaaaattaagatggcagttatgtatagattttcatttctttttcctgtgtggttttaatgataagtagtacaggcttttaggactggtacgatttttctatgtcgtagaacccttttgtaaatacttttggtattatggtgtgtgtttctagatattaaccataagaacttaattctggttgttaattaattagactcttgaaatatatacttacagctgaagggggtcttcccaactcttcattagatcttcctaatctcattgggatatagcattaattctgagtgtaccgagaatgaaataccattaaattgcattttcttactttgcaaaaaaccctcacagaatgctaactcattacttcagaaaataaatgagattttgaattacttgataagttgactttaagccttttcccc

SEQ ID NO: 6139 - DNA, 1029 bp, Homo sapiens
acaaaaaaaaaaagaaaaaattcttccctacttaaaataatttgttgaaatggtttattttcttctcaagttgcatttgctttaatttgttggctaaatgcttaaaaggcttaaaattggcctgacttaaaaattccttatctgtgttaaagatggaatatgaggtatgtttaattttactcagttatttgggagttttatttctgaaataagggtagggttgtatttttatttcttaaaagaagtttcagactaaaattttctttctcaactcttacctaattatatggtaagagagctagctagttcctataaaggtagaagatttaattttacaaattatgccatgcacattttaggtgtctgtttcatgtggaatacctgacttcaggtcaagggatggtatttatgctcgccttgctgtagacttcccagatcttccagatcctcaagcgatgtttgatattgaatatttcagaaaagatccaagaccattcttcaagtttgcaaaggtactatgaactcttctggttgtttctttggccttctctcatgaaaaagtattttgttcacatacagccaccttaaggttatcgttcattgtttagtaaagtgaatgctgctactgtggcggagtaagatcactcattatggctagaattcctttattcctagaggaggactattatctacttcattttaggagtgagcttattttcaaagagatagttcatatttttaaaatttgcactgcagcgatggtcgttattctgcctgggcttttttaagaggtttgcacaccatataaaagtaacataacttgtgatttttaatattttattagagattgtaaaggttataacatcactttggtgtttcgtagtcaagttttaacataaggatgtgcctgaaaaatcatttgtaattagagaatgggaagattcttgggttgcatttttgtcagcaaattgcagaggatcattattctgctctagagttgcaccgtccagttcagaagccactagccac

SEQ ID NO: 6140 - DNA, 1048 bp, Homo sapiens
ataggaatgtgaaatgggcatgtttcaagtaggtcgtctgggcccagtgaactataattgttgctttttgaactttcggggtgggggtgggtgatgtagcaattgttttgcgtagtttggcgtatatatgttagaatttgtttttaagttttacttttgggaaacagttaaaacaacccagtgatggtagatgtgtgtgtattgaaattgagctttcgatgttaaatcttccaagagttgtattttgtgcagtttttttttccgatggcattaaggctctagaagtaaaatacttcaaaatacggttatggtttattttcttttggtagctaggcatgttttttctttagtgtaggagtatagtacactgtaatcgtattttaaacaagggaataagcctactaaacataaaaacaaattgtaaacccagtcacgtggtggtggtgtgattcggatgagggtcctgagaactggatccgtaattttcattgaagacagtacaaaagggaggagaaaggcctgagagtaagaatttctgataattcatgtaaaactttataagaatattgttacctacttttccagctctaaaaacaaaaacttattattattgaagatgttcagtgatgctttctcaagattgccaaggaaaagtttacgaaaatcttaccttgaaacagtaggtttgagtgaccctttgaagagatagtccagactgtcctgtaaagttatatatgatataacaaatagctttactaattggattggactacacatcttttttctgtcctcttttcatttgtgccgttatctggaaatccatctaattgcctttttaaaataatgttatctttgatttccttgttttggtaaactgactgaactgcagtagataaaaacctggttctagtgaactaacattttagagaccttacctccttaagctattaggggtgtgtctagttttttgtttttgtaaagagcaagcccattgggaaggaatgatgtaaattttctgttaaacttaaatcatcagcactttttccaa

SEQ ID NO: 6141 - DNA, 2259 bp, Homo sapiens
atttatttgtgtgcataacaagtagttgtaatgtcagttaaaagtttgtattcccattttggttttctatgtctagagtggcacctagggctgaaggtgattgacactagaggtacttaactacttccagagaatttctacattagcttattttaagtgcatgaattctagggaaaaatattttaccctttgcagatgccacccctaagagatgcaccaacaaatagatgacatgaaattaagcattagtgaatgctgttgatacgaaatatgatcttcaaacataaaggaatcaaatgaacaaactttgtttacaggggaggaggtggtgagggaaaggtttgaaatactcaggtgagtaggattcctacagctgcatagtgagatttgtaaggttctggtaagtttctgcagctgaaggacttctgcattcacctcttttgtaaatattatggaattttaaaaggaaggatggttgcctctggggaagggaactgggaactgaggttattttggaggggaaggggggcttctagatgtaccttttatgctttattaaaaagtatattacctattaaagtttgtttaaatctatttgattaaaaatttgagtaaactggtttctaaacactgtctccagtggcttcaaaaacacaggtactgttggaaggcattcacttttgagtggcctttgacctcagttttaatctgattaattcagtcattttataatcttgctcttggtgagtttaaactagatttggctaaaatagaggtgggagtgttggcccttcaaagacagtttgatgtgttcaaaattgtagtgcatttaaaagggttagacttctgtgatatttgtccaacgtcaatcagtactcattgcatttttttacttaggctcttgatgttagtggatactggtattatatgcaacttctgaataagttttaaagaatttgaataatcagttgaataaaaacctgaaaagtggtgaatgaaaatttgagagataaggaaaggctagagttggcattcaggggacacaaatagtttgaagactctggtagtagaattatgcaagttttcttaaaattaggcaatatataatattgatactacgaaattcagtacttttccgtaggagggggtcaggtctcattgccttttccgtaccccaaaatatgaaaggtggtctacaattttgttgtggcattgtcacagcagttggccccatgttacatttcctcttgtggcacctctgagaggtgtttcttcattacctcttgacaagagtatattttgattgactgctctatgtgcttgtttattttttatagcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctagttaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtggggatggagagtttgggatggtgttaaatttttatttttgggggttgtgggtcactattgcttaaatgggggggtagccataacatttttctggggtagtttaaaagaattgataattatc

SEQ ID NO: 6142 - DNA, 1287 bp, Homo sapiens
ctagatatagaaaaacttactgcattttgcccagtatctaatttacactaatacatttatgctgaaacctgtaccttaaaacatttttaaataggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaattaagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaccacaaaatgtttttgtaaactaaattataaaatttatctctggaaagtgtgtagtcatgtgtttctccttaaattacacaggttatggaggttttgatgactatggtggctataataattacggctatgggaatgatggctttgatgacagaatgagagatggaagaggtaaaataaatattaaagacatttttattcataggtaaattttagtatttgctttgcaagctcttagtggtaatataggaaacttgtataaagttaattcagacaaatttcagtgcattcctatatagagctttataccttgtatagtatgtatgtatacttccctacttgtatctgtaatagtttataatcttggcaaattgtgttttccaggtatgggaggacatggctatggtggagctggtgatgcaagttcaggttttcatggtggtcatttcgtacatatgagagggttgccttttcgtgcaactgaaaatgacattgctaatgtgagtaatttttaataactattagtggttttatacttatcctggtgtctaaatctttaagcattcttaatgttctcatgtttatagcttaataccaaaatcccttgaatataaaaatagatctacctttaattcttttt

SEQ ID NO: 6143 - DNA, 2343 bp, Homo sapiens
tgacagtctcccactctgtctctctgaggctggagtgcagtggcgtgatctctgcttactgcagctcccacctcctgcgttcaagcgattctctgtctcagccttctgagtagctgggattacaggcgtgagccactgcgccctgcctatctgcttattttaaaagcagtaaattctttacattatccctaagtgtatactctgatattcacagaacctctgtagttgactaagttattagtctgacagggcagtggaagggtttgttttaattgatgaggaaaaatcaaggtatgtggtaatttactttaatattctcaatagaaaagtaaataagtgtttccttttatttagttcttctcaccactaaatccaatacgagttcatattgatattggagctgatggcagagccacaggagaagcagatgtagagtttgtgacacatgaagatgcagtagctgccatgtctaaagataaaaataacatgcgtaagtggtgtctttggcacacaatcttatttcctaaacgtgaatttataaaataagaggctctaagatctgtaggtaacgcttggcagttgttgggatttaaaaccatttgacctctataatggctttctgtgggctttatatatcgctgtactagtaattaataagcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatgggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatggtaagtatctctagttcagtttgtgttagtccgcatatgtagtgcaaactttaaagtgcaggtattacttttattattttatgcagatatctcctgctgagtgattcttaatatctttttcttaaggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatg

SEQ ID NO: 6144 - DNA, 1165 bp, Homo sapiens
taattaatgcaaattccactggaaaaaaaattgtaatacctacatgggctgtgtttcaggagctaaaaagttaagtagtgttaatatgatacaaattgaacgactgactgtccactattttatgtgcaggcctttccatgtgataattgtctagttccagggctgtcatttcagaattacttgacacacttgtattattttatcccttttggtggcagtgggggtggggctagcctctcttggccattgcttttctcagttttcaaacagccgtatctcattatggcatatgttacatatggcatatggaacaaatttttgctaccaactctttcaattgagggcagatgttatatgtacttaaatatgcctttaaggaatctctttgtatcactactgagacttcagtagcatactgcaccacagaactggacttggggaaaaaaaccaaaaaacaaacttttgttgtttagtagatattcgtgtataacctccaagtttgtcagtataaaggcatgtagactgattctgacccatgggtgttaatttctgaaattttgtcacagcagttcaaatcttaccctgtcatttcgtatgtgttatcttttccaggaagaaaaatttgtaaaactggccaacatcttcatctagtgtcagcataatccaagttacactgtgatgtaatattgagcaccctattatcgtgcatgtttattttgctgcagggcttaacttcagatctctttttgttggtcaggcttttggttttttattccagggtggtatttcaagaattgactatatcaaagctgcaaaagtccttttcaagtagccagccactgtgggactatgatggataatggcacaaatgttaccaggaggggtaggagaaagcatctccttttgcattattatcatactaaaataagacacaacttccaaatgaatcagactaatctaaacaattcagggcattaccttgacaatgagacccagtgctcaagacatatccagaaggtgttggctaattatcatcagcttttcatgtctgctatgagtgcaacaaaagagaaattttgctttttactgatttaattatgcaccattaacaccaagtcactgtttctaaagaaggccctgatgttctcctgcagagagagcagta

SEQ ID NO: 6145 - DNA, 1035 bp, Homo sapiens
tcacagagagcttcttatagatagtgtgggcttagtgtgctcaaagttgcactggtggatgtgcatatttcagagtccattggttttgttacaagtgttgcaggaagagttgagaacaccatattcattaggttttttttttctttttctttcttttttttttttttttggagacggagtctggctcagccatctaggctggagtgcggtggtgctcactgcaactactgtctcctgggttcaagcgattctcctgtctcagcctcccgagtaggtgggattacaggcacccaccatcatgcccggctaatttttgtattttagtggagacagggtttcctgttggccaggctggtctcaaacgcctgacctcaggtgatcttcctgcctcggcctcccaaagtgttaggattacaggcgtgagccactgtgcccggccaatagtttttttcttacatgaatttgttaaaaatgtgggtgaggggtgggtgagtgagaggtaatttaaaagtggaaaaacaacgcatgccggacttcacgttccaacacggaaagcatgcttttgtggcaaactgaaaggctagggattaagggtgatgaaatgcaggccttccggccctcactctgttcctgatttctggttgtgggaatctgttctgaatccagctgcaagtggaaaacccatctttggctgagcagccggggaggccctcctgccaatccccgaaatgtgctgctgaaactttggccctgcaaggctggagctagggctgtcttccccagatctgtgcagctgtcaaggtggctgtgatgggactgtgaccgccctctacactgcattttggcagtgaccttgagaccagccagctcaccacagctgccctgctctgctgccgctgttgcaatgccaggtggcttaagaggggtcgtggggggcacggctcccggtccagtctttcccagtgtctggcaggtgctagctgtggtgccagctgtcccactgcctaccacccactgggcgtgggggcagtccag

SEQ ID NO: 6146 - DNA, 1060 bp, Homo sapiens
tgattcttttccaaagaaaaagtccttaatgtgtaagtagtggagatcttacagccaaattatagttgtttaatctcaaattctcataatatcatctttaattttggctttcatgaagccataagaatatgcatgttttctttattttctatagtttgcctgatgagtattaatagtaacctaattcagttataagctcacagtctgtgtgatgagatttgtacagtgtttagaagggttaatttaaaagcatatggcatcactaaaagttcaaggctagctttagtctaacgaataggtgcttatgtgtttaagatttcaagtggtgtattgctattacaaatgtaagcaacctttgcaagccaccttttaaattcatgaagaaatactaagcaataaaatgacttatctttaattattttgtgtacatttaatttaaaatagttttacctaatcctagctttccttttttacacataaagttttagcactcaaagaggaacaacatgttgaactatgaatgtggcagaattttatttcatttgttgccccagtgtgtaacttgaaaatgttgacacggagaaccaaaccttgccctgctttcaaatttgcctgaccacattgagtttctgcttcctgtgtatatacagcattttcatgtacctgtttcatcaaccaacaagtatttatttaatatttaccacatagtcagcaatgtgctaggcactgtgaaatgaatgaaattgcttgacacaaattttcactgggcctggacaaatagaatcatggttattctcaaggtaaattaaacccttttctgtttttcttctttgtgttgatccatcgacccccatttattccttttccttccaacagagatagaagtttatcattaaaagctccttctatactttctgtgttggctatatccatctcaggcattttgtgaaaaatagatttagtcttcctcttaaaaatggctctcatttgttggggttgtggatggggattagcaggagaaagggatagattatgtggagaaactaatacagaccaagcc

SEQ ID NO: 6147 - DNA, 1050 bp, Homo sapiens
ctccatgagtagctcgggaggtggggggggtggggagagagggagagagagagagagagagggagggaggggagaaaggaaggaaggaaggaagaaaggaagggagggaggaaggggaaaagaaaataatattatttcctcttggtatattcacttgatagccttactgagaaatataagcctatattcaacagaggcttttcattccttttgaaaatgtcacttctgttttaatttacttacaatggatgaggcatatcttgttgttgttttcttttttttttttatttgacagagtctcactctgtcacccaggctgaagtgcagtggctcgatcttggctcactgcaacctccgcctcctgggttcaagtgattctcctgtctcagcctcctgactagctgggacaacaggggcacaccaccacacccagctaatttttgtatttttggtatagacgaggtttcaccatgttggccaggctggtcttgaacttctgacctcaggtgatccaccagcctcagccttccaaagtggtgagattaccagcatgagccaccgggcccggccagtcattttgttttaatgtgatcagcaggtactaggacccaattctataatcccagcagtgtgggaggctaagtttggagaatccactgatccccggagtttgagaccagcctgggcaacatgttgggatccagtttgaaaactgaaaaataaaataaagtcctttatagtctattaatttgcttaagtttttatttgcatttattattctatatgtatgggggttttttgtttttgttttgtttaggagatagagtctcactttgtcacccaggccgtagtgcagtggcaagatctcggctcactgtagcctcacctctcaggctcaagcgatcctcccacctcagtcccccaagtagctgggactacaggtacacaccaccacgcccagctaatttttgtgtttttcatagagacgggtttacagcatgttgcccaggctggtcttgaactcttgagctcaactgatctgcccacctc

SEQ ID NO: 6148 - DNA, 1162 bp, Homo sapiens
ggttttggtgttaaaaacagttggccaggcatggtggctcatgcttgtaatcccagcaatttgggaagccaaggtgggaggattgcttgagcctaggtgtttcttgttgttgttgttgttgttgttttgagacggagtttcactcttgttgcccaggctggagttcagtggcgtgatctcggctcaaagcaacctacacctcttgggttcaagtggttctcctgcctcagcctcctgagctcaggagtttgagactagcctgggcaacgtggtgaaaccccgtatttactaaaaatacaaaaattaactgagcttggtggcttgcacctgtagttccagctactcaagaggctgaggcaggagaatctcttgaatccgggaggcggttacagtgagctgagatcgcaccattgcactccagcctgggtgacagagtgagactccatctcaaaaaaaataaataaataaaattttaaaatctggctgattaaataccagtttcccctgagtagacgatttggggtgtttcttctggttttccttctctacatctgttgcattttcaatttttttctgtagtgagactttaataaaatcaaagaaatttcaaattataatgaaaaacacaaaggctaaccttaggattaaagaactgagtgatcaacgtcatgtacattatgaaatccattccctatatctaaaagttctgtttaaacctgagccttgagggagaaaaagggtcttgggaacaggagtatgggctctaaactgagatagttatatgtttgtcttttttttatttggatatcatttgatatttataaaatgattacaaaagtagtacaaagaattctcttatactctttatccaacatccccaaatgttatcttacatagccttagtatcagtcaaaactaagatgttaacaataacacagtgctattaactatgttaaagatgtaactcaaatttggccaatattcccacgaatgtccttttttgggtgcaggattccatataggatacctatgcccttccttccttccttccttccttccttccttccttccttccttccttccttccttccctccttcctcccttccctccctccctccctccttccctctctccctcttccctctttggacaaggccttgc

SEQ ID NO: 6149 - DNA, 1009 bp, Homo sapiens
aagatgacttgatattggctaaaccctagtagaaaacaggatctggccgggcgtggtggctcatgcctgtaatcgcagcactttggaaggcctaggcgggtggatcacgatgtcagatcgagaccatcgtggctaacatggtgaaaccctgtctctactaaaaatacaaaaaaattagcggggcgtggtggcgggcgcctgtagtcctagctactcaggaggctgaggcaggagaatggcgtgaacccgggaggcggagcttgcagtgagccgagatcccgccactgcactccagcctgggtgacagagccagattccctttcaaaaaaaaaagaaagggtgcagggcgggtggagtcgcggagtagtcctcatggcctccacgccggagcccggtgagcccgaggagaggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggggggtttatcttggtgactttgggatgctggtttcactgtaggtataattatgcaaggcaaagaatccaggaaagaattgccagagaagaaattaaaaagaagatattatatgaaggtacccacctcgatcctgaaagaaaacacaacggcggcagcagcaattgaacaatcttgagcatagaaaagaagtcaatgtaaacgaagttaagatcaaccacataaaacatttcatgtgcaataagctctcaatcaagtaaataaagtttaagttgtaaaaaaaaaaaaaaaaagaaagaaaacaaaattgtcttaagaaaaccagatttgtcataggaagaatctcctgaactcttaaggagcatttaaatggtatttgaattttaaaaaaaaaaggacagatcacctgaggtcaggagttcgagagcagcttgtctaacgtggtgaa

SEQ ID NO: 6150 - DNA, 1064 bp, Homo sapiens
tggaggacaagtagaaaaatgcctatctaataggcatttttcctttaaataagtcagttcatttcaacatatactaaagtccagcaatttggctgggtctggtgtctcacacctgtaatcccagcactttgggaagctaaagtgagaggactgcttaagcccaggagtttgagaccagcctgggcaacatagcaagaccctgtctcttaacagaaacaacaacctacagtttataggaatacattgattcatttaatcctcacaatgaacttctttaatacatgttattactagctctgctccaaagtttgttgtttgattcctgccaaacccatgttcttaaaaatatataaaatagctaagatactgaaaagaataatacactaatcaccagagttggttattaaccttaagcatgggtgggggattgttcatggtaagtgtgaagaatgagaaggtagtaggttttgctttagagtcctctagggcctgggcaaggtggcatatgcctgtaatcccagccttttgggaggctgaggcaggcggatcacgtgagctcagaagtttacagaccagcctaggcaacaaaccgagactcagtctctaccaaaaacaaaacaacgaagtgaaaataaagtagagtcctctaggagtaggctcatcaaggggccaagaggtgtgagagtgaagcttcaaggaagatctacattttagagagttttaagtgaaaattctccttggaggtctacaaaccagaccattaaggggtcatggcaagttaagtctgtggtatttaagaaatgattgaatctgactgataattcaattataatttggtagaagtttaagatatttgaataaggagggaaattggtagaatgacagtttgaggcagattgggtggtcttagaaggtttttcctcctttgggaataaattatactggctcatagccccaaagaaaaaggaagatagccaggaatacttgtgaacagagagcattaactcttaggtcagtcatgatttgctacacatttggagccaatcttcaatttgcacgttaaa

SEQ ID NO: 6151 - DNA, 1052 bp, Homo sapiens
caattaacaacctgctcaacttcccctctgcccttcactccagccctgatttgaaaggatttcttgtgagttctaagaagccctggacagatgagggtggagttctcgtttggggtaggaatgagaaaattagaatatcaaagtaatcccagcactttgggaggccaaggcaggaggatatctttagcccaggaatttgacactactagcctgggcaacagagtgagaccttgtctctacaaaagcaaaagtagctgagcttcaggggatcccttgagcctgagagatcgagactgtagtgagctgtgatcctcttactgcactacagcctcggtgataaagtgaaaaggaaagaagcctggctctagtgaagagattctggaaacttctgaagcctctgctgtggctcccatccagcctagatatggaagagccatgaggccctacatcaccaaggtaaggagagtggagtctagggtcacacagtttctcagatccacttttggggcagcactttctttgaccctgactttctgtggacttcgaatctctcagctgatggctgtagtcagtagggaaacggatcagaggcaaagctccaagaatattaggtattcgacacttggtttagcagctgacttttgttttctattattttactcgttgtgtgtgtgtgtgtgtgtgtgtgtgtgagtgtgtgtgacagagtcttgctctgtcacccaggctggagtgcagtggtgcaatttcggctcactgcaacctccgccttccgggttcaagtgattctcctgcctcagcctcccaagtagctgggattacaggcacgtgccaccatgttccgctaatttttgtgtttttagtagagatgggttttcactgtgttggtcaggctggtctcgaactcctgacctctggtgattcggcctcccaaagttctgggattataggcatgattcactgctcctggccagctttctttttatccctaaaaaaagaaaaataaattgatggctgaaattctgaactagtcaaattagttcatttcactt

SEQ ID NO: 6152 - DNA, 1045 bp, Homo sapiens
ggggccgcaggtgtgcatcaccacacctgactaattttttttgtatttttggtagagactgggtttcaccatcttgctcaggctggtcttgaattcctgggctcaagcgatcctcccatcttgtcctcccaaagtgctgcgattacaggtgtgagtcactatgcctagcctagttgtcttttctttttgtatattatgtccttttggtattttatgacttcgctgaatgtgtgaaaagcaaaaataatattttaggctgtatccacaggggctttacatttagttgttattaaattttaatcttctatggctgttattcagatatttaagtagatgacataagtaatttctgtattttacaggcagattttgacaacaaaccagtaaatggccccaagtcagaatccatggactacagtagatgtggtcatggggaagaacaaaaattggaattgaacccacatactgttgaaaatgtaactaaaaatgaagacagcatgacaggcatcgaggtggagaagtggacacaaaacaagaaatcacagttaactgatcacgtgaaaggagattttagtgctaatgtcccagaagctgaaaaatcgaaaaactctgaagttgacaagaaacgaaccaaatctccaaaattgtttgtacaaaccgtaagaaatggcattaaacatgtacactgtttaccagctgaaacaaatgtttcatttaaaaaattcaatattgaagaattcggcaagacattggaaaacaattcttataaattcctaaaagacactgcaaaccataaaaacgctatgagctctgttgctactgatatgagttgtgatcatctcaaggggagaagtaacgttttagtattccagcagcctggctttaactgcagttccattccacattcttcacactccatcataaatcatcatgctagtatacacaatgaaggtgatcaaccaaaaactcctgagaatataccaagtaaagaaccaaaagatggatctcccgttcaaccaagtctcttatcgttaatgaaagatag

SEQ ID NO: 6153 - DNA, 1056 bp, Homo sapiens
ataataaaaaataaaggtgaaaaaggaagccacagaagtaattcccctagtatttgacatccagtgaaaatgactttttggtgtaggtataccatggctagaaattcatgaaacgcagaaattccccagtaattcttactacacatgagtctaaggggccaagttaaaaatagcattttttaagaaacataaaattcatgctcacaaaaattcaagtggtgcagaaatacgacgcaaacatcttcctatactcccattctatacaaaagaacattattgattttaattttgtttccatttttacaaaaatttaaaacaatctttctacttggttttttaatataatgatattgtggatgtctaaatgttttataaatattattgtttcaatagatttattgtataccactatataaacatcccataatttatttaaaccacatgttattgacagatgttgagtgttttgctctctttttgatattacaaataattgtaacaaggaacattcttttgtaattgtgcaaatgtatagtagaataaattgtctgcaatgaaattgctcaattttcccagcactttgggaggcacaaggtcaggagattgagaccatcctggctaacatggtgaaaccccgtctctactaaaaaatacaaaaaaaaaattagccgggcgtggtggcgggtgcctatagtcccagctacttgggaggctgaggcagaatggtgtgaacccgggaggcggagcttgcagtgagccgagatcgcgccactgcactccagcctgggcgacagagcaagactctgtctcaaaaaaaaaaggggattgctcaattttaataggattctaagggcaacctttaacatttattgttcttggataacttttagtattacacctcaattaatacagattttttttttaagcaggagataggagtataaatatgacccacatcttaaaatattttttttctcctctgattttcagaggaagaaagaattcgttaggggcaggaagaaaggaacattaaaagttaaatttcatgggctgttg

SEQ ID NO: 6154 - DNA, 1028 bp, Homo sapiens
tacatatttctcttgtgtatcctctaatacagttagtccaacagactaactctaattttatattgctttagtaacgatggtctccttactttgtttctctcttcccatggggatctttccagggttttcccattaagtgtgggttgtcggcccagcacggtggctcacgcctgtaatcctaacactttgggaggccgaggtgggcagatcaccagaggtcaggagttcaaaatcagcctggccaacatggtgaaaccccgtctctactaaaaatacataaattagctgggcatggtgatgggcacctgtagtcccagctacttgggaggctgaggcaggagaatcacttgaacccaggaggcagaggttgtagtgagccaagatcgggccactgcactccagcctgggcaacaagagcaaaaatgtctccaaaaaaaaaaaaaaaaaaagcatggattgtcagggaatgcctttcgggggagggaacatttaagctgagaaaggagtgacaaaaaacaaaaaagagctaagtaggcagaggataagcaggaagtagcattcctaagcagagaaaacagcaagaacaaaggtcttgggtttagaaataagagtccagtaaaaaaaatctaagcagagtcagttgaaattaaggggataggccaggcgcagtggctcacgcctgtaatcccagcactatgggaggccgagtggggcagatcaccagaggtcaggagatcgagcctatcctggctaacatggtgaaaccccgtctctactaaaaatagaaaaaattagccgggcgtggtggcgcgagcctatagtcccagctactcgggaggctgaggcaggagaattgcttgaacccccgaggtggaggttgcagtgggcctagatcgtgcctctgcactccagcctgggagacagagtgagactccgtctcaaaaaaaacaaaaatgaaaaacgaaattaaggagataattaatagaaccaggtgggggtaaaaaggtgaatgattttgtaggccatag

SEQ ID NO: 6155 - DNA, 1029 bp, Homo sapiens
ggtaataattttcttgctttccacctttccctgctacttatatatttctcaaacagtatagttttattttgttttgttcttttgtgtctggcctatccatagtaccttgtatatttgaaataaatcacacaattggttcccaatatctggcgctgatagttgttaccaatttattgagctatatctgttagctatttctgaattgttcactcctttgtctattaagtggtaaggaatgaatatgtcctcatgttgtggcagctggcttctcctacagtgagtccaaaagagagaaatgtaactaggcttattggtgggattgggatgatttctttttcctctctttaaaaccttttctaatataataataatgacagtgatataaagaattgtagtgtatagtttttttgtttttgtttttgttttccttaagaaggcaaatataaatgctgtagcttaaagatttcggtaacaactttctattagtatttttccctagcgaaattttatttgttttggatatctgtctgtgttgcctgggctagagtgcactaacccaggggactccaacccctgagccatgggccaataggaacctgacttcatggcagaaggtgagtggcaggagagcaagtgaagcttcatctgtatttacagccactcctcattgctagtattaccacctgagctctgccttctgtcagatcagcagtgggattagactctcataggactgcaaaccctgttgtcaactgtacattcaagggatgtaggttgtgctctccttatgagaatctgatgcttgatgatctgtcactgtcccacctcacccccagatgggaccgtctagttttaggaaaacaagctcagggctcccactgattctttattatgatgagttgtataattactttattatatattacaatgtaataataatagaaataaagtgcacaataaatgtaacgtactcgaatcatcccaaaacctctgcccctggccccacctctgtggaaaaattgtcttcca

SEQ ID NO: 6156 - DNA, 1050 bp, Homo sapiens
gcagtggctcaatctcggctcactgcaagctccgcctcctgggttcacaccattctcctgcctcagcctcctgagtagctgggactacaggcgcctgccaccacacctggctaattttttgtatttttagtagagacgtggtttcactgcattagccaggatggtcttgatctcctaacctcatgatctgcccacctcagcctcccaaagtgctaaaatagattttttaacagattttatgtcagaaaaatcgtaatgttagtcaaactttatttttccaaactttccaggttatcttacttaaaatattcatatcacttactgcttttgcagagagcaatgccgagcctagaattagcactcaataaatttgtgttgagtgaatgaatatggagcttaaatatggctatttagaaaatgtattttagggctgggtgaggtggctcacgcctgtaatcccagcactttgggaggtcgaggcgggtggatcacctgagctcaggaatttgagaccatcctggacaatacggtgaaactccgtctctagtaaaatacaaaaaattagccagacatggtggcacgtgcctatagtcccagctactcaggaggctgaggcacgagaatcacttgaacccaggaggcggaggttgccgtcagccaagatggtgccacggcactccagcctgtgcaacatccagagtctagctccaaaaaaaaaaaaaaaaatttcccatttgggtgcggtggctcatttctgtatatctgtaatcccagcactttgggaggctgaggcgggaggaccactggagcccagtagttggagaccagcttggacaacatagtgagactctacaaaaaaaattttttttctttttttttgagagggagcctcgctctgtcgcccaggctggagtgcagtggcgtgatctcggctcactgcaagctccacctcccaagttcacgccattctcctgcctcagcctcccgagtagctaggactacaggcgcctgccaccacaactggctaatttttcgtatttttagtagaga

SEQ ID NO: 6157 - DNA, 1060 bp, Homo sapiens
ctcagtttgtctttttcctttggctatgttatctcccacaaaaggttttgtttttgatgcaatcaaacatacccatctttttccttatttggatctggatgttgagtggtatttaggcatgtttttctatgactttaagcaaagcaacatataatgaaaccaatatttttctcatcaacgctgtagcaatattgagcgatattcggggaactgctctaggtggtttcacttataatcagtttctaacagcctgttgacatcaagtgagaaatgactatacttgtttaaaatataaatttttgaaatttaaatctctcatacatttaatgaatcactggtgaatagttgtaagaggagataagttttgttgttgttcttgttgttttgtttttttgagacggagtctcgctctgtcaccaggctggagtgcggtggcgcaatcttggctcactgcaatgtctgcctcccgggttcaagcgattctcctgcctcagcctcctgagtagctgggactacaggcatgcgctttgggaggccgacaagggaggaccacttaaggccaagagttcaaaagccagaccaggcaacatagtaagactccatctctacaaaaatatttttttaaaaaaactgtttgggaatgatggcatatgcctgtagtccttaggtaattaggaggctgaggtggaaagattgctgttgcccaggaatttgaggctgcagtgaactatgatgatgccactgaactccaacctgagcaacatggcaaaaggagagagagagagagagagagagaacttcatgggcctgatgtactggctcatgcctgatcaaagcaggaggatttcttgaaaccaagagtttgagaacctatccctacacaaaatttttaaaaccaggcatagtggtgtgtgcctgtgttcctggctactttgaaagctgaggagggaggatggcttgaggccaggagtttgccgttacagtgagctctgattttgccagtgcacttgacagagcatgatcaagtcttcccctcaccaccccccacaaaaaaaaaaca

SEQ ID NO: 6158 - DNA, 1069 bp, Homo sapiens
gggttcaagtgattcacctatcccagcctcctgagtagttgggattacaggctcccgccaccatgcctggctaatttttggtatttttagtagagacggggtttcaccatcttggccaggctggtcttgtactcctgaccctgtgatccacccacctcagcctcccaaagtgctgggattataggtgtgagccacagcacctggccttttgtgtgtgtgtgtgtgtgtgtgtgtgtgtatacacaagatatatatgtatatatatacacatatatatgtatgtatgtgtatatatatatatatatatatatatatatatattttttttttttttttttttttttttttcttctgagacggagtcttgctctgtcacccaggctggagtgcagtggcgcgatctcatctcactgcaaactccgcctcccaggttcacgccattctcctgcctcagcctcccaagtggctgggactacaagcgcccaccaccacagccggctaattttctgtatttttagtagagatggggtttcactaggatgatctcaatctcttgaccttgtgatccgcctgcctcagcctcccaaagtgctaggattacaggcgtaagccaccgtgcctgacctggccatttgtatttttttttcgtagagatgggatttcatcatattggccaggctggtctcgaactcctgacctcagatgatctgccctcctccgcctcccaaagtgctgggattatagatgtgagccactgtgcctggcccacatcaatttttgaggaaacattaatcttgtttgttccctaactgaatagatatatcaactggttcagcctacacaattcttactgaaacattatagttgtgcaaacttcctacttgatgggttccaaaactgttgttcccagctcagctgcagaaaagaatagaaattttaaacaagtgggatcaagatcctgaggcattcttaaaattacaacaggagatggagcatggctttaccagcataatcctgaagacaaagcataatcaaagcaaacgccagcaagaggtataggaagtccagt

SEQ ID NO: 6159 - DNA, 1033 bp, Homo sapiens
ttttgggatgcttaaggcattttccttgctcactttttggagggccaaacaaaaataacatctgcttattatgaaagtgttttgagaaagttggagaaagctttagcagaaaatagcccaggaaggctccaccagagagtccttctccaccgcaagaatgctcctgctcattcctctcatcaaacgggggcagttttgcaaagtgtatcaatgggaactcattaggcatccaccctatagtcctgatttaactccttctgatttctttttgtttcctaatcttaaaaaaatccgtaaagggcacctatttttcttcacttaataatgtaaagaaacaacaacaacaacaaaactatattgacatggttaaattcccaaagtgctccatgctttagaaatggattaaatgtccaatattgtcacttacaaaagtgtcttgacctggatggaacttatgttcagaaataatgttattttattttttgatacggggcctcactatgttgctctggctggactcctgggctcaagggattctcctttctcaactccaaagctgggattacaggcatgtgccaccctgcctggcaatttttttaattgagacggagtttcggtcttgcccaggctggagtgcaatggtgtgatctcggctcactgcaactcctgcctcagcctcccaagtagctgggattacaggcatgcgccaccacgcccagctaattttgtatttttagtatagatggggtttctccatgttggccaggctggtcttgaactccccacttcaggtgattcgcctgccttggcctcccaaactgctgggattacaggcatgagccacaattgcagaccagtattttttatttttatttattttattttattttttgagaagggttctcactctgtcacccaggcagagtgaggagggaggccacccacctcggccttccaaagtcctgggattacaggcgtgagccaccacgcccagccagaatcaaagagttttaaggaggagagtgacatactt

SEQ ID NO: 6160 - DNA, 1030 bp, Homo sapiens
catcaccatcacttggccaggacattttacctgaattacagaatatctgtgatcaggctgaagtcagttcagagtcaagctaagtttcagtttctcttctctgcgctctttgacttccagggcccggattactcactcaatgagggtcttatccggaacttgacatcactccaaattcccccatcttcaaacatgtgaactcttgaaattctaccactacctctcccttcaccctgttttaccataatttctattttttttattttttttattggtttactctctactccttattggtttactttctaattatgctcctcatgtcaactccttatgtccttcttagtctctctgtgaccaattaaattggttccagtaaacatttattgatgtgacattctgattttcagcatgactattattagttatgaacagattaccaccatgacagtttaatattgcaggctttctccaggcaccatggctcatgcctgtaatcccagcactttgggatgctgaggtggaaggattgcttgaacccaggatcttgagtgtagcctgggcaactttgtgagaccctgtctctacaattaaaaacaaaattagctatgcgtgatggtacacaactgtactcccagctactcgagagactgaggcaggagaaacactcaaacccaggagtttgaggctgaaacatatatttatattttagactttgctgaaaaatgtgactacagatattgaaaaaaatgaatttttttaacctttaactttgctttaccttggtatctatcaagttctaccatgaatacaaaaatgctttggaaatcaaatctgtttatttcatttatctccagtcttcgctatcactgaaagggtttacagctccgggatatatgtttttattattaaataaataaaacattttataggtttctgttggatttttaatatttgaaaattaatttggctgggcccagtggctcacacctgtaatcccagcacttagggaggccaaggtgggtagatc

SEQ ID NO: 6161 - DNA, 1050 bp, Homo sapiens
ctacaaacaactgggaagttactatgattgaacagagttgggtggcttgatataaaataataatataccatcagcaaccaattgaaaataaaatgggaatacaaatctctttcccaaaggcaacaacacgaaggtaggaatagccacaatgaatgtgcacgacccgtatatctttcccatttcatgtttttctccctatcaggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttaggtgagccctatggaacctggtaatctctgcacaactttgatggatagatgtgtttggactttgccttgccttatttgtttagagttaaaactaagacactgaatatatttttacatataccagaaccaaaagtcaacaaaaaagtgacccatcagtatttcttggtaactttttcgacttatccttttttttttttttgagagggagtcttgctctgtcacccaggctggagtgcagtggcgcaatcttggctcactgcaagctctgcctcctgggttcacgccattctcctgcctcagcgtcctgcttagctgggaccacaggcgcccgccaccacgcccagctaattttttgtatttttagtagagacggggtttcaccgtgttaggcaggatggtctcgatctcctgacctcttgatccgcccccgcccccccgcccccgccttggcctcccaaagtgctgggattacaggtgtgagccaccgcgcccggcct

SEQ ID NO: 6162 - DNA, 1041 bp, Homo sapiens
aaaaaattagccaggcgtggtggcaggcgcctgtagtcccagctactcgggaggttgaggcaagagaatggcatgagccgagatcgtgccactgcactccagcctgggggacagagcgagactccgtctccaaaaaaaacataaaaataaaaattattagatgaaaaattatacaaaactacataaaatttttaattcgtgtttgtgatttgaaatgaacagaacaaaaccaaccaacacaacatcagcgttttcttatataattctttgtacttgtctttgaaaatactttttaaaaggcaacccctaccaaaagtaatttgtatttttcttcacatttggtgtccttgtttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgcagctgctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctacc

SEQ ID NO: 6163 - DNA, 1039 bp, Homo sapiens
acacggtttcaccatgttgtccaggctgctcttgaacttctgacctcaggtaatccatccgccttggcctcccaaaatgctgggattacaggtgtgagccactgtgcccggccttagatcaattattgattatagaggtaccttcagtatatttgatgaaaaatatttacatgtgtatctgtatttaaactattaaaatatggaggtggatttaccagattcagacctattgtcacccatttcatatatttttttaaacatccatttcattttttgattttttttttttaatctttttagctaagggaaaaagacatccaaaaataatcctggaggtttttttttccgttgtttttgtttgtttgttttttgagacagggtctcactttgttgcctaggctggtctcaaatttctgccttcaagggatcactcagcctatgaatggtgtcttcaactgcctaaggggattggccaacagttatttgaattgtagtaagaagaggctattgccaggagcactagtcctcacttccaaaggacttctgtctgagagcggaagagctgtcatctgttaggacattatagagagtataagaacctcatataacaataaggcttttccttttccttatagaatagcactgtccaggctgggcgcgagtggctctcgcctgtaatcccagcactttgagagaccagacaggtggatcacctgaggtcaggagtttgagacccacccacctaacctggtgaaaccctgcctctactaaaaatacaaaaataagctgggtgtggtggtgggcgtctgtaatctcagctacttgggaggctgaggcaggagaatcacttgaacccagagacaggttgcagtgagccgagatcgtgccattgcactccaacctgggcgatagagctggactccgtcccagaaaaaaaaaaaaaagccctgtccaataagtagaactttctatggtaataagcatgtgctacatctgctttgtataatatgatacccactatgtgtgactattaagcccc

SEQ ID NO: 6164 - DNA, 1091 bp, Homo sapiens
ttggccaggatggtttcgatctcttcaccttgtgatctgcccgcctcagtctcccaaagtgctgggattacaggcgtgagccaccgcacccagccaaaaaagaacatatttttatccttaaaggtggtttcagaaaacttagcccttaatttttttaatttaattttttgagacagggcctcactttgtcacacaggccggagtacagtggtgcagtcacgctcgctgtagccttgatatcctgggctcaggtgatccacccacttcagcctcctgggtagctgggactacaggtgtgcgtcaccatgtactaccaaattttttatatttttcatagaagcagggttttgtcttgttgcccaggctgccctcaaattgctgggctcaagcagtcagctcaccgtggcctcccaaattgctgggattacaaatatgagccactgtgcctggcctaaattttatttagtagatagcctgtggtcattttggtttcatttcatttagttatttgtgatataaatacatagtgataagtatctattgtgattgtggtatgggacctttgacaatcatattgaatgaggtaaaagtgaaggataaagtgcttcaatatgtataattggaaaagatcttcaaatgacacgtgtttagctatttatgtgtgtgagggagattaaatcagagattaatacctttgtactttgcagattacagaattacttgcagaatgttgattctaataattcacattgagtgcagaatgcacatataaaaatattcaaggatagcttctcaaatgtccacaaaggggagcattaataaatatttaatgaaatacacttcattgaaattaaagtctcaagtataagtgatttagaaaagaactgttatatatttataaaagatataatcacattcacagtgattccacaaaatttgaataagtacctggtagtgtgaagcaactactctactgcaatgtaaattatcttcctatcaatttttcctagcagtcaaaatcttcattacctattaaattgtcttgtttctgttttttttttttttttttttttttggtagaatcttgctct

SEQ ID NO: 6165 - DNA, 1058 bp, Homo sapiens
attctgtctgtagatagaatagatagataaatagatgaataggtaggcaggtaatagtctgttaactgacaggtttattactctgtatttatttttatacttcaaataaagacatctctgcatgtagattacttcatctttcatacttctgcttttagttgtcttttcatcttacattatacttttaacagacatctcttagccttttgccagattgacctttcagttcctctcttttaaaagctctacttcttaggaaaaaggaaatgatcctttaaaaaatcagtgtgagatttaaaaggcaagaaatttatcccctctatacataataatcaggtatggatcttaatcattcacagagaaagggttgtggaggtgcagataatccaaggaacatatgaattttgctttttgtggatttttgtatttaattttgaatgtaagtatgcttgatctaggaacttactatagtaaaataaaagttataatttttctacactcaaaaacctgattgaggggcgtacagaaatactaatactctcattgctgttttgtatctattcaacatgaaccataattttcaagtaatccacagttccaactgaggaaaacctgcttttgtacagatcttttctggagctgagattcaagttatttcaaagcgtcttctgtaacaaaaagtatcaaaataaggataacactgagaatactatttattcaaagctttgcgtatataaatttgaacgtaatattttcatatgtctctatgcaaatctatagctcattagtaactgactttgtcttttttcagcttactttttactatatccagttatatttgctacagaattaaatgtttgtgtaaccttttttattaaggctatttattcactacttatgtctgtttttcagtcccagttgtgacatgatggaactaaggcgccgttatcaaaatttgtatatacctagtgacttttttgatgctcaatttacatgggtggatgctttccctttgtcaagaccatttcagctgggaaattactgcaatttttatgtaa

SEQ ID NO: 6166 - DNA, 2277 bp, Homo sapiens
tattctaacattttaaaccttattaaaaatgtgaagataaagttgatattaatgagatatttggaatgttgtatgacttctggtagcctcagataaaacttaatgttagatgaatgcactaaatgtcaatcttaagggaaacattcagtatattgtgtatagtctatagttttgtttaaagcattgtgtgactgaaaaagcatcccttcaaaagttaaaactaagtaattataaggtatctaggcctggcgtggtggctcacgcctgtaatcccagcactttgggaggctgaggtatctaatactgtttctgctatagtattacttcctatttttatttaaatttcagacatcttatatttaaagataattagtagtgcttctcattttttcacattactttagacttttgacaggattgaattatttgactataataggtaatgctgatggctagccctagtatggaagatttatatcataagtcatgtgctcttgctgaggacccacaagaacttcgagatggattccaacatcctgctagacttgttaaggtaaaaggacacatttgttttaactttagatgtattcactttgcttagctgtaactttgtacacataaaatctaaagccctacattttaatatttgttgattaatgagtaattttagtattaaggcacccagaatttaatgatgtagatgtttttctcattgcagattacaactatatcttatttgtacgctactagttcaacagtcattttgatgttttatatttgtaacatagtagaatattagtggtaataggattcagagtgtctttggatgttgttgaagtttgaattatagcttgtttctttaaaagaactctatctgaagaaatattttaaaaggatgagttatgatgtgtgtaaatcctattccattgctgaaatgcagtgtggaacacaatgaactgaactcttccttgactgacagataccagaggtagtaaaaatgatattggaaaggtttgtacctttccttctcaagtatcttattggtaatttgacagggtgcgtaatatatgtaaatgattctttgttttgaattagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaagtactaattcatttcttgattagaagtgttttactgatagtttatgtagttgttcttatcgatcagccttttccccccggcttattttagcaaccctggtcaatgcaggtaatctcaaaggaaaatccccatttgtagctaaagtttatttggtgccaaaatgttttgggggaaaagggattaagaactaatcaaaataaactgaaaatttaaatgttttgttatgttgtactttggaagttggatgtatgttgaaaatacttttcatttcatgcatagctggagaagatcgtcaagagagaacttcatttcattataattcttttgttataaaatgatgtagttgcgattatttttgttcagccatattttctcttgaggcttatttgtcctgtgtattttagtgtatctcttgtgacttaatttgagaatattcttttttagcacatgaaatctgaacagctatccagcttcttcaggtattctctaaaatgcgggtagctctgtaatcaaacttgaaaatgccttgggggaacatattcttcctttaacttattaaatattgtacaaatgtaccaaaagaggaactatggcttctataatttttttttctttagaccaacctcaagttcttgcagcaaaatttctttacttgatgtgctacaagtgaactagggtctttaaaatgtattttagaattttttttccaacatgcttcttcccttgcaacaggtaccgttttgcagagattcgctaccatcgccctgaggagacccacaaggggcgtacagttccagctcatgtggagacagtggttttatttttcccggatgtttggcattgccttcccacccgctcagagtgggaaaccctctcccgaggatacaagcagcagctggtcgagaagcttcagggtgaacgcaaggaggctgatggagaacaggcactgaacgctaatccctttttctatttccgcttctcacaggcacaggaacacaggcacaaatgcac

SEQ ID NO: 6167 - DNA, 1525 bp, Homo sapiens
gttctagtcatggatatttgaaattggacaaccacaagtctgagagatttgaaatttcaggctatgtggcaacgtctttggtacatttcaaaggtctgactaaatcagtctttgggtggcttgaaaattgaggcaagatcacacactgtgtggtttgtggagaccggcagtgtttgtgcatccctgatatcctttgtgttgtaatttatcacccttttgtgtttcacagatctggctttgattggctgatgagtgtctttgtgatcagttaaaagtggtagaatgtatgtacgtggacttgcctaaataataactttaggagaagacaatctgaaacatttgtgaccttgcacagatcagcaacagacttttaaaaataaattatttttattttaaggtttcataatagtaattacattcttaactttgtatgtcaggatgaagaagagaaggatgatggtgaagctaaagaaatttctacacctacccattggtctaaacttgatccaaagacaatgaaggtaactttgataaggatggattttatttatttttttcaattaaaaagttctttctgagatggagtctcgctctgtcgcccaggctggagtgtagtggcgcgatctcggctcacttcagcctctgcctcctgggttcagtagattctcttgcctcagcctcctgagtagctgggattacaggcaccctgccaccacgcctggctaatttttctagttttagtagagacaaggtttcagaatgttggccagtttggtctcgaactcctgacatcaggtgatccacctgcctcagtctcccaaagtgctgggattacaggcatgagctgccgtgcctggccaattgtatttatatacatataaattaaaaggcaattttataaatcagtacagccaatatctgttgaatgcctataatatatgagggtctatagtgtaactatagtaactttgagaactaagaaggtaggatttctgcactaagtaacttcaaggggatgggactataggcgcctgccaccacgcccggctaattgttttgtatttttagtagagatcgggtttcaccgtgttagccattatggtctcaatctcctgacctcgtgattcacccgccttggcatcccaaagtgctgggattacaggtgtgagccaccgtgcctggccgtaatttggtttttaaaatagaatatttttttgagacagagtcttgctgtgtttcccagactggagtgcagtggaatgatcttggctcactgcagctttggcctcctgggttcaaatgattcttgtgcctcagcctctcgaatagcttggattacaggcacgtacaaccatgccaggctaatttctgtatttttagtagagatgggattttgccatattggtcaggccggtctcacactcctggcctcaagcgatctatccacccccgcctcccagagtgttaggattacaggcgtgagctactgcgcccagcctaaaatatatttaaaattaaaacatag

SEQ ID NO: 6168 - DNA, 1117 bp, Homo sapiens
gtcacacgaaaggctgggcgtggtggctcacgcctgtaatcccagcactttgggaggccaaggcaggctgatcacgaggtctggagttcgagaccagcctgaccaacatggtgaaaccccgtctctacaagtacaaaaattagttggatgtgattgtgcgcatctgtaatcccagctacttggggggctgagacaggagaattgcttgaacctgggaggcagagcttgtggtaagccgagatcacgccactgcactccagcctgggcgacagagtttggctctgtttcaaaaaaaacaaaaaacaaaaaaaaaaaaaacacacaaaatataattgttaattgtagctagtttgtttcctatttcaatatccgctgccccccgccccccgccaccttttttttttccgtgtttttctgctccatatattcaggtaaatgacctccgaaaagaattagaaagtcgagctcttagttccaaaggattaaaatcccagttaatagcccgattgacaaaacagcttaaagtagaggaacaaaaagaagaacagaaggagttagagaaatctgaaaaagaagaggatgaggatgatgataggaaatctgaagacgataaagaggtatgtactcaatctattattatactctatggtattaatattcatgtatagggtgttcttggaatacgtgagttaagattatgtgtgtgtaagcttttatttatttaatttaattaattaatttatttatttgagactgagtctcgttctgttgcccaggctggagtgcagtggagtgatctcagctcactgcaacctccgcatcccaggttcaagctattctcctgcctcagcctcccgagtagctgagattacaggcgcccgccactacgcctggctaattttttgtatttttagtagagacggggtttcaccatgttggcaggctagtctcgaactcctgaccttgtgattcgcctgcctcagcctcccaaagtgctgggattacaggcgtgagccaccgtgcccagctatttatttattttttgagatggagtttcgctcttgttgcctaggagggagtgcaatggcacgatcttggctcaccacaacctccacct

SEQ ID NO: 6169 - DNA, 1028 bp, Homo sapiens
gtccagcctggtcaacatggtgaaaccccatctctactaaaaatacaaaaaattagccgggcacgcgcctgtaataccagcttctggggaggctgaggcgggagaatggcttgaactcgggaggcagaggttgcagcgagcccagattgtgccattgcactctagccatggcaactgagggaaactccatctcaaaaaaaaaaaaaactaatttgggcattttgtttaacaaagactatcataatgcaaaagagtacatatagagtttaaaggctaatagtaataaacacccatatacctttcgcctaagttttataagacagactttgttaaccatgcggtgacatttaaaatacagtagatgctctgaccgtagacatcaacgatcaaatacctcaaaagtgcctctgaataccttacctgttcttttctaggtagatttgtggctttttaaaaaattatatttttctgatatagaaaattataagagttctttttgtttttttttttacagtttgtgtctctggcaattacttttatttacggtatattttgtttgcctctacattttcttctctctaccatatcagtttttaatattgtttaatgaaaaagttgaaaagatcaaaaagttgatagtgcagtgaacacctgtgtatccatcaactttgattcaataattgttaatatttgtcttgttttgtttttgtaacccagtttaacatatgaattcttcagtttgcctaaggaaaaaacatgctctgaaataaccacaattccataatcacacctaagaaaataaggtcgtaatagcatctattattactatgtaatatctcctcttatttgctttaatatagtaactcattagcagtgacataatattcatacagcagtgtttatcttcattacttgctttacttaatgaagacttaagccctttttacagccccattttctctcccctgtacgcccagtattattttattgctgctttagttgaatcattaaatagtattctcattatt

SEQ ID NO: 6170 - DNA, 1033 bp, Homo sapiens
gatagggatgaggaagaaatgaccaaacgagatgacaaaagagatatcaacagatactgcaaggagaggccctctaaagataaggtgtttattgaatactgtattctttataatatggtgatatcttacatcatctaaacataacacagttgtgaagtttattagtccttatacatctttattaccactaagtaaaattctgtcagttgtttttttgtggctatgtcagataactagtatgtctgattcttttctctcatattcgtataccagataaactcattttagctaggatgaggcaaatatcttattagattattgctatcttatgcacagtctccgtttctcactttttgggggtaaaaaatttgaaatttgaatactatgttttctacttctccattttcttaggaaaaagaaaagactcaaatgatcacaattaacagagatctgttaatggcttttgtttattttgatcaaagtcattgtggttaccttcttgaaaaggatttggaagaaatactttatactcttggactacatctttctcgggctcaggtaatctatcttgtgaatatttaaaaggaaaacattttttaaaagttacctttccagtgaaaagttaatagaacctctgttgactttttgatatattaaagcaatataagggccaggcgtggtggctcacacctataatcccagcaggttgggaggctgaggcgggcagatcagttgaggccaggagtttaagaccagcttggccaacatggcgtagctccgtctctactaaaaatgcaaaaattagctgggtgtggtggcacacgcctgtaatcccagctactcgggaagctgagacaggagaatctcttgaacccaggaggtggaggttgcaatgagccaagatcacgccactgcactccagcctgggtgacagagtgagactccatctcaaaaaataaaaataaagcaatataacacaagccagttgtaaaacacttcccttctccctctccctctgtttctactccttagg

SEQ ID NO: 6171 - DNA, 1122 bp, Homo sapiens
aagcagctcagttccatttttataaacaaaacgtggaattattctgtacgttttgactggctttttttttttcattccacagtattctatagatacattcaccatgaaaatagagacctgcctcattctttttatagctgcacagtacccattatacagatgtaccataatttacctacctagtctccattgctggtggttttcatttattggatttaccaactatgctgtaataaatcatccctgtgcataaatttttatcaatgttatactttttaacaatgaagttttttttttcaaaagtaacttggatcttactcaattccatggatttccatcataagtgaaaattacagctgggcatagtggctcacacctgtaatcccagcactttgggaggcggaggagggtggatcacctgaggtcaggagttcaagaccagcctggctaacatggtgaaaccctgtctctccaaaaatacaaaaattggccaggcatgatggcgggtgcctgtaataccagctactctggaggctgaggtaggagaatcgcttgaacctgggaagtggaggttgtagtgagtcgagatcacaccactgcactccagtttgggcgacaagagcaagactctttctcaaaagaaagtgaaaattatatcatagtttttctaagagaatcaagaaatgtattttcatctctgtattttgtttacttgcatgcataacaggtaaagaagcttcttaataaagtagtgctccgtgaatcttgcttttaccggaaattaacagacacctcaaaagatgaagagaaccatgaagagtctgagtcattgcaggaagatatgctaggtctgagtaatattaagattttgctttttaataaatatactagtaattaaagaagaaaaataacttactaaaatatggtatattttatattataggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaa

SEQ ID NO: 6172 - DNA, 1077 bp, Homo sapiens
atgaaacaggccaggcatggtggctcccgcctgtaatcccagcactttgggaggccgaggcaggcagattgtttgaggtcaggagttcgagaccagcctgaccaacatggtgaaaccccgtctctaaaaatacaaaaattagctgggtgtggtggtacgcgcctgtaatcccagccaagatcgtgccacttcgctcaagctggcgcaacagagtgagactcagtctcaaaagtaaatacataaataaatgaatattgcagtgtgctttatgactaatgaaattgacagacattgccattttatggaattctatcagctttttattttcacagcttaaatattttaacctcaaagttaaatttgaaattttaggaagtaaaatgttaatttttggatttttttaaacagatgaagatgaaaaaaccatattaaatttggagaattccaacaaaagcctctctggtgaactcagagaagttaaaaaggaccttagtcagttacaagaaaacttaaagatttcggaaaacatgaatttacaatttgaaaaccaaatgaataagacaatcagaaacttatctacggtaatggatgaaatccacactgttctcaagaaggtgagaaattttgtacttttaacattttcttagttttaaaaatctaactctggtgtttttaatgtattttaatgttattaagctcttagtgattattctaaaagcaaataatgatagcattgtgaccttcctgagattagtaaaaagtgattcacaggctgggcacagtggctcacacctgtaatcccagcactttgggaggccaacgcgggcggatcacctgaggtcaggagttcaagtccagcctcgccaacgtggtgaaaccccatgtctactaaaaatacaaaaaaaattagccagacatggtggcgggcacctgtaatcctagctacccggaaggctgagacgggaatcacttgaacctgtgaagcagaggtttcagtgagtctagattgcaccattgcactctagcctgggcaacagaactagaccccatcttaaaaaaaaaaaaaaaagtgattcc

SEQ ID NO: 6173 - DNA, 1110 bp, Homo sapiens
tgagattacagtcatgagccaccacacctgccccattcactgcatttttagaccccatttattcttgggcagaattgaggtaaatgcttcgtcaccattaattttaagatactaaaattaatttattgttctttatcactagaaaaaagtataccaaactgaataccattgtactctaaaatcaaagtaacatttaagataatctaataaaatgtattttttccttctctattgtcttataggataatgtaaagaatgaagacaaagatcaaaaatccaaggagaatggtgccagtgtatgataaaatccatgtagtgatgaggaatggtgttaaataatgtaatatataaaaatcatgatataagaatgtttgaaggtgatgcatgtttgattttagtagtataaatgtattttagttcaaatgatgtataaagttttatgaatgtgagtttctgcttttgaaaattgcttgtaattcctagccttcaaattattaaacactccttgagtgaaataattttgcattgcaaagtgttttaggatgaactttgttatagttttaactccaataaagttcatcagtttaattgactgtagtatttaattaccaaatttcttttattaaaatgcctagaaatttttaatttatagaattattaggttttaaaatttttagttcatctgttaaaatttcagtcaaaatcataaaatagcatgatgcttaatttttgcaagttttttgaaactttttgttttttttactcatcaccaaaaaatcccctcttgatcagtctctaaaagcattcattaaaaattcagttcaggccgggcacggtggctcacacctgtaatcccaacactttgggaggccgaggcaggtggatcacctgaggttaggagttcgagaccagcctggccaacatggtgaaacccggtctctactaaaaatataaaaattagctgggcatggtggtgggtgcctgtaatcccagctacttgggaggctgaggcaggagaatcgcttgaacccaggaggcggaggttgcagtcactcaggatcatgcagctacactccagcctgggcgacaagagtgaaactccatctcaaa

SEQ ID NO: 6174 - DNA, 1044 bp, Homo sapiens
tggcatcggactccaataagataccatctatgcaaacactttgaaaagtgcacagtacaaacaccagcatgtctttacatctatttgtgccttctttaatttctttcataagtgtttatagttttcagtatgcctgtctttcacctccttagttaagtttattcctaagtattttattccttttggtgatgttgtcaatgggattgttttcatttcgtttcttttttttttttcttttttcctttttgagatagggtctggctctgttgcccaggctggagtgtcgtggtgtgatcatggctccctgcagcctcgacctcccagacttaagtgatcctcccatctcagcctctccagtagctgggactgcaggcaggtgctaccacacccagctaatttttgtgtttttagtagtgatggtgtttcactgtgttgcctaggctagtgttgaactcctgggctcgagtgattcttccgtctcggcctcccaaagtgatgcgattacaggcgtgagctaggactgttttcttaatttcctttttggatagtttattgttaatgtatagaaatgcaactgattttatgttcagtgtgggttctgtaactttacagaactgattagttctaagaatttttgtgtgtggcatctttagggtttcctatgtaagatcatgtcatctgtaaacagagatgattttacttcttttctgatctggatgtcttttatttgtttttcttggctaattcctctgggtaggacttccagtaatatgttgaaaaaaagtggcaagagccgggcgcggtggctcatgcctgtaatcccagcactttgggaggctgaggcaggcagatcatgaggtcaggagattgagaccatcctggctaacatggtgaaaccccatctctactaaaaatacaaaaaattagccaggtgtggtggcaggcacctgtagtcctagctactcgggaggctgaggcaggagaatggtgtgaacccaggaggcggaggttgcagtgagccgagattgcaccactgcactccag

SEQ ID NO: 6175 - DNA, 1046 bp, Homo sapiens
aagcaccaaatattaacagtggttattttgttttatttatttatttttgtttcttttttgagacagagtctcattctgtcacacaggctggagtgcactggtgtgatcttggctcactgcaacctccaccatcctgcttcaagcgattctcatgcttcagcctcccaagtagctgggattacaggcatgagccaccacgcctggctaattttttgtatttctagtagagatagggttttgccatgttgcccaggcttgtcttgaactcctgagttcaggtaatctgccgcctcggcctcccaaagtgctgggattataggcatgagccatcgtgcccggccaacagtggttgttttatctctggtatggaatatggctgtggggtgtgtgtgtacgtgcacacatgcacttgtaaatgttcttgctttttgctttttttttttttggagacagtgtctcgctctgttgcccaggctggagtgcagtggtgcgatcctggcttactgcaacttctgccaccagagttcaagcgattctcctgcttcagcctcctgagtagctggactacaggtgcctaccaccaagtctggctcatttttgtatttttagtagagacgcggtttcaccatgttggtcaggctggtcttgaactcttgacctcgtgatctgcccgccttggtctcccaaagtgctgggcttacaggcatgagccaccatgcccggcctgtttttgatttttaaatatatattacttttagtaccttttattttaatttgagtttcacttggtgggttgctcctgtaacacattcacatagtatgaaagggtatgcaggaaaaagtctctcatttccctatcccaaccactgattgcctttctctggaaatggctgcagtgaccagttttctaatccttctatagatagtttataaatctacaaataatatggatagacatatctgcctccatttttacataaatgttagcatattacatgtattattttttcttggaaacaaattttcttaagtcattaaaaaaatcc

SEQ ID NO: 6176 - DNA, 1048 bp, Homo sapiens
ctgtgaatttgactactgaagttacctagagtgtaagcagaaaaccaagcaggtattttaaaaaaggcttcttttgaaattcttgtcttttgcatcccaatcctgtccagcggtcaaggcctagtttatgtctttcctgacaacccgaatgtaccgttatctagtttcagtggctatcttcatcatttgattgacatttgttatgcatgtctatataaaattagttcatttttcctgtatgtatcccacatatttcccaaaagttcttgaggaaagtgaccaaatctttatccatccttatgtttcactatgttgttttaaattggtggctttcacattgtaaattctccagaaatacatattgactgccctttaactatgaaagataaccagagatttggaaacgaattggaataccaactaaaagaaatagagcattagaatacaggtctggtggctagctgcagtggctcatgcctgtaatcctagcactttgggacgctgagatgggaggattgcttgagcccagaagtttaggtagagttttgtagagaccctgtctctacaaaaaataaaaaaattagccgggtgcggtggctcatgcctgtaatcccagcactttgggaggctgaggcaggcagatcacctgaggtcaggagttcaagaccagcctggccaacatggttaaatcccatctctgctaaaaatataaaaattgggccgggcatggtgactcactcctgtaatcccagcactttgggaggctgaggcgggtggatcgtgaggtcaggagatcgagaccatcccggccaacatggtgaaacaccatctctactaaaaataccaaaaaaggccaggtgcggtggctcacgtctgtaatgccggcatttttggaggctgaggcaggtggatcacctaaggtcaggagttcgagaccagcctggccaacatggtgaaactccgtctttactaaaaatacaaaaattagctgggcatggtggcacatgcctgtaatcccagctactcaggaggctgaggtaagagaatc

SEQ ID NO: 6177 - DNA, 1021 bp, Homo sapiens
aattaactgaatttaaaacgtaaaaaaaaaaaaaaaatccaggattactgtccttccgtggaagtataacaattggacttctatatgaattatatagtttctttttgttttcctttagcctgtgaattgtcaaagtgcagggaggaagcataatgtgaaaagagaatgggctttcaagtcaggcagtgctagattcagtttctagtacttatagctgcaggaaatcccacatgtggatctttggcaagttgcttaacctcttacaacttctgtttccttgtctataaaatggcaaaggtggctgggcacagtggctcacgcctgtaatcccaccactttgggaggccgaggctggtggatcacctgaggtcaggagtttgagaccagtctggccaacagggtgaaacctcgtttctactaaaaatacaaaaatttagctgggcatggtggcgtatgcctgtagtcccagctacttggaagactgaggcaggagaatcacttgaacccgggaggcggaggctgtagtgagccaagattgcgccactgcactccagcctgggtgacagagcaaaactctatctcaaaaataaataaataattaaataaaatggcaaaggtaatacaggttcactatcccttatccaaaatccttggaactagttgtattttggaattcagaattctggggatttttagaaaggtagcaccccggtagggtttggggcctgaaacctgtaatcaaacaccttaatattaaatatgagtggtcatactaagcaggataaatgaagactataaagagcctcacgttagttcaagttaaattttgccatcaaatgagttcaggtaaggttttgcctccaaataagttacaaaaaaaactttcggttttcagagctttatggatatcgcaatttcggataagggattatggacctgtacttcccttatagggttgttatgaagatttaaacaagataagctgaaaacacattacacagtgctgggtaggtattcaata

SEQ ID NO: 6178 - DNA, 1091 bp, Homo sapiens
gaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggaggtatggaagctttttattttgcatttgacattgttgttgaactataggttgatttgaatttttttaggctaattagaattgattctataacatttcttgattagtgtctagtattcttagttgcactagagtctgtacaggtgaagcctgagccttttttcctttggcccttgtttatttcactgtatggcctttttcttggggcgaggtgggagcaatagttaaatttaaaccttttctgtacatttgggttcctaaagttattcggaattgcttgatggttatctacttgaatttcttttcttttttcttttttttttttttttgagtcagagtctctctctgtttctcaggctggactggaatggcacaatctcagctcatggcaacctctgcctcccgggttgaagcgattctcctgagtcagcctctcaagtagctgggattacgggcacgcaccaccatgcctggcaaatttttgtatttttagtagagacggtgtttctccatgttgatcaggctggtcttgaactcctgacctcaaagtgatccacctgtctcggcttcccaaattgctgggattacaggcatgagccaccacactgggctgataattagtaattctttatattatataaatacgataattgctgatattcatatacatttgagcttaatgcataatctttggggaaaagtgttgaatccttgtgttatggcctttttttttttaatttgtgaatttgctgtttggcaggaagcacatgtgtttgttgatctaaataaggtcctttaaatctgtatttctagcagtggaatgtatggcttgcttctcactttggtgggattttgcctggtaaaatctgtattataataggtttaacagtttattattttgtttagatcacat

SEQ ID NO: 6179 - DNA, 2123 bp, Homo sapiens
ttattgttcgatcttaaatgcaaacgagtttttatttaataatttttattgcagtgtcccctgcgttctaacaaaactaaaataatttggtatctgttctgtccttgaaaaagaaagtatgatagcatcattttaactattttcttagctttctgtgctttattctatttttttatagtcagtagttagatttactaactcattttattgatttctttgttcattgttcctgcttaaattctcactttccttttgggttcagttctcttcatattgtcccccagttttgcaagttgaaagttttaataattgcaatgaagtctgtgtgttaaaaattcaccccaagttttacatttttcattatttttttgaagcttgggaggatttttaagagcgggctacatcgtgggaaattaagaaaacatttgaattctttttgtttatttaagattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaagtaagtagctttctagcatgatagattttagcttttagttggtatttacttttgacatttgttgaagctaaatttaagttttgggtacctcttcatgcctaatcttccttttctgctcttagtaagacacctatatatttttatagtctgagactgagtagcagaatagaataaatagggggaaaaaaagcacgtgaataggcaagtcctaataggaaacacacaagcagccatagagacagatttgaagtgtttctttctttctctctttaaagccgctcaaaaacaaaaacaaaaaacaaaatatttacaacgtgacaaagaaggcgatttatattgactagaaaagaatagtgcggagataatttgttaaagctgaggtgaaaaaaagatagatcctcatcccattcccccaaaccaaaaaaatttctcaaagatttaaaaaattaagctgtaaaataacttaaagcagacgtaggtgaataaagagttttttgatttcaggaaagggaatgcttttctaacatagaagttgggctgagcatggtggctcacgcctgtaatcccagcactttgggaggccaaggcgggcagatcacttgaggtcaggagtgtgagaccagcctggccaatatggtgaaactctgtctctactaaaaatagaaaaattagccggcctggtggcgggcccctgtagtcccagctatttgggaggctgaggcatgagaatcacttgaacccaggaggtggaggttgcagtaagctgagattgcgccaccgtactccagcctgggtgacagagggagaccctgtctcaaaaaaaaaaaaaaaaaccacagaagtcagaagaagaatccataaaggaaaaggtttataattttgactccatgaaagttaaaccaatggtatgtttaaaaaaagaattagggccgggcgtggtggcttacgcctgtaatcccagcattttgggaggctgaggcaggcggataatgaggtcaggagatcgagaccatcctggctaacacggtgaaactccatttttactaaaaatacaaaaaattagccggtcatggtggcgggcgcctgtagttccagctactcgggaggctgaggcaggagaatggcgtgaatccgggaggtgaagcttgcagtgagccaagatcgcgccactgcactccagcttgggtgacagagcgagactctgtctcaaaaaaaaataaaagaaaaaaaaggctgggtgcggtggctcacgcctgtattctgaacactttgggaggctgaggcgggcagatcacgaggtcaggagatcgagaccatcctggccaacatggcgatacctcgtctctattaaaaatacaaaaactagctgggtgtggtgacccgcacctgtaatcccagctacttaggaggctaaggcaggagaattgcttgaacccgggaggcggaggttgcagtgagccaagatcgtgccactgcactccagtctggagacagagtgagacaacatctcaaaaaaaaaaaaaagaaa

SEQ ID NO: 6180 - DNA, 1088 bp, Homo sapiens
gtagctgggactacaggtgcgtgccacaatgcccagctcattttttgcgtattttgtagagataagatttcaccatgtagcccaggctggtcttgaactcctgggctcaagcaattccgccctccccttggcctgccgaaatgctgggattacaggtgtgagccatcacacctgacctctatcagattttatcagtttttttttaagactttgaaaatgtgatctggaaaatataaaagttgaaacaaaatgaatttctatgggtaagagagggtaatattttagagttgtgttacaaaactacaaatttttattaaattaataaatcagaatactaaatccatgtgtttttttctttcttaaaaaatatcttttggctgggcacggtagctcatggctgtaatcccagcactttgggaggctgaggtgggtggatcgcctgatgtcaggagttcaagaccagcctggtcaacatgttgaaaccccatctctactaaaaatataaaaattagccggtgtggtggtgggcgcctgtaatcccagctactcaggaggctaaggcaggagaattgcgtgaacccaggagttcagtgatgtagcggggagctgagattgtgccactacactccagcctggatgacagagtgagactccatctcaaaaaaaaaaaaaaaaagaaagggaaaaaaaaaaccttttaaagaaaatgtcaaacatggacaaaagttggtagaatcatgtaaggaacccctatgtattcatccaccagcttcagtaattattttatctatatgctaacctacctactctttcagaagtattttgatgcaaaccctggatatcatattattatatccataaatgtttggttatgtatctctaaaaaggattttcaaaaaaaaaaataacaatactgttatcacatctaaaaaattaatatttagaaatattaattcatttcacattatcaattgtcttacaaatggttattttcttttattgtttgttttcttgaatctgagtccaaataaggtttttacattgtgtgattattaagttgcttttaatatatggattactcctttatg

SEQ ID NO: 6181 - DNA, 1029 bp, Homo sapiens
tggtctcaaactcctgacctcaggtgatctgccctcctcagcctcccaaagtgctgggattacaggcgtgagccacctcacccggcctgtattttttttctaaatcatttgaaagtaagtcgaaacaccgtgatatcatccctaaatatttcaacatgcatcctctgagaataaggatattctgctacataaccacaatataataagctcatctgtgaaaattaatgatagttctgtatcatcatctaatatttagtttatatccatttttttctcattatcctgaaaatgtctgtctgtctgggtatttggagagaaatataggaaatgctcactttgcacagacctttgttaactgaaacttgtatcccagaacctacatttcattttgtaagtttccatggaatcctgcaaagtaagaaatagactctgcacaattaacacagtagcatgcaaagtaagtaagaaatgcctgtgtgtgtgtggaggggttgtgtaagtgtaacaccatctgaactggcctgctgccagattcgtatcacatgtcaaaacataccacaccagaaccattggtgcaggtagctcagagattttttacttattcaagtataagtgaggggagtttcttggtgaagagaattttaaataagagttctgttatgtctgagtggagagagtgagtgagcgaacctggtcctggagacatctataagactagagcctgctggtgggattttcaaataataacaaaacagactaatttgggcagcacatccctgtgatggggaggaggaaacaaaaagggcagggcaggttcacttggatgtgacttatttggtgtagcacaaatgaatgctgctggggtatctgatggtttctacctggtaggtgttaatagtttagctaaatgtcattttgctttgagtgacttattgggctccattccgtttatccatatgtgtacatatacctatttgtatgtatgtttttaaaaattcaggacctagttaagttttacatgttacattt

SEQ ID NO: 6182 - DNA, 1470 bp, Homo sapiens
aggtgtgagccattgcacccagccacagttacttatttttaatgactcccaggcatttggccatttgggtggctggttttcttaaccagtgtcctattttctgaaatttagattatttctaataatttactattattaggactgccctaaacattggtatagcgaattctttatgcattgccatgtttatctctttaagatgagtttttaaatgtgattgcttggccaaaaggtttgtgcctttttttttactttggttatatattgccaaacccaccagtggaatgttcgtttgtcttttcccaaaaagtaccagtattggaaagaaagatagccttagcaacagggtgtcttaataacaacattttttttttttctttgagacaagagtcactctgtcgcccaggctggagtgtagtggcacgatctcggctcactgcaacctctgcctcccaggttcaagcaattctcctgcgtcagcttcccgagtaactgggattacaggcgcccaccaccatgcccggctaatttttgtatttctagtagagttggagttttaccacgttggccaggctggtctcgaacttctgacctcaagtgatctgcccgcctcggcctcccaaagtgctgggattacagacatgagctactgtgcccggccaataacaactttccttgccaactcatgatcacaataaggaacagttagtgtagcaagatataaaatagtgatgctcttatgggttactgatttgtatatcttcacttgtttactccaatatcaaagtgtttccagtggctacattttttagtccttggctggtgttgacttgtatttaatctccatcatgggctcttttactttttgcttgtcagtatacctgctgaaaacaacgcactacttattaatggcctgtctgctttgtgctgagataccaaatagtgctgttttagaatgtagaaactgagtataatgtatatttttgtacatttatttaattagtatatttatttaattagtaatacatagtatagttttagaatgtatatttattagaatagaatatatttagaatgttagtattagaatagaatgtatatttagaatgttagaatttatttagaatgtatatttagaatgtatatttatagaatgtatttaattagtacatgtaattagtaatacatagtttaattttagaatgtataaactgagtatgaatttatgatctcgaaaattgaaaatatttttgcttattttctggttttcatttttgttccagatacgttaacagaatagatggcctttagctaatagatatgaaaaaggtgtcttcttgtacttaacatgtttgcttatggtttctattttgcatttatattaatcctgtaaattcccctaacaggcagagtggcatgattccgactggatactctcagtgccagccaaattacctgaaattgaagaat

SEQ ID NO: 6183 - DNA, 1067 bp, Homo sapiens
tttgatttttaccttatcacagcatgaaagtacaaatgtcgaaatgccccaaaattgtattttttaaagttgaaaatgatcttgaaataatccagaattgatgaatgttgcaaatgtataaatgccttattcagtgtttgtattttccttatgaattttttttagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggtacatttgcacttcattgggtagaagatatctttcattgttgtttcagataaataagtaggtaactgctatatgtactctttaatagtaggagaaaatgtgatgtgtcagcaccttgtgggttgggggataccttaggctgactgggacttcatcttaaaaattagcatacgacagggcatggtggctcagctaagagtactctgtcttttttatttttttatttttttgagacagagtctcgctctgtcacctaggctggagtacagtggcacgatctcagctcactgcaacctctgcctcctgggttcaagtgattctcctaccttagcctcctcagtaggtgggattacgggtgtgtgctatcacgcctggctaattttttgtatttttagtagaggcgggctttcaccatgttggccaggctggtctcgaactcccaaccccaggtgatctgc

SEQ ID NO: 6184 - DNA, 1143 bp, Homo sapiens
tcttttatatttaataattaatatatacagatcattctctgtatatttcaatattttaatctttcccacagttttgatcatctatataattaatgctatcatatttccttcaaaccattagatgtccctggggctcatagctttcgtcaagtgtctgaccatttttgcctagatggagaaagcatttttggtagaaaagcatgaatgggcggtggctcacacctgtaatcccagcactttgggagcccgaggtgggcggatcacgaggtcaggagatcgagaccatcctggctaacaacatgaaagcccatctctaataaaaatacaaaaaattagccgggcgtggtggcgggcgcgtgtagtcccaactacttgggaggctgaggcaggagaatggcgtgaatccaggaggcggagcttgcagtgagccgagatgcaccactgcactccagcctgggcgatagagcaagactccgtctcaagaaaaaaaaaaaaaaaaaaagaaaagcatgaatggaaagaagggcaagtcagaggtgaaaacgccaagcccccatattagggtgagtccattgggttcatttctagagaacttgacatttaacaaacattaacctcattgaaatgactgcgaatgcccatgtagtcactttggctgtgggttcttgcagttgtctttctggcctaacctcacttgctcactggccttccagtgtccatgctccccctttgttaatttgtttactgctatatccctagcacattttagatgaatgtattaggtgttcttgaatcatattagtttcataccattaccctatttttgaggacctgtagcagttcaagcaattctcctgccttagcctcccaagtagctgggattacaggcgtgtaccaccatgcctggctaattttgtatttttagtagagatggggtttcaccatgttggccaggctggtctggaactcctgacgtcaagtgatccacccacctcagcctcccaaagtgctggaattataggcttgagccactgcacctggacttttttttttttttttttttgagacaaagtctcgctttgtcgcccaggttggagtgcggtggtgcaatcttaacctctgcctcgcaggtttaagtgatcc

SEQ ID NO: 6185 - DNA, 1050 bp, Homo sapiens
ggttttttctgatcctaaaagtaacacatgcttcttgtataaaaactcttgacataattcatcatcacatctaatggtagtatgacattttattatgtctgttttgtggcttatataagcagcccaaatgatgcacattttaaaattgtttgtactttttgtgtattataagtaacaccgtggtgaacttcttgttttattatttccttaggataaaatggtggggtaggtgataaattagaattacatacagtcaaaggaatggatttattactatagaaatatgattattatatactgcatcaaaaataaatatgttacacatgtgaaagatttggaaagttactcatttatcttgagatgtcttagaaatgaaatgtgtccacttctagtatcctttctcctaacacactctcaaacaacaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtggtaaggttctgcagcacattcctgacacttcataatttggggtatgagcaggatatgaaagggtttcatttaagcttcccagttgttttcattttctcatgaagttagtaaagtattaattgtattttacaatttctggccagacacagtggctcatgcctgtaatcccagccctttgggaggcacaggcaggaggatggcttgagcctacaagtttgagatcagcctgggcaacctagtgatactctgtctctacaaaaaaataaaaaaaaaaaaaattagctgggcgtggtgacatgctgtggtcccagctacctgggaggctgggatgggaggagggaggattacctgagctcaggaggttgaggctgcagagatccatgatggtgccactgcactccagcctgggtgacagagtgagactctgtctcagaaaagaaaagaaccaataattcccatgtttaa

SEQ ID NO: 6186 - DNA, 1398 bp, Homo sapiens
agacatttaaaattgttacatctttattcaatactgtgagaaatgtgtgcttaatatatttgttttattacctttggctgtagataccctgtagcaattgagttgaataaatggtttaataacttaataaatgaagtagtgatgagggctatttctcataatgaaactgtgttttcccacacttcagggacactggcttttggaccatgatgggtggccagtgttatttttgaccagtgacttgttaagcacttatgttatcaccttttctttgaagaagtggcaaatattttgtttttctcatgctttttaaaaattgaatactaattaaagcacacaaaaacaaaacattctctcaacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggc

SEQ ID NO: 6187 - DNA, 1066 bp, Homo sapiens
ccaccaaacctggctaatatttaaattttttatagagatggagtctcattctgttgatcaagctgtttgtgaacccctggcctcaagcaatcgtcctgccttggcctcccaaagtgctgggattataggtgtgagccaccatgcccgccctcttctaattatctgtcatgagatggatctccagtcattgcattgaggtttatgtatttaatatatttagtgttttccctataccggggcatggatttttgtctttctttgagacagggtctctatctgttacccaggatggagttcagtggcatgatcatagctcactgcagccttgaactcctgggctctaatgaccctcttacttcagtctcccacttagctaagactataggcatgtgccgccacacctggccaatatttctttaaaaatgttttttgtagaaaaattagctgggcatggtggcgggcgcctgtagtcccagctacttgggaggctgaggcaggtgaatggcgtgaacccgggaggcagaatttgcagtgagctgagatcatgccactgcactccagcctgggtgacagagcaagactctgtctcaaaaaaaaagatgttttttgtagagccagggatctcactatattgtccaggctggtgaatttttatccattttttactgctgaattcccagcacctacaacagtgctggcaaataatagataactaaatattgaacaggtgaacaaattttttttttttttttttttttttgagacagggtctcactctgctacccaggctggtgtgcagcggcttgatcacagctcaccgcagcctccaactgccaggttcaggtgatctcccatgtcagcctcctgagtagctgggactacaggcatccaccaccatgcctgtcaaatttttgtatttatttatttatttttttgtagatacggggttttgccatgttgcccgggctggtcttgaactcctgggctcaatcgatcccgcgaccttggcctcccaaagtgctaggattacaggtgtgagccattgcgcctggcccaaatcatttta

SEQ ID NO: 6188 - DNA, 1031 bp, Homo sapiens
cactggtccagaagcacttgacaaagctaaggcattggcagcaagtgctggaggtcatcacgtgcagtacaaaaagctagctgacatccatcaaggctccttggtctaccttgagcaggcattcaatatccctgcacttctgaagtgcacctgagcaaaagggtaaaggctgtgggcctgagagtgggctggtgtgggagagccccatgcagatggtttgccacacatcccttcttgtagacttggcattttggaagaactctttgacagagaatgagttgattttagttttatgctcccacctaaaattttttcactatttttataagatgttaatttcttgagtactttatttataacatgcctgtaccttgggtaaaccaagtaaacttttttttgtcttaggcaaagtttagactgttcgtatgatgatacactttcttttttatgtgggtttttttttttgcttgttttttatttttatttttatttttgagacagaatcttcctctgttgcccaggctacatagcagtggcaccttcacagctcattgcaacttccaccctcctggcttaagcgatccttccacctcagcctcccaaatagctgggaccacaggtgcctgccaccatgcccagctaatttttgtatttttagagagacggtgtttcaccatgttgctcgggctggtctcgaactactgagctcaggcaattctacccaccccagcctcccaaagtgttgggattaccagtataagccactgtgtctggccttttaaaaatttttgcatgacttttcatctttttatgtgtgtttcccatttgtttgatatgagggaaaaatttctaatagcttgagaatcaaggggatggggattttggttgtaggcattttataataattaaccccttagcagtggtgtagaaaaataggtaaattttttgtttcaagacttaaaactacctcaagaagaacaatctaatgtaacagtatttgtaacgcttccagaggtctcagatgaggaatt

SEQ ID NO: 6189 - DNA, 1017 bp, Homo sapiens
cactgctataaagaactacttgaggccaggtacagcgcctcatgcctataatcccagcactttgggaggccaaggtgggtggatcacttgagcccatgagtttgagaccagcctagacaacatgttgaaaccctgtctctaccaaaaatacaaaaaattagccaggcatggtggtgtgcacctatagtcccagctactggggaggctgaggcaggagaatcacttgagcccaggaggcagaagttgcagtgagccaagactgcaccactgcactccagcctgggtaacaaaacaaaagaactacctgagactgggtaatttatgaagaaaagaggttaattgactcacagttcctcaggcttaacaggaagcatgactaggagccctcaggaaacttagaatcatggcggaaggcgaaagagaagcaagcatgtcttaccatggcaagcaggagagagagagagggcaaagggggaaatgccacacacttcaaaaccatcagatctcatgagagagctcactcattaccacaagaacagcaaggaggaaatctgcccccagtgatccagtcacctcccaccaggtccctcctccaatttaatgtgagatttggccagggacacaaatccaaaccatatcagtggtaaataatatagaaccttgtgaaactactaaacgaaagaaaaccaaacaaacaaacctcaacacatcagaagcataggtcttgaaaagatgaagataattttagaggtcagagggtaaagaggaggcatattaaggaaagacaggaagtagggagaataactgtggggctttatgtgtagagaatttggagccaggaagagctgtcaagtttattctggtcaggtaaagaaagctggaaaaggagggttgcagggactattggagcaaaacagtaggctaatttaaataagcatcctagagagaacatgtaagtaaacaagcagcccaagaaggaaggaagtatacaagatttagagacttatgatctacatt

SEQ ID NO: 6190 - DNA, 1055 bp, Homo sapiens
tgccctcagatcctcctgtccttccctggccctgctctgtattggctgtggggtgggggtggcggtggaactgacccctggcgtctgcatttctcaggctcccagggctgtggctgactttggccaatgggaggcaaggacgggagactgagagcttgggaggaagggagagaggtatgtttcttctccttactccctgcctgggatggcaccttgggcaggactctgttttgcccatggcctcagctcccaccagatgcctctagtccctgggctcaggaaatagacaacctccttccactatcgctgtagcccaaggagggaagtatttttttctttctttctttctttttttttttttttttacagagtctcactcttgttgcccaggctggagtgcagtggtgcgatctcagctcactgccacctctgcctcccgggttcaagtgattctcctgcctcagcctccagggtgtgccactatgcccagctaatttttgtatttttggtagagacggggttttgccatgttgaccaggctggtcttgaacttctgaccccaaatgatctgcctgcctcgtcctcccaaagtgctgggattacaggcatgagccactgtgcctggccgaaggaaatattttcttgctattgctaatctctgggttacctcgctatcccccatttagcttcacttctcctccatcacctgtatgaggaattccctctgtgttaaatatctggagaagtttcctgattggaccctggctgttgcagcttccaaggccacctctctttgtggctggtatccttttcccatgcatcttctccaggacttccattctgcagttatctctctgaactcagtgtcttcttcccatcagtataggggtggactttagtatctcctatgtttaggcaacatctctcctttgactctgcgtcttctccagtggttgcccttctctgctcctcttcacaataacacctcctgaaagggccacccatgcctgccccctcctttcctcaccccctctgtggctggacttctgttccta

SEQ ID NO: 6191 - DNA, 1011 bp, Homo sapiens
gccaggaggagaccatcactctgacattcatcttcttttaaagagcttacctggtttgatcaattccagttaggataacctcccttttgattaactaaaaaaatcaactgattagtaacctgatcacaggagtggtatcctatcatattcactggactcacccacactcaagaggattatacacatgtgtacaccatgggatagtaatattgagggctatcttagaattctgcctaccacatttgtattgactcttatgaaaggacatgggggccctaggatttttctttttttaagctgtattgagatatatatatatatatatattcgccataaaaattcacccattttaagtgtgcttaaaatttttagtaaatttagagttgtacaactatcaccactaattccagaacattttcattactccagaaatttttaaaaatgctgtaccattagcagtcattctccatttcccctccttccagtctctgacaacccctgatctctgtttctatgaatttgcctattctggacatttcatataaatggaattatacaatgtgtggtcttttcctattttgtttctttcacttagtataatgtatttgagattcatcaatattgtagcatttgttattagtatatcattgttttttattgatgaatagtattccattttatggctataccacattcttgtttatgcattcaccagttggtgggtatttgggatgtttctacttttttgctgttgtgactaatgctgatgtgaacatttgtgtagcagttttgtgtggacctatattttcctttctcttgagcatgtacctgggagtggaattgctgccttatgttaaatatgtttaagtttttaataaactgccaaagaccttaggagtttttggtggctttcttgctaactggtatgacaagatgtttaagggtcttttgtgtttctgcttcatacctgcactcagccgtatctttcaaggccatagttgcatgcaaaga

SEQ ID NO: 6192 - DNA, 1099 bp, Homo sapiens
aatatatatgagtaatttgggagttcttaggtccatcagacactccattgcattctttgattcctcctgcacaaccctagtatcatgcaggttttgtggctattaacctggtttgtccctacgcattatgttttgggattgtgggaatactttatctttttctgtggtaaattggatccttagatttttttggttttgctgtctagttggtccatctgtttttatgtgacgatctggggagattcaaagactatgttgccatcttcccagaaattgatctgagattctaaaaggccatgtgtaaccattctggcagtttagcaatatgtatcaaaatcttcaaaagtggatatcatttatagtagccagaatagtctggattattactatgtaagagacaaccccaaaactcagtgacttaaaaacaacagtggcagtggcttctttcttgcccaggcaacatgttccttgtgagttagctgagggccttattctgtgccatgctcagtgatggagcagccaggaacatcacactcatcatggctgagggagagaaatctctgcagagtctttcacaagccattaaaatgccccatcctagaagtaacaaagagcatttctgatcaaatttattgtctctagaaacagtcttgttcgtacctcacccagccacaagagggtagggaatacaatcataccatgcactcagaatgtatgcagctggaaatatttgagcagtgcctgtattgattaatattattttgatccacagattcttctgatcagattttatcctaaaataatcaactttgttcatttcactgtttataatattcaaaaattgaaagccacttaaatgtccagacattaaaaaacctaattatggtaataaccattaagtgcttagggccattattaatgtgattatattgatctgtattcattcacatgaaaagaggtttgctataataacaatatttactgagtactcaccatgacccaggtattccttctgaagttcttcataatgatacaatgattcctcttttttttttgagatgcagtcttgctctgttgccagcctggagtgccgtggcgc

SEQ ID NO: 6193 - DNA, 1177 bp, Homo sapiens
ttttgtagagacagggttttgccatgttggccaggctggtttcaaactcctggcctaaagtgatctgcctgccttggcctcccaaagtgctgggattacaggcgtgagccaccatgcccagcctctaatcctttttttttaagttttttttttgagacagagtctcgctctgttgcccaggctggagtgcagtggtgcgatctcagctcactgcaaccttcacctcccgggttcaagcagttcttccgcctcagcctcccgagtagctgggattataggtatgcaccaccacacccggctaatttttctatttttagtagagactgggtttcaccatgttgaccaggctggtctcgaactcctgacctcaggtgatccgcctgcctcagcctcccaaaatgctgggattacaggaatgagccaccgcgcccaaccgcctctaattctttgtttaatataaagtgttcattacaaacttgttctcatttgaaaatcaattaaaagcttttggtgaattttgaatgaagatagtaattagaatggtcttttgtattctgaatcagattaataaacatgtagttaaatgtcagttgagtgttcaaagctaagttagaaattaccctgtcctaagtactgtgaaaaatacaaaaactaccttttataaacatgatctgtcctccatgttctcacattgtagatatctgggaaaaagaaaaataatataaactaacagaatacttaaataatagcttgacagtaatttagaagagacaaaacctattccagtattgccatcctaatgttgtataattaaacatacatgatttataactttgaaataaattacatgatttttacaatttcaaaatcaattgcatatcatggcactattggaggtaagtctgttatttcccatgtgcactcatttggatgtttaaattctgatatgttggggaaaaaaaaaagcctataatgacttcatgaagcaaataattttaggaatttagaagagggaagttctcaggatggattggttagggtaagagttaggtagagaaatcgagatttgaagactggggaagatgtagggcgagtttatttggattgcattggaggcagagagtaactccatttggccgatgggggaaaatggtcaagggagggaagagaataatgt

SEQ ID NO: 6194 - DNA, 1045 bp, Homo sapiens
tggtgatttcagtcaaaagtcagccagctaattagaagtcataaactgaaaaagaaatttgtgtctttaatgaagagttacaatgtctaatccattggttctcaaccctggctgcatatcagaatcaccttagaagcttttaaaataaccaggcccgggtcctactctgaccaataaaataagaatctcagagactgggccataagcattaaaaacaaaacaacctcaaaaaaatacctgtcatctcagccacttcaggagtctgaggcggaaggatcacctggaattcgagaccagcctggccaacaaaaatgagaccctatctctacaaaaaaattaacaatgagctgggcatggtggcatgcacctgtatttccagctatttaggaagctgagacaggaagatccctttgagaggtgaagccagctggacttctgagttgcgtggggacttggagaacttttctgtcttacaaggggattgtagaatgcaccaatcaacactctagctaggattgtaaaacgcactctggctagctggaggtttgtaaaatgtaccaatcagtgcttgtgaaaacgcaccaatcaggctgggcacagtggctcacgcctgtaatcccagcactttgggaggctgaggcgggcagatcacctgagttccaggagttcgagaccagcctgaccaacgtggagaaactccatctctaccaaaaatgcattagtcgggcgtggtggcacatgcctgtaatcccagctactagggaggctgaggcagaattgcttgaacccgggaggcagaggttgcagtgagccgagatcacaccaatgcactccagcctggctagaagtttgtaaaatggaccaaccagtgttctgtagaatggaccaatcagcaggacgtgggcggggacaaataagagaataaaagctggccaccccccagccagcagcggcaaccggctcgggtccccctccatactgtggaagctctgttctttcactcttcacgatacatcttgctgctgctcactctgggcctgtgcca

SEQ ID NO: 6195 - DNA, 1075 bp, Homo sapiens
ttttcccgggcagcttacctgctcggcctgggtctttctggacagcaggcgctggaggtgcgcgtcactgtccgccgccgtgtccgcggctgcgccagacagtgtagaacctgcggcctcgatgtccttctcccgtgccctattgtgggctcggctcccggcggggcgccaggctggccaccgggcagccatctgctctgcccttcgtccccactttgggccctttcccggggttctggggcaagtttctgtccttgccaccgcctcctcctctgcctccggtggctccaaaataccaaacacgtccttgttcgtgcccctgactgtgaaacctcagggccccagcgccgacggcgacgtcggggccgagctaacccggcctctggacaagagtgagtgcgggaactactgagggcggcagagggtggtgtctgctgggccgaggctggttgggaggaagctacatccccttcccctggggatccgaggtcccatcgagtgttgtcatcgtgcctctcagtgtctgcctccttcgctggtgtgtgagcccctcaaacggcttaggactgtatctgattaattcttaacgcctcgtcccagaagcggccttttcccttttactgccctgctctctgaatggtttagacactcatgtgttgggaagatttgacttttttgagttgttaggtggacgcccgctctttcttgcattctttgtttctctcccacccccgaatgggatgtggcagtgaaaagccagcggagactccttttaggattctttatcattgaggaggcgccgactcataccacgctgttaggctgtgtggtggttgccaagaggaaccagactcagatccagatcccctcttaagaaacgtaacggtatcgtgggggaggacacgtgtatggaaagtgaactgtaatacaaggtagaacatgacaaggtctagaacaaggtagggtgtccccggctccagagagaaaagaagaggtagcatcagttagtggcagcgggctttgctcagcaaaacttaagtttggatggattcgttgacagagaggcatgtgaatg

SEQ ID NO: 6196 - DNA, 1070 bp, Homo sapiens
actaaaaccttctagttcttgcaacactcattagactgctgcctttagtgttattgcttcaagtttcttttgctttttttcagcatttatctaagataaggaaacgttaaattttgacatctctcttctagatgaagtaaagaaggtcttagacaaattttacaagaggaaagaaattcagaaactgggtgctgattatggacttgatggtaaggcccaaaacatcttcatagaggtattttattacctcttacggtacagcttggtcaggactgtacgacccctcatgtgacctggctgttgtagtctggagacacgtccctgctctttgcttctggctgagtgggagactggcgaggctcacctggtgagccatactgcacggcagaggagctgcagctgcggccttccttcatgctgtgctaggacttcagttttagcccagatcataataaaccagctgtactgccaaaaaaaaaaaaaaaaaaagaaaaaaaaagactctttgatgagtttggtgtggtgtgtctgtgtgctttttaaaatgagaactacaccttacatcttttcattttgtgtttctacagctcgtctcttccaccaagctttcataagctttagaaattatattatgcagtctcattccctggatgtggacattcacattgttttgaatgatatttgcttcggtgcaggcaagtgtttagagactttttaaaatcctattgaacataccttctatttcttctcatacttcatgctcatttctctagaagggcttatttggtttagagtgggtctggtaacatcctctgtaaataattcagtgctttcacaggatgacttctaggttgtttgcttttatattgggtccctgagctggttattacatcacccatatgtcttagactggaggaagactggggcccagtgaaataagctctcacacaagttggaattagtgcatagcagattccatctgtttttgccactggcttccttctccctcatatcaggacaaagttcttgctataaaagaaaaaaaaaaagtcaaaatatcatagtttcat

SEQ ID NO: 6197 - DNA, 1513 bp, Homo sapiens
agtatggacttggagctggatgtggtgacttgtgcctgttaattctggctacttaagagattgagatgggaggattgcttgaggccaggagttcgagaccagcctgagtaacatagcaagaccctcatctctaaagaaaaaaaaaccttttttttttttgagctggagtcttgctgtgttgcccaggctcgagtgcagtagtgcaatcttggctcactgcaggctccgcctcccgggatcaaatgattctcctgcctcagcctccagagtagctgggactacaggcgcacgccaccatgcccggctaatttttgtatctttagtggagacggggtttcaccatattggccaggatggtctcgatctcctgacattgtgatccacccgcctcgacctcccaagaaaatgtttttaaaattagctggtcatggtgctgcgtgcctgtagtcccagctgcttggaagctgaggcaggaggattgcttgagcctaggagtttgaagttacagtgagctatgattgtgccactggactcaggctgtatgacagtgagacactgttaggaagatcactttcaacccaggagttcaaggccatcctgaacaacagtgagaccctgtatctaaattaaaaagaaaaaaaaaagagtatagactttggagctagatggcctgggtttgaatttcatctctgcatttaactgtataacttaaggcaagtaacttaatttctctgggcctctgactttttctgtcaaatggagatagtgataatacttaacctcatagatttgttgtgaggattaaagaggaggtacttaagaggaggtaaaacacttagaacaaacctgctggaaaagaggaacccagtaagtgatggtggtagtggtgatggtgatgcttgaattttggtgttggaatttgtttataatactatttaagtagatggtattgctcatgttaacttttttattttaagatgaagtggctgtaattgatgaaattcaaatgattagagatccagccagaggatgggcctggaccagagcacttctaggttggtggtcgtaatgctataaaacccgtgctttatgacatctgcgctgagatgcatttttatctgcttgccattgccaaccaaatagagtcacctagaacctttctttttgacacaaaaaagtaaactaagtatgagtttttattttctaaatattattttaataatgggaaatctattttttcctgtgctaaaactagcataaccatgtaattaaagttaaaatgttcaaatctcatatttacacaactacaatttatgttttggtgtgtttcatgctagtcttttcttttttgtatgtgcatatggtgttttgagaacattagttttgtatcttgctgtttttcatgtgacatttttcattatgtattaatatgatcgcatatctctattgaagggcaatactgtaatttgctccatagagttgaacctttttttccctattactaataacgctg

SEQ ID NO: 6198 - DNA, 1061 bp, Homo sapiens
acagctattctagtgaatagaagctctttactaaggtgtagggagtctctggaacatgcaggtcaacagttgcttgttttcttaagataaggtctcactatgttgcccaggctgcagtgcagtggcacaatcatagctcactgtaaccccaaactcctgggctcaggcgatccttccacctcagcctcctgagtagctaggactacaggtgtgcgccatgatgcgtggtgtgttttctttttgagatgaagtctcactctgttgcccaagctggagtgcagtggtatgagcttggctcactgcaacctccgcctcccaggttcaggcgattctcctgtctcagcctcccgagtagctgggattacaggtgcccgccaccatgcctggctaattttttgtatttttagtagagatggggtttcaccatgttggccaggctggtctcaaactcctgacctcaagtgatccacccgccttggcctcccaaagtgcagggattacaggcatgagccaccacacccggccgctccgtgtgttttctgtttaaaaattagaatatgaaatctagaggcttttccttttttcctgatctttgtcattactgaactatgaaagagctcaatcacattaatgacttaggatgccccttaggactgtgatttggaagctgtgctccatggagctcctttagggccagctgctggatggatggatggatggatggatggatgggcgggcatctctccctgctctctctgcatagctccttacttagctcttttatgtattgggcttccactagttgtttgtggccaaaaaaaatagagccactgcctttataagataacttgagaactcatgcttggcctgtcctgcctagcaggtagtgtggtcacatttctaccctttatggctatcctacttggcatttattaaacttagcagagtggaccagactgaatttaacaaaattgtggcattatttaactacaattgatctaaaactgctcttcctctctgaagtattaaccttgcttaggttaagcatttagagataattt

SEQ ID NO: 6199 - DNA, 1113 bp, Homo sapiens
tacttggaaagtgtacacaactgtacaaatgccaggtgttatcattgtcactcacccagctcacacctgtagacaccttgagtagccaagtggaggacggcagcttcctggctaacagagtaggcagacaacagagccctgagcctgggcaggggtcctgagtgccattctgcctttgccttggattgtgtgagagctcctggaccatctgcatgtctgtgtgccctggccaaatggacagatgaaaatgacaccatgggctgctgaaatgccatgttctgaggactctaaagtgtcatggagctcctgtgtatggtatgtgaggccagaaggcagatttcatgattgctgttttactgatggaaatacacaagagatcgaagtgacttgctcagggtcatagagggaggcagtgcccatggccgaggcctgaggtctttcgatttctagctcagtccagtcccaccactgcagtatctccaagccacagcattgggatttggttgtctcacagtgaaagtaaacctgtctgcactcagatccttttctccctgttgtcgggaggtgctgggacagtgggaattgtgagactggaggtccagaggctggctgtttgctaagccatccaccaggaggctgagaagtaagcctgttgtgcctgccctgccacattccagggctgttctgttctccccgagggaatgggggcctgctttatttttagctagttcagtgtgacagccttgttctctttctgggcaaggacttggccacttttaccagtcaggaagctccctttagaacctccaggccctactcaggttctcctaggaagagggggccaagggaaggggagctgaagttggagtgccgctctgcttgctgggggcctggggcatttggcttaactgcacagccctaggttccacctgcctcatgtggggttcataacagctaccttacacattgtgcagatttggatggaggagcttagagcacccagcgtgggccctgtccacattcacgttgctagaacgtcagtttcttcatcaagaatggggatcctggctgggcgcagtggctcacgcctgtaatcccagcactttgggaggc

SEQ ID NO: 6200 - DNA, 1108 bp, Homo sapiens
gcatctccctctccaggaagcccctggccctggctctccctggactgagaggatagagcacaggaccaggaatcagggagcttgctgtccaccccagtctctgcaagtatgtcgccctggccagttgaggaacctcctggccactcattcttgcccagggtgttggaagtgatggtacctgctctgcttctgcagacaggatgctgtaaggaccaacaggtaaacgcgctgtgccaattagagaggcctttataggtcaaagtcataggaacgcacccacttgacagatgggaagactgaggtgcccacaggatggcagagccagaagtcaaatgcaggtgtctacatggccccgactgtgccctgtcatcggaccgggaggggtcctgaggaagtctttagtacggctttgctagtttgagtcttagagagtgtctgcaggaaataggaagcgggaagtaggtttttaaagaaaaaagtgtttatgatataattccatttttgtaaaacaaaaagaaccatccatctctttatgtatgagtgtttgtttagggaggaagatagtcctagtacatagagctctaaagtccttgtacataaagcagggatatctctggggagactgggggaagaattaataatttttacttttatgcatttttatgatgttggaatatattttacaataagtatatattactgttattgcttcttttttgttgtttttttgagatggagtttcgctcttgttgcccaggctggagtgcaatggcgtgatctcggctcactgcaacctccgcctcctgggttcaagtgattcttctgcctcaccctcccaagtagctgggattacaggcatgtgccaccaggcctggctcattttgtatttttggtagagacagggtttctccatgttggtcaggctggtcttgaactcccgatctcaggtgatccaccagcctcggcctcccaaagtgctgggattataggcacgagccaccgcgcctggcctattattgcatctttaaaaaaaaaaatgaaacagtgtaaatgtttcaagtagttttgttagaatctttcatttgccatttttttcaggcatattgcc

SEQ ID NO: 6201 - DNA, 1049 bp, Homo sapiens
gctaaatgttctgtgaaatcttccttctaacttcatttgttcatacatttgctcattcattcattcaccattccatcaatctgctctcccatccatccatccatccatccgctgatccatctgctgatccatccatccatccatccatccgctgatccatccatccaatatgtgtctactgagaccttatgccagtcactggggataccatggttgggcaaggctgacctgctgtcattgactttactgtctagtggcttgtgatactttagaaagtgtagtgtttatgggtctcgcagatactgtgtgggttgctcttatgtcttcagaacatgaagaactccagaacaaatgaagggttcattttagggaaatctctccatcagggaatcaaagcttccctctcttcttatcccagataatagcaatcctaatggacaggtgggtctcagacttaaaggcagagattccagaccccctttggacagatttcacagatgcagaattgaggcagcccccaaaacaaagaaatacagaggggaggtagaattgaaagaaaaattgtatcctttcactctgcatcctgtggctcataccctgcagtggggcgttgggggagggccccctgaggattgtctgtttctcctccccagaggagtggtatcagcccctgcacctggctgagcggagactgagaagtcgcagtctggcctgctcagtggaagctgttcttcccggcagacccgcagttactagtttgtggaggtgaatgctgtgcttgctccagcgtggcgccctcacaggaatcccctgttagctgtgttctgtgctctagggtggggctcacctgctgtaggcagcagagggagggagagcaggaggaagtcaggtttcccttggggttgtgagtacacgaccagtgagtacagctttcacacacccctgcgatttcttccctgctctcgaggctcttatttaaaggagtgatttggggcatcttgtatgcagcctgcaaaatggacgccaggaaactgcagctgttgcaactg

SEQ ID NO: 6202 - DNA, 1053 bp, Homo sapiens
ctttattattgttcatgcatctgtgggtcagttggacagttctgctcatcagggccaggattggctgacctctgccggcctcattcctgcatctgcagtcagctgttgagtcagctgggaggcagatctcagacgcccttccccacatgtccagcagttggctgtcagctggggtgcaggggcccctggccctgtgtctcatccttcagtgggccacctggctgttcaagtggtggcagcaagggctgcgagggagaggggaagacttcaaagcctcctggaagcccaggctggggataggttcagctttgcctctgccacactctgttggcctgaacaatcctagggctgggctagatcccaggggaggagaaattgactccatgtttcagtgggaggaactgcagtcatgttgcaaagaaggattttgcacatgcagggaagggaatgatgcagctgtttttgcaaataccccacaccttgacataaattattattttttgtaggagattttcattgttgcagccctggtgaagtctgtgtattgtgacaggtggtttactcacatgctctcctcccagtgtggctccaagtctgtggtggtcagagatgtggtgcccactcttcctctgagtctgtgctgtgtcctaaagggaggagttgcagcttctcctctatgtttgctatggggttctccccttgaaagtctggagtcttggggttactggctgccaagaggcacttagctgtttttgacattctttacgcttttgactgcaacagagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagaggtgagattacaaaaccatagtgcatgtgcactgcacacacggccagtggcaccggcagtcacgtgatgaccaaaatccgccacggggtgcccacatggatttgtgtccttgtggcccagaa

SEQ ID NO: 6203 - DNA, 1033 bp, Homo sapiens
caggtgattggcccgcctcagcctcccaaagtgctgggattataggcgtgagccaccgtgcccagtggcctttaaggtctttactgacatttaatgaaggaggaaaaagaggaagaaccaatagtaccataaagagatggtaactaaaaaatgagtatagtgaagaaccgtgctattcaagtctagctgatgctgtcgcctaccaaatgacctgaactaagaccccctttgggctgagtgcagtctatcatcaaagtaatcccagcactttgggaggccaaggtgggaggattgcttgagctcaggaggttgagaccaccctgggcaacatagggttgagaccctgtctctactaaaaattaataacaataataacaacaataatagtaagacccccttggttaaaaagcggggggatcagcaagtgttggaaggggttaaggacatgtcagcaccaaactggggtggtctttgtggtggaatgagaaggactgggtgggacttcgtagtggtggcccacccctctgtgattccattctgtttcatgttcttccatggaccacatgaaataggaggaatcctggagttccaaattccaggggactcttctcagctttgggacactgggcttgggcatgtgccatggaaatgaatcaatcctttgttatttcttgagatccttgagcatggagagggcaggaaatttgaagtcccaagaacaggttgacctccagtgtgttgtggtcactgaattctccctcctgtgtggcctcatcactctgctgtgggcttgaccagtactctgggtatttgcaaaacctttagaaaaatctagaaactttccttttttttgtcttcttgttcctttaagacttagcccagtcatttgcttattctgcagatagtttttgggcactttcctgagggcccagtgctatgctatgctgtgctgtgccctggggactcagagctgaaaaagacacacatgccctgtcctcttggggctgtcactacagcagtggtggtgggaggc

SEQ ID NO: 6204 - DNA, 1097 bp, Homo sapiens
agtcccacttgtacctacaaggcgaggatccagcttggggcagaggcctggctgggggtgtaacccgcagtggtcaggtctgctgaggccttgactttgcaaagtgggcagggctgatcatggtgctacggactctccacagagcaccaagcctgtttccttgataacagggtaggactttcaagtgggtaaaggtgtcatggctggggagtgttgactaatcaggaagaaaaggacttggtgggagttgggggcaagtagggaggagctgagggtgggtaggtggtggaggcagcaaatgccagaggcaataggaactctttctgggctttctccaaggatgaacctgcttattagagcttggcctgtgatttcttacatttcttatagtttaatggttaagagtgtgggctgtgtaccaggttgcctgggttcaaatcccagctctgacacttaaaggttaagtggcctagacataacttccatgcacctaacctacctgaagagttgctaagcagattagatggattaatacatctgaagagcttagagtggtgcctggcacatgatgaacactccatcaactagtcatggattagtcgttcttttcctgccttcctctctagccttgctgctcaagagccatagactaagaatgagaagggctgttaaagacacctctagtgcagccttttaaatttaccgataagaaatcagaggcctgaagagaagtgagttgcctgaaagcccacagcaagtcagtgacaggccaagaccagatccaggctgcctgactccagtttcttcctcgggcccccatgacctttccaggcgccatgtatgtttctccctggtctcagggtgagggtagaagataacctttctgaaagaggccacgtccctggcctcccagtgaagcactaggtgaagccaggccaaaaagaaagcacttctctggagacagtttccaggagatttttactttcgagaagagctttattatttttgtgaaaatcatacatgcgcatagcttaaaagattcaagccatttgggaaagtacaacgaaaacagcaaaagtcccctttgattctaccac

SEQ ID NO: 6205 - DNA, 1094 bp, Homo sapiens
tcccacttcctgcctgggagagcaggaaccccctactcctggggccactggaagtccctctcaggatgttgcctgtgaccttgtatgagtgacacaggctgtttcccatctcctaccagagggttggccatgctgacctctccggctgtgctgggtgcagtgtggggagactgtgggggtgcttggggtcagagtgttcatttctgggcactcactgtgtgccaggtgctgggtgcaggcatgggcacagtgtggctggtggtgggctgaggccagcctctggcccaccctgtggcagattgggaccatcccctgggtgcagtagggttggggtgctggctgccgaggctgcacaggattctgagactaggtcacttcccagagtcaaaagacaggaacttcttggccagtggaccttgacttcatggctcaaggcctcctaccctgggaggatttcacaagaacacatgtccaccacccccccgccaccaccccccccatcaccagagcttctgattcagtgggtctggtctaggcccaggcacccgtaattaaaaaaaaaaaattataatgacagggtcttgctctgtcacccagagcaagtggtccaatcatggctcactgtggccttgacctcctgggctcaagtgatcctcccacctcagcctcctgagtagctagaaccacaggcatgtgccaccatacctggctaattttaaagttttttttttttttttttttttttttgtagaaatagtgtctcaccatgttgcccagcctagtcttgaactcctgggcttaagtgatccacctgcttccgcttcccaaagtgctgggattatgggcgtgagccaccgtgcctagctttatctgtaatatttttatttttattttattttttaagtttattttatttttgagacggagtcttgctctgtcgcccaggctggagtgcagtggcgtgatctcggctcactgcaaactccgcctcccaggtttatgccattctcctgcctcagcctcctgagtagcttgggactatgggtgcccaccatcacgcccagctaattttttgtatttttagtagagacagg

SEQ ID NO: 6206 - DNA, 1031 bp, Homo sapiens
gatttccaggacacctgtctctgcaggtgaatcctgagtaatgtgaaaccttcttctgacatctcttacgatctggacaggttctctgagctggggaaagttagcaaacacagttgggagaggcccagaaagaaagagaacactctagccaggggtttgggagaagtgcagggggagtcagtagggccccatgtgggcgaggaagggctggtggaggtatgtggagaccactggcctgggaatgtgggagactatgggagctggcttctcctgcagggaaccaggatgatgttgtgggagggaggggagtctgtgagttctagaattttgctttccttttggttgtcttcaaaacattcttttatgtgctctaaaggcaaggtttctatgcagttacctttgtaaatagaataagtttctatagaatcagtcttaacttttatgagtcagggattcagaaacttgtggggtggcctgtgataatttttcctccttcaatgatatctcgagtttgagaactctcgatgcaggattatcatgttggaaagctggctgtgatctccaggtcagtgaactgcagttctggcctccataggagaggtgtggcaggtggtggtctatctctacttcacagatggtgaaagagggccagacaggggagaggaccttgcttgggatcatggtggtaagctaggggccagttagcagaaggatgaggccttgatttctcactctgactggtgagctctgttgtgggttgagtcgtggcctcatcaaaaaggtatgttcttggccgggtgcggtggctcacacctgtaatcccagcactttgggaggctgaggcaggtggatcacttgaggtcaggagttagagaccagcctggccaacatggtgaaaccccatctctactaaaaatacaaaaattagccgggcatagtggcacatgcctataatcccagttacttgggaggctgaggcaggagaattgcttgaacctgggaggtggaggttgcagtgagccgagatggcg

SEQ ID NO: 6207 - DNA, 1026 bp, Homo sapiens
acaggaatatacccctgagcggttaccctgggaggaagcaagccccactccagcccaccccacccagctcttcattcctgggctccctaagcccatacccagaattccagtctcctttccccattcctaccccgcagctagagctccaaccccagacagaggatgctgctggcagtggcctgagctggggacttcctgtctcactgccagggccagacatccagggtgcatccgggagcactgtcttctgctctgactgacctctggctactgagtcagcggggtctgggggggcctggccggaggtccacccagggctgagatctgggaagaaaatcaccagacaccattacccatgtacgctggggacacagccttgggaggcaggcccgtggctctcttggttcagacacatggaaggtggggagagagagacagagaggtctggagagtgagggagaaagaaaaccagggggaggagggtgttgggtggagatgaagttgctcttgactctccttcccatggctgtttctgtggttctccgattaaccatgagtcattcttatccttaagccttggaaggctctgttccagactgggatcatcgcagagttccttctttgggcttacaggcgtctgaagccataaaccatttctcagatttattctcccagcagatatattaggccagtccctgtgctcagggagggtccagttgcatgaagtcaaactctgtgcatccttcagagtccttctctggtttccccaggaggaagtaattgctctgcatcttgtctcagaatgccttggtcagttatttgttctaccgcttctacctgcctgtccccaaactcttccccaaaacagcccagggcatgccatccccactcccaccctgtgcttcatttgtggttgttctggattagaaattccactctctgccctggctggattgaataactggggtttgcaaaactcccagcctagctccttcacagcctggaatgtgctgtgtgcctgtggga

SEQ ID NO: 6208 - DNA, 1053 bp, Homo sapiens
aggcagatctgaggggaccagcccatgacgggggttgtgcagagccgggattggaggatggcgggagccagctctgtggggaaccaggagtgtgctttccagacctcaggccccagctcttcccccatcagcgcctctctcctggtctgggacccttaacgagcactccagctgcctgttatttgatttgcttgctgtgaagaaagaagctggaatgtcccaaatggagaaaatcagatgacacctaggactgggcagccgtgtgcagtgaatgagaagggagtggaatttaaaagagccaaatgctgggccgggtgcagtggctcatgcctgtaatcccagcactttgggaggccaaggttggtggatcacctgaggtcaggaattcaagaccagcctgaccaacatggtgaaaacccatctctactaaaaaatacaaaaattagccgggcatggtggtgggtgcctataatcccagctactcgggaggctaaggcaggagaattgcttgaactgggaggcgaagtttgcagtgagctgagatcgagccattgcactccagcctgggcgacagagcaagactccgtctcaaaaaataaaaattaaaataaagagccaagtccatcttctaggcccaaggggaagcagaggagggtctcagcagccacctttaaggtgagttttgagagatgccaggtagactccctaaccccagtaataacatcagaaactgtaatagaaatgtcctgtagttatagggtgcatacaggggccaatgctatgcgtgtcaccactatatctctttcaatcctcacaacttccctaagggactgacattcacaccacccccttttacagatgagaagactgatgtcactgtacctccctcccactatctgtgattcattcctttggatgttaaggaatctcctgggagaggaagtggttgaaacttccaagctaaaatgttaaggaaccccaggcagactccttcatccctaaaaataacaacaattataataacatgtctcatgtttatacggtgtgtgattt

SEQ ID NO: 6209 - DNA, 1041 bp, Homo sapiens
cttctgcctcagagggctcagaccaaaactagagcaggagggctggtgagcggtgacatgtgtggcatgtcctgaagtgctgggggtgccctgagaaacaggtacccccaacaagtgcctaacaccacctttcccttccctctccttcccagggtcagtgtggagagtacccacaccgggtaagtgaacccctaaaatttagcagggcactttgatccatccctggggcacagcgcccagctcagcctcatctccctggggtctccagttactaacagatcatgggggagcaggagcacccactgccctctgcactcagcagtcagagaggggagcttgggatggtggtgcgtctggtgggaacagctgatgtgtctctccagccatgtgctatatggagccgctcatcacccgtgcgtgtctgtacatccgcccctttgtacgtacgtctgactcggtatgttggagtctcctgctgtgtgtctggagctctgtggctgctctgcacatggccccctgtggcagcgtgacttgtgtgagtctgtttgactccccacccaacaagcatgtgtgtgcgtgtgtgtggcggtaggggggtggtgtctggcagcctagccgtggccaaaacagtgggacttttctattagtcactgtatcagatgatggtgtttcacatccaaacctcgatgatgggagataatcggggactgactgcagcaattcaaggataaaatctctccttggcctctttaaaagcagaggaaacccttctccaagcagggtggggatttcaggctgagatggttcctctgcccacccccgcctgctccttccttttccttgctccaccccaagacacagaacccaaaagactgctgttgtcctgttaggaatcttcaaacttgtgtcccagcagcagggtcgatcttgggacaggggagagcaagatacgcacagcttcctccagtaggagccccagtgagctggacccagaaaaaaatgcccctcattttgtggattggcctcgttgctcccagacct

SEQ ID NO: 6210 - DNA, 1024 bp, Homo sapiens
tggacgtaggaatgtgggcccagctcagccagggttcccagtgtttcatcagaagccaccaattcaaattttatatgtaaagtctcttgctcagttgtttagtgagccaaataaaattccatgggctttgacctaaggatcccatttgatcctctgggtcagataaagacagcaaaaagctgagacaggaaacgagggctattgttcccattctatggctgagagactggggcttagggagaactgtgcctcgccacacagggagggtgacagaggcaggcccaggctgaagattcaggccatctggccaggctgggagcaggcctttggttgggccaggggctgtctcccacccactcctctgcctctgcccccccgcagaatgtctctccgcagcaactcctctttggaagccccaccttcagggacctaacatcttggcgttcttctcactgccaccagcccctgcatgtcatcaccactaccacagcatcatcaccatcatgccaccgcttcctccccccatcaccactccttcccggcagaaatcacagcaggccttcactgggtgcatggcctgagggtgggggacggtctgcagctctgggggccttccctctaacattcgtttccatgaacctcagggcgaacagagccaggccagcatccaaggtccaccagggcccccaggcccccctggaccaagtggacctctggggcacccaggactgccagggcctatggggccacctgtaagtattcccttcctctctccttcaagacttatcccaagaactctctggaaacctccaaaccttgaataggcagtgggtcccctacaaaaagcagaaatgccttggcagggccattggatgtgggtgaaccatgcaaggggctattcatccccatcacactcaccacctgttgcactctggctctgaaacacaacctgggccatgttccctgccttccagggaggagaccgccaatggcctgcctgccccgttcccagccccagcagaga

SEQ ID NO: 6211 - DNA, 1034 bp, Homo sapiens
tcggcctcccaaagtgctgggattataagcgtaagccaccgcgcccggccttgtccttcattcttaaatacaaacgcataaccaaagatcaccagacatttaagaaaagcctacatggaagtgaaagatgaaaatcaatcaataaataaatagaacaactgcctgataaaataatttagaggacagaagataaatttaacacattctaattagtttcagagagatttgaagacatggtgcattcattaaagtacaggatgctataaaaaaggaataacctgagaacaaaaagagctcttggaaattaaaaatatgattaccaaaattagataaagactgaagaaaaaatagaagaaaaaagataagagacttggactattaatccaggagatccaatacctggtttacaggaatctcagtaagagacaaagaaagggggtattgggagaaataaagaaattggcagtgggttgaggggggagggataatcaaagacataatagaaaaaaaatccatgttataaaagtctaagttttcaggttgaaccaacttattgccaaatgctgagcagggttcaatgacttcaaaatattgaagcaaaatgattttgacactaaaaatgttaatactctactaaatgataacctaaagatcgttcaagtaagatagttctgtttctgtaagaaaacaaagtttaggccagatgtggtggcttatgcctttaatgccagcactttgggaggctgagatgggaggatcacttgaagccaagagttcacaggcggggggatcacttgaggccaggagttcaagaccagcctgggcaacatagtgagaccccatctctacaaaaaaatcagctgggtgtggtgtacacctatagtcctagctattcaggaggctgaggtagaggattgcttgagcccaggaggtcaaagctgcagtgagccgtgattataccactgcactccagcctgggtgacagagcaagactctcaaaaaaagaaagaaagaaaacaaagtttacttccctg

SEQ ID NO: 6212 - DNA, 1041 bp, Homo sapiens
ttcagggaggcagaagctggagctaaggtaagtccagggtttccagggctgagcaaactgatgaaaagtcaggactttcattcatttgttgaatattggagcacctgcctgccagtgactgtggcaggagccaggcagcagcaaggaatacaaaagtgcttcagtgaagatgtcagctggggcagaaccagttcacgttaagcatctacggtgtgtgctgtcgggcgcaggcatcaggatgtggatgtgattgtaggccctgaacactcctgaattttacaaccaggcggggaccccagggtaacacagtacatcacttagcacagctggctgctgaattgcatggcagaggcccggagagaatgggcgagggagtcagggacaaaggaggatagccaagtgtggagacagaggtgcagccagacccatgtgtgcaggggactgagcccactggctggaggacgactgggcatccagaaagagcaagaaatggatagactccaaggggagaggggccgaccatgaagggagcctgggaggactgcagtaaggccagggggcaatcaggagcagttgcagattctgagtttaaatgtggagtttaaggaccttggctccagcaaccgtgtggaggatggtttggcagacagagggctggggcccgaagaccatcaagaaagctgtattggatgagggtgggggtggagtgggggtgaaaatgaagcacatgggcctgaaatgagacaaggcagaggaaactgatggtgtctgcagtgacaaagagggaaaaaggggaatcgggtttcaggagtgaatggccattttactgggcacgtgttagccctggggccccagaaaggtcatgaggtgcaggtccctgttgaaagctaaggaggaaaatggcttgcagatggctgcttaggaggtggggctgcagcagagagaagagcactgggcccagacacgcaggaagaagagaggccattgtgggaaactgaggtgctgttaaaagaaaacccacagtgtcacggaaaccaggca

SEQ ID NO: 6213 - DNA, 1065 bp, Homo sapiens
tgccaccctcagaatgcaggtcttcaccaggcaacatcacattaggtaagagaatgcccctagtcattatgtggataggtgcttataccaaataccagggtcacagcccttgcaataacttgaccctcatccttgacaactctggagaacattacaaagcattatggctacaagctgtgttattcatttccagttgccatgaacatactttgttttggactgaaatgtcatcgtgcactaccctgaaagtcattttttacttgattggatgtttgacattgccaataggaacatattccttttatttaaaaatgacttttggctgggtgcagtataatcctagcactttgggaggccgaggtgggtggatcacttgaggtcaggagttcaagaccaacctggccaacatggtgaaaccccatctctactaaaaatacaaaaaattagccgggcatggtggcgggtgcctgtaatcccagccacttgggaagctgaggcaggagaatcgaatcgcttgaacccgagaggcagaggttgcagtgagctgtgatcgagccactgcactccagcctgggcaacagaggggcatcctgtctcaaaaaaaaaaaaaaaaaaaagactttacattagaggaataccattctgctagtaacatgattatacttttaaaatatatgaaataaatcagccatgactgtaacaagccaaactctgtccggcatacaatagcagccaggtgctcgggaagatggcaccatgcaggcaaggcccatctccagggtccttggttctcagcagagcagcctccagttttaggggcatcattgttcagtccaaagagggacactctgcttctggtgcacaaatatacgtggtcgtagagtcagcacgcatggcgggcccctacccagggcctcggtgtattgtgtggcctgggtcctgcactcaggcgttcacgtgtgatgacactgagccccgtctaggcactggaaggcagggagcctacagcctcccctgatggacgaaggggtcccttggatttggcttctacccatgtgaggaagt

SEQ ID NO: 6214 - DNA, 1052 bp, Homo sapiens
ccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagc

SEQ ID NO: 6215 - DNA, 1035 bp, Homo sapiens
gctttgattcttggcccagtctggccctcttcctctgtaggcccgggtctccaaggagagtacgtttttcagtttcagagggttttcctgaaggggcagtaacctgtcagagagagagtggcctatgggagacccggctcctgaaggtggccgggatggttggagccctttctcttgggttgtcagagatgggagtaaagcttcatggcccagggaatcttctgggcatctctactctcccagccagaggcccaggaaccaactccttggcttctgggtagagtaacctgaacccagtggccgagcacctcttaaatgccaggaagggcactgggccgtgcccctggaatgtgtggatggaggaggatttggaggattctgtcctcaggaggctcagcccctgggggcaagacaggacataaacacacaaagttccccgatacagggtttcaataccagtcctgaactggtaatagtggaaagccaagaggctacacaccattaattgctatgtgagtaatgtaggctgcgagagtgccagggcagcagagatccagttccatgcaagcaagcaaatgtgctgaaatgttccagctccatgcccgcccttccttattaccttgctccaagggcagggagcagcaggggcgctgaggaggttctcctgcactcatccccacccactcccaggtttgtttgtttcctgctggtggatttctgaaataacccatttggtttcttggcttgggctgagcacaggacactcctagttgccctgtggctcctggggtttggggtctagagccagccttgtaggaggttcagaggtaagcaggaggaagtcctcacttcctttctgaagagcctctgtcgcggggggttggggtaggtcgggaggctggcaggcactgggccagtttcctatgagtgcagacagaccccaggtggtgcatgcacccccctccctttcctggccagtgttgggggtgggcacagtagggcccaggtggcttgaggtgggtggttcctggcaca

SEQ ID NO: 6216 - DNA, 1007 bp, Homo sapiens
tctggggccctgccccctccctcattgtccctggcaggtttctgtttttctggagcacttcgtggaggtggcagtgtgctcatgctcgtggccttgggtgcagttctgggagtgggagttgctgagctcacccgaagcccttggctggcactgtgagaacttgtgtgaacacacttgcctgcctccaaacaggtggtgcacagacctgggttacccaggcacctgtgggggatgccccgtgtgggcagagacgtgagtgcgtgtgtgtgctcaggtttacatctgtgtgggcagagacgtagaggagctggatacatatatacttgaggacagacacaggaggatggtgggggtgagcaaacaacccagggacacagacatgtgcggggacagacatacatgaacccatcagcgtgggccacgtatgggctgcagacacgtacatagaaatacaccattgctgggatctgaatctccccacatgggaggcagacatgtaagtggacagacatataggtagacccagcagagcacagacggggatgggaaccgacattcccagacaaaagactcggagccacagggaagccgctcaagtgcctgggcagaatggagttggctgtgagctcctggggggcacagacacatatgcttgccagagccagcggacagcagaggccaggaaccagacacaggtgggttctgagaggtaggccgaggcgtgcattgcctggttatcactgtttccctgcgtggcacagtgcccggaagttgtcctgtttggggtggtgatggtacaggtgctctgtggtggagcttatttctagactctcactttggggtttgaggaccccaaaaagctcagtctcctgtgttttactcagagtcatttggcctctccacctctgcattacaaggctgtgtttgtgccttaagtgccagcaggtgctctttgaattttgattctcatcttccctggatctccagaggcttcctgaagtgaggct

SEQ ID NO: 6217 - DNA, 1050 bp, Homo sapiens
gggacctccatacacggggtcaggaaatggcaggctgggcgggcgtatggaagcttgggcctgctgactgctgggcctctgggaggggagccagtgtttgctaagaatagtcccaaatcatggctttcgtttcccagagggcagcccagccatgtgctgcccctgtcttgggccaaggcacttgcagatggactttttatgtttcctgtaactggtgctcagcacaggattgagcctgggagcagcaggcttagtctgggaggaggctctgtttgtcttccgaggcctttggctgggacccggggaaagagaaggtctggaagcactggcctttataatccctgagttccttttccactcagggcttttcctgacacatctgcctcgaccatcttcctacctgcaaatagacctgttgtgattaagaacactggctctggaaagaaactaccagggtctgaatttctgctccctccctcattagccatgtggcccagggcaagaaacttaacctctctgtgcctcaagtcccttgtgtaacagggttaaggatagcaactcccttatgagaatgtcacaaggatgaaaggaggtaatcgcagagagcctccgaggctgtctggctcctaggaagtactcagtaaacattaggtgcttatgttattaccacgatgttattctctcagcagaggccaggatgcttgcacaggaccagttggtgggaagggaccagcgtggcatcttgatgtgggttcctgagctttcttggccctgggttcagtatgaggtgcaggggctccgaaggtagattaaactctgtccctgccaggaggtgagtgaggtacatgcagacaccatgtctggttctgtgatggggtctgtgctagttatggttggagcctgagggagggaatggctggcctggggtgtgtgtgatacttcacgtgggctttgagggatggccaggagtttgcaaaggaggagggcaaggcttccccagcagaaagagcagcgtggcagaggtgtgacagcccttgtgaagcgttttgt

SEQ ID NO: 6218 - DNA, 1026 bp, Homo sapiens
ttttttttcttgtttttgagacagagtttcactcttgttgcccaggctggagtacaatggtgtgatctcagctcactgcaacctctgcctcctgggttcaagcgattctcctgcctcagcctcccaagtagctgggactacaagtgtgcaccaccacacccggctgatttttgcatttttagtagagatggggtttcaccatgttggccaggctggtcttgaactcctgacctcaagtgattcacccgccccggccccccaaagtgctgggattacagatgtgagccgccgtgcccagccacaaacttcttttattacaaccacggaaggggcacacatgggtcctgtctctggtatggattcacacacacgtgcacaaattgaagtccaataaaaagcatttcccacagacccaccatgtgccatgaaagagcttctctccagcacagactggttggtgttgttctggtcttgagctctcaacaagagctttgccgtgttcttcacagacgaggactctgggactgtggctgtgcagatgttttctcatggcagagttatccaagaacatcttcgtgctccctttatgaggcaagctgttgttcttggggcatcatcttatttaatttttcttggcttcattccagcaagttatgccgattgtttaggatttgagaggttactgccaggtattcctccaggaggaagtttctttcctgtcatatactttgaaaatcaggaggcaggttctcttcaatggccagttcttcaaccactgttgaggtatcaaagtcaatatcttttttttttttttctctgaggactacatggtgaccaaaaacttgccctccaggttcttgatctgcacctgcttctgctcccacttgttgttgcctgggttggcgccatcaccacccaccacatttctgctttgacgtctgccctgtagtgactgaacccttcatcctgggacccctgaggttggtgccaacccctgcacttcccagggacagccctctatcaggg

SEQ ID NO: 6219 - DNA, 1049 bp, Homo sapiens
tcctcccgagtagctgggactacaggcgcccgccaccatgcccggctaattttttgtgtttttagtagagacggggtttcactgtgttagccaggatggtctcgatctcctgaccttgtgatccgcccgtcttggcctcccaaagtgctgggattacaggcgtgaaccaccgcacctggctgtgcccaattttctcacctgcagaatgggcatgaacatttccccctgcctatcttcaatgttttttttttaaactgaggtgaaatccatttaaataaaataaaccattttaaagcccacaatttagaggcatttagtatagtcacaatgttgtacaaccaccacttctatcacattctaaaacattttatcaccctaaaggaaaactccacctattaagcagttactcaccattcccttctccaccacagtactttttttctttaaaaaaaaaaacaaaaaaacaaaaaacagttttgttgagatatgtgcaccataaaatacacctgcgtgaagtgtgcactttggtgaatgtcggtaaaagtcctgggcatgcagccaactcctagacaagtctgacaacactttccatcacctagaagggccctatgctcccttgtagccggtcaccactcccaccttgggcccaggcccactcatctactttctgtcactatgattttgttttttctggatttttcacatacgtggactcatataacaggtagcttttagtgactggcttctttactcaacatgatgttttttgagattcatctctgttattggatgatttaatcagttccattccttttttattggtgagtagtattccaatgtgtgggatatgttaaaaatagtttaaaatttctctctctttttttttttaagaagggcctctttcctgttgcccaggctgcagtgaagtggctcagggtcgactcactgcagccttaacttctggcctcaaatgatcctcccacctcagccttctgagtagttgggactacaggtgtgcaccaccatgcccggctaatttttgtattttt

SEQ ID NO: 6220 - DNA, 1172 bp, Homo sapiens
cttgcccagcctacgtgggtggaggatgggatgcctgtggcctctgaggaaggggctgcctgggctcagattttcaccctcctggccccaccccaaccccaaccaatgagactgcagccagtggggtcccaggtgctctgagtcttatgtcatgctgctttccttgacactgccatcgatgtgtagatgaaccccatcccctgcatcctaaagttggttgttttcattgtttttaagttttccctaacttaacagtacaaagtagtgccttaattgtaagacatgggttctgggagataggaatcctgtgtggtggttccagggcagccacttgcttacccaggaaggggttgtcttgtgacttggggtctcatcctgggctcaggaatcctgtagggggaggggaggacctggcagggagctctgcataggtgggtttgtggatgtctccctttctgcagctcagtgctgctcaaatgtgggtaatacgtggacttccaattcacagccctattgagatctaattcacatgctgtacaattcactcatttagtagcttttagtacattcaaagagctgttgtctcaccacagtctaattttacaacattttcatcaacctcaaaagataccccagtacccattggtagtcactccccacccccagcccgctagcatgctctgtatctctatagatttgctaattctagacatttcatataaatgaaatcatacaacatatgggttttttgtagactccctctctctctcttttttttcttgagatggagtctcgctctgttgcccagtctggagtatagtggcgtgatctcggctgatggcaacctccgcctcccgggttcaagcgattctcctgcctaagcttcccgagtagctgggatcacaggcacctgccaccatgcccagctaatttttgtatttttagtagagatgaggtttcaccgtgttggccaggctggtcttgaactcctgacctcaggtgatccatctgcctcggcctcccataatgctgggattacaggcatgagccaccacgcctggccctctctctctctctcttttttaaaggtctcactctgttgctcaggctggggtgcagtggtgcaatcacggctcactgaagcctcaacctcctgggctcaggtgatcctc

SEQ ID NO: 6221 - DNA, 1045 bp, Homo sapiens
ggctttcttaagcatgaagcagcattggttgctgtatacaatgcaacaaccttttggaaaggtaatttggcagtatctcggaaagctgtttaagtgcacatctttagctcagcctcctgaattctggtaacctgtcctaaagaagtaaactatcaggatgcaaggctgtgtgcacaaggattttgcggcagtgaaccggagactcgctgtctcctttcagttctgtgttcttcccaccgcagggcatctgcacgggccgttccctctgctgccgggcatgtgtcttcacacggccggggccttcctgtcttcatacgtcggcataggccttccgtgactgtcatatctaaaatatgttccttccctatctttctcatctagctcagcctctcagcccctggtagcccacatcacaatgtatacagtgtatcataatcgtgttccctggtggactccctccctccctccctctccttctcttgttggaagatctgctccatgagggtccgggtctgtgcctgtctggttgacagggtcagtacttcgcagctgtttgttgaatgagtagtgatgcaatgaaatggcttttgccaccattaagcagacagggttggaattacgtgtattggctgggaggggtgtttgtattaagcagacggggttggaattacctgtattggctgggaggggtgtttgtgttgtcctgttaagggcaaaagcttgttgcacaaggaagcttaagaggtgggcttggatggggatgggaagggcataagcgttttctctatagacctttgacttgtgacaataagtacaagttacttttgtaataaaaaacatctggcaggccgggtgtggtggctcacacctgtaatcccagcactgtgggaggctggggcaggaggatcactgaggccaaggagtttgaggggagcctgggcagcatagtgagattcttgtctctacaaaaaaaaaaaaaaaaattagccagctgcggtagtgtgtgcctgtagttccccagatacttgggaggttgagatgggag

SEQ ID NO: 6222 - DNA, 1676 bp, Homo sapiens
ccatgcctggctaatttgtgtgtgtgtgtgtatttttagtagaaacagcgttttaccatgttaaccaggatggtcttgatctcctgacctcgtgatctgcccgccttggcctcccaaagtgctgggattataggcgggagccatgtgcctggcctattaaaaacattttttaacgaggccttaattttcttttaccatggtaaaatatacgtaacataaaatttaccattttgggcgtttaaaattgtataatttaatgtcattaagagcatccatattgtgcacccatcaccaccatccagccccagaacttttccttctttccaaactgaaactctgcacccattaaacactaactccccactccctctcctccaggccctggcacccacagttctacttcctgtctctgaatttgaccaaggtatctcatattattggaatcgtacaatatttcttcttttgtgtctggcttaaacatataacataatgtcctcaaggttcatccgtattgtagcatgtgtcagaattcatttcttttaaaaaatgttaacatttattttatttttctttagagatggggtcttgctctatcaccagagctagagcgagcacagtggcatggtcctagctcactgcaacctcaagttcctgggctcaagcaatcctcctgtttcagcctcccaagtagctgggaccacaggagtgtgcgccacacctggctaatctttaaaattattttttatcgaggtgagatcttgtgttgcccaggctggtatcaaactcctgacttcaagcagtcctcttgccttagcctcccaaagtgttgagataacaatcatgagccactatgcctgtcctgttttgtttttttttttttgaggctgtaattgttcttttgagcatatttgaaaggtatcgcacagactgggcgcggtggctcacgcctgtaatcccagcactttgggaggctgaggtgggtagatcacctgaggtcaggagtttgagaccagcctggctaacatggtaaaacccggtttctactaaaaatacaaaaaattagccagacgtggtagcgcgtgcctgtaaacccagctacttttgaggctgaggctggagaattgcttgaacctaggaggcagaagttacagtgagccaagatcgccccattgcactccagattgggcaacaagagcaaaactttatctcagaaaaaaaaaaaaaggtatcatacgtctttgggattgagtgagggggtcagcttgatggtgagagtggcaataaatagcatttgttatgtttaccaggtgctagcactttccttacattgtctcatgtaatccttaccatatccctatgaagtaggtattaacattatccttattttacacataagggaactaggctcagagaagttcggtaacttagccaaggtcacacagtaagtcacgggcaagctaggtttggatgccagttctgcctggctctacagccagtgctgtgtgtttctgaccccagctctggcccttccttcttcaataccaggcttagagttatttcttcaaatccttcttgtcacctctctggcctgagtgtggagctgattggtgccatggtatgggcccctcctcccagccccaggtccccttcctgggccccagcttcttctgaaagcc

SEQ ID NO: 6223 - DNA, 1032 bp, Homo sapiens
aatatcatggactgggtaatttataatgaacagaaatttatttgacttacaattctggaggctgggaggtctaagagcacagcactgacatctgcttggcatctggtgcaggccttcttgctgtgtcctcttatggcagaaggcagaagggcaggtgagcatgtgaaacagataaaactcactccccaaatcccaattttaaaaggcattgagggcggggcgtggtggctcacgcctgtaatcccagcactttgggaggccgaggcaggtggatcatgaggtcaggagttcgagaccagcctggccaacatggtgaaaccccatctctactaaaaatacaaaaattagccgggtgtggtggcgggtgcctgtagtcccagctactcgggaggctgaggcagaagaatcacttgaacctgggaggcggaggttgcagtgagctgagatcgcgccattgcactccagcctggagacagagcgagactccgtctcaaaagagaaaaaaaaaaggcattgaatccaccgtgaggacagagccctcatggcctaatcacacctcttaaaggcctcttaatactattataatggcaattaaattccaacatgagttttggaggggccattcaaaccatagcagtactgttagcctgttagtcacatggccccaggtcgctgcaagggaggtggggaatgcagtcttggctctgggcagctgtgtgctcagctggctgtccctgcttctgggggatgaaggcattgtgagatttttgattaaatctgggccatttccaggctgaaaagctggaccagagcttcagggcttgagtctctcacagagagatttcccaatggggacatcagtcctgccttgggaccagaaagccacatgctgtaggccaggaagggggaagcaggggctgagcccgagggagaaaggctttagaggtgttagcagacagctcagtggcagtggttagaattagggaggcagcgacctcttcttagtgtggtcagagcatgccaagaaagtgt

SEQ ID NO: 6224 - DNA, 1034 bp, Homo sapiens
tgtcatctcagtgtgtggcagccatgaggcctccttcctgccaggacttggcgcttgcttcaaaggctccccagggattgcaggctgaaggctggaagtcagggctgccccccgcagtggcagccccgcctgcagagcaaaggactgcatttccacacgtcctctaatttctgtttttaacttttaaactattttttttctagtttagaaaaatataaaaacacttgagaaacacataatttagcaggtgaagggttcctgtgatcccagcccccagacagctttattttaacatttagattggactcttcctagttttaaagagaaagaggctgaggggcagaggtcatgaaggatgggtctgtgggacccccaagagatgaaggagtcggggccaggagcctctgcctccatgaagcctgtcacctgggaggttcatgtctttgactttgctcagccgtcacctcttctgtaaactggggatcctaattctcggctctcttgagggctgtagcaaagacacaaaaatcctaccagactgtacaagtggaattattgtcaggggaacacgcgctgcagtgggcagagtgcgcctgggcagagggccagggttaaggacacggggccggaggagcatggggtgctttgaggtgggtggggtgagggttctctgggtgaagagttgtgacctttgcccaacttggaaacttatacaaataactaaacttaaaaagaaaatgttcctagggtaatcatgttcattgtaagatgtttagaagcgatggatgagcaaaacagaagaaaataaatatcaccctgcagctcactactcaggaataagtaccattgctgttgaagtagatggcccccagtctttggtgcctacttgttgagaaccagccttggcccatcatcagtaaccagacagggtggggaggtaaagtgatggagagactctgccctgccctcttggatcagattcaaaagggaaggagataggtcagtcaggtgctagtggcccaaagctggtgggg

SEQ ID NO: 6225 - DNA, 1810 bp, Homo sapiens
cgggtcatatgagaagggtatgtctccattagtaagaaattacaaaactgtcttccaggtggctgtatgctttcactgctcgccagcagtgtatgtgagttccagttactcatatcttcctcagagctcggtatcgtcagtcttttaaatttgtcattctagtgcaggaccctgatgacatgatcccgaacatctatttaatgtgcttatttggcatctgtatgtatcttcaaatcttttgcccatctttacattttaaaaaaattgacttgatattgacttgttaagagttggcacctcttttttgggtcaggattaaatgagataatatacgtcaaacgccttgcagtcagagattgacccattggccctcctggtgtacccctctctgcgctcagggtctctggctctctcaggtggctgttcaaaccccacctcaccccagtgagtccccgacccctgccccctggcagacacatgagtcacacactctcgaccaacacagtgactgactagcataattccatactgacacatctctgtgtgttcacaacacagtcttcctgtttgcctcaggccagaggcagtgcagcccagccagggagccttgggtctggagaaaggagccctgagtcccaattctgtccttgtggccacttgctgtgtgaatgggggcatatcactctcctgttctgtgcctcagttgcctcatctgtggaaagagagcattttactatgttttattttttgtaaatgagacagagtctcgctatgttgcccaggctggtcttgaactcttgggctcaagcagtctgcccacctcagcctcccaaagtagtgggattacaggtgtgagctactgtgcctggcctctaatatttcagtccattcaggctgctacgacaaaacgccatgaactgggtatcttaaaaacaacggaaatttatgtttcatggttctagaggctgagaagtccaggactaaggcattgattcattatctgatacaggcccactttttcattgatcttgccttcttgccgtatcctcagatggtgtgaccaggcagctctctggggtccctattataagggcactgatcccattcctgagggttctgccctcatgaattaattaccccctctcccccaaagcctccacctcctaataccatgaccttggggattaggatttctttctttctttttttttttttttttgtgagacgaagtctggctctgtcgcccaggctagagtgcagtggcgcgatctcaactcaccgcaacttctgcctcccagattcgagtgattctcctgccttaccctcccgagtagctgggattacaggtgtgtgctaccacgccgggctaatttttgtatttttagtagagacggggtttcgccatgttggccaggctggtctcgaactcctgacttcaggtgatctgcccgcctcagcctcccgaagtgctgggattataggtgtgagccactgtgcccagcctgggattaggattttaacatatgagtttttaggggcaaaacattcagaccacaacagctagatgaacttcagggatgtggccagctctgaatctgctttttgggggatacagggcagggggtcttgagtggttaggcctcagcagcgatagggtcttgcagcaacagccatttgtggagattgctgtggtctcagcatctctaaggtgggacttgggattgtgccagagggtctgggattccggccggcggggagggcaggaaaaagggacggggtgggcgtagtggctggggtcagtggcagacag

SEQ ID NO: 6226 - DNA, 1115 bp, Homo sapiens
ctcacctggcaggtaccaccgcctgcccctgcccgagcaagggagtcccctggaggcccagttggacgcctttgtcagtgttctccgggtaactggggcacgggcgcgcatgggggaggagtcttgagagtcgtccccatggaggtgctcagggtgggcacagcctctcgccttcctcagaggaaggcttcattctgtgttgtgtatgtgagcatgttagggtggacgtgtgttggtgtctgtctctgtatatgtctgtgtgtgtcagcgcctttgtgtgtgtctgtggggagtgtgtgtacatgtttatgtgtctctctgtgtgtctgtgtgttcctgtctgtgtgtctctgtgtggggatacatgtgtttctgtgtgtgtatgtgtctgtgtgtgtatgtgtttgtgtgtgtgtacctgtatgtaggtgtgtgtttgtgcattctcttatggcagagtccatcactgaccgctggcccagctgctggccgtggctgggctgccaacttgctgtgtggtcccggactaatcacctcacctctctagacctcagttcctcctttctttagtggagctaacgactcttgccctatagactgttcagctgacatttcctgagtcctggcggagtttctctccagcccccttcagggcattatcttatttcactggcatcttgcagaaggtgttaatactggcctggtgccctctgagtcgctctcacttccagttctttgagctcctccaaggcctggggagggagcaggtggagctgatcaggctgtggctttggcagaagaggccaagacacctattggagcccactttgctgcagactgtggggcagggtgggctgatgtcatgcttttctccctgctcaggcctcagcccagggtttcctggtctcactggggcctgatcctcatggtctttcccaggagacccccagcctgctgcagctccgtgatgcccacgggcctcccccagccctcgtcttcagctgccagatgggcgtgggcaggaccaacctgggcatggtcctgggcaccctcatcctgcttcaccgcagtgggaccacctcccagccagagtgagtggcccggggcccagcgtc

SEQ ID NO: 6227 - DNA, 1029 bp, Homo sapiens
tagctgagtccctgctttcagttcttttgggcatatactcaggagtggaattgctggatcctatcgtaattctgtttacttttttgaggaaccaccatgctgtttgccgcagtatatgcaccattttacattcccaccagcaacacacaaaggttctgatatttccacatcctcaccaacacttgatttcttttttctgttttttttagagatgggagttcaccgtgttggccaggctggtctcgaactcctgacctcagatgatccacccgcctcggcctcccaaagtgctgggagccactgtgcccagccgttttttttttttttttttggataatagccatcctgctgggtatgaagtggtatattgtggctttgatttgcatttctctaatgattagtgatgttcaatatctttttatgtgtttattggccacttgtatatcttctttggagaaatgtctgttcaagtcctttgtccatttttgaattggattgttgttgagttttggttctttatatattctggaaactaatcacttataagagaggtgatatgtaaatatgttctctattctgtgggctgactttttactcattgatagtgtcatttgatgcacaaaagtttttaattttgatgtagtttgtctgttttttcttttgttgcctgtgcccttggtgctatatccaagaaatcattgccaactccaatgtcatgaagcttctcccttgtgttttatcctaagacttttatagtttttaactcttaggtttaggtctttgatccattttgagttagttttttttatatggtgtgaggtgagggttatctaagtttattcttttgcatgtggatatctggtttttccagcaccgttagttcaagagtctgtctttccccattgaagggtcttggcacccttgttgaaagccagttgaccatatgtataagggttttattttccagctgagtttagtctttgcatcggtgccttgaatgtgatggtcaggcctctccttcttcacacc

SEQ ID NO: 6228 - DNA, 1089 bp, Homo sapiens
ttgtggttgttaccagaggtccttgtttctgctgcaagatccacctctgaaaccctgactccaggaccctgcctggcacaagtaggggctccacaaatgtctttctagtgagtggatggagggaaggttgagtaaatcattgcataaataaataggaaaacctgactctacctttattattaactattagtcttccaggacagagcgttcttctgcagcaagcaaaagagccctgggtcaggggttggaagccctggctgcagccctggctctgccagtaactccctgtggaaccttgggcaagtcactttggcctgctggacccctgtttttccatctgtcacctggagttgttacccttgctctgtgtgctttgagggatggtggtgaggaccagtctggggcccatggcaggtgggatggggtgtggggtgtgcagggtggctgggctgccaggcaggctctatgggctacatgcggacacagtgggcctcttgaggaacgagactgtgtcctctcagcattgaatctctgtgcctggcctagaggtgctgctgaacagcgtctgttgaactcacagcatgcagagtggcccacggcaccaggtcaagtcccttcacactttgaaattacttaacaaaatatgatgtcacctttggaaaatgggttactggtagggattgagggcaattttgtccttccaggggttaggtacagaaaagcgtcctgtactggggccccaccgctgggctggcctgaggatgcagtttgcagggactcggtggggacccaccacacgcagcggctggtgctgcacgtgggaagagggtgggctgccagccctggaacctgcccttcagccactggccatctttggggactgtcacttgcctccccacctcagctggaggcagaggtcaccaggccaggtttctttctgttgagtgggtgagcgaggggatactaaggagtcttcagtaatggcagggggtggcagggtggggagtgttgctgtctggcttggcttgatgaagaccctgaacctggccttgttggctcttccttttttttttttttttttttagagac

SEQ ID NO: 6229 - DNA, 1064 bp, Homo sapiens
aaggccgactcctggcagaggcccttcagcacctggatgcaggaggtgaggggaggctgaggccgagaggggccggggcgatggctcctgcagatggagctgggtcacagccactcagtgcctgtacatggcctgcggggaccccgtgacaggcgggaagagcccccatccccctttctgcaggaggcttctgtttggccaagagtttgtctaatctgactttgggtcccgagcagtttgtctgtgcctggcaggcagttgatgagtttgatgaatgaacaaatgaatgaggaggagggaggggacagagtggtgagggacagagcagggcagcctctgggggtgggaccctgtcaccacagccacccttgcgtgcatgacagctctgggcccacctgggcacttcatgcccacaattgtggtcagccctcacctgtgctccgcgagggcctagggtgaggctgtagtggccctgcccctttctccctccagccgtgaccttggaccagtgagccaactcctccacagctgctggccttagcactaacatggaggtgatgtggatcctgtgggtgccagccctgaaggctgcgttggggacttggggagacatacagtgccatctgctggagcctgtactaggcaggtctagcacactgtgattgtcgctctcccattttacagaggcagagactgagcacagagagggtgggtgacttgttcaaggttggcattagggctgattgattggctccagagcccactgtatcctgacctaagacacctcccttgctgtccggcctcctggatcctctctgtttggcctcctggctcttcttgcactcagttgttttagaggcagagctgccaccttggcacctctaggtcagaagagaggcctccttccctccttggcaaagcggcctgtaattactcctctgccaggaagctggcccctccagacctcaccagcagatcctggcagttctaatctggactggaggctggaattagctcctgggaagtgggtgggtggagagcaggggccggtgacctggccagag

SEQ ID NO: 6230 - DNA, 1030 bp, Homo sapiens
gcatccccagttttgcctcaccctcttacactggatgtcaggctgagctcctccttgaagaaagcaacggaaccagcgaattctcactaacatatgaaggattgctgcatctagggaaacagtatagagcaaagtggaattgggggcctgtgaaggagcctggatctcagcctccactttctcccctaacccctgtgggccccacctgacccctttgggcctctggttgattgaacacacctcacccctggttgagtgctggcatttaaagagtcagtggggagggtggggtagagacagcactgactccaggcctcttcccccatgcttgcagggttaggggaacaaggttgtagttccgaggtcagctggggtgggcagaatggaacccagagcccccaccgcccctagggttggtgttctccccagactaggagagaaggccccgggggttctttcccagcccagcagggtatggaagttgtcttctctaggtgcaagaatgctctgtgtggcttctggacaccagtgtagagctgtgtacaccggggtggggtggaggggggtgggggtgggggtggctctgccattctctccctgggatgtggggacacacaggagtgagtgggtgtgcctgtgtgtgttcccaagttcccctgggcctgctgtagcctgtgggaggacgcttagcaatgacatgaatggcactgacccacatttcagtagctcctgctggtcagcagcatctcagccctcatggtaaatgagtgaacccagcacagcaaaggagcaatcagcagagttagggagcctaccgaataggagacggcatttgcaaaccatccatctgataaggggttagtatcccaaatccataggaaacccaaacaatacaatagtaaaaagcaagtaactcaaaagaacacacacaaatgacccacaggcatatgaaagaaatgtccggtatcactaatcaccagggaaaggcaatggaaaccacctcacacctgttaggatggctgcaggaaga

SEQ ID NO: 6231 - DNA, 1060 bp, Homo sapiens
ctttttgtttgaatttggccatattcttgaactcacttaataactaagttttctgattgattagtgctcatgtaggaaaaaataaatatttccttttgtttgaatttggccatattcttgaacccacttaataactaagtttttaaaaacttgtcttggattttggagatagatgatggtattatctgcaaataataactatttaatttctttctaatatgtataattagtatttctttttcttgtcttttgttataaaggctagaccttcctgaacaatatttggaatagtgaccatttttatactttctaagtctaatgggaatatttcaccactaactgtaatttttgatctaggtttcaagtaggcgcatttgtcaaattaaagaaattttcttttattactggtttgcagattttaaaaaattataaattgatttttaattttaaaaatgttttcttgacatctattgaggtggtcatatattttctcctttaatatgttaattttaaaaagtacattagcagattttccaatgttgactgatcctttgcattctttttttttttttttgagatggagtctcactttgtcacccaggctggagtacagtggtgtgatcttgactcactgcaacctctgcctcctgggttaaagctattctcctgcctcagcctctctagtagctgggactacaggtgtctgccaccacgcctggttaatttttgtatttttagtagaaacagggtttcaccatgttagccagactggtctcaaactcctgacctcaggtgatctgcccgccttagcctccccaagtgctgggattattggcatgagccattgcgcccggcctacattcttaaatgtttattactacgtcatggtgttgtcttcttttatcatattgctgaaactaaatttctaatattttatttaggatatttgtgactatgtttatgagtgttttttttccaccatgttatgctttttaattttgttgtcagggttatgatagttttatacatgtgttaggtagttttgtctttttcaacattt

SEQ ID NO: 6232 - DNA, 1042 bp, Homo sapiens
tattctgacgttgttttttctctttttttttttttttgagacaagtcttgctctgtcgcccaggctagagtgcagtggctcgatctcggctcactgcaacctccgcctcctgggttcaagtgattctcctgcctcagcctcccaagtagctgggattacactcttaagcctgtgagagggcaaggaagggagtagtttctggaactttgagagagttgagatgaaggagaaggtaacctgtaggaatgccagccagtgacccagtaggaaaggcatcaaggggaataaatacttcaaactcttttgctaccctctgatctcctgctgtagcctcccattggtctaatacaactggaaaccagaggttaaggagtctggttgatttaattcagagggtggaatccggaggcacatagccgagctggaaaatgctggatggaggatctggaggaggagatcatctggaggggagaacatccagcatgctggagttgagaggtctagtttgtcttaaaaggcacaaatgaggagataattcttgaacagaatcttgaaggtggatagcatatggattatagaaagggaatgttcccactgattttaacaggatagattcagaggcacacagttgccacagctttggcaagcccaaagctgctttgttccagtagtagccttagaatcttaattgcctggagggcctttaaaagtactgcagtccagctttcttgctgcctaggaatccctctacaatgccctgtcaggagtgagtgctacatactttctcagggggttctttccactgttggacagctttaatttttagaaaatttttcatgtgtccagatcactgaatgcatcagctagaattaggtttgagtgtatataacagaaaaacctaaagtaatagagattttttaaaagacataaatatatttctttaagagaaaactggcctggcgcggtggctcacgcctgtaatcccaacactttgggaggccgaaatgggcggatcacttgaagccagaagtcaagatcagcc

SEQ ID NO: 6233 - DNA, 1026 bp, Homo sapiens
tcttttgaattcgttttgacagatgggtctaaaaaggaatagatcaattctgtattgaattccagtcttaatggcaccgagtctttgagacaattgaggcaaattggaaattctgttttcacattcttctgaaaggggatgcctttcagaagtgtcctgaagggcgctggggagggcaaatatgaggatgccagggtaagtctgctccctgtctggctgtgttgggccagagtggaagaaagcctaagactctgttacccagccctttctgaaaatgttttcaaatgctttcccaacaatcacgaccacaagagtcaacagtctgtttggatgactgaaaacacacaggtttacgatctgtaaagatagtaggtaagtgatttaatcttgttgtataggtaggccagagggcactcgcagccttctgattgatttaatagattgttgaagattaagagttgacttaacatctctcttagaaaactgagaaatagctcattactaaggtgtgttttattaccaccgtctgtaagaaaatacaacataggcatgggaatcaaactacttaaagcctcttccagctcctttgtgactgggaaggttacttttccttgttgcttattgaagagaaaaggaaaatgtttatcattggataattcaggttcactgaatatttaatgagtgtttattatctgcagtcattttcttattaccttatctcatttaatattcacaacaaccctgtgagtggacgatggtatcttttttttttctcctgaacgttttgttgaattatcccaatggcttctatttttgcagatgagcagagtccagttgcatagaggtttagtgttgtgccacacatcacacagcttctaagtgagagctaaaattagagccgaaggttttgattaccagtccagactttctaggacaccacagctgcctttctgtagaacagattaacatgactctcagagtccgcaagagtagtggtgaggtgtcagttcaggggaatactcaaag

SEQ ID NO: 6234 - DNA, 1027 bp, Homo sapiens
catggtttatacctcattgtggtttgtttgctggtttcatctctgatgatagtgtgctgaaatttcacacttttcattttgctttcttctgccaactctgctcataatagttctcaaaattcctaggactggataggaaaggagagaagaaggaagctattgcagaaaaaggccactccaaagccatatagagaacaaaaaataagtatagacaaaggcaaatgttcctgctgttagaaggcagttgaggatgaggacaacattattatcagattgcctttattgtagctaaatgctattaatatctttttcacattgctgataataatgatttttcatctttattttattgtgctaactctattgaacttttttcttgatttgctataagaatgctgttgggtttccactcaacatttttttcttttgtatccagaggagtttcttcctgtttcttctttatcagaacctgtcttcccagagattcttgcttactgaccagtgaccttacctttctctgcagacgccttctggcaagaggggagagcctctggaacagtgtacagtggggaggagaagctcactgagctccttgtgaaggtgagtgtccagttcttgagggaagcctgtgaggtctgtgccagtttacatgacctcctttttttcccttacttttgtaattagaaaaattacttaaggaaagcttattggtacaataaaaccataaaagtttctcttcacccaaacataggcgaatatgtataatattatcaaagacatcttcagtctgtaaaatagtaaaatgttatttatgttttcagtctttgcagatgtcctgtctagaaggcagattactagggaaggtagtcctgtcagatgagatttttgtggtgagacagattttgtttgataagaagagataagatagggaaactctttcataattttctcaaatcatgtgacccaagatgagcagtggtctcatgtatacttcaaataattctcattcttagcttcttccatttct

SEQ ID NO: 6235 - DNA, 1060 bp, Homo sapiens
ggggtttcaccatgttgcccaggctggtgttgaactcccaagctgaagtgatctgcctgccttggcttctcaaagtgctgggattacaggcgtaagccaccacgcttggccgtcttttttttttttttttttttttaatctgcttggttgttttttatagtccttttccttggcttaacttttgtttacttaaatatattacacataaatatgttgtattctgtgtctgataattccaatatccatgagccttacctgattctgctggcttcagtcatggttccttgtttccttatatttgtgattttattttatttatttatttttttatgagccactcatttttctgggaacctagggattctttgaggcctagattgaagttaagtctggaagttctcttcttccagagaagatttgtcatacctttttgagttgctggggattgccaccacactggaaccaaattaagtcaaatccttagcttgtcattttgtaccacagaggtagtgtgaattctgaccacaaactcacataaaggcttccttgttacacattcttgaaagattgctatttttctttacttgaacatcagggttgagaaaaacagtttttcttttctcttttgcagtagtgggatttatttcttgtacactgtagagtgtggtctttttccagccatctcctgttggactccttatcttgggcagtctctaatgtatcttctggtccatcctttgctcatctgtcagtgtaggagtttgaagtctgaagggtctggtgccacctcagggtgaaagctagttttgccactcacttatcttgcaggattcttgattttgctttgtttgggggtttagcaagtttctttatgttaggttagtgataggtttaaattttttttttttgatgttttatcaagttttttagttatttcagttaggaaggttgctcaaggtatataatattgctagaaatagaagttccataattgttttttccatgttacagaccttcgtctatttgaaagcccctttctccctgaatcttctctgcccca

SEQ ID NO: 6236 - DNA, 1025 bp, Homo sapiens
aaatagccttgtgtttatagcccatctttccacccatgtcttgcagtttttattatagggctataaaggaaattctcttatgttctttgttttttggaacaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataaggtgagctaaggaggagatcaagtgttaccagttgattattttgactattattgataaaataaattggtagcttccccgcaaagtataaaattaactatagaattctcatcagatgcttgttttaaactctctctttgccgtcaccagatcagctggttcaggtgatggggtatagtggtagaggtgacaagcagtagtgaaaatgaacctgttacctttatctcaaattggctaagagaatttctgtatccactgactgtgtgtaactagaacatgctagtgtagtggcccttgttaaaaaagctccctgaagccttgagctgatttgaggtggagggtagaggagtgtgagggttggtagtggagttcccatgctggtagataacattagagctgctgtgcaactgggctcctgagcgtacatgacgggaaaatgttgacggaagagtcctttggaaaatgggaagaacctgtgtgctcaggaacattcagcatttgagatggccacgcctgccacccttggtggactgagacaaagtctagatcagttgataacgctattgaatatacatccagatgtggaagaagtattagcagcctcaggaatgtgtaccttgttttgattgcattttcagagcttgttttaaactcaagtatattaaagacttgtttttcaaaatcggtgtgatctgcagccgattttcagtcagcatctgttttttccttaccatccagatagctcctgtgtccttttcccataaccatccatttc

SEQ ID NO: 6237 - DNA, 1051 bp, Homo sapiens
tcacaattccagtaaaccccactaaattcctccagggcgaggtagaatttcttctgtgccctgaagtcctttaagaccccagccatgtggccctgtccccatgagagcacatgggggctgattatctaagataaaagtgtctcattgatggtgacgtggttgaaggaatggtggtggaatttgtgaggggatgggtgggacaaagcagccaacactgttcatcctcttagcatggttctcagtcatgccgagaagctctgaggccagcccatgcctgacaccccaagcatgagagagccgagattcccaggactaggaacaacttggatgactacacttgtcagaaatattgtgaaagggcaaccaggaaattcccgtatttggggctgcatcattttagaacattttttctttcttcaaggttcatctctctctgtctcttctttcctagtattcatttctgcatcacattactacacgcccggaaacgagtagctatacaattcctaaaggacattcgagaatctgtcactcaaatcatgaagaatcctaaagcgaagaccacaggaatggtagggacacttggagttttttttcttctcttggaaatttaggtgttggtggagagtttgaaggaatcatatgacccggagtctgttcctgcctctgcccctttgccacagacatcttttatttgttgactggagctgatgatctctgcatcacccaccccttagggttgctgaagtctcaaatgagatacactataaagtaccttgtaagttagagacttctgtataaaagcagctggtggtagtgtccatttgaaaagaaaattttgtcacaggaaagatagtaaacatgttttttctggaattttcttaggctagtccctttatgcagaaaggcagactggaaagtccctgtgaaaaattgactatgccagctgtttttctgatagaatgatgggatgccttaggtggaaatggggtagggcagtgcacatgcgaagctaggactcggggagaaggggctcattgctgcagtttta

SEQ ID NO: 6238 - DNA, 1059 bp, Homo sapiens
tccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctcttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtcctt

SEQ ID NO: 6239 - DNA, 1035 bp, Homo sapiens
agcactgtactactgacccaacaactgtgactagctggccacgccattcagggctggtgtggcatttatgtgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgtaattactgtggatggttgcattcatttgattacttgggcacacacgagatgacaaatggggcagtggccatgcttgaatgggctcctggtgagagattgccccctggtggtgaaacaatcgtgtgtgcccactgataccaagaccaatgaaagagacacagttaagcagcaatccatctcatttccaggcacttcaataggtcgctgattggtccttgcaccagcagtggtagtcgta

SEQ ID NO: 6240 - DNA, 1035 bp, Homo sapiens
ctcccagttcagtcaccccttcccccggaagaattcaaagaggaagggcagggtctatgtcatggacactgctacttgttcgatgaagctggccaggtttatgtcccgttctgaaaggccggcacactcatgggtgctcagcgtgatgtggacctgaaatgaaaccagaaattctgcttccactgacttcacttaagaacaggagggagtcactagctgctgggctcagccctgctaggagctccagaatagcagctggccagtacgatctctcctggggactccttcctgacatgtctgtaacaacatcttctacatctcccctttgctgtctctcaaaaataatcatgacttcagctatagaataaaagcttaatatctgaatgtcaagagcaacctaaaagctaaagacaaaaccaaaaaccaatgccaactcctaaacactatccattcatagacgacctcttccacccttactgtttttataaacagagaccagcagagcttttggcacatggtagacatttaatgactgtttctattcattaagcaaataatttgataggttggctatgtgtctgtatttttttttttttttttttttgagacggagtcttgctctgtctcccaggctggagtgcagtggctcaatctctgctcactgcaagctccgcctcccgggttcccaccattctcctgcctcagcctccccagtagctgggactacaggcgtccaccaccgcgcccgcctaatttttttgtgtttttagtagagacagggtttcaccatgttagccaggagggtcttgatctcctgacctcgtgatctgcccacctcggcctcccaaatatgtgtgtattcttagttcaagtttattactttttcattcttccatacctccagcaagattaaagccatttagagctatgaacactgaataagtatgcctgattcccacagcctttcctttcttgggttttgccttcttaatgtctacttaaatgtctactttaaccacaactatctcatgcatc

SEQ ID NO: 6241 - DNA, 1046 bp, Homo sapiens
tccataaaaatccctttaggattctgattgtgaatgcattgaatttatagatttaatttgggaagaattgacatcttcatattatcgggtctttccatcttggagtgtgatatatcaccccatttattcaggccttctctatgcccttcagtaaagttttactgtgttcctcatgcaggacttggacatgtcttgttcagtttattcttaggtgttttatagtcagcgttggctgctatgcacgggatgattgcttcattacatttctaattggcctttgcaggtatataggagaagtgtggattttgatgtggtatcttgtctccagtcatgctgataaactctctatttagttctaatatttgtcaatggattagaaaaactttgaaccagtcatgctgtcgcacacaggatgggcctccagggaaggggcaaggagctccgcagtcctgatggccgctattgaatccacggatcctgttagggctgctgtagagactgccgtgcatatggttcagagctttggacaagacagcctttagatcctttcccattctaagcttctaacattcacaattccggtgcctgtctgcttcatgcactatctcccagttgcataacgaccaaagccaagttcccttccttccctccctccttcctttccttcctcaactatactttggtttctacctgccaagctgtgtcaggttctgggaaggtggggagggagagatcacgatgattgctgcagagataagtgctccacacccttgggatgcaaatgatgttacttaaatcgcctcagactagaatgtggtagaacccccgtgccccgccatgggctggatatacaatctacacttggggggctaccccgcctcctaccccacctccctaagtggttcatgaaccctagggtttgcccgatcccaaaggagggcttccactctcaaggaacccagagccacgccgcctctccccactgctgtccttgcctttgccgcgcagggtgccgccatcaggtcctgttgtgcttctgctcaggg

SEQ ID NO: 6242 - DNA, 1091 bp, Homo sapiens
ggcttgtgggtgtgagagtatgtattaaggagtgtgtggggggtgagaatgtgtattaagcaggtgggcggaggtgggagtttgcagggaggggagggtgggtgtggtgttgcactggggtgtcaggtgtgtgtgggggcgaggcatggactgggtgtgtgccggaggatggatgtgtgtttgaggagggttgtgccttttgtaactcaggaggtgtgatgtataggctgtgtctgtgtttgggtgtgtgtggggtgggcaatgtcacatgggcacacttgtggtgtgtttgtgtataaataggtatgtgtaatgtggagacagtgagtcaccaccaggcatgggaagctccatccattgtattccgttggggattccacttcaggatgggacccaggccatttgcccatcagcacttaagagacctcattttgccccacacctgcactgtgagcagggtttggcctgagtgccaggttctgctgttggaagggcagaggacagcttcccctgctgagtgcagatgggataggcctgcctgcaggtgggtcctggtgctccagggggaggaaggttggcagagatggaccctaagccagcccagcagcttgggctactgcccccaggaagatcagagtcccagacctggagtcttctgcagtcaactcccagcttccccagagcatgggagcggctgtggtttggagatctgctctctgacctgggtcagcttatgcttcagcctgtctcccccaaagggagtgagttctcctctagagtttgctggagaaggggccagcagagcttgagtgggtgggatccccagtggagaaccccatctcaggctgacgtggctggggcctgggactctcagcggtagcaatttaaagaggacagacacacccacacacatgctggactccactgtcgttacaactttcttggtcacagaagcgcttacctgctttcccagggctgtccacaggaaggacttccatcacttcaactctaggataagatggactgttctggagcagggaggcctataggaaaatcacagtccctcgccccaccctggtgtgcatgttgct

SEQ ID NO: 6243 - DNA, 1062 bp, Homo sapiens
tgctccataagcatttcctgcttcagaaactgagaaccccagatgccaagcagggcccaggaggtagagaagggccccactggcagaggcagcctgggcatgtgcgagaaggggcctgtggtccccccccttgtcacccactccgaagctcaagtgcgccctgctgagggtgttagagacagactttgcaggcctggcccccgtgtcatgcatagcttcatttctcagaggcagggggaggccaatcttgggggttggggaatgaggactcctgtctccatgtagggtatcagaacaccagcccaccctaaaacctgatgcacatgcccattcattcagcctgagcaagtgctgagctccgcagtcagaagcttaaaaaccatgggcctgactcttgaagaactgatgggctttgtgctgcttcttgaagcatgggccaagtgcctggcctgtgatgctggggtgcaagggggattaggatgatgcaacagatatgaatcattcaagcatgagccaagatgtgtgtgtcttgggaggggtcttgcgcgatgtttagagggcaggctgtgcagtcacattacttgggttcaaatcctggcagtgccaccatctggctgtgtgtcttagagcaagttgcttaccctctctgagcttagttctgagcttagttccttcatttgtaaaatgggagtagtaacagcaccaatctcattagatttggggataaatgagatcatgcttaaaagtgtgttgcatattctgaagtgctcagtgacattcactactgtcatcatcatcatcatcatcatcatcatcatatgggcaccatgtattgcgtggaacgaagggaaatgtctggatgttgagaggaagaagctcttgtggtctgggcagtcagaaaaggcttcctggaagagggaaggtttgcacttgactggcccttgaaagatgagagactttgggtaaatggagagtgtggccctggtaggggatgtgtacgtgaaggtatgggtgtgaatgtctggcacatctacccaggagacaaattctacattcagcttc

SEQ ID NO: 6244 - DNA, 1052 bp, Homo sapiens
atctaaaggccatggccagatctgactccaggcctcagccctctatagcaactgctaccagcttcttagcaggagctgggcttggtgcaggagagcagttctggccatggggtctggctgatatagactctgggtggcatcatgtccagtactgacatctttgggagattaaacatccccaggcagcaacaagcctggcccagtgaccatcctcagctggtggctcactggtccttgtcaggagtccctgccagaggctgatctggaattcctccctggcagcccaggaaagccggggctgctgggcacagtgacccctgctgcaaatttgatccagccccacattttcctcctggtccatcccacttctgtatgtagacacagacacagacacacacacacagacacacacacacacaccaggaaagccggggctgctgggcacagtgacccctgctgcaaatttgatccagccccacattttcctcctggtccatcccacttctgtatgtagacacacacacacacacacacacacacacacacacacacacacacacacacacgaaatgacagcagaaaaagccccaagttgaggattgggaaaactggattcttttttttctttttttggaaataaaaaactggattctaatcctagccatgtagctaatctgctttgtgacattgggccagtccttttccctctctgagcttcctctgtccaaatgaagaggttctgccctggaatcagaaaacctggattcaagtcctggccccatcactaactgcaatttcatgagcctccatctcctcactataaactgggcccccaattggttgtggggacattaaaggaaatgggcatggtcagtgaaggtcggttttctttcctttccacccagaaggaaatccacaaattgctggatcctgccttctagtgggattttggattgctggatcccaaatccacagagcccgccttctttctttctgatattgccttcttgacatgggcatattagacataaggtacagtagggttatcctac

SEQ ID NO: 6245 - DNA, 1034 bp, Homo sapiens
tggctaatccctagaggctttagacgagggagttaaggcttctgcctgctcagacttagaaatggaggcctggtaacaccctgttcatttccctgcccttgagctgtcctgggatggtggaagagagggtgggttcagatttgagtggcgtgtctcccagccaccctaagccaacctctgcccccacagtgccagtgacccagggaagactgacttatcatctccctcaatgtgccagaaaacctctcagctagtagataccttagtgtccagggcttacttgcgttgggatggcattgggggtagtggggcaggttttagcagcggccttgggaaggggaaacattttctataaaggaacattaacagaggtgacgccccacccccaggagaacctcgttatgaagagggggtgcctgaggtggcaggaggccccaggcacagggagggaatgggcctgagggtggccatcgagttcgggtgggtgggatgagggtcgcccgtcctgactgagcagttaggggctcctcatgcatgtcactggctgatcacttaacctcttgggccctgtttccccatcactaatagttccagcctcatgggaggctgtgcatgttagtcaaaaggtccatgccaggccctgcccagcgctgaggttagcttctggtgcttagctgcagtggcccagtctggagagcccactccacccccagtcctctgttcagcagtgcaagagcagggcatccacgggggcgggcagtgggcacacacccctgctggatgggtgggagccccagagattataagcagagcatatggtggctggtgccagagggcccctgggtgaccctgaagcccagattcctccggtcatcttcacagggttccctcctgtgatctgcatgtgagcacacacacatctggatttggcagaccctgtatatatactaaacccctgggcctgccctcgggaggctgcccattctgtgaggggactggccttgggctcatggagaaataaacaggtgcccagt

SEQ ID NO: 6246 - DNA, 1058 bp, Homo sapiens
aaacaagagaccagcagaggcgctgaggctagaacaagcaaggcatgtcccaggaaaacacgcctggtggggcttggagcacagtgaaagataggtgagttggccgggtgcagtggctcacgcctgtaatcccagcactttgggaagccaaggcaggtggatcacctgaggtcaggagttcgagaccagcctgggcaacatggtgaaaccccgtgtctactaaagacacaaaaattagctgggcgtggtggtatgtgcctgtaatctcagatacttgggaggctgatgcaggagaacccaggaggcggaggttgcagtgagctgagatcatgccgctgcactccagcctgggtgacagaatgagactctgcggaagggagggagggagggagggagggagggagggtgggaggcagggagggagggagggaagactggtgagtccatgaagttagagggttctgggtagcttaggactttctccagggtcacagagaagccgcaggaggctgtacaccactagagggcagggtttctctcttatgagatcactctggtgttaagaggaaagtggattttaggggcaaaaggaaaggtagggagcccagagagaggaagggtccaggcgggaagacctgggcttggagactgcagcgggtggtgggggtggtcgtgcagtgtgaggcacatcttccaggttcatctagcagcaccaggtccctccagcagcacggactggaagtggggtgaaggaaagggagccaccaggcatcctcccagatgggacctgaacaactgggtgcttggcggagtctaagattgcagctcaaactcaccccatgccaaccctgggtcagggagaggtgacctataaaatagcaggtctgagtcacaggtggggagcctgccattgccttagggggacagcagcattaacaaaggcccaccctgagaaaggcactgtggtcccagcctgggtggggctctcagggtgtccccagagatagctgtggatgtaacctggctgggcatgtgtgtgtctgagggggcttgccacc

SEQ ID NO: 6247 - DNA, 1076 bp, Homo sapiens
gaagcctctggaggcagttggttgggggcgggcaggcaggaggccctccctccacccccccaccctcagcccggcaacttctgggttccatgggttttagttccgttctcgttttcttcctccgttattgatttctcctttctccctaagcccccttctgcttccacgcccttttcctctttgaagagtcaagtacaattcagacaaactgctttctcctgtccaaaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaagaaaatgaaaaacaacacaaaaaaaatagaaaactcttttcttgagtgtggatgagaatgggcacgctcacacttctggccaggagtgaatgtgcctgtgtgtgtgtgtgtgtgtgtgtgtgtgtgtgtacatgtacgcgtgtgcattgaggagagagagactgaacagagagtactttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggcc

SEQ ID NO: 6248 - DNA, 1033 bp, Homo sapiens
gtctaataaaatccgggttgcatttggctgtcttcctgttggtaattgggaatgactccgttgctcttctcaaaattccatggaaggtggaggtgtcactgtcagttcagagctatctgacccccaggagatgagcaagcccaactgcctcattttatagaagggaaaactggttcagagaggggtaaggacttccctagagtcacacagcaaggaggagcctgtggtccatctggatcccggtccttgtgcatccggatctgttcaggagtttgtcatgtgagtctgccaggggctaggtaatggttgagagggatgacacagagatgaagccccagcatccctgtccgtctctgaggagttcagaagggggtatccccaagggtgctgaggctgtgaggtcagttcagaaacctcacctaggatatatgactattgtgcaggctgaaagggagtgatgggcaggttgggatcatatgactccgccccaggctgccaggcatggttgggcaggtaacgcactgggcaagagtaccatatctaaaggggagggtggctccattcccatgtatgttgtagatttgtgtatttgctgagatatttccagcagatggcagtaaagggtcttgtgctaataaaagcagtaccttgctattgaggagagggtgccttgttctcacgtgcacagacgtgctgtaagaagactggcaagggtcccatttcagctggtcccctccaccctgtggacctcaagtctttccctttatgagttgagtctggcctgagaatttcccagcatggattgcctgctccatgagtagattctgcggtgtcttaagtttggggtgagagcaccctctggccccatcttggacagtcatgttgcccaatcagcatgttaaaggctctgaaaagccctgcaggaagcagctggtctcatattaacacagacatcccagatagatttggccttggaacttgttttcacagcctgactatgtggtgcctataggccctgccagccctgactttc

SEQ ID NO: 6249 - DNA, 1048 bp, Homo sapiens
tccggaggcccaaggagattgaacgtcctcagtgctgtccttcttatttgtttatttatttattatatatattttaagagatggagtcttgctatgttgctgaggttggagtgcagtggctgttcggaagtgcaatcatagctcactgcaacctccaactcctaggctcaagtgatcctcccacctcagcctcccaagtagctgggactacaggcatgtgacactgtgcccagctttttaaaaaaatgaaatataactatattttccaaaacaaaatattggtgagaaaagtgccattgttttgcagtttttaatgtaattttttattgatacataatagaggtatatattttcagggtacatatgataatttaatacactgatatcatttgtaaagatcaaatcagggcaattgggatagccatcaccttaaatatttgtcttttctttatactagaaacatctaaattattttattatttattttttaatttttaatagagacagggtctctttatgttgcccaggctggtctcgaactcctgagctcaaacgatctactcacctcagcctcccaaagtgctgggattacaggtgtgagtcatcgcgcttggcccgaatgattctcttctagctattttgaaatgtatgatagattattgtaaagtgtagtgaatactgatccatcaagcactaggtcttactgattgctgttccgattctggaaaaagcccccacgttcctagcccacttcctatgcactcactccagggtgaaggatgtgaggtcctcttcccagcactttcacccaacggcctccatcactactgcactagcccgccccactccttggagtttaaccagggcagaatgttctcatggctctagacttctgatgtccttgctacttccttctaagagtcttatgtgggtcttaatctggggcctctgggtggaaagagggattcatggaacccctgagatcatatgcagaagtttctgtgctttgggagaggggctatagcttacatcagatagtcaaagaggt

SEQ ID NO: 6250 - DNA, 1029 bp, Homo sapiens
agtaatacagggcagctccagagaaaacagactcctgacctcaggcccatggtactcaagggccaagccacagaggagcttggggaggggacataggtaggaggatgaaagcctgaaatgagggtgacgtccttcaccttgatgcaggcccaagaggtgctccactcccacagtggagaaacggaggcctggagccatgagtggcggggcaggcctgaagggcagaggaaaaagaggcagcagggcagagccacccaccatgtgacatgggcttgctgggtaccaggggttgaggtggagtcagaaacggaagcagtgtcctctgccaggctccttccactgccttctgtatcctggcatctcagtgggcagagagacttagcaccccccttaatgtaggggttggagggagaagcagctggctttgagttgaaggtggaaggagaggcctacctcctgccgaggtcccctttgccatgtctgattggggtgaattaagtgaaaggatggacaaagaaggataaagaatatgtattcgatgggcttttattttctactgctcaatgttatggatgagaccaacagaaagtacagccgaggaaggagggaaacctgcgccccacgcccagggtgggactggtgggtcccgtcacccaagcctttgcccttctctgcctgctcctttcatttctggccatggtctagaaatcagctccttcccagggatgcctcctctcctacccccactactcctagaacaataataatagctctcctctattgaacacttattccgtcccagatgcttgaccaagatttggcagctcacccacagtagccctatcaaataggctgcattcttcccattttacagatgaggaaattgaggctcaaggatataaaattgtgtatgcaaaaatcacacagctgtaaaaggcagtgcctgagcctaggctcaactccagaggttgtggcttccaaggttctataccctggaagctcaggtcatggggctcttccctggcagac

SEQ ID NO: 6251 - DNA, 1041 bp, Homo sapiens
tggctcatgcctgtaatcccagcactttgggaggccgaggcaggcagatcacgaggtcaagagatggagaccatcctggccaacatggcgaaaccctgtctcaactaaaaatacaaaaattagctgggcgtggtggcacgcgcctgtagtcccagctactcaggaggttgaggcaggagaatcgcttgaacctgggaggcagaggttgcagtgagcagagatcgcgccactgcactccagcctgccaacagagcgagactccgtaaataaatacatacatacataccagactgagcaacatagcaagaccttgtctctatttaaaaaaaaaaaaaaaaggaaagaggccaggcgcagtggctcatgcctgtaatcccagcactttgggaggccaaggcaggcaaatcacctgaggtcaggagtttgagaccagcatggccaacgtggtgaaaccccgtgcctactaaaaatacaaaaattagctgggcatggtggctcatgcctgtaattccagctactcaggaggctgagacaggagaatcgcttgaacctaggagacggaggttgcggtgagccgatatcatgccactgcactctagcgtgggcgacaagagcgagactccgtctcaaaaaattaaaaaaggaaagaaagaaaataccatatacactttttagaatttttgttaaagtcgtgtaagcttctgtggcaaagggagggttttgttttgaacttttgtaaggtgtcatgtattcagtacagttttctcgttaacatttgcattttttggtatgaaataggattaaacactcacaggtaggtgctctgttcataataggccatggtttccaagattgtttcctgaactttttgttccagttttgggatgccaccaagtgataagtttgggtattacatttagatgaaaaggttaatttttttttttttttttttttttttttgagagtcccgctctgtcgcccaggctcactgcaacctccgcctcccgggttcaaatgattctcttgcctcagcctcctgag

SEQ ID NO: 6252 - DNA, 1029 bp, Homo sapiens
ttgaccaggttaaaggcagagtcagggctgggcacggtggctcactcctgttatcccagcactttgggagactgaggcaggtggatcacttgaggccaagagtttgagagcagcctggccaacatggtgaaaccccatttctactaaaaatacaaaaattagccgggcatggtggtaggcgcctgtaatcccggctactggggaggctgaggcaggagaatcacttgaacctgggaggtagaagttgccatgtgccgagatctcgccactgcactccagcctgggtgacagaatgagactctgtctcaaaaaaaaaaaaaaacgcagaggcagcactgaatccaggaattctcttgacctcctactccagtttgctttatcctggcacctgtctacctcccatggtagtaggtttgatgtatttttttctagggtgattaatctacggatagattcaccctgtcagaaaggttctaagagggaataaaagctaatacattgcccttttgtgtgaacatgactcctgacccactgcagcatgatgccgtgtggttcttatagcaccaaagccagatttgcatcaaatcattcaccatcttgttcagcatcattggctgactggctggccaagatcagggtacaggctgtaagcatgtcatttgaagagcaaagaggttacttaaaatgcacatttctggccaggcactgtagctcatgcctgtaattctagcactttgggaggccaaggcgggtggatcacctgaggtcaggagttcgagaccagcctgcccaacatggtgaaaccccatctctactaaaaatacaaaaactagctgggcatggtggcgatgtctgtaatcccagctaatcgggaggctgaggcaggagaatcacttgaacccagaaggcagaggttttagtgagccaatattgtgccactgcactccagcctgggtgacagagcaagactctgtctcaaaaatatatataaataaataaataaaatgcatatttctgggcccaccttag

SEQ ID NO: 6253 - DNA, 1046 bp, Homo sapiens
tttttttttttttgatcactttgaagatgatattggaaggatgccctcttggttatatattcaagctctttggatacagtatctatagttgtttttttttttaattggttattgtgacttctgaaataaggtttcctttgtgtgaaactcagcatgaggccagaatgtgttagtcctgtctgcttgccatgtaatacctggccaacacaacaacccatgattgatgggtgaatgcttgaggcctagtagtgctaacgtgaagtactgcctgaaaaaggacagctgtgtcctctctccccgtttgttttaggattttcgcaataaggtacatcccccaaatggtttctgctacctttttaaaaatcaaatgtttctacgtgagctgtaaatttttgagaatatgttttgctgtatcagcccttgcctgacaaggaataacatgaactagcttatgtttcatgatcatcttccaagtgctgtggcaactgagttggccacttcttgttggcagttcttggcaccagtacaattctaggttctgaacttgcaccatactcttatcgtcatccaaattgcagtgttttggttcagttggaaaatcaaggttacagtttgcgttcacagaatgaaatttcccagcagtgttctgtgattgtcagagtgatgtaatttgatatattaaaaatcaacaattttttcctcagctttgttttttagactgaaaatgatttggagttttggtgaacctttatattttgacactacaggagccagccacaaggccaaatgtgtcagctgccagtgtttgcttgacatacaggagaacattaaggaactctcaggttgggaggagggaagtgttgaccaggacatcagacggaggtttcttgtttttgtttttttaaacactatttttaaactcttaagtagagggactattttaatattctaggtatagaataaatagcttttataacagtcttagttctaaatgaagcagaacccgtctttgtaaacactgagaactagaccctgaatgtacaagc

SEQ ID NO: 6254 - DNA, 1007 bp, Homo sapiens
gccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaattggtggcattatcctttcaaaatctcagggatttgggatgaagtgaagaggtcaaattactttttagaagaagggaatctaaaaaccatctctcctaaacaaatggtagactggctttacttaagggatatttgtctttataggagtacataaatttatcttaatgatatttaagtagtttttttttttttttgagacgaagttttgctcttgttgcccaggctgtatcgcaatggcgcgatctctgctcactgcaacatccacctcccaggttcaagcaattctcctgcctcagcctcccaagtagctgggattacaggcacccgccaccaca

SEQ ID NO: 6255 - DNA, 1049 bp, Homo sapiens
aaatattaagaggaacagaaaggtcattttaagtgtaataattgctctgatggggaaagcatgaggtgctggacaatcccatagcagagacaactaatccagctgggccaggcatcagagaaggctttaatgaaggatgaggtttaggctgagacctgaagaaaaagtaagtggggtgggaaggaagaactttataggtggagggaatacaatttgcagaggcccaagggtgggaaagggcatcttgcttttgtggggctgcgggtggttcgttatgattgattcataggtgataagggcaagaataaggcagagggtaggactcgtgggctttgctaaggaatctgaacttcaaccagaggacagtggggaaccactgatgagcttgaggcaggagcatgacaagatctggttatacttcagataatttacttggagggaatagtggagaattggtggtggcgagagccagattccttaggaagcctttgaggtcgtccaggtaagagatgactataggccaaattaaaggtgtggatatgactgggcgcagtggctcatgcctgtaatcccagtactttgggaggccgaggtgggcggatcacctgaggtcaggaatttgagaccagcctggccaacatgttgaaactccatctctacaaaaatacaaaaattagccgggcatgatggtgggtgcctgtaatcccagctacccaggaggctgaggcaggagaatcacttgaacccaggaggcagaggttgcagtgagccaagatcatgccattgcactccagcctgggcgacagagtgagactgtctcaaaaaaaaaaaaaaaaaaaagatgtggagacagaggatggacttgatttgagaagtggcagcgggtagtggctcacacctgtaatcccacactttgggaggcccaagtgggaggatcgcttgaggccaggagttaagaccagcctggccaacatagcaagacccccacctctaaaaaaaaattacagattagccatgcatgttggcacacacctgtagttctagctact

SEQ ID NO: 6256 - DNA, 1038 bp, Homo sapiens
tgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattcctgtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgcc

SEQ ID NO: 6257 - DNA, 1075 bp, Homo sapiens
tactcctaaggccaatgacagcatcaaaatcgagtgcctgaaagatctatgaaaagacctaatgctctgcaaaagcaaggttgtattgttattattagtcataggtatggaccctatcctcattcttgtgagaagattgtacctctttttatttggcatactggcatattgctttgctgaagcttttgggtgacagccaagagcttttccacagttcaatttaatttgcatgtttcatagcctctagttatgtgttttgttctcttaaaaacataaggccaccccaaattttgattgcattcccctttccgtcgaactacttaaaggcttcccaagttgtccttaagtccatattttgataagacatcttctgactttgcacagtttttaagactgtttgggtgtgatattcatttagcattttaaaaaatttgtgccttgtatattttccactatgcaaatttgtcaggctgtgagtgtctcccttgtggggatacttcacgaaggtgttctctgtgctattctagggtgggtaaaaatgaagtgctgaatttgtaactgaaagcacaattaaaacgaagtgttatttctaaagggcaggaatgttatgggaatggtgacttgtacatgaatttagaattgtaagattttgaaaaaaattgaacctgattatttaaagtgtataaacattttatttttctacaattcttctgaagccatcatgtatacagctgtttccataggatagtctgtgattctttacaagaaattccatttaaaagatattgaggccctaaaaagagagagacttggccaaggttacgttagctaatacgtaagttttaggactcccactcatctgagatattctcacctcttattgtgttcttttcattgtaaagtgcaaatgctcctttacatctctctcctcccttataaaatttactattgtccattatgaaagtattgctatttcaaaaccccatgaatgggaattctcctgtaagtaggtgttgatttgagtacatatattaggtgaatatgggagcaaacaacttaccagaaagaatagatg

SEQ ID NO: 6258 - DNA, 1023 bp, Homo sapiens
ggcgcctgtagtcccagctactcgggaggctgaggcaggagaatcacttgaaactagaaggcggaggttgtagtgagccaagatcatgccactgcactccagcctgggcgaaagagcgaaactccgactcaaaaaaaaaaaaaaaaaaaaaaaatttttttttttttttttttttggtagagacagggtatttctaccaggctggtcttgaactcctggactcatcttcccaaagagctagtattatatacgtaagccactacgtctggccaaaaattcctttaaatggagatggattcaagaattcctagtgtgaagatctggcctaaaattcctttaaatggagacagattcaataattcctagcgtgaagatgatactttcagggataatttctataattcgttactagaaaagtttctctaaatgtgtagagaaaaaaacatttcctagtttgaatcttgatttgtgtaattcctggctcttaacccttttctattgttgtcttctgtcctctctgaattctgatgggatttattatctttaggacacaaattgacaccgacatgatttctaaatgttttatttgtgggcatctaatcttaactggggagataaagcaatgatgtgtatcttattacctttgtggctcatagactctagcacaatgctgggtacataggtgacactcagacaagcattagttagctatgcacccctttttctgcttgctagggaaaagatatgccctttatctcctctccctatccccctacccccagtttggcttgcttaatagccttccttaggtagccacatttggagaattcctttaagcttagtattgccagtgctgtctttggttgtatattacacttctttatggtggattgatggaaagagttggtaccattggattagctcagcagtggtcattagctttctgacaatagccagcaaaagtataataattacccagattattacaagtatatgtttgaatcagattccacatttgttggt

SEQ ID NO: 6259 - DNA, 1030 bp, Homo sapiens
gatcatcttgttctctgtgcccagatactacagtgatgggaattatgggaatgtcaagaaggaatgacttctctttgattcatgaagcagctaatactcttaaaacagtttcgattgtgctgaaacaagcaggactaaataaaatgctcagtaaaaatagtaatgaaaaagattgtaaagctattatgttaaaagtaatttgaggccaggctcagtggctcacgtttgtaatcccagcactttgggaggctgaggcaggaggatcacttgagcctaggctgcagtaagctttgattgtaccactgtactccagcctgggtgacagagtgaaataccctatctctaaaaaaaaaaaatttaagaaattgatacagtggcatctacctggcatgattggtgggggtatgggccatgctggacactgcagaagagagaaaggaactatttcaaagaggtgctgccaactgtagattctttctgtatatatatatttccaaagaaggcagatttttggaagtgtttattttggaactagtcttgtgtatttccattctgtccccactgtatcctgtattttgcactgccagaattctgatagctgccgtgaagcagggctgtggcaagtggccaagtgtgataaaaacctatttttcattttaaaacaatacagatgtcagaatactttaaagaagtatttaaagatagattgagtagaatggaacaaatagtaaaaatctaatgagaagattgaaggtttttcatttgcttttgatggaattacattttttggaaacagaagaataccaggttatgtctttcttgatctgttagtttctctctctttctccctttttcctgatctgtgaatgctggtgctagacactgctgaatagacaggaaaaatggattttctggtgtttttttttcttttttgaggggacccctagggtatactttgtgtgagtatctgactagatatagatatagatgtcaatagtttggttttgtttatttattttcttgttttaac

SEQ ID NO: 6260 - DNA, 1034 bp, Homo sapiens
ttatggtaaaaaggctgttcttgaattgtgtcgtggttttatggggcaagcaaaagaaaagtaaggtctagaaatgaggggacatactttttgagacaggtagttggtgtgaaataaatatttgttttaataataattctgtacatattagtcaatgtatattcttactttgaagtcattgttttaaaaagacaatctctgataaaattttatcttctcaatttcatgctgttgtctttcatttccaacactcttgataatggtttgaacatttttgcagagtacacagggcagagcttcattcaggttgtccctccaaatgatttgctgtagtgcattaaccagaaatgctgaggcagcaagggaaacactaataaattggatggtttccagggactgtcgctacggcaagcaaacacaagccaaaattaaaatgttagttaggcacccaagatataagtctggccagatatgctattaacagtgaatcttccattctcattaaattatttgagatctgtacaatttgaagattgttacaaatggtgaccaattttaagcatattttaattaggggtggtataatagtcttttggctaaaacttaattagaatgaaaaaatacttttgccttttttatttgatagattccagtgcctcaggaatgaacctccagtaatgggagagttttttttgttttgttttgtttttgagacgaagtctcactcttgttctctaggctggaatgcagtggcgcaatctcggctcactgcaacctccacctcccaggttcaagtgattctcctgcctcagcctcccgagtagctgggattacaggtgcctgccaccaggcccggctagttttagtatttttagtagagatgggacttcaccatgttggccaggctggtcttgaactcctgacctcaggtgatctgcccgcctcgctagtgctggttttcttgctaactacacaaattatacttctgtagtaattttcacaaattattttaccgtgaaaagtataggtatggg

SEQ ID NO: 6261 - DNA, 1026 bp, Homo sapiens
ggtcttccatgatctccttgcatgaaaattttattttattggttgttctgagatgattttaatatacactacagtgtttttgtagtcatctagtgccttgctgtagtgatgcattactgctatttctaggcaatgtcatctgtgggtgggcataatggttatatttgctgttgagacttaaaaagaagcatttcattttgtttgaaacgaaaatatctgtgatacatataaacaaatcagtttgggcctcttattggtaattgcaacttgaattactatccacttaggctccttatggggaatgcaacaatatttatggttaagtgtacatttgatagtatattgttctcacagtaacatcattgtgggtttgaagatctgtgctaagttatgaaacaatggaatttatacactttatttgaagataaattgggtttatagggaattcttggtataaatattaacgtgtagattagtataacatactgtttattataattagaaaaagctgtgggcacttaaatcccagctacttgggaggctgaggcaggagaatcacttgaacccgggaggcagagattgcagtgagcggagattgcacctttgcactccagcctgggcaacaagagtgaaactccatctcaaaaaaaaaaaaaaaaaaaaaaaaaaaggtacatgacttcttatgaactagatgccaccttttccccttaacctcagctgtttctttttcttttctgttttattaaggaactttaacctcccgcttgacttagtctaggcatagctaatattacagtgaggtaacaagattgagttgtagttattggcacttttttctttctttctttttttttttttaacatgcaactatttttacaagcaaaattctagtgtaaccagagttgaaaacatgatagctatagttactttttaaaaattaatttttcaggggtaactttgacaacccatttttggggggagtttgatttataagtcaaagaagagagtagcttgcactgaaag

SEQ ID NO: 6262 - DNA, 2006 bp, Homo sapiens
ttttaaataaaatttgcattatttcttttctcaagactactggacatgggagaaaaagtcccttttccttatcaaagcttaatttcctttattctattactgttatcttcagaaaatgtttatttttggctgggtgtggtggctcacgcctgtaatcccagcactttgggaggctgaggcaggtggatcatgaggtcaggagatcaagaccatcctggctaacatggtgaaaccccatctctactaaagatacaaaaaattagctgggtgtggtggcaggtgcctgtagtcccagcaacttgggaggctgaggcaggagaatggcatgaacccaggaggcggagcttgcagtgagccgagattgggccactgcactccagcctgggcgacagagcgagattctgtcttaaaaaaaagaaaaaaagaaaatgtttattatctagtcttttttttgcagctaagtttttaaaaattagcaaatttgtcagaacgaagattaaattaataaacttagttttctgttctatatatgatgctatgattcttattttttctaacatattcagaatcattcatttttaaaaaatttctttctatgataaaagtactaaatcttttatcatagaaattgagatgtacagaaaaatggaagaaagaaaaagtgctactcagagacaaccattgttaacatttttatgtatttccttttagacattttttaatggaattcatcttgctttgataaaagaataggtcatctttatatacaacataaaaccatataacttaccatcgaagatgactcaaagaagaaaaaaacccatgtaactatattttgctttttttgctcagcattataccaaatatttaacaaacttgtcatacacatttaatggcagcataatattccagagtggctgtatcagtatttgtgcttgcaacgtgcttttcaaaatatatatattttttggtagcacatttgaggattttaaaggtaaacattctttcctcgttttcacctgatgacttttgtagtttgttgctctgcagatagaataggttaccgccctcaccatgttcttttacactcacaagtaacagccacaaattttaataatgttattcagaacatctttaaaagtccatctgtttcagatggtatcttcgagaacgtttaacacaaactgtcagattcttctaaggtcattggaaagcccatccttttgtctctagatttgctcatcaagaatattaagaaatagcttgtgattctttaatatagttatgtagatatactatatttttaaaaaatcaattccctattacacatgtatgttgtttccagtcttttgcagttatttgcattgctatggtgaataaccttgtgcattcatcattgcttgtgtatgagtttatagaatgtattccttgaagtagaaggtatcagaattactctctgcttacatctttgccaatacaatgtggtactaaactttctgactggtgaaaaaatggtatctcaatgaagctttaatatgtttttctcgtataagtgaagtgagattcttttaaaagtactgtctttccctttgctgtgaactaaaactcatgttccttaactctcatagagatgttggtctttttctttgtaatttgtgggagttctttgtatattagggaaactaatcctttgtgattttaactgcatttctaccaccaccccctcccccacaagtttgtcactttttaacattttaagtcctttaagtctgaatctggacattcaactcttaggcacatttaaagggctgtattatatatgaaagtagggaactacctgtaaatgttgccaagtaaatacagtattagtcctgaacatatttgaagacagctatgtggatgaaggttagattagatttattccttctctttatggagaagcaaattgcagctcagcatatggaagaattttctcttattagatcagcttcaaaatggaatggaaa

SEQ ID NO: 6263 - DNA, 1109 bp, Homo sapiens
ctaggaccaaaggcgtgtgacaccatgcctagctattaaaaaaatttttttttttgtggagacaggtctcactatgttgcccaggctagtcttgaactcctggctcaagctattctcccacctcagcctcccaaagtattggcattacaggtgtgaccccgtctctacgaataattttaaaaaaattagctgggtgtggtggtgcatacccgtagtcccagctactagggaggctgaggctggattgcctgagctcaggaggttgaggcttcagtgggctgtgatcgggccaccgcagtgcaggctgggtgacagagtgagattgtctcaaaaaaaaaaaaaaattcgtctgtgttgtatcatgtatcagaattttttttttttgatagctgagtagtatttcagtgttcagcatttttattaatgacatggatggaatattaatgacttgctttgcaaacccatatatgacctggaactggcaatgaaaataagttgtattgttaaagtgtgttgggttttttttcagactagagattgaaaatagttatcagactgaaagaattgactgaattgattaaaacgtattaaacattgataagtgcaaaatcccatatatgatctaaaaagttagtgttattgtagatggatgtgatgtggtttaatagcaggtaatatgaaaaatacctggagggtttcacttgacagcatgttcatcatgagtccacagtattatctgggctctattaatagaagcatggtgtccagaatgaggactatgattgtcccaaagtattgtgttcatgtctaggtaccttattttaatggtaaacatttaaaaacaaaggcatattcaagagagaaaccagaatgatctaatgggaaggtaactagccactcagtattagaataaagctgttgtaaggtagagtggactgccttgggaggtaatcagatctatgtcacaagatttgttcaagcagaagctggatgaacacttggcagggacattgtagactattttagtttcactagttgggtacaggagtggagaaggtgcctaattatatagaatatctttgtggatcttcaaccttgatattaatatt

SEQ ID NO: 6264 - DNA, 1027 bp, Homo sapiens
agcagaagctccaagtcacatcacatatctggagaattagaagtttttttgtggttgtaaaaaacaaagatttttcgtacaggcgttttaactttaagtagaggcataaatgttatctgtgtctatgtaaatactacctcacttttcagttggataaatctgacttaaatgctctgattaagttgaatgtttgaattgtatctattagaacagtatcctaagcagcaagcccaagtctgttattttcaggccttcttctggttctagggtatgtaataagacttcagtgtttgaaatgtctgaagttgtctccaaacagagattacactagcccttatgtgtttggggattctgtgctaattgcataattgtaatgtttagcagccatctgaaatgtaaacttaatgccaaatttcttataattgcttccatggaaggtaacccagggttcagaaaaaaaataacttatttggacttctaatccctgccgactctgagatatcaagacatgtagttattatgtactgaattggggaggtgactaatttatgatctctatctagaagtttggtaaacacttagtggtaggttgctaggcatgaatttagtctctttgaaatttggaaatataaatgtaattctgaacctaacaatgaaactgtctgggccttttcagcctaactctggaaatgtgaccaaaaccagctaaaaatataaactaaaaatataacgaaaaagttagggactatgtgcagggcagaggtgctgatttttaactctggttgcttccacttgctgcttttagtccatgtttagtgcctgtgttttgcttcctcattccccattgcactccttctctgttgccatgggtttcccaagctggcattatggtcttccagaatccactgttgtgttgtttgcagatatttcagggatcacacaatgtctatacgaatgttatagatacttaatgcattcttggaggattaagaatatattctgaaccagaaaagtaaggagtagtgca

SEQ ID NO: 6265 - DNA, 1022 bp, Homo sapiens
taagggaaggacatcctgatccatgtttgttacagtctcaagaaaataattataatttgaaacctgttctttccttgacagtggtattactttaaggaaacaggtaaactttccatctgaggattaagatgttagagtcatttagcttctctagaatttgccacacagcatcctaaattgggatgaaaagcactcactattccacactatcaaatagctgtaaaacttgagaatgttggattatgatggctcacgcctataatccgaacactttgggaggccaaggtgggaggattgtttgagcccaggagttcaagaccagtctgggcaacagcaacatggtgaaatctcatctctcccaataattgaaaaaaaaaatgttgttttttttttgccagtcatggtggcacatgtatgtggtctcagctacttgggagactgaggtgggaggattgcttgagccctggaggacaaggctacagtgagccgtaatcatgccacggcacttcatcctggacgactgagtgaaaaaccttgcctctaaaatcaaaaaccaacttgagaatggtgacatgggcagagattttaaatgagtgatttatttttctccaacctgactgataggagcttttcttctaaggtataaggtatttactagagtgtgaagctatttatatgcaattatataatgcaaagaatataattttattagcttataattacaaaataaatacaacacattaggttgatcaaattaaatgttctgccttttttggcctattatagggacttgtgtttgtaaggactgctttctatgtcttggtgatagataaggattaaaagttaggttcttaaagggggttaggatggccatataagtcacctctaaattgcagtgccttttgagtgaaagagagtgctgacaataaatatgttacaggagcaggtgttaagctggactatcccaggcaaattgggacatatggtcaccctagttaaagggtgctgttgtagctttgcta

SEQ ID NO: 6266 - DNA, 1071 bp, Homo sapiens
tgttgttgcacaggttcccgagggtctggcttcctttgagacattgttattaatccctcagtgtcattcctttgagacattgttattaatccctcagtgtcattcattcagatgccactgtgaacattcttgtgcaggcctgcttgggtacatgtgacagactttcttttttttttttcctgagacagagtctggctctgtcgcccaggctggagtgcagtggtgccatctcggctcactgcagcctccacctcctgggttaaagtgattctactgcctcagcatcccgagtagctaggactacaggcacccgccaccacgctgagccaattttttgtatttttaatagagacggggtttcaccatgttagccaggatggtctcgatctcctgacttcgtgatccacccccctaggcctcccaaagtgctgggattacaggtgtgagccaccatgcccggccgcacatttatatctttaattcatttgtctatttgaagtcaacccttaggagataatacttttcacgcattatctcagagaagatcagtctgctgaggacataagtgacaggtccagatttttttttttttttttaatactagagacagggtttcaccatgttggtcaggctggtcttgaactcctggcctcaagtgatctgcctgcctcggcctcccagtgtgctgggattacaggcatgaggcaccacgcccaccctccaaatgtttttttgaatgggcaaaataatccacagtaaatatagaatgtgctttatgtctaaatgctaagaacatataggcattaatgacgttgaaaacattcttttcttagtactgtattgataaatgtgtggctagctttttggtggcagtaataaacatgaatagcaacaaagcaacaacaaaactgagggcacatttggaagacaaagagatatgaaggacaatatgggatctggtgttagttttgttttgggttttgcctgctgcatgggtcacaggaaacatttagttacagaactggagacctattaaaatcctctcatttgtaggcctgtggtgtgtgtttc

SEQ ID NO: 6267 - DNA, 1065 bp, Homo sapiens
tgaaaaccacataatgggccgggcgtaatggcttatgcctgtagtcccagaactttgagaggctgaggctggtagatcgcttgagcccagaagtttgagaccaacctgggcaacatggcaaaatcctgtctctataaaaaatacaaaatactagctgggtgtggtggtggcatgcgcttctggacccagctacttgggaggatgatgtgggaggattaccggagcctgggagattgagattgcagtgatctgtgatcacgccactgcactctagcctgggtgacagagcaagaagactttgtccaaaaaaaacaaaaaaacaaaacacacacacacacaaacccacactatgaagtaagtactgttttcagccatatttcccagatgaggaaactgaggtttagagtgattaagtaacttaccctagattatattgcaagtagcaattgttatatggtaagtagcagagtaggcagagccaccactagctatgagagacttctgtttgaattaggaaagttaccccctgtggtgaaccaatgaggaagccaaacttcctctggcctggcacaccacccgaagcagtaacttggggacctgtgcttagatgccacttatttcagcatctgtgagctgaacatgggcagaatttcagccttattttgcttccttgatgcctttgtactgtgcacaaactgagccacccttacccaaaggtcttaaagcccagatttcaatccaggtctatttgagtccggagcttatattctgtttaatagcatgctgccaattaatggcaaagttaagacttcagccagattttctgatcatcagtattttcctccttctattatgtatcatgcaggttggttgaattacagatgacactggaggcggggcatgctgactcacacctgtaatctcagcactttgggaggctaaggcagggggattacttgagcccaggagtttgagatgaacctgggcaacatagaccctgtctttacaaagaattaaaaaattagccaggcatgttggcacacacctgtggtcccagcactttgg

SEQ ID NO: 6268 - DNA, 1735 bp, Homo sapiens
tttaagatttgtgtttgagtgctgagtctttccctttttggggggatgactttggtcaaaaggtttggtcacttaagatttctgaagtttagttttctgatctgtaaaatgaaataataattcacagtcttataggaatgaaaagggaatgtatgaatagacaggagtttaattttgggataaattttactggttgtttcatcttcatcttgttaggctcttttaatttaggcagatgttagatgatcagatcaacttggaaaaacaatatttgagggaacatagaaaatgtcaagattcttaaaatgacttgtactatctattaagatgaagagtttccaaggcgaataaaaaaggctcatgaaacaacgagcagttatctttgaaccagagaggaaaacaaaaaaaacaaaaaaacaaacaaaagacttttttaaaaaaagaagttgcattaatttttgcataaaataaaattgtcatagaatctttcttaaattctgtttctgcaatccttggaattttaggtggaactactgactatgaagtcattttggtattttattaatccattttgcctaggttttgagatagacatatggtttgtagtcaataagattctgaagaactacacaaaggcttctggaaatttatttcttgtttttaaaaacatttatataatctcagtcaatttaggatttaatattcatgttagaattccagtaaattagaattaggcaaatcagtcttgaacactatgctaagtagtgaagttatcaaacctcttttgtaatattgtgtatctatacagtggttgcaaaataggctcagaaggttgcatagaactaagttagcatgatgatagtttcaacctcttaaatggtgaggttagtccattcactttgattgtcattactaatatattgtaccatatttcattgcctctaagatgccatcagttgtaagacactgttatttattagcagtaagaaaaattacagttaagatgacaatgctttgtcatgcaatttcttattttatgcttattgaaaaacttagttttttaaaaaaaattagatacaacttttagacatttaaattgtctcaggagttctattccaagccgctgacacatgttatgcatggtttttgtttttgaaacagggtcttcttgctctgttgcccaggctggagtgcagtggtgcaatcatagctcactgtaactttgaattcctgggttcaggtgatcctcctgcctcagcctcctgagtaactaggactacaggcatgcaccaccatgcacagctaattttttttttttcttttaagagatatagtcttggtatgttgcccaggctggtatctaccttctgggctcaagtgatcctccctcctcaaagcactggcattacaggtgtgagccatcatgcccagccattttgtagtttttggtcctggaactttcttgatcttagtgtcagtggaatgtctgagcaacatgacttttatttcttcctaaaatgaaccttaagtggtttgttgtcaaagggttttaggtaaccagttatgccatgaagaataaaaccgagttcttgctcacacaaacaatgacaactgtgttacaactgctgctttgctgtcagagattccactgcaggtagatgcatcttggtttcatccatgttaaatatggggaggaaaggttttaatattgatgaaacatactattttatttatt

SEQ ID NO: 6269 - DNA, 1060 bp, Homo sapiens
aagcagttcagaaatttatcagagaaatttaacaaagagattgaaataattaaagaaaaaacccacagaaatcttggaaatgaaaaacacatttgcttaactgaaaaaactctgtggaggctctcaatggcagaatggatcaagcagagaaaatagtgaacttgaagatgggctatttgaaaatatacagtcagtgcagaacaaagaatgaaaaggaacaaagactgtatataagatatagaaaattacctcaaaaggcaaaatttaagacttactggtgttcaagagggagctgagcaagaggaaagatagaaagcttattcatagaaataataacaggtaattttttaaaacttgaaaaagatagaaatatccaggcacaggaaagtctgtgccaaacagattaaacccagatgaaactacctcaaggcatataataaactctcaaaagttaagaacagaaagaggatcctaaaagcagcaaagaaaagaagcagataacatataaaggaactccaattggtctggcaacagacttctcagtggaaaccatataggccaagagggagtataatgacattttcagaattctcaaggaaaaaactgccacccaagaatattttgcaaaattgtctttcagaaattaaggtgcaacaaagcgtttcccagacaaacaaaagctgagagaattcaccaccaccagacccatcttacaagaaatgctaaagggaattcttcaatctgaaagaaaacataaaccaacaaaccactaacgtgctaaaggaaaacttttcaacatataacataaacttttcaacatataaaatccactggtaaaattaagtacacaggcaaatacagaatactcttactgcaattgtggtgtgcagtacacttataactctaatatgaagcccaaaatcacatctatcaaaaacaataatagctacagcaacctgttaagagataggtaatgtaggtaatattaaaaatgtaaattgagtcaaaatgtggaggagatggagttaaagcatagaattctttttttgttttacctttg

SEQ ID NO: 6270 - DNA, 1029 bp, Homo sapiens
aaatcaagaaacatctgagttaaactacacactagatctaatagacttgatatttacagaacatttcacccaaatgctgcagaatacacattcttttcattagcacatcaaacgttttctagaatagagtctcccttaggccacaaaacaagtctgaagaaatttttaaaaaacagaaataatatcaagtatcttttctgaccacacggaataaaactagaaatcaataacagaaggaccctggaaaatacacaaacacatggaaattaaacaacatgctcctgaatgaccaatgggccaatgaaaaaattaggaaaattaaaaagtttcctgaaacaaatgaaaatggaaaatataacataccaaaatctatgggatactgtaaaagccttactaagagggaagtttatgatgataaacacttctatcaaaaaagaaaattagaatttaagtaaacaacgcacctcaaagaactagaaatggaagaccaaaccaaacccaaaattagtagtaggaaagaaataaagatcaaagtagaaataaatgaaatcgaaaccaaaaaaactccacagaagaacaatgaaacaagaagttgttcttttaaaaagataaccaatatcaacaaatctttagctagtctacaaaggagagaagacccaaataaaataaaaaatgaaaaaggaggaataactgaaacctcagacatacaaagaatggttagagactattttgaagaactatacaccaccaaaatgggaaatctagaagaaaaggataaattcctggataccgtacaacctaccaagattgaaccacgaagaaatgtaaaacctcagcaaaccgatcatgagtaatgaaatagaagctgtaataaaattgggccaggtgcagtgactcatacctgtaatcctagcactttgggaggctgaggtgggaggatcccctgagactcggaatttgagaccagcctgggcaacatagtgagaccctgtctctacaaaaacagttttaaaaaatagttggatttgg

SEQ ID NO: 6271 - DNA, 1075 bp, Homo sapiens
ttaagcaagataaagaaataaagggcatccaaattggaaagaaagaagtcaaattagccttgttcacagatgacatgatctcatacctagagaaacctaaagactccacaaaaaattgttaacactgataaatgagtttagtacaattgcaggatacaaaatcaacatacaaaatcagtagcatttatatatgttaacagcaaacaatctgaaaaagaaatcaagaaagcaatcccacttataatagctatgaaatacctaggagttaatctaactgaataagtaaaagatcaaggaaaactataaaactctgatgaaagaaactgaagaagatgcaaaaaagcagaaagatattccatgctaatgaattggaagaattaatatttttcaaatgacagtactacttgatgtaatttacagattcagtgcaatccctatcaaaataccaatgatatccttcacagaaatagggaaaaaaattctaaaattcatatggaattacaaaagaccttggatggtcaaagcaatcctgagcaaaaagagcaaagctggagacactacctgacatcaaaatttactctaaagctacagtaagcgaaatagcgtgatactggcttaaaagcagacacatagaccaatggaacagagttgagaatccagatatcagtccatgcatttacagccagctgatctttgacaaaggaaccagaacatacaatggggaaaggacagtctttccaataaatggtactgtgaaaactagataaccatatgcagaagaacgaaactagacccctaactctctccattcacaaaattcacatcaaaatgtattaaagctttaaatctaagacctggaactgtgaaactaccagaataaaatcttggggaaaccctccagggcactggtctaggcaaagattttttgggttagacctcaaaagcacaggcaaccaaaagcaaaaataggtatggaattacatcaagttaaaaagcttctgcacagcaaaggaaacagtcaacctagtaaggagacaacatagagaatgggagaaaatacgtgcatctgacaagg

SEQ ID NO: 6272 - DNA, 1027 bp, Homo sapiens
cagccagatctcgtgagaactcactcactctcttgagaacagcaagggggaaatccacctccatgattcagtcacctcccaccaggtccccctaccgaaattgggaagtagaatttgacatgagatttgggtggggacacagagccaaaccgtatcaccttggaaattataagatgttttgtctttatcctttcagcaatgaggagccagtgaaagtgttctgaagagatgataatatcatccagtctttctgttggagagtgactggtgcattctgatggatatattagaaggacaaaagattggaggcattgtagtagtagtaacaataaccattctgttttgagtgccaggcacgtgctcactgtgcttaatgctttatatgcattagccctttgtcacctcacaacatctggatttatctaaacagaaactaagacttgaggcagtcagtggaacttgctccaaaccacaaagctaataaatggaagagctgggattcaaatccatttgtgactttagggcctctgctcttaaccactgaattatattaatattcatagaaaaaagaaggaacaaaaagaagcaaaaagggtgatggtagacttgatgagacttggaattggctgggagtacaaagtgaagactctaaaatggctatgggtcttaaagcctgagagactgaccaaaaagtttgacgtacaattaattgaaatcggaaacattggagtggagcaggtttgggaacatattttacttcagggacttagaggtatatttgatagagctattctaataagcagctagaaatttgaatctgaaaatcagtacagaaaggactcaagacattattttcattgagataataacttgaagttctaagaaaggttgagctctccaaacagaataagtatgaaaaaacaagggcaaagaataagccttgatgagtattttggggatagctggaagagcaagaaggcaataaaggagacatagaagtggtcaaagacagtagagtaagaagtaa

SEQ ID NO: 6273 - DNA, 1080 bp, Homo sapiens
ctcctgagtagctaggattacagatgttgtatgtgtcttcttgtatttttcttaggattatatctagatatgacattgccaaattgtagatatgaatgtaactaaataatgccacattgtacttaaaagtggttatgccaatttacatccaattacaattatgagagtcttcatcagtgcttgttgtgggaagtcagggacactgaacggagggaccggctgaagccatggcagaagaacataaattgtgaagatttcttggacatttattagttccccaaattaatacttttataatttcttatgcctgtctttactgcaatctctgaacataaattgtgaagatttcatggacatttatcacttccccaatcaatactcttataatttcctatgcctgtctttactttaatctcttaatcccatcatctttgtaaactgaggatgtatgttgcctcaggatcctgtgatgattacgttatctgcacaaattgtttgtagagcacgtgtgtttgaacaatatgaaatctgggcatccaaaaggaacaggatggctgtgattttcagggaacaagggaaataactattgggcctgactgcctgcagggccggacagaacagagtcacatttctcttcttacaaaagcgaataggagaaatatcgctgaattctttttctcagcaaggaacagccctgagaaagagaatgcattcccaggggtaggtctctaaaatggccgctctgggagtgtctctctcttatatggttgtatataagggatgaaaaaagccccggtttcctgtagcgcccccaggcttattaggattaggaaattcttgcctagtaaattttagtcagaccagttgtctgctctcaaaccctgtctcctgataagatgtcatcattgataatgcgtgcccagtgggacatgaaacttcatcagcaattctaatttcgccctcgtcctgtgatctcgctctgcccccatttgccttgtgatattttattgcccttgaagcatgtgatctctgtgacccacaccctattcgtacacccctccccttttgaaatccataata

SEQ ID NO: 6274 - DNA, 1074 bp, Homo sapiens
gttggtctcgaactcctgacctctggtgattcacccaccttggcctccaaaaatgctgggattaaaagcatgagccactatgcctggccatttttttgtactcttatacaattatatacttgctttataaaaatgaacttattctacatatatatgttattacattattaggacatgttccctaatgacatattacattttcatcacttttttaaaatatttttttcctgagacagcatctcactctgttgcccagacgggagtgcagtggcctaatgacaggtcactgcagcctcaagctcctcggttcaagggatcctcccatcttggcctcctgactaacccagctaagtttaaaaaaaatttttttttttggcctggcgcagcagctcacacctataatctcagcactttggaaggccaaggcaggcagatcacttggggtcaggagtttgagaccatcctggccaacatggtaaaactccgtctctactaaaaatacaaaaattagctgggcatgatggcaggtgcctgtaatcccagttacttgagaggctgaggcaggagaatcacttgagcccaagaggtggagggtgcagtgagtcaagatcatgccactgaaatccagcctgggtgacagagcaagaccctgactcaaaaataaataaataataactataacttttttttttcttttttggagaaacaagtctcattatgtttttgaactcctggactcaagcaatcctcccatctcagttcccaaagtgctgggattacaggtgtgaggcactatgcccagacattttcatcattctttctttttgagatggagttttgcacttgttgcccaggctagggtgttacgtcacgatcccggctcactgcaacatccgcctcccaggttcacgtgactctcctgcctcagcctcctgagtagctgggattacaggcatgagccaccacgctcggctaattttgtatttttagaagacatggggtttctccatgttggtcaggctggtctcaaactcccgacctcaggttatctgcccacctcggcctaccaaagtg

SEQ ID NO: 6275 - DNA, 1023 bp, Homo sapiens
ggcactctgtctcttccgcatccacaacgtgaggccctcccaatttatcccggccctatcctacactccatcccccccttctctgctgcatgcctggctacaatgtgagccccctcgcctcgcctactctgcctctctgtcccccagctccagctccagcaaacctgttctcagattgttccatttttctctgtgtccccttcaggcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccgggtgagtgtggtgagaaagattggcagtaggaagaaagccagcttgtagtacagagcgccatttactcaaggcttgctgttgtcaggcaaatccaggcccctatctctagatgactgactgcctgtcatcctcagaccccacagcagggccctcagcatcggaccagagtacttggtatctggatgaatcgacactcactgacaacatcaaaaagacactgcacaagttctgtggcccctcccctgtggtcttcaggtaaatcggatctctgcatacctgtgtctgtggtggagggggagcgtccctcaggctgatgacagatcctttcttctattcatgcctgtgacccctaccttttattccctgaactggcacagtgcctggcacacagttgtcactaacgaattgatggaagatgatgaccttgtacagtcacagagtggtctgctcttacctagcaagagttccttttcttcttttgatagatcaggaaatgg

SEQ ID NO: 6276 - DNA, 1034 bp, Homo sapiens
taagcattgtgcgggagatgttcaagcggagggacagcaatgctgcccccttgttggaaatcctcactgaccagtgcctcacctatgaacaggtaatcactcagcgttggggagccccgtggtagctcattctttccctccccctgcctcatcctcctcttgctgaaatggactctgggagggctactctgcctttctctgagctctcaggtgcagctcacagccttctttgtctccagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggtgagtctcccctgaggctcaccacagaactgagcctgggccagctcaggacagactgagccttcatctccttgtttgcagagacataccatgattttagtcctcgggaaacgggaggtgctgagcactggtgttagcagtgatttacgagtcctttttctgagaggctttcatccttccttcccctaaataacacccacttttcaaaattctccagtgtttcagtgatgcttatggggctgggtcaagaagtactttcctgtatcctttccccatgcctctctttggggtgtacacctactccatgcccatcctttcccagtagcccctcagcagcctcctgccccttgttcccacaggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaat

SEQ ID NO: 6277 - DNA, 1053 bp, Homo sapiens
gtggcccacagcagacacccaataaatgagagttgctgggatgtccgagggtccctgccccgcgcaggcttcgcccccacgttgacttcctcgctctcagcgccttttaggcctcctcgatctggctgtgcgggggagggagagcgggccttcccacggatcccttgccttctcttctagggatccttatttgagccacgttgtcctcctttctaatacttctgcccctcaccctgagacccgcctcgcccacccccgctccccagagctccctgtattccgcccttttattcacttgcctcactctctgtcgcctcctcctccctcctgggcattttacttatgctcactcctctggcactctcacacctttatgcagtcattcgtgaccacaagcccggtttttccttccgctcagccctgctgcccttcctttcattccctcctgtggacattttcacctggcgttacctgctgtcaaacggcctcctcccactggggcctttctagactcgggggccctccttggcccctcctcctggcaggaagcaagatggagctgttgggagaggcctgtggaatctgggatctgccgcccctgccggagagaaggctggggcatccgctccccatccacaactttcctggtggctctgcagacccctgtaacccacagctgtgactcataaccgaggtgattcctggaggaggtggagcccacgtctgaaatgggaaaaaagaggtgctgagaccagtctcccaagactcccctggctaatgtcacacttttctttcccaccctgggtgggtgactcagactggtcctgcttgtgaggaacaattttggaaaaagttcatactgctcccccactgagctgtgtaaatagtgtgtgtcagggcagttgggcggcaactgtgggtctgtctgggtggggcttgggttacttttctgatttgagcactttagtgcacttagaggctctttagcagctgaaagtcttcctcagtcttcaggggtccctggactgtctcaagcaatttaggagactggta

SEQ ID NO: 6278 - DNA, 1022 bp, Homo sapiens
gcttgggaggatggttagatgtagggaggaaggaaaatactctaggtgcaatgaatggcatgaccaagtcatgagggcctgtggggagaggggcacatggtgggggtggtaggaactaagcttaggtaggtaggttgggcaatagtgaaggtccttgaaagccaggcaaaggaatttagaattgggcaggagggaagctttgtagttgctgagcagtaggatgacaatatgaaagcatcttccagaagattcataaccaaatacagaaggaatagtaggtgctaatgttgtaacagagaataagctagatgtcaaactgaccagatttattttctgtcagtgtagatttgcttcagattgattccttattataggtgagaaatgtttatagcaaactattttatttgccttggaaaaattgtcattgctgtatacagtggaatttcattcttatttctgcaatggagcagaaatgaataaggaaggcaattcttggacctgatccaaggatgttcagaactgaatggatcaaaaagcatcacttctgaggtggtcttgtgatatgaacttgaaaagggcatggtgtacattatctgttggcaggcaaatgacagctttcatttcgaactggacagtgttgtcactttctgccttagtgctgctctgacagtctgcttgaagtcaaaacttggattggttcaccagcttggactatttttgaagcatactgtaatgtctaggcttattgaataaaagaatgttcccaaaataccatgtgaaaggatgtactactgctacatgattgccattattcacatttcttgggaattctttgttttaacccttaaactttattagttaagaacagttatggtatttacttatacaaatttaccataatttatattcatgcacaaagaagaaatttgagaaggattaaaatatgctttatacttaatttagatctcttttgacctaaagtaatgatgtcacatttttaggtcatcaggccttgtagcttt

SEQ ID NO: 6279 - DNA, 1066 bp, Homo sapiens
actttttttttttttttttcagactgagtctcactctgtcgcttaggctgaagtgcagtggcgtgatcttggctcaatgcaacctccgcctcccaggttcaagcaattctcctgcctcagcctcccaagtagctgggattacaggcgcttgtcaccatgcctggctaatttttgtattcttagtagagacagtgtttcaccatgatggccaggctggtctccaactcctgacctctagtgatccacttacctcggcctcccagagtgctgggtttacaggtgtgagccactgtgcctggcccccagcactttaggagtctgacatggatgaattgcttgagcccagaagttcacgaccagcctgtgcaacatggcaacactccatcgctacaaaaaataaacataattagctgggtatgatggtctgtgcctgtagtcccagctacttgagaggctgaggtgggaggtgaccaggaggtcgaggctgcagtgagccatgattataccactgcacctgccgcctgggcaacagaccgagaccctgtctcaaaaaaaaaaaagaaaaaaaaagcaagttaaattcacaatagtttatcgtttcacattgaccagattggcatattaaaagttcagacgatgaggatcaagtctgtatactgctggtagaagtattcaattgataaaaccattttggaaagcagtttgtcattccctggtaaagttgaatatatttattttctgtaatttagtatttccattactagatatataatctaaactctgttcatgtgtaccaggagccagaataaaaattttcacagcactattattcatattaacactaataacagaaacaagaacctagaacacctctaacatccagcagaggtagaatgggtaaatcaattttggtatatatatatatatttttttttttttttgagatggagtttcgcttttgttgcccaggctggagtgcaatggcacgatctcagctcaccgcaacctccgcctcccgggttcaagtaattctcctgcctcagcctcccgagtagctgggattaca

SEQ ID NO: 6280 - DNA, 1085 bp, Homo sapiens
tgggcctaattgaatagacatttctccataaaagatgtagaaatggacaacaagcacatgaaaagatgttcaccatcattgatcattaaggaattgcaaatcaaagccataatgagataccacttcacacctgctagggtggcttttatttaaaaaaaaaaaaagataagcattggtgaggatatggagaattaggagcccttatgtgaaatggcacagtgctggaaaatagttttgtggtttctcaaaaaatcaaacatggaattactatataaactagcaattcctcccctaggtatataactaagagaaatgagaacattatagcagcattattcataattgctaaaaggtgtagacagctcaaatgttcataagtagattaatgggtaaacaaactgtggcatatccatacaatggaatattattattcagccataaaaaaagaatgaagtattgatacaggctacaacttggatgaacctcaaaaacatgctaaatgaaaggagccagacgtagtgtatgaattcttttgtatgatgtttccacaataggcaaatccagtgagacagaaagcagattagcggttatcaggggacgggggaaggagaaaatagggagttattacttaatgagtattgcgtgttttactgagataatgaagagttttggcactagagagaggcagtggttgcacaacactgtgaatacactaaatgctactgaattgtacactttgaaatggttatttgtatgttacatgaatttcacctcaattgaaaagaaactatgtttggatccaattttggtttattattggtgaagatccaaaatttgaattggtgagaaggtaagaactgtttagtataacttctgcagattgcaatatggcaacatttgttaaaaattatacatatgcatacctttgactcagcaattttatatctagaatgtatcctacagacatacagggtaaaattacatgtattcaaggtgattcatcacagcaggctaataactattagcctgggctattatgtagctttataaaagtaggaggaggctctttatgtacttttctttct

SEQ ID NO: 6281 - DNA, 1026 bp, Homo sapiens
tgctcaaacccaggaggcggaggttgcagtgagccgagatcacgccgaaagtgttgggattacaggcgtgagccaccatgcccagacattatttttttcttctttatgtttgggggttggcaaatccaagctacatgttgagagaaatctcggatgataaacttgacatcttgggatcttctgctgggatcaggggcagcaggatacgccattcagagtattactgacagttttcatattgtcccattaggtttgtagtagatggagccagggtgagggccaggatgataactgatttagaaggatattagatattttgtgattgcaggtcatcagcatatgcaggttaaattagttacttaatcatgttgtgatggtgtctttgtaccttgagttttctttttctttttttatttttacaataaaggttgttaatgttggaactttattgtcaaacttgtagtgtttgttttgtatactcattttaggatcttaaaagcccaaaacatctaaagtgtagaacatcttttgtgaatattgttatacaacaagattaaattccaagcttactttctgatcttttatttttacagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggtacgtgttcttagtggagaaataagcaaaatccccaactctccctggctgggggttttgattggcacctgtctcatactttatcttgtaatttttgtagcataagagtactcagatattgtgaaagtaatttcttcttcatttctgtttcataggttacttgctatctttgctaatttcctttgttctaaggtagaacaagtaaataggcatgtggggtagatactggtttaaggctgagatttatagcttttccatcaggctggagtctt

SEQ ID NO: 6282 - DNA, 1029 bp, Homo sapiens
gtagtcagttgagttttcagggctaggattaggcacttggggatacaagtgaaatagacctggtactcaccgtgtacagtcttgtagctgctcccagttttatgctgaggaaaaccaatttgttaggatgctacaaaactaacttcatctgaaatgaaagaaggtaaattaaattagctcaactcaagtacacgatgacatcagaatgaacaagagatgtttatgttttaatctactgaccataagaatgaaaaagagatgcttattttttaacctaatgacatcagaataaaaaaagaggtttatttttaacctaattttgcttttgttttacatttatgtggttcaaatatcaaagtgctgcaaaaagatatacctgataagtcttcctcctaacctggttcccatccactctaccgctcctcaccctctaagagtaatcatttctattggttatcaaaatagaaaaaaattttaccctgaaaatagaaattggtagctaggattttggctctttttcagttttgtagcattacgcatctttcattgctccactgtaagcagtgaattaatcagaccttttgtctgactgtgactgctgggttcccattctgtttaatgcatacagtgtctttcacctcttctcgcccctaccaataaataattaactttgtcttaccatacttgtttcatgcctccccattggtgcagtattcttctggaaagtgatgattcctctagaaaagtgggggaagaaagtaagtggaaaaaattcttggtaaaagtgcgtcttgccgaataagttaagattttaaagaggcaatgcaataactgattattttaccttttatacctatattcaaattgcacatttacaaatttaaaagtaactttgactttaaacacttcacttattttaaaagtaaaaagtttccttttcttaaatcaacaatcattttatagtgatcattaaaaattaggttagcatttttttctgaaaatacattatttattaaaagaatttgagtt

SEQ ID NO: 6283 - DNA, 1045 bp, Homo sapiens
gatcctcttgtccaactttttaacttgtccaacttttacacaatttttcataagctacaaacatgtctaacactctttaaaagctcccataaaacatggaacataaaatacaatttcaatatgaaactgagattcctaaaaaggaggaacaggaatctaggcttataacaccaattatagataaaatgaggactctggagacagatttggacttgagacctctgtgagtttttttttttttccgagacggagtcttgctctgttgcccaggctggagtgcagtggcatgatcttggctcactgcaacctccgcctccggggttcaagcgattctcttgcctcagcctccccagtagctaagattacaggcgtccaccaccatacccggctagttttttgtatttttattagagatggggtttcaccatattggccaggctggtctcaaactcctgacctcaagtgatccacccgcctcggtctcccaaagtgctgggattatgggtatgagccactgcacccggccgactcctctgtgctcttgatgcttagtctctcatctgtaaaatggagctaactccttcctaatggactctatttggattaagaatatgcatgtacagcctgtatcttaccagatacgtggcaaatgttaatccttttttccccaaatgctgtaactgactggccaggacctcttgagcagtcacttaaattttctgagacttggtttttgcatctctaaagtagagatattaactgtcctgtctcatggggttgttgtgaggattttttcttcatattattcataaatcagttttgagtacttttcggtatccttcttaatggtgatttttaagatggaagagttgacatcaagtgtttaaacatatgccagttttgtgtatgttcttctgaagtatcaagtggacactcatttactttgtcactttattaccttcttaaaatcaggctgtgatggtaaaaccttcctgtgaagggcccattctggggagctgtttattgagaccaaacctcatgtatt

SEQ ID NO: 6284 - DNA, 1049 bp, Homo sapiens
acctgcttctgttgagattgaagcaggtggtccttgtggctcagtgtgggtggtcttatgtggagtcaatatgggtgggttttctagggatgctttttagaagaaaggaaagaattccaggggggagtagttttaggactttacttacaacttgttttctcttttttagctaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaaggtaagtagtgaagcttttcttgttgagaaaggatgtcttctcggaaaggatgaaggaccatgaaagacccagaaagaagagtctatttggagtcaccctctctctctcctttggttcctgtgttgccaatagcatattcctcttcttacctgtgctttagtgagatgtttctgacacctgatggtttctccttcaagcttgcaaaagccagagtcagggtgcctgtgatttgagaagaggattcctgtcctttgtccattagagtgccaggtgccttgaccttagcatttggggtcttttagaaattgcttatctttcttggaactgcaaatgtttttagatgctacattgctaatgatcagagctccaaatatgaattgtgtgggctgtgctaaagctagatgaaatgtttgcattttctttttttttccacagaagcaagtagattggtatcttagaagccatgtgcttttgtcctttctcagaatcatttcacctgtcaactcaagacagctccaggctgtctcttactcagcaaatctgaaggtgtaaatattaatgtggttggtaaaaatatggatgctacagcagtcttgccctatgaataacttttgcctattttcccctaaatgatgaaaagtgagcagtagcttttctagataagaggaatattattgctaaccctgcagtgaaa

SEQ ID NO: 6285 - DNA, 1040 bp, Homo sapiens
ccctgggatccctggggaaagagcagtccaggtacaggaaacagcaagtcctgagggagaagcatgtttgaagaccaagaaagaggacatgctgtaagctatctgaagccacagtatacaatcagcgatggccagttttgggttctttttggtgatctgggaaaacccctagtgatgcaagcaaatatgggggatgccaggtaccagtggggttagctgcatcccactcctggctgaaacctattttagagacaggcctgcatcagggaccctgggtaacggaaagtacctttttccttgcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctg

SEQ ID NO: 6286 - DNA, 1023 bp, Homo sapiens
cccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccg

SEQ ID NO: 6287 - DNA, 1028 bp, Homo sapiens
ttttcttttactactttaatttgcttaaaagcacaaatgcttgtgcttgcagtaacttcctaaaagcagaagtaatgttcccttttactaccttaataaagcatttgcccctttgatacaaatgatttttttactgtgctaacagctgaaccagtggcacaaaattgagatggtatttactgcagcaaggtccctgtaaatcaaattctaagctttacataaaaatcttatttataaaaaatacaataccaagtacagtgagaatggagcatggagcagcagtgctccctgccagggccatgtggaagtggcttttgctacagtgcttgcttaatggcacaagtgaaaagctgaataaggcaaacacttgaagaggcagttttctgtaaacttctgggggtggggggaatttcctctcgggacagatactggtttgggatggctaagatcagaaggtgtgatatttggctgcacctgacacatcacagatttaagatagcttctgctggatgagaccagttaactcttttaggagagaggttatcactacagctttctgcctttactgttacaatgtgcagccgccagatggtatcctcctatggaaaaaaatcacctccaaaatcttcctaagtgaaaagatacaaaataagctaagtcactaaaaggtttccttagcttaaagctccttaagaatcctacattgataactaagtaactttgttagcggtgtgtagctagacacaaatgctttaactagaatatgtattcccactcacttggtacctaatagtgatacatcgtaatgacacttggaaaacaaactggtcctgaggaattttggcctcttctcatgtcctcacttggaactttccagctttcgtgacgtatttgactcctttaaatggcttatatttctccccatacatgtccaaacggtttacttttaagcctgtatcaaaaagaatgaaaaagaataaattatcatcatcccaaccaatataatgttagcaatgagcgctatatgg

SEQ ID NO: 6288 - DNA, 1032 bp, Homo sapiens
ctccttctcgcgggtggtctggagcctgcctccgcctctggtccccctcgtgttgggggttccctccgcacttttcatttgggcatttctgctttcctcagaagttttcgggtctgtggcacattgcggagttctgtgtgtcgctgcttggtcgaggtgaccctcgcccaaattccagggttgcaagcgttcttgggtgtgtagtggatttcccatgaaaaatgtgccccacccgcgcccccgggggcggcccagggccggagggagcgtggcgtgcacagtgtgtgtcatgcctgcgtgtcatgccctctgacagaacttcattgttggccgggagcagacctgcaaagttggcccttctctgatgcaggtatattgccctcaagttgtgaaattgtgtgtctctaaaatgtttgctcatgactggaattaggaccctggttcccgaaggtaccatcttgtttctttactccttttatctcagagtcacaagtgaaatgagttgagagatactgggcatgtagcgaaatccatgaaactggagactttcccccaattgctcttccagtttggaaggttctttttttgttaatgaggacaggataatgggcttgtccactttctcccagtagccttgactgaatgtttaatttacgctagttcaactatttataaaaagagataaattgccttatatacccagtgttctgactggcctttttaaaagcagaacttgggctttgttgtcccagagaaagggaggccccagcacaaaaatgtgaagagaaataaaataagctcatttttggtctatgagctttccaggctccacccgtcctggtgatttgagggcttctcaatgccaatttttactacattgtgtttaagagacagcttgggaacctaaccctcagtaagatctaactgtgctgaactcggacatagtctgtctcttaaattgcataattatatatatatatatatatatatttttttttttttgagacagagtttcgctcttgttgcccaggc

SEQ ID NO: 6289 - DNA, 1057 bp, Homo sapiens
ataggcctgggcacactgttttcatcttccagggtcttaggaatttcagaacttttcaaaactccctatggacatctcattctcctacttttccttttgtgttttttggttagcttgtttgccccagctgcttcagggagctgaaatgttaagcaattgtagctgattgtttttgacaaataaataccttgggggaaaagcctgttagcaatgggcaagctctgaatcaggttaaatattaggaagtcttgggagtggggtttttcagggaattgctagtcagctcaaataataactgtactctgaaaatgggactttgaaggaactctagccctgttctgtcacctccactggctgctaggctccaggattccacagattgtggtttgctgcttttcagggctagcctggagctgggaagaggggcatgggaataaggcatgttaaaatgccacaaagcttgctattcttactgagatgcagccatctttttttgaataaatgctccttggattgttgcaaactttttggttaatattcagagttctgaaaaaggctatttttgactttttttttttttttttgagatgcagtcttgcattgtcgcccaggctgaagtgcaatggtgtaattttggctcactgcaacctctgcctcccaggttcaaacgattcccctgcttcagcctctggagtatctgggattataggcacctgccaccatgcccagctaatttttgtatttttagtagcgacggggtttcaccaggttggccaggctggtctcgaactcctgaccttgtgatctgcccgccttggccttccaaagtgctgggattacaggtgtgagccactatgcccggcccaagtcttgacatttttttgccagtgttcttgttggttttatggaagagaggatttttggaggtccttactctgccattcccaatgatgtcacccaatttgttttttaagcattaaaaaaaattattttaaaatataaagacagggtctcactatgtcaattaaaaagacagggtctcgcccaggctggtctc

SEQ ID NO: 6290 - DNA, 1034 bp, Homo sapiens
gaatggggttagcacacttgtgaaaggactcaaggttgaagggagagctctcctgcctttacattccttctgtcatgtgaggacacagtgttcctcccctctggaggatgcagcaacaaggttccatgttagaagcagagaaaagcctcgccagacaccaatcttgctggtgccttaaccgtggatttcccagcctccaggaatgtgagaaatatatttctattgtttacaaattaccccaaacaaaataagaaaaataaaacaacaacaaaacataagtaagtaaataaataaatagcctggtctgtggtatttttgttatagcagcacaaggggaccaagacatataccaaatgaatgagatatatactgattagtatcttacactgtgaaagtgagttctaattgtcaaaattcatttgataaaatatttttctgattctgatttttttttttttagagacaagtttttctgtttcccagactggagtgcagtagcacaatcatagcctagtcactcactgcagcctcaaactcctgtccctcccaccaaaaaaagaattgaaagttattaggaacacctgtggcagaaagtacattattgaaaagaatcttttctagtaaactgtagggacacagtgggcatgaggggataggaaatgtggaacatatgaatacctccagttgagccctggtctgtaattatggaggtatgtattaatagggatgaaaaaggcagggaaggaatgtgtaaggtaggtttgccttggtttttcctgacactagataaatatgaaagtaagaggaatgagagaatgaatgaaatggtaattgagaaaggaaaaccatcagtagaaatgaaaatactcagttttggctgggcgcggtggctcacacctgtaatcccagcactttgggaggccgaggtgaacggatcacctgaggtcaggagttagagaccagcctggctaacaaggtgaaaccccatctctattgaaaataaaaaattagctgggtgtggtggcacacgcctg

SEQ ID NO: 6291 - DNA, 1050 bp, Homo sapiens
accttcaagggtattaggacgtgctcaggatatgatctttggtgcagtgtaaaaatgtaatttcttagtgaataggtcaatttccaaaccagcaggaaagttataagtatttaaatggaatgtgtagggatatgtcagggaagttagagacaataacatctggtatgctttttttttttttttttttttggtgagatggagtctcgctctgtcgcccaggctggagtgcagtggcgtgatctcggctcactgcaagctccgcctcctgggttcacgccattctcctgcctcagcctccagagtagctgggactacaggcgcccaccaccacgcccggctaattttttgtattcctagtagagaaagggttttgccgtgttagccaggatggtcttgatctcctgacctcgtgatctgcccgtcttggcctcccaaagtgctgggattacgggcgtgagccaccgcgcccggtctggtatgctcttaaattaattgttaatgctgtgacttagcagttctttgaaatcatcaagatcatagactgggcttgtgcctataatcccagcactttgggaggctgaggcaggaggattgcttgagtctacgagttggagaccagcctggacaatatagtgagactcttgtctctacaaaaagttaacaaaagtagccggatgtggtggtgcctgcctgtagtcccagctacttgggagactgaggtgggaggattgcttgagaccaggaggtccaggctgcagtgagctatgatccgtgccactgtgctccagcctgggtgacagaatgagaccctgttaaaagaatcttttttttttttttttttggtaagaatgagctaagaactggatatctgtaaagctaatagaaaaaaatcctgtgaagcaaaaagtcaaaattgaaataagctaggaccgacagcaaggttaaatgcttatttttttttagtgttcataaataaggtacagttttaaaaatatcataaacatttttatgatcctattctcagggcccggttttttttgtatctttaaa

SEQ ID NO: 6292 - DNA, 1047 bp, Homo sapiens
ccactttagctagtgcttttttttttttttttttttttttaagacggagtctcgctctgttccaggctggagtgtagtggtgcgatctcagctcactgcaacctccaccttccagtttcaaatgatacttatgcctcagcctcctgagtagctgggattacaggggccagccaccatgcccagctaattttttcatatttttagtagagagtactttttaactgagaagagatgctgtaaagttttaggaaatcacagtggggacagtagtcatacttctactttcttctgaatataatattgtttcttttttctcctgcagttacttattttttttttctttttgctttaaggcttggtagttctgagaattttagattcagttataatcgaatgtaactatcaacacatgttatggagtagtataaattgttacttgatgtttggagttgttttactcagtcactcagcaaaggtaagattagatctccgttagatgaaaagtattatctcttatgcaaagagacattggttagctctggatgaagacaatggctatggggtcagtcaaccttgtagaaagaataggctaggcacagtggctcatgcctgtaatcccaccactttggggtggtcgaagccagtggatcacttgagcccagcagttcgagaccaaactcggcaacatagtgagagccccctctctacaaaaaatttgaaaattagccagggcatggtggtgtgtacctctggtactagctatcaggaggctgaggtgggaggatctcttgacctggggaggttgagtctgcatgcagtgagccatgattgcgccactggactccagcctgggtgagaaagtgagaccttgtctcaaaaaaaaaaaaaaaaaaaaaaaaaagacacaataaaagtaaaattgtataatctctggaaaaaacaaaataggctgtcatgttctaatactcaatatgtaaggatgtttagtatattagtgggtataattattaataaaatattctatttagttatctttgaaccagtttg

SEQ ID NO: 6293 - DNA, 1197 bp, Homo sapiens
gtggtgcacacttgtggtcccagctacttgggactctgaggcacggaaatcgcttgaacccaggagtcagaggttgcagtgagccatcacgccacactgcattccagcctgagtgagattacgtctcaaaaaaaattttttttaaacataaataaagaccacactatcttttttgaagattatgttcacatttcattctctccattgaactgtatagatgtattacctgtatataaagaatgtaaatttttttgtattaaaaatcgacaccttaaaaaaaaactaataccaccacaaggttaagctctgaggagatttcagctttacaataattacattgttacaataatgtttaacttctcaataattaaaaaccaaagcaatgttgcaaccttggttcaatattcaaatatatttttcttggtaaccaagctacttcactatttatagtactttataaatgatttagaattgttatgcagttttttcaaagaagtattcataaggtaaatttagaaaattattttaaaacgaaagtgatgcccaccagatggtgctatttcgcctgttttatctgcgacaataagtaggaaaaatgaatatagaacttcaaaaaagtgtatggaagatctagaatatttgggcattgtattttgggtgtagatgagctcagtggaaggaagcattcaaatattctaaacttgtgtttagtactgtatgtttatcttgataaaggtaaagatgaattcccagagttaatatgccagataaccttttatttagtctaaatgttaagtagattttttgaaaagttgacctatatgcaaattttattaacttcatagctgtatatgcatgaaaaatgaaattatttattagatatgtgttaccaaaatttgtttcaagatttctttatattgttaagtaaacaatattactatctcatttgagttacattgtgatttacaaattaagggaaacattttgatttttttatgtgtttgtaattattacccagaaacttaggcttgaattcactatttttacaaaggaaagagatgactcttctaaattaatttttgtattaggaagagggcaaactatgtggtacagtgttcacttagatgcagccattgaatgacgatccattagagtcaaaatggttagttagctaatgaaatacacttttcagtaaag

SEQ ID NO: 6294 - DNA, 1060 bp, Homo sapiens
ttgttgcaaaacataaacatttactaaagagttcagcagagtagattaaatgttatttaaaacatatgttatattgacctcatggctaaatggcctggtttaggaatccatgaattatcccacaggtaatagcaaagttttctccctgcctcgtctcccaccccaaatatttgatttccacatatactgcacaggggaattgaatttgatgtcgaaagccataagaaaaagagaaactttgctttttactgcttttactaggaaatagaaaacatttttagtgacaggctatgcttcatcatgaaaatacggttgggtgttttaggccttcacaaatttgatttcattgtacttagtgatggatgttagtaagctgtgtgagatggagagaaattaaagaataaacaggaacctctcaaacttgctagtgatgttctacagtttgtagcatgaattttcttacttttagtttttccttatgaaatactttatgtagaacaaactagcagtactaaaacaaacacccatgtacccaatctgtcaacacttagatttgttgaagatttgggtgggcagagtcttccacccaaatggtaaaaggggaatacattacaagtacatctggggttctctgtatacctgtcttcagcccattttctgtcttatttcaaagttcactggtgttccagttttgtttttagctgtaatgcttttcttagtgcttaaaatatatgtgtatatattcataagcaatatgaagtattgatttgcgtgttctaaaacatattttacagtgcctctccttcggctcgctttttcgtgtaacattgaatttttagatttttccctgttaatgcacgtaatttatatgtaatttattttcacctgtatagacttgtatgaatacatcacaatttattctttggttgaggaattacaggtttttcagtattagaaacactactgtgtttaaggttcttgtactgatctgtttatgcatatgtgaaagattcttgaggactgtattttaaatatgtggatgtttaaatttcaattaatt

SEQ ID NO: 6295 - DNA, 1093 bp, Homo sapiens
cgactttttactctcccaaaacttaactattaataatctactgtgtaccagaagtcctaccagtaacatagtctataaacacatattttgtatatgtattaaacactgtattcttacaataaagctagagaaaacaaagtgttattaagaaaatcatggccgggcgtggtagctcacacctgtaatcccagcactttgggaggccgaggtgggtggatcacctgaggtcaggagtttgaggccagcctggccaacatggtaaaaccctgtctctactaaaaatacaaaaattagctcgtggtggtggcaggcgcctgtaattccagctactcaggaggctgaggcgggagaatcgcttgaacctgggaggcagaggttgcagtgagcctgaaattgcgccattgcagctccagcctgggcgacaagagcaagactctgtcttaaaaaaaaagtcataagagaaaacctgtttattattcattgagtggaagtggatcatcataaagatctttatccttgtcatcttcatattgagtaggctaaggaggaggaggggttgctttttaagagggggcagaggtgattagtaggagaaaaattttaatgtgtgtatatatatatatatacacacacacattatatatatataattttttgtagagacagggtcttactttgttgcccaggctggtcttgaactcctgggctcaagtgatcagcctgcctcctaaagtgctgggattaccagcatgagacaccgtacctgactggaggaactacgtttttgatatggtactcagagaactgagtgcagtacagaagcttatacacccccttttttttatagggaagtggggaaatggagaatgtagacagttcttttgagggccagtaaatcatttaggtgggaggcagacattgtgggaaggtgagaggtgaagctgcaggttgtcttaccatgcagatgaaggccccctgggtaatctgttggagctgccctgggaagaatagatgaagtctttctgggcagtaatgatcatgacttccagcttcttctcatgtagtcgacctttcctgatcatttgatgagatc

SEQ ID NO: 6296 - DNA, 1618 bp, Homo sapiens
tgtattgcagctgatttggagaatgagtggctactttgaaaattgtcagtagataggaaataaaaataacagaatgaagcagctcacacacttcagagtttattctcaatattgttgaattgggccataatgaagcataatgcctggttaaactttattgcaattcaaacatcccaccagaaagaaatttttaaaaactatatcaacaaataaattcactgaagtctgtctatagcttcttctaggaactacaatttatttatttgtttattttaatattgttttttgtagagacaaggtctcactttgttgcccaggctggtcttgaactcctgggctcaagtgatcagcccgcctctgaaagtgctgggattacaggcatgagccaccgtacctggctgaaggaactacatttttgatatggtactctgctttaaacgcagtaggtactctgctgaattgggctaaataaacatttcacctctcaaaactatgtgaatatttggcttaagcaaagatagcctgggaccatgaagaaagctaaaacacttaaaaaaaatgtacccttatttaaaaagtagcatgtttctttctgatttggagtgttatgtttttgttgaaaaattggaaattacataaaaccaaaatgaaaaatatagagatgatcagtaatttcaccatgaatataatactcctcttatcattttgtattcccttccaactaatttttctcttaaaagtggcactatgtttttgaaaaagctgactactttaagaaaatttctctcagtttactttcttaatcgtgtgcttttctgaagagttggctctgacgttgactactatagtaaatccaattttgatgagtttttcttttttagtgggccaaaaaaaaaaaaaggaaagaaaattctcctttgtagaaaaaggagggaggatggaatgtatattgtagtacacctgaaaatccataccttttcttagccatatacacaattagtttactctttctcaagataatatttttatagtaaattaggattctttgttacaagtgatgggaaaccaaactagtgctatgctaggttaaaaaaaggaatttagggactcaagtcactaaactactcacgcgcacacacacacacacacacacactcacacacactcacataggggttcaattgggccttaggaatggctaaatctaaggtctcaaaagctgtcagtttttttccttcggttcgttctttgtctctgagagttagcttcactttgtcagcctgcttctttatactcttcctgtttttcactctgacttactgtgtttataattatcttgggttagtttttcttattgctcatttggaaaaactatcagtacttctgattagtaatttcagatgtttttatattttaattttgtatgcaaaataagtatccgtgatattttaaaaatatttactaagtatttccctagtctttctctaaagggtaatctcaaatgaaacaactggaactggattctcatttgtttaatgactgaagaagtcttccaattactctacaaaccattgataacttttgttatttgtgaccagtattcatctagtaagatgtt

SEQ ID NO: 6297 - DNA, 1023 bp, Homo sapiens
taagagttcatcaattttattagcgtttcaaagaactaactttggctttgttggttctctgtagatcatgatgtatgttttctatttccacgtatttagctccttttttttttttttttactttctttgggtttcatttgcagtttttttccttaccctaaccctacagttgtttttaaaaaaagattcttgagatggatacaggaccatataaaaaattttttttatgcatggcaagaagtttgcataaagtcagaagacaaattacaaacttgtaaaaaaattatttaataccaattacatcaaagtccaaggcctacttctttaatatgtagtgagtttctaaaagtcaataagaaggaaataattatgtattaaaaatgagcaatgtttgtgaagagttgatgtgtagaaaagttaatattaatggcagtaaaacatatgaaaggatgttcatcgtctcatgaggaattcaaaataaaccttctattattaaattggcaagtattttaaaaatcagtaataagtagtatgggcaaagttatagagaataggcgctttcataagctatcataaggatataaattgctacaacctctttgaaggagaagtttacattatttatcaaaattttaagtattcttttttttttttttctttttttttgagatggagtcttgctctgtcacccaggctggagtgcagtggcgccatcttggctcactgcaagccccgcctcccaggttcacaccattcgcctgcctcagcctccggagtagctgggactagaggctcccgtcaccacgctgggctaatttttttttgtatttttagtagagacggggtttctccgtgttagccaggatggtcttgatctcctgacctcattaaccgcccctctcggcctcccaaagtgctgggattacaggcgtgagtcatcgcgcccggcccttaagtattctttaattcacgaactatgtgtataaagatgtttatttccatattacctataaaagccaaaaa

SEQ ID NO: 6298 - DNA, 1039 bp, Homo sapiens
taaaacctttttaaaaacttgatttttaacatttgagatatttatggagtcttctccatgaaagggagaattttgcatgcaatagtgtatgatgggcacttttaacttttttatggctttctttttcaaagtcatacaccactttacttttcttttaacctaattccatctttcttctgttttttttgggggggagaggttggaacatctccttagtaattttttccacataggaaaaaggattattaaatattactttgccttattaacctgataatttgagtacatattgaaaatttctagtttcaaaaatttcctcccttctcagcatagaatacattactccattatatttttagcatccggtattctttgagaagttaagtattagtctgatttttattccttttaaggtaattattatttttcacattatatgctttaaaggttttatcttaatatgagagattaaacaagatgtgtccaagtatggggtcctagtccctaatcccttgtaaaactgcttgatgtttggaaaaatctgaccatatttatgtttcaccttttttttttccaacatttctctcttactcttcataatctctattttccctttctgtatttcctgttaaacagatctcagaccacctaataaattctctacaccttttaatttttatttcatatttttaatttcttatattttctatctacttttttggtctttttaaaaatttcaacttttctatttttatcttagtttttacccatgcatattttgattgctcaggtaatccatccaactattgatttttcaaaaatttttcaataattgttagtgtacagaaactgtgtcattctctagctgcatcttttcatataattagataggtctgtttgtggcatctttctttccttgctttacaggcagtactgttatacttttgtttatttttatacataaaacatattttttgacgtttagtaagatgtggaagaggaaatgaacatatacttcatctcttttgaagtgtaaggt

SEQ ID NO: 6299 - DNA, 1068 bp, Homo sapiens
ctcactctgtcacccaggctggagtgcagtggtatgatctcagctcactgcaacctccacctcccgggttcaagcgattctcatgcctcagccacccaagtagctgggattacaggtgtgcaccaccttgctcaggcaatttttgtatttttagtagagacggggtttcaccatgttgcccaggctggtcttgaactcctgacctcaagtgatctgcctgcctcggcctcccgaagtgctgggattataagcatgagccaacttgtccagccacatattttgaatttttgatgttacaacttacaacttttaaaactgcatatcccactatcaattgttgtagttataattatttttaatagttttatctttaatcttcatattaaagatataagaggtttacatactatgcttacaataggccgaatagccacttcccactcattttttccaccatagaaaacttgcatccaggggacttctgcatatgtgggcttaggggaagggtgttgcagtcaaagcaccatttcccttactgtctgatatggtttggctctgtgtccccacccaaacctcatctctagttgtaatccccataatccccacatgttgagggagggatctggtgggaggtgattggatcatgggggtggtttcccccatgctgttctcatgatagtgagtaagttcttacaaatctgatggttttataagtgtttggcagttcctccttcactctctgtctttttctcctgccaccatgtgaagaaggtctttacttcccctttgcgttccagcgtgattgtaagttttccaaggcctccccagtcatacagaactgtgagtcagttaaacctcttttctttataaattactcagtcttggatatttctttatagcagcgtgaaaatggactaatacactgttctcagatttttctcagctctgtggtacaatgagacaccatcctgagttccaagagatccagggtagtcgtcttgccactgagaagatactaattgtgacaagttaatgggtgcagcacaccagcatggcacatgtatacat

SEQ ID NO: 6300 - DNA, 1315 bp, Homo sapiens
gttttcagagtataaattttacactgtaaagaaaacttattcccaaatattattttctttttgatgctattgtaagtggaattcttttcttaattttatgttcagattattcattgcagatggcttagagatacaattgtgtgtggtttttgttgttttgtttttgagacaggctcatgctctgttgcccaggctgaagtgcagtggcacaaacatggctcactgcagccacaatctcctaggcccacctgattctcctccctcagcctcccaagtagctgagaccactagacatgcaccaccatgcctggctaatttttaattttttttgtagagacagagtcttgccatgttgcccaggctggtctcgaactcttgggctcaagcaatcctctggccttagcctcccaaagttttgggattataggcatgagccgctgtgcctagctcagtttgtgtgtgtgtgtgtgtgtgtgtgtgtgtgtgtgtgttttaatattgatcttgtatcctacagcctttctgaacttacttagctctaatattttttagtgggttctttatgattttctataaacaaaaccatgtcatctgtgactatagttgtgtttccttctttctttctaatttggaagcctttaactattttcccccttccttaattgctgtgactagtagttgtaatgtaacagtgaacagaagtggcaagaagagatgtccctagtcttgtttctcatatagggggaaaatatctaatcattcaccattaagtttgatgtttctctgcagttttcttagatgccctttatcagattgaggaagttactttctatttctgtttttttttagcgtttttatcttgaaacagtacagttgacccttgcacaacatggcgattgtgggtgctgacccactgcatagtctaaaatccatgtataacttttgattctcccaaaacttgtcaattaatagcctactgttaaccagaagccttaccagtaacataaagtcaattaccacatattttatatatgtatcatataaagaatatattattaagaaaatcatgagagaaaatgtatgtactatttattaagtggaaatgtttcgtgagaaaagtcatcattgtcttcatgttgggttggctgaggaggcagaggaggaactggttttgctgtcttaagggtggcagaggtggaagaaaatactggtgtaagtggatttgtgaagttcaaaccagtgttgttctggagtcaattgtagtggattttgccaaatgctttttgtttgtttgttttttgagacggagtttcgc

SEQ ID NO: 6301 - DNA, 1035 bp, Homo sapiens
gggttgataggtgcaccaaaccaccatggcacatgtataccaacgtaacaaacctgcacgttctgcacatatatcccagaacttaaagttaaaaaaaaaaaaaaaaagccaggcgcagtggctcacgcctgtaatcccagcactttgggaggctgaggcaggtggatcacaaggtcaggagatcgagaccatcctggctaaaatggtgaaaccctgtttctactaaaaatacaaaaaattagccaggcgtggtggcgggcatctgtagtcccagctacttgggaggctgaggcaggagaatggcatgaacacaggaggtggagcttgcagtgagctgagattgcgccactgcactccagctctggcgacagagcgagactctgtttcaaagaaaaaaaaacttcagtttacttgattttgcttatagagttctttgagaatttaaatcatcctttctgaattacagaaagtcatagattagaagtgtagctttaaaatgctctagatcactctgaattaagaaaaagggtttcctttgtccagaataagcatcaatttaaaacagcatttaaaaacaagtattcaacaaattggtatacgaattataacacaagcaactaaatcactgactttgattagtctctctactgattactactgttgaacagaagttgtgtgtaagaataggagaaggtgaactcattgtcttgagcatgtggaattagttcttgtctgaggccagatagcaatttttatcttattttcagtatagcagatcctatgctgccctgataagaatcacctgcacagcctcattgactctcacggaagtattccagtaactctttgaattttttcctagaaaaattggcatctgttacccctacacaattccttcataaacagtagaaatttcccccatgaaacctttcctttaaccttaacattcttcgataattatttatgaagtccttaaataattattacaacaagtattggttttgaatacgtaccagctttggaatactgcttaag

SEQ ID NO: 6302 - DNA, 1029 bp, Homo sapiens
gaaagtctttatttctccttcagttttgaaggataattgtgctgagcacagtaatcttggttgacagtttcttctccaccagcattccaaatatattcttccacattttcctggcttataaggtttctgctgataagtctgctaccaggcatattggatcttccttgcatgttatttacttctttcctttcagtgatttcagaagtttttctttgtgcctttgacctttgtgagtttgattataatgtgtcctagagtagtcttctttgtgtttaatctaattagtgatctttgaccttagtctacctgaatatttatatcttttttcaggtatggaaagttttctgttatcatttccttgtataagttttctacccctttgtctttctcagtccttctttgacttcagtaacctgaatatttgcccttttgatgttgtcccatagattttgtaagcttgcttgcttccttttctttttttttctcttctcaccatatttttaatcatttttctttgaactcactgattcttttatttggttaattctgcttctgttgctctctattgagattttcgcttcattaattttttttttttagttgcaggatttctggttttttaaaaaagttatttgagtctcttatatttctttcataattttctgaattgattcttcatgttttctttaagttctttgagctgtcttcaaacaggtattttgaatttttggagagatcacatatctcggtcactttcaggttagtctgtggtaccttattttgttcttttggtgtgatgtatttccctaaatgttctcaatgctttagaagtgtgatgatgtctgagcattgagggatttgtaatttattttagtcttcccagcctggctttgtttgtgcctgtccttcttcaagaggccttccagggattctaaagctgacttactattgcattctctgagcctctgaccaattacagccatctcagcactagagtatgctttaagcccaggttttctgagtcctgca

SEQ ID NO: 6303 - DNA, 1034 bp, Homo sapiens
aaccgtaaggtcactctttacccaatcagctcatttgcatgtttcacgtctcagtttaaatgtccttttgtctatttaaaatatattttagctgagtgcctttaatcccagctacttgggaggctgaggcaggaggataacttgaggccaggagatagagaccagcctgggcaacatagagagacctggtctctgaaaaattgaagaattagctgggtttgatggcttgcacatgtagttctagctacacaggaggctgaggcagggaggatcacttgagcccaagagttcaaggttacagtgagctatgattgtaccactgcactccagtctgagtgacagagtgagactccatctctaaaaaaataaataattggttccttctttgcctgcctcccactctttgtctttctcaaacatttttttcttcatagcatttcttacaattatgcattttatttctgtgtaatgtttttgtttgctatgctttgcattttatattgtgtggaatctccatgaaaataaggaccagcctgacttgttcaagtttgtggtcaagtaacaggatggtacctggcccttagaactatctttataaatatcattagattggattgactgactcaattaatgaacaaatgaacaaacaaaataaatcattatatgctgaagtagcagtcctggacattgtatctaatttagattttaatttaaccttgttattttgatactcgcttcccttaatcagtcattgcatgttccttattgtaaggtggttgtttttctttatcatgagaagaatagttcttctccgggcgcagtggctcacatctgtaatcccagcactttggggaggctgagacgggcggatcacaaggtcaggagattgagaccatcctggttaacatggtaaaaccccatctctactaaaaatgcaaaaaattagctgggtgtggtggcatgcacctgtagtcccagctacttgggaggctgaggcaggacaatcgcttgaacctgggaggcagaggttgcag

SEQ ID NO: 6304 - DNA, 1034 bp, Homo sapiens
ctcatatagtcatactacctgtcagggaaatgtgtcaaaggaaatatgaaacaatagctttaaagttgtcccgcaccctcaccctgtttttcttttgaaggtattatactaaaggaagaaagggaaaaagagaaatctatggtgtgagttcaagtttactactgtaagtgtttaagaaagggctctgttaccatgacaacaaatgcatgaatttcatgtggaaaattttcagtgtatgggactgataaaattgtaacattctgattttctctggtatagaattgttctttgtcaagttaaaaaaaatctgttaatatatgttaaaattaaatttttaaatgttttatgatattgttttctaattgtttattataacttaaaatcatagccaaaagagtgtactttcgtagatctgtcaagcagaaagttaagtatttgatttgacattaaaaattacttttctaatctgtattagatttttgctaaatggtaaataaaatggtaaatagtttcatgtattgggagttcttgacaatagaaaatgacctgccactttatagattcctttgccttaaatgcttactaactcaggtagaggaaagctgttaagctttaagtgctttgtcatatttgcaggcttttatagtggaagagaacagcagtcagcaatgatgatggaaaactgtggcaggtagacttaaaacaccataaagcacagacgattgtgtgtaatgccttgaattgaatcctttttgaatgaaatgatcagccatatgtgccacccttatggaccctgtaagaagagtagaagaaatgtgccctaatgctaactgtgcatgaaattgcagtgttaggagatattgaccagatgtttcaatctcagcaaatggcttgttatgtgactgagtgaaaatatctttgctgctttgatcacatacaccttgaaggaaggggtaatttaatagaggctgtcatagttcatcattgtcaataaactttgacttgacctttgccttacgtttttgatgttgctg

SEQ ID NO: 6305 - DNA, 1035 bp, Homo sapiens
gcctacactcttccctcacttccccttggtgtaggtggcctagaccgtgttagtcacctaatgaaatctgtgaatcctctcttgaaaaacacagcaaagtttccttacaatttcaggatgtttattggattttccccccctcctctcacacataccctgcaatgataggggcccctggacttcaagcagactaacaaagcttagaaaataagattcatactccttcttagtattctagatatataacaatttgacttagaagtaacaataacaatagtattagtgatactgctacaataattacaacagtaataataataataataattaaaatttactttctgccaaccttatgccagattctatgctgaacctttaacctgtattactggttatattgttaatgatacctctagatagagtatatgcagcatacttttattctgtactttaggaaatactatatctttagaatacagatttgagtaagagattataagcattttgattctaagactttttggaatactgaacttttagttttctgattccagtagtcagtctgtctgtctctgtctctgtctctgtctctctctctctctctctttctcggcctctctgccattcatcttcttctgaaaattagctatcccacgtaagcctcatatatcccctaattcctatttgtagttgtgagggaggaaaaatattttccttctaagttctctgctgtaagattcttgtaacaaaagacagattaacaaaagttaagtacactaatttatattctaagttttatgtaacatagagggaaatgaagacttgaagaaacaattaaacctggtgtttttacattaggttttatgaagagtggaagggaaaggcaataggacaaaaaggggtatgaactaagagtagtaaactgaggggaccttagcaagacctgtttgtttagattcatctcatgtccttacatcttctgagataaggatgttctttttttctgcatatagtaaacatcctctcacatggatg

SEQ ID NO: 6306 - DNA, 1050 bp, Homo sapiens
gcttacagatgtactaaaattttaacagaaatctttgcaaattacttgttaaattttcctaaactgatttttaaaaatctatttcattctcaattataacatctttactgagattattaagtgctttgaagcagttaacgtggcttttttttttaatggctgtaaaaaaactgaatttttaggcttgttaaactctggttttagaatgacttttgagtggaaatcactgatcaaaagcaaagttctcacattttgtcaatatctgaatgtcagaaatagaatgtcaggcagtttcccatgttgaaatattcgatagtaaaaggatagcaaagttgctgaatatttctactgtttatcaatttttgccttgcaggttcaaataatatttatttgtagtggaaatatttcaattcatttaaatcctgattatggagtagttagtaaatcaggtttaagcctgacagtgagttgatatagctcttatttcagactgtagtttgaacatgtagactctctgattataactaggctaaattatataataatgactttattttcactgaacaaagtttgctattattttgatgacaaattatttaagtaatcatagtaaaagttgctattggctctgggttttatttattttgctatatatagtagacatggttgatcatttaatcatgccttatagataaataaaagtaagttatagaataacacagaaattttctgctaaatttatactttcactaaatttaataacaatagaaattctctgttaaatttatactttcactaattgtagaataaagtattttaagttaggcatttatactgagacattttatgatattaactgcttcatgttatttactcattttgataaatggagtgataatatccaaaatggaataaattaagtttaaattattgttattctttaaaggaatgatttagctacagtatgtttgtcccaccttttaattttgaacattttctaacttacagaatagtaaaatgaacttttctatacctttcacattgatccac

SEQ ID NO: 6307 - DNA, 1026 bp, Homo sapiens
cttttatttaccctgcaaattatttatctctctcaaagcatatgttagattcactattgtgaaaatagaacagaaatcattatctttctatgggtaacataatttgtattatttatcttcaggtctacctatttttggatacattatgcataggtgcttgccaaccaagcgcagaattctatattaaatcagtttccaaatatattttaaaataattctacaaacttacatcttacatttgtaggcaacttgcattgtgcagaaaaatattagtagtataaatattcactgcaaatagtttgagctgaattgcttaaaaaacttaattgctatttattccatagtaattaccatgacacctcttaatttaatatttcagaaacattgatcgtgacaaatctcttaaatctgggaacaagggcagggtgtaatttgaattattaagtcttctgacacaaaaataattggttaagaatttatttctaaaataggatggtactaaaaattctgaattaatcaccccatgattaccttgtttttatttaatatgtgttaaatgtggctttacacaaataagtagatacctatgaaaaaagcatctcgtatgcatgtaatatatggttttggtataacagctgctgccatttcattacctgagctctgtgaaatagctggtaagatgtgtaaaaaattgattaccctactaggaggaacatgtttattgaaaatataattatttctttcagtctaatgttaatgtctcctacagcatgtttgtgtgcactgttctaggctttacaacattgttattgattcctctgtataccaaatcctatccctttataactgtcaaataaatgcttacattgagaagattatataatggaaagttatgctatcttttctgccagtatgtgagaaaaacatttcaagaattaaatattttacccctttattatttccatttcattttatttctcaaattggtctcatgttctttccatttttcaaatcttgatactgtat

SEQ ID NO: 6308 - DNA, 1083 bp, Homo sapiens
ttcttttgttcttcaatgtttcacaacccccattccccaaattttgctgcttttaagatttttcatatgagaccaggtgcggtggctcacacctgtaatcccagtgctttgggaggtcaagatgggaggatggcttttgaggcatggagatcaagattagcctaggcaacatagtgagaccccatccttacaaaaaatacacacagagaaaattactcattttgatcagtttagttatgatgggccttagtgtattcttcttcatgtttcttgtgcttgggttttgtttaacttcttagagctatcggtttttagtttttattatgtttggaatatttgcagccattatacatcttcaaattggttttctgacccttttatgccacttgaagttgtctcatagctcactgacactctttttttattttgtttctttctctatgttttattttggatacctcctttgctgtgccttccatttcactaatattttcttctgtaatacctgaactgttattaatctcatcaaataaataaagctaaatatttcttactactgggggaagacttttcttagtactccatggcacagagcactaaggggtccctaatctctggtactgcaactatatcagttcctgttaggaaccaggccacacagcaggaggtgagtagcaggccaccaagcattaccacctgagctccacctcctgtcacatcagcggaggattctttttttttttttttcaaatgtgaaaaatctaattttattcagtttagattaatgtatagctatacactctggactcttaatgaaacctttcccattctttttttttagattttattattatactttaagttttagggtacacgtgcacaacatgcaggtttgttacatatgtatacatgtgccatgttggtgtgctgcacccagcagaggattcttataggggtgcaaatcctattttgaactgcacaagcgagggatctaggttgtatacgtcttatgagaatctaactaatgcctgatgatctgaggtgcaacagtttcatcctgaaaccacgcctcctacccgtccg

SEQ ID NO: 6309 - DNA, 1052 bp, Homo sapiens
attcctgacacttaacacatatgaatctttttcattcatgtttaataattttatttgagagtcacttcaagtaaagcccaaactgtgttaacatttgagttaagcaaagacatctttgcttaacaataaagcaaatatcacaataaagcaagtcacatgaatattttggtttctgaattcatataaaagttatgtttacactatatggtactctcaagtgtgtggtagcattacatctttaaaaataaacatactttaattaaaaatactttgttgctaaaaaatgctagtgatcatctgagcctttagcgagtaataatctttttgctgttggagggtcttgcaccagtgttgatggctgctgactgctcagagtggtggcttctgaaggttggggtagctgtgacgatttcttaaaataagacagcaatgaagtttgccacatcaattgactcttctttcataaaagatttctctgtagcatacaatgttgtttgatagcatttacctacagtagaacttctttgaaattggagtcagccctctctaactctgttgttgctttaacagttatgtttatgcagtattctgaatttttcgttgtcatttcaacagcattcatagcgtgttcaccaggagtagattccatgtcaagaaaccactctctgtgttcatctataagaagcaatttctcatccattcaagttttatcatgtgattgcagcaattcagtcctatcttcaggcttcacttctaatactagttctcttgctatttccatcacatgtgcattgacttcttccactgaagtcttgaagccctcaaagtcatccatgagggttggaatccacttattccaaactcctattaatgttaatattttgaccacctcacatgaatcgtgaatgttcttttttttttaaacagggttttactcctgtcactcaggcagggaagtgcagtaacaatcactgcacattgcagtctcaatctcccaggcaagctcaagcaatcctcccacctcatcatttattttatttttgtagagacga

SEQ ID NO: 6310 - DNA, 1074 bp, Homo sapiens
aaagcgctgggattgcaggtgtgagccaccatgcccagcccatgaatgttcttaatgacaactggaatgatgaattattttcaggaggttttcaatttactctgcccaaacccatcagatgagtcactatggcagctatagccttatgaaatatattacttaaataagatttgaaagtcaaaattactcattgatccatgggctgcagaatgaatgttgttttagcagccgtgaaaacaacattcatcttcttatacgtctccatcagagcccttgggttaccagatgcattgttaatgagcagtaatattttaaagggaatctttttttctgagcagtagatctcaacagtgggcttaaaatattcagtataccagctgggcacagtggcttatgcctgtaatcccagcactttaggaggccaaggcgggaggatcacctgaggtcaggaattcgagaccagcctggtcgacatggtgaaaccacatctctactaataatacaaaaatgagctgggcatggtggtgcacacctgtaatcccagctactcaggaggctgaagcaggagaattgcttgaaccctggaggcggaggttgcggtgagccaagattgcgccattgcactccagcctgggtgacaagagtgaaactgtccccaaaaaaaaaaaaattcagcataccatactcaaacaggtatgtgttcatccaggctttgttatttcatttatagaacacaggcagagcagatttaacataactcttaagggctctaggatttttagaatggtaaatgagcattgacttcaactgaaagtcaccagctgcattagcccctaaaaaaaaaagagtcgtcctatcctttgaagcttcgaagccaagcatttacttctttttagctgtaaaagtcttcaatagcatcttctgccagtagaagactcttttgtctatgttgaaaacctgttgttcagtgcagccaccttcatcaatgatgttggcaagatctgggtaactcttcagcacctgctattttaccttgcacttttatgatatggagattgcttctttctttcaacc

SEQ ID NO: 6311 - DNA, 1050 bp, Homo sapiens
gagaacttgcctgtttgttgtgagaggtcaaactttcagcctgtctcacctttcgatatgccttcctcactaaactcaatcatttctagcttttgacttaaagtgagagacatgcaactcctcctttcacttgaacacttagagaccactgtaggattattaattggcctaatgtcactattgttgtgtctcaagaaatagggaggccttaggagaggtagagagatggggtaatggccagctggtagagcagtgaaaacacagcatttatcagttaagttcaccatcttctatgggtgtggtttgtggcatcccaaaacaattacaataataatatcatagatcagtgatcactataaaagatataaaagtttgaaatattgaaagaattaccaaaatatgacagagatccaagcgagcacattctgttggaaaataatgacaccatactcaaggcaggcttgccataaaccttcgatttgtaaaaaaaaataataaaaaggtatctgtgaagtgcaataaaataaggtatgcttataccaaaacagacttaattatgctatttcttaccattagtgttagagttcagtttctaatgtttttcattttccatatgttattgatgttcagtgagttacacaaattatttactgttgttacttccaccttagtagggagaatctttgatttttgctggataaattttcaaacaagagtgtgattataggctggacgtggtggctcacgcctgtaatcccagcattttgggaggccgaggtgggcagatcacttgaggtcaggagttggagaccagcctggccaacatggtgaaaccccctctctactaaaaatacaaaaattagccgggcgtggtggcgcatgcctgtaatcccagcacttgagaagctgaggcaggagaatggcttgaacctgggaggcagaggttgcactcctgcctaggtgacagagtgagactccatctcaaaaaaaaagaaaagaaagaaaagtgtgattacagagatcctatttgtgtttatttttaatttctct

SEQ ID NO: 6312 - DNA, 1094 bp, Homo sapiens
tgagaatttgtttttataaaaataaagtggggaatcagactcaaggtgaaatgttgtagacttagtgccagcaataagcagaattatttaaaatcattcaaatatctttaattcccttgttgtctttttcaaaaactgtacattttaactacattaatataacggaagactttttaaggcttagttttcctttatagatattccctaatttcatttttatttcagtctgtcagggttgtgaatgtgatgttttaaggtacactgtagtgttttcacatcctcagatgaactgaattgggacaatactttgtaggaagttttttaatatagtatgtagacacattggtaaaaatcagtatgtccactggcttattagtttcacagatgcttccataattcttagtgtactcttgggtattttaaattatcatttcctgacagcaatcctgaaacatgccagtcttttaaagccttatttctgagaactaaagcaaggcatcagcgaaccatatctgacatgccatgttaatttccataactatcatttctgggaggtggtaggatttctaaggcatggagaatctcagtaaatctactttaaaaaaaaaaaaagcaaaatatctgttttattactgggtttccattcacgagccctgactgcttcattcccacttaaataatttcaaaaatagtgataagcatattttttctcttatagattattaaatatttactcacgtgcacaatatatcaaaacatattttgaattctatattcttagtgttgggtgttcatgttgtgaatgaaaacctcattctgttatctcatagcatatttatatatacaaataatttttgccttaagtaggaaagaaacagctaaaagatacataggttattttgctttttaaaattttagcaaactattctgtgaatcttttgtgtgtttggggctgtttgtagaggaaaatttcatcaagcaacattttgggaacattggccttttgtactctttcctaaataaacagaaacttgtactccccaaaataaaatgtttctttgtatattgttacctgcaagttattgataatggaa

SEQ ID NO: 6313 - DNA, 1051 bp, Homo sapiens
agctgcagcagcccaggcggcaacagcagtgccatttttcacaaagaaaatgttgaacaggagccaaatgtttggtggcagtctgttgctaggaaatcaaggtcctgaggcgattaatgacaaagcaagcaataacaagaaggcagaattacagatttaaaagagaaaaaagtggttggtgttataattacccaaagaaatccgcactcattaaattggctgtttttatgattgactttaattggaggttagctcagatatttagctcctttcccacccctttaaacacacacaggcacataatctgtagaactgcagacttgtttttctaagcattgagaggagcttgccctgtaatttgatccccactgacagatgcattttctatgctgccattttgaattaacctattgtagaacaattttcttcagccctgttgaataaaacatccagtctgattacctccgatggatttgatagagtaaaagaatgtacttctcattgaagtagattgtttgcatggactctactgattgtgaactctgccagtaagcacaatcatttgtaataaattttcaaagaaatttgtgaggaaaaggtaatgagagtcacccttttatagtttaatgtttggcacctccatcaaaataatataattcttataagacagtgttatttttccagtaagcttttcacgtggttttagaaaaaatttctgaatcttcatttggactattcatatatttaggaatagagtcttgtatttacactctaaaatgaccattcttcctccccaacaacagtattttagtgcaagactcaatatgcaaagcactctattgcaaaaatatttttggtatgtacaatatttaaagtgattttaagattggcctatttcagtctttgaagtatttcccccccccaaaaatcccttatttaaattttttagggtgtgataaagcatattactagaaaagcatcaatcggtctttcaggtacaataccagaggaaccatcacagtttatttacctttcagaagctttaaaaata

SEQ ID NO: 6314 - DNA, 1025 bp, Homo sapiens
cttttaagtagtaactctccctacagtttaactgttaaacagtaactcttctgacagttttaggttttattctgtgaagactcatgatttttaatttttgcatcttaatttttcagttatttcaggtattgaaattacaaacgacgggaaagaaaagtggttgactaaaaaggggatacaaaaggcaatttttagggcgatgtactgttctgtatggtactgtggtggtggatacatgatactatgcatttgttaaagcccaaagaactgtacatcacaaagggttaattttaatgtatgcaggttttttaaatgttagggatttcaggatagaatgcaagctgtaacaaatgaatctaattgtattacaaatgtatggcataacttcactgaatgggtgggggaaaaggagctgacctaagtaactttggaaaatggtgttttgattggacaatgtaaagctaaagactaaggaacactatagaaacactctattctagttggtaaatttgtttctcataacggtatgggtgaacagttctgaacctctttacatgtatcctggggttgaacaaataagtaaatggatgatgaatggtggaagctaggtttctcactgtcaggaagggatgttacagataaataaacaagaggggagagccagaatgaaacctgtggtactggattagagttggagatataagtatttactcatgtttagcttaatatatgcagatggatagatgcagaaataattatagatgcatgtgtatatgtggattagtatacatgcatatgtttcctagctgtgtttactgagaaggcctagaagcagtgatatcccagtagccacaaacacatctaacgctcacatcctggtttgtaaatcctattctccaataaaaggatccaggactccttttaaatatgactgattctggggctggtgatgggaaaatacaacataagcatggaatatcttgtagtgccagaaggcaagagatttcttaaaaataataaagatt

SEQ ID NO: 6315 - DNA, 1108 bp, Homo sapiens
aaaatgtggattggtatttccaaaattacttttcttataaaggttaaagcagaggggacttccttataccagctaaaactggtctgtttggggatctggctattatctgtttctcctgatttcttggaaagtaagataaacaactatgttttagcttagtgatgtggaacttcagcttgagtgactccattttggtttggtctggtgggcctagtgcaggagcttagtccaaactaatgggatcctatacattttgtttaacactgccaacatcctggtgcacgatcatcagatttctcattgaacagggaatggatgactttgaatgttggagagcacctgtggtgagttgtttatatataatctgtaaactagttatgcacagtagcactatatatgggtctatgttggactagaggataaaaaataacttggccttcacctcagagagtttaagaatcactatgccaccagaaagatggtagtagtaggcacattacatcgagtgaagactgttgggtgagagggaaggtttgcttaaagatataagagatttgagtttgtatattgtctaaggaagatatgatagaacagaagactgataatgcagtgtggaagagtgataactgctagatggaattgagatcaaaggtttatagatgaagactttatccttggaaaaatacatttacatttatttaatgtttagtttttaaattagatattatgtaacttgagcctcacagtaatccaatgaattaggtgacatatggttggtataattcatccgcctttacatttaagaaaattgagacacaaaaaatgttgtgtgttatccacagtcatgtggttagtaaatggggagatattttcatgcccagttctatgctataactactattatgtctgaaaataaaggcagaaaaaaatacttgaagaaaaaatggcaaaaaaccgcccaaatttattgaaaaacatttgtttatacatctaggaagctctttgaacaccaagtacaataaatgcaaagagatgcacacctggcctcataatagcaaaatcttgactatttgacaaggacaaaaggaaaatcttaaactcagcaaat

SEQ ID NO: 6316 - DNA, 1051 bp, Homo sapiens
cacatatgttaacgtgaagttatagattatttatatctccagggcttgcttcgtgtctttgatttcgtagttcagattgcccagttattagtacttagaattcaaaagaataagataaaaaatttttacttaatacattcatttctgcatcacaataaagagttttcatggaaattatccagataatttcatagtagaataatatatgaaatgaaatcttttcttttttatggtagttgataattaatagtaaatctattcagtttatctctaagaagtcagattatgggagacttgtctctatttttctctatttaattttcccaaaaaaattcataaggaaaatattaattttcatttaaatctctatattaaacattaagtgatctttttatgccttggaatcacaatgaatataaatgttatttttattgtagttgattttgcagtttcaattcatttctattaaatattttaataaacatttttatgaaactaggtagaggtcacaaatctcattagtcactgacagccaattctcaaacccaggtcttttcctgtataccacatttcctcattagttctcactacactgtatggctatttccgcctcttaactttttatattttattacactcttaaagtacaactgtacttctcttctcaagtgcccttttctattcagtaagggtcccaggtgagcaatgattctgactggggaagagggagaagatggtgttgtagcaagtagtattaaaaggcccttaggaaggtagatagatgtataattttgtctctttcttctcactgttttcgtaaagacaaaggctatgccttaacttttttgccattcttatttttgagactacccattagggattgtttttgatgttgttgagatgaagtatttggtgaagccaaaacctccttgacttttatagttttaataagtttgtgctctccaaaccttcataaagtaatgtctagtgatcctttcagatatggcatgctgtcatgtcagctttaaataattgttaatggcatgatttt

SEQ ID NO: 6317 - DNA, 1051 bp, Homo sapiens
tgtttgttttggggggcagattttgtttgtttgttttcatttttttgagatagggtctcactctgccacccaggctggaagacagtgatgtgatcatggctcaccgcaaccttgaactactgggctcaggtgattctcccacttcaacctcctgagtagctgggactgcaggtgtgcaccaccatgcctaatataaatatatatatatacacacacatacatatacacacagacacacacacacacacacacacacatatagagagagagccactgtgcctggcctaaatagttttattttgaaataattttagatttatagaaatgttctaagatagtaaaaataagttccatgtactcttcacctagcttctcctaatattaacaccttaaataactgtaggatcttcatcaaagctaaattaacattggtacaataccattaactaaactacaggtttattttcccagtttcttaagtaatgtcctttttctgttccaggatctgttggaggatactacttgacatttcattgtcatgttgctctgtcttgccttctcttttgtggccttgacacttatgaagagtagaggtcagatagtttgtaggatatctttcaatttgagtttatctgttgtttccttgtaattagactgaaattatggggttttgagaataccaccactgaggtgattttgctttcccaatgtatcacatcaaggtgtacgtagtatcaatctgttactgttagtgtgaaccttgaacatcaagttaaggtggtgtccattgggtttctccattgtctatttgttcctttccatatacagttcattagaaatgaatcactaaatccaccccacacttgggggtgggggggtaaatacaaaatgaatagtgtttagaaacctcatagaggaaggatatagccaccacagtaattaataaatattagtggagagatattatgaaattatgcaaatattctagttttttaaagttttacccactgatttatagcatttattagtggatattgcctataccaattac

SEQ ID NO: 6318 - DNA, 1032 bp, Homo sapiens
acagagaggacagagacagatgccttcatttccataaggaaatggttgattattcaataaatggtgctgcgataattattttttcataacaaaaaagtgaaatcaaatttctgttttatactatacacaaaaatcaatttcaggtgaattatagatctaaatatgaaggtaaaatgacagagcttttggaaggtaacttttgagaatatctgtatgatctcggggtgtggaaaaatttcttaagcaggacacaaaagcataaaggcaaagactaataagttgtaccacattaaaattaagagcctttgtttatcaataggtacctttaaaagattaaaaggcaagccactgagtaggagaagacatgtgtgacacaaataacccagaaagaattaatatccataatatattttcaaaattttagtaatcaatatggaaaagacaacacagaagaaaaatagtcaaaagataccaacaggaaatttaccttagaagaaaatcacatgtgtattgaaggaatgaaaaattgttctacctcatcattaattagggaaatgcattagccgggcatggtggcacatgcctgtattcccagcaattcaggaggctgagacgggagtattgcttgagcccaggatgtcaaggttgcagtgtggtatgatcttaccactgcactccagcctgggtgacagagtgagaccctgtctcaaaataaataaataaataaataaataaataaataaataaataaataatcctttgaaaaataagggaaattcaaatgtaatccacaatgaggtatcattttataccagttgataaaaattttaaagtctaaaaatttcaaatgctgcataaaattagaattactgactcttacacacttgaagatacaaattccctactatccccagaaaatgttattgcttttagacactaattatatccaatatctagaacttagtctaataaactatgaacaaggcctctaccaagaacacttaaaacataattgtgagaacttaaaatgta

SEQ ID NO: 6319 - DNA, 1033 bp, Homo sapiens
gtcttgtaaacactgattatgatagtgttttgaaaaattaaaagcctccaaaatcactaatttttaaaaaataatgcagttaaatatagaaaaggattagccatagatattttgtagttaaccctattatcattaacctaagtgaatagaacctaatttttgtacttgctaataattgctattaagaattttgttaatcgtgtgtggattggtgcttgagttcagaatgaatgattgataggggacaactctaagaaatacagcacttacattaatgttttattaaacagaaaaagctttaatgttttattaaacagattttaagagttacagtcttaaaatctttattatttattttatgaaatatttcattttgttttttttctgggcactttaaaattgagatgaggatggtagaatttgccagtttattttttggctattttttttttaacccatcttattttgagaacgaatttagtaatatttttctcaacatcctgaaattgtgtaacctgtagaaacttcccactgtctttttaaacttattcttaaataccacatttaatataggataaataagtcacaaagcttgcttatcaaaacagaatattgtattcagctttccatcggagcttttggggaagacatcacagtattgtactgtctcccaagatgcaaagtatcaggctttaaataatgaaaataagggaaatgccaatagaaaattagaaaaaatgttagaacagttaaaaacagcatactgaagcctgcattatttggcttatctaaaaatcatatgttttcaaccaatcagtacttatagtcattctatttaatcttttaagaaggagacataatccaccctcaccaagtgattcagtgtagcatcctaactaataatgacttaatgtgtgtccaaatggcatgtaatgagaagtatgaaacattgtctgtatactttcttgcctaagatacttaactgagtctaatcataaagttcagacatatcttcactgtggaacatttctac

SEQ ID NO: 6320 - DNA, 1049 bp, Homo sapiens
ttaaaccaatttatattttctgcagttaaaatagaatgcacagatttttaaagacctaggacacattattatatctagttcctgaaatcattaaatgtccatggggaagaaaaaaacttgtgtaagtaggaataatataattggatttgcaatgctctcttaagagattctttaaaatcatgtgaaataagtagagtttctatgattttttaaaaatcacaaatagcatatatccgttttatctttaatagtgtttgagcccatcatttgaaagcattggagcatgtaaccaatatttctgaaaatgaaccatggttccagtcataatctatatgctttaaaattccttccctttattctttcttcccaaatccatgacatctgaatttcaataaggaagaaaataagcatgtttttaaaatgttttagaaaagattttcaaaattagattaaaatgtttgaggaaataaaaacttctttatgtattcattgtgatactgatttttatcaatgtctttttgtaaaaatacctatatactaactttgaataggtccaacatatggtaatgtgttatgcaattaatgataatgtagaacgatgttaaacccacagaatattgccaaggatttaccaacaaccaaaaatgtaattatatagaagaaaagtgtagttacaaatgcagtcttttgtctttttacattctctatatgtagagggtaacagaaatactgtatcactttttagtatatgttctcccagaataagttgccacaattagaacagagtttaggagcctatattaagctttactagttatggttatttccatagtgctagtaaataagagaaaaaaactttttgaacccatgtctcattgtaggtctcctaaaggaaagtggcccaaagtccaaatacttcaataccgttcgtctctgcctgataacaaagtgttttgtttttgtttttaccctcggacaagccagtcagctgatctttgtcctaatttgttcctggtagaattgaacaagatgtttgcagaagcttcctc

SEQ ID NO: 6321 - DNA, 1151 bp, Homo sapiens
tcccccagcccacaacaggccttgtgtgtgttgttccccttcctgtgtccatgtgttctcattgttcaattcccacctatgagtgagaacatgtacactattcacaatagcaaagacttggaaccaacccaaatgtccaacaatgatagactggattaagaaaatgtggcacatatacaccatggaatactatgcagccataaaaaatgatgtgttcatgtcctttgtagggacatggatgaagctggaaaccatcattctcagtaaactatcacaaggacaaaaaactctacattttatgcttggactatcagaaaaactgtttacttgaaaacagtttacagaaaaactctttaccctgacatgtattgatttgttgctttgtgttttttgagacagggtcccactctgtcacccaggctggattgcagtggtatgatcatagctcactgcaacctcaaactctggggctcaagcaatcctcctacctcagcctccctagtagttgggactacaggcgtgtgccatcacacctggctaaattctgagttgttttttatattgaagccttaatctttcattgaggaataccacaataaacagactgagcttgctgttgagaagttgttgaggacaacatagtcttctgtattaatgtttaacatattaaagaccctatgaaaagtttattttagaatcacgtgtttcttataagaaagtgacatttttggccgggcacaatggctcacgcctgtaatcccagcactttgggaggccgaggcgggtggatcacgaggtcaggagatcgagaccatcctggctgaagcggtgaaaccccatctctactaaaaatacaaaaaattagccaggcgtggtggcgggcgcctgtagtcccagctgctcaggaggctgaggcaggagaatggcgtgaacccgggaggcggagcttgcagtgagcagagatcgcgccactgcactccagcctgggcgacagagcgagactccatctcaaaaaaaaaaaagtgacatttttatctcttcaagcatgaaaagtagataactaggcatgtcttactttttgctttcactgtcaagaaattggaaacaaattcagagctaattcaagacgcctctgccatgtatttcttttt

SEQ ID NO: 6322 - DNA, 1445 bp, Homo sapiens
gattgatcctgagactgttgaatgggctgatgaaaagaatgtgtattctgccactgttggctgaaatgttctataaatatctgttgtatttagtctatggtgcagtttaactctgatgtttctttgttgactttttgtctacataatctgcccagtgttgagagtgggatgttgaagtccccaactgttatttcactttagatctaataatatttgctttacatatctgggtgcttcagtattgggtgcatatatatttacagttgttatattctcttgttggatcaatccttttataattatatagtagccctctgtcttcttttacagcttttgacttgaagagtgttttacctcgtataattatagctattcctgtttgcttttagtttccatttgcactgaatattttttccatccacttccagtctgtgtgtgtatacaggtgatacaagtttcttgtagatagcatataattgggtcttgtttttttaaaatccattcagctagtatgtatcttttaaatgtggaacttaatctatttacaatcgtgttattattgataggtgaggacttactcctgtcattttattgattgttttctggtggtttgtatatcctttgttcattactttctctcagtgttatttttgcagttgaatggttttctctagtgaaaaggtttgattcctttctccttctcctttgtacagcagctctatcagtgtgttttatagtttcacatattttcatgatggtgattattgtttttcatttccacatgtaagacccccttgagcatttcttgcaaggccagactagtggtgatggattcccttagttttgctagtctgtgaaatattttatttgtcctttatttctgaaggttagctttgctgggcgtattcttgggctaataatttttttcttctagtactttgactatattatcctgtcctctcctggactataggatttctgctgagaaattcactgttagtctaatggggattcccttatatgacttgatgcttttatcttgctgcttttagaattctttctttgtctttgacttttgacaatttaactgtaatgtgccttgcagaggtcctgtttgaggtgaatatatttgagctttctcgacttggatgtctctctgtctttctgttattatttcattaaatatgtttttctcacctttcccttcaccttctggagatatttatttgcttaatggtatcccataaatcctttaggctttttcattctctttttttttttaaagttagtctgcctgtgttatttcaaaagatcattcttcaagttcagaaattcttcttcttggtctagtctgttgtttagctctttattgtattttttatttcattcattaaattcttcagctctaggatttctgcttcattcttttttatgatatctgtctt

SEQ ID NO: 6323 - DNA, 1096 bp, Homo sapiens
aggtgaaactggtatgtccatgatccttatcagaagtgtcatgatcgaacaaacctgaaagtatagatcagaagtttcacttgtttctcagttattgaatatgtatctttgtgtacatatctgcaaaaatggataagtaaaaatctcgatgtaaattgtatcaatgaatatgtaaacatacagtgacaacactgaacttataaaagttttaaaacttaaaaaaaaagctcaaatttgtaaaagacatgtaaaaagaaggtggaaaatgtatttagaatcagggaatgatgctaaaagtttggtagagacaaaagagaaaagaaagtcccaaaagtggtttaagtttgcagcagatgctgatgatatcaaaacaatcttcacttaaaaaaaaaaaaaagactccaaagtacaagcaacaaatggaaaaaatagataaattagacatcatcaaaattaacaatttttgggcatcgaaggacactaacaagaatgtgaaaagacaactagtggaatgggagttaatatttgcaaatcatatatctgataaaggattcatattcagaatatttaacacagtaacaactcaacaataagcaaactaacaacataattcaataatgatcaaaggaatttaataaacatttattcgaagaagatatacagatggccagtaaacacatgaaaagatgctcaacataaccattcaagaagtgcaaatcaaaaccaaaattagataccacttcacacccatcagaatgacaattgttttaaaaaatggaaattaacaagtattggtgaagatgtggagaaattggaaacacttgtgtattgctggtgggaatgtaaaatgggaatgtagaagacaatttggtggttcctcaaaatgttaaacatagaattattaccatatgatctagcagttctacttctaggtatattacccaaaataactgaaagcagggactcagataattgtacaccaatgtccatagcagcattattcacaatagctaagatagaagcaaatcaaatattcatcaacagatgaataaacaaaatttcatgtatatatacaatggagtattatttagcctta

SEQ ID NO: 6324 - DNA, 1017 bp, Homo sapiens
gggaggctaaggtgggaggatcgcttgcacctgggaggttgaggctgcagtgagctacgatcatgcaactgcactccggtctgggtaacagagtaagaccctgtctaaaaataaaatttttaagaaagtaaaatgagaattcataaactatgaattctagatgtggttctacaagaaaaactctagaatgtcagtctgtaggcatgctcaaaggttttgaccctatttttttttttttttttttgagacagagtcttgctcttattgcctaggctggagtgcagtggcaccatcacagctcactgcaacctccacttcccaggttcaagcaattctcgtgtctcagcttcccgagtagctgagactacaggcgtgcacaaccatgcctggctaatttttgtatttttagtagagatggggttttgccatgttggccaggctgattttgaactcctggcctcaagtgattttgaactgcccacctctgcctcccaaagtgctgagattacaggtgtgagccccccacccagctgaccctattttaaatattagcaaatgatgtatctttatatattaaaataaaatgtttagattatgaaagctattttttgttcccttaatttaatcatcactctgatttatttatcaactactattccttttcctcatctgtaaattgaggggatttgcatagaaatactagataatcttttaaattttttcttaaagcttaaacatgttataaaactgatgattcattttttttccacattctaagattaatactgttagattttattataaattaataaagttcctcttttaacatgtaaaataatgcctgacatttcttttaggtagttctgattttttattatgagtgtagccttaactgtagtgcctttgaagctgaattctccccatttgtgaccccagtattccttttttgtttagtgaacctaggggaaatgatatttctctccaaaaaatacctgaaaatatttggttagacacgtg

SEQ ID NO: 6325 - DNA, 1033 bp, Homo sapiens
atgtcattttattcacaacactcaattccaggaaggaaaaaatgggtctgtttttgtaaaggacatattatgtgagtatcattcattgtaaaccaaaaatgatactgtattatagcatagacaacaatgagaactgattctgaaaatgtgacctgactgagaaactgagtaatagtgaaagttatcaaaatggaaaaaaagcgttaatgtgaaatccagccttctcagaaatactctttcctggcctgtttagttttgcttttgttgcttgtcatgcatgaatgaaagtgctgtactctcaggggagcaggaaagcctctgtgtcggttgtttatttccttaatccctcctcctttgtgatttttgatgtcagatctaaaatggaaagcctgtaaatataatgattatcacacggataatcacctgcattaggaaccgccctgcttttctattctaacccgagctgttctccacatgtcacatccactctgtggttggattttaacctgactgcttcattagatttgtgaaactcagtacgaggcgccctggggcagcacagatggggacttgcttgttttcttttctcacttttactgcaaaggcacactaaaaagtccttttcaatttagtgcgatcagttcacttggaattatctctgatatttggaacctgtcttgctcttctgcccaccaactatgcctattctttcttccttactttctgacctaatgtcttttctttctgcctctgcatgtcatgaatctgacaactaaaattctgcttacaattcttactgggtcaaactgttcccccgtgttgttttgtttgttttgctgacagggaaaaataaatgttgttccatcattgtacctacaaacaccttcagatcagaggttagctgtgggaaagtctgcagtgatatgagccagctgccttctctaatggagtgacttggggcaccagtccaagatcagaggaaggtgggaggaagtcagaagataagatcattttaagccacagaacaacaagc

SEQ ID NO: 6326 - DNA, 1050 bp, Homo sapiens
tccattataaagttatgctttgctcccgtgaccagcatataatctgagatactttgattccatggaaatacccagttccctatcatcctttttacccaatgagtttaacatctactgaggatccttgcctgcataaatttcgttatgaggattgcaaaaagatgatttttctgaatttatacatttattagcaggcattcttctctacataagagctttttgagaggtattgttttaattaaaaacacaaccaccagcatattccttggattgtctttctttgctgaggtcagaacacctgaactcactgtggcagctacagtaaaaacatgtactacatcttctttattccaacttgtgaagtgtgttgacattaggctgcctttttttattattattattccaagggaaaaaagaaatctttattgctgtaagaataaaaattgaactatgtgggtatattgagataattgtgtaaagaagaagactgaatgagtttcaaaaaatggattatttcttcattaccgagcactttataattaactgttcttttttttttttatttcaggaagctgccacttttgctagagagcaaggctttgaggtgagttaacccacaattgcacactaaacagatcctaaaggttttttctagctgataatgaagttcttttggacagtgattgatgtgctattatactctcagagcctcgcagcagttgccatggaaacttggcagtcgtcatggtttctttgttctgccagcacagtgttatgacgcactctgctaggtctgcacccaacatcgcctacagatgttatttattgaattttgaaaagcctcttgggaagccaagaggttgggcacggtttcaagctgcctctgcagatatggggcctgtcagtttgttcagttaaaaagctacctcattagctgcattacatttcataaggattcactgctaaagcagtggtggaacaagactaaataatgaaatataatgtcgtttaaataatttcagccctatcacatgtagattatcattatgc

SEQ ID NO: 6327 - DNA, 1056 bp, Homo sapiens
tggatagaaagtctacagagaatgtattcaggcagtgttgattaccaaagaattaccttaggtgacttttaggttcctgtgttcttcacaaatataaatagtgcaatgaatgatcactcagagtttcagagtttctgaaaataagaccctaaatcaggccctgctggctaagagagtgcagtgttgtttttgtaggtgcctgaaccccaaaagaggacaattttagaacagttcagttaagggaaagcaataagctagtcttctaattctcttcatttaatcatttatttattcaacaaatatttactgagttcttactatgtacataccactttgatagaccccaagacaaggtggaagtgaccagagagtgtaccatgaaagagcatgtgggaagggttcccattttagctatgatggctatggaatgaccctaaaaatatgaatatctagcaatgacaaaaaaaaagcgacacaaacagcaaaacaaatttcaaacagagagaacaggactataaaagtctctgaacgagagagaacttaatgtactatgtactccaggaactgacagaaggccagtgtgactggaatggagttagtggggacagcatatgagatcaatctggcactgacacatcatataaacagcataactattaaaggagtttctatttggaaaacaaaacaaaatggtatggctagatgactcaatgtgtggaaacactacagttggttttctacagaactaggtagactgtgacaggattgcttaacctttgtataaccagctggttaaaaatagaataaagattttctttatccagtctatcattgatgggcatttgggttggttccaagcctttgctattgtgaatagtgctgcagcaaacatatatgggcatgtgtctttatatcagaatgatttataatcctatgggtatatatccagtaatggtattgctgggtcaaatggtatttcttgttctagatcctttaggaatccagttcatgttctttgcatggacatggatgaagctagaaactatcattctcagc

SEQ ID NO: 6328 - DNA, 1024 bp, Homo sapiens
ttttttctttggtggagactggattttgccatattgcccatgctagtctcaaactcctgagctcaagtaatctgccttcctaggcctccctcctaaaatgctaggattacgggtgtgagccaccacacctggcctaaattgtagacttttctgaacactcagaattcttatttgaattgtaatttttcacaaagggagaaaatatattaagtcagatgttttcaactggaagactggtgctatcacatcaaaatcacctagtgagtttttggtaaatacagtcctaccttttttttttttttttaattttagaattgggggagggtgtgatactttttcagggttgttacatggatatattacataaggctggggtttgggcttctattgaacccatcacccaaacagtgaatataatacccaataggtagtttttcaactcacccccacccacttcctgcctccccctttatgtccatgtatacccattgtttacctcccacttataagtgagattgtggagcatatggttttctgtttctgggttaattcactttggataatgtcctctggctgcatctatgctgctgcaaaggacattatttccttctttgttatggctgcatagtattacatggtgtatatgtaccacactttctttatccaatccgctgttgatggacacttaggttgattccatgactttgccattatgaatagtgctgtaataaacataagaatgcaggtatctttttgatagaacaatttcttttactttgggtagatacccagtagtggggttgttggattgaatggtaatcctgtttttagttctttgagaaagttccaaactgctttccacaggggccaaactaacttacattcccaccaacagtatgtgtttccttttctctgtatcctcgccaatgtgtaatttttttactttttaataatagctgtgctaactagtattatgatatctcattgtggttttaatttgcatttctctgattattagtgatgt

SEQ ID NO: 6329 - DNA, 1035 bp, Homo sapiens
acatcctaatgtcagtttattaatagaatacttatgttgccatctttagcacattctgtcaaatgtgaatcaagctacaaagtaatagcaatagataacttttatacagtacctactaaccaaccaatatcttaaacactttatatatatattaactaatttagtgttcacaaaaacttcttggggtagattatttttacccctattttactgatgaaaaaaacagagacaaagaaaggtgagataatgtgcccatagtctcatggctagagagtagcagagccaggattcaaacccagaaagtctggctccaaagtcagtgcttttactcaccacactaatactgcttctctaaacatttatgtaaatctcaccattagaactgagaaccacagaccagccttcctgacaaaagctggttttgccagagaatcttcctgttatctgagtagatgacttactttattgaaaaggatctgttgtaatctgacagggttctggggactctaaggtaagattgttgaggaaaagaaagaaaaactgaaagggaagagaatccaagaactgtagtccctggtgagtttcaaccaagagctttttgctaagcagtagaatcgattgcactacagagatacagaaagccagatgataaacttgcttggttagcatgggctccaaataagagagttatatgaatcagctgtttaatagtgaagcaggatatttccctaagcccttctcaggcagaaattgcagtgtgtgggcgcaggaactagccagccactttggtgccagcaggagcgaacttcactcactcgcttctccactgctcacaggagggtgagcacacgtgagcaggtgcaggagctgggctgagcgcttttgggcactggtaagagcgaactccataccagaccagtggcagcatctaagggaagctgcccgtgacccctggatccccagaggaagcgttacagtgcccttttagctttgctgtctgtagacagcttaagcattaacagctcagttgagtga

SEQ ID NO: 6330 - DNA, 1050 bp, Homo sapiens
tctacaagcatcgctccttgttctatttggaggtcttaagcactttgtgatatttgttctttatttgtcactgcccagccctgatagaactaatcttttcacattcttcctcaaaagcccaagtgctaggattgtactcttggaaatggatacaattctataatctctaagtatgatttcctaatttcctaggtcaggaaaaaatttcttcctgttgtcctgctgtgctttgtcacagcaggtctaccttttcatttggaaccctctttgtcactgccatagtaacaaatggaaacattgagaacattttgtgacaggcactgtcattgttcccagtgaaatctcttcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaattaaaaaaaaaaaaaaacaccttcattaagtatggttaaaagccacgtatagattagaagattttactttgttggttttttttgttttgttttcgtttttgttttgagatggagtcttgctctgtcgcccaggctggagtgcagtgacagaatctcggctcactacaacctctgcctttcaggttcaagtgattctcctgcctcagcctcccaaatagctagaattacaggcatccgccatcacgcctggctaatttttgtatttttagtagagatggagttttgccatgttggccaggctggtctcgaactcctgacctcaggtgatccacctgcctcagcctcccaaagtgctggatttacaggtatgagccactgcacctggccagaatattttatttggaatgataataaagtaac

SEQ ID NO: 6331 - DNA, 1049 bp, Homo sapiens
tgtttattgaattattcctgcaacttttctataggtttgaaattttttcaaaataaaacttttttgcccaggcatggtggctcacggctataatttcagtgctttgggaggctgaggtggaagtatcgcttgaggccaggaattggagaccagcctgggcaacatagagagatcccatctctacaaaaaatgaaaaaaaaaaaaagccagatgtgatggcatgtgcctgtggttccagctgctcaggaggctgaggcaggaggatcgcttgagcccaggaatacaaggctgcagtgagctatgatcatgccactgcactttagtctgagcagcagcaaaataaataaataaataaataaataaataaaataaaactttttaaaggtcaccgaggctgctgtgtggccaggggagctatagaggagcaagggtagaggagggcaagcctgggaggaggcctttgtgaggatggaggcatagactggggttttgacagtggggatggagagatgaggacagatctgaaatatgttttgaagaacatatttaacagaacttgctcatggattggaagagattttaggggagagagagggaggtagatgttccccacttggtgcaccctgatggttgcagactgaattccaatagaatcttctccccaaggtctttttattccctctctcttttcctcaattcagccactctatgagtagttaatacaggtatttatttcacagatgaggtgagactcagggagatgaaatgactcatttagagttatcaggtgcagacagaaattttactctacccagaaaaccaaaatataggcatgaaatcagtgttcttcaaactgaattgtctctcattaattgattgtgaaatcaacataatgagttcctatcagcattaaagaaaaaaaaaagagaaacagaataaaaatatagcatgccttgtgtaaaagggtaagtaatgtttcatgaaacttctattttagtttaatattcacatatgtgtatagtaggtcatgatgtgaacgtatttcttac

SEQ ID NO: 6332 - DNA, 1048 bp, Homo sapiens
tattctttggcggcaatgagaaaaaatgggtgtactttcatattctgagcatataaattgttcagacctttttggagaaggtagtttggctgtatctttgaaaataaaatcacatacttttaatttggtaattttgtgtctagtgaaatacacctgaacacatgctcattccagcactggaatggtgaaatattggaatgattaaatgtacagtggtacagccagcatatagaatgcgatacctaaaaagtgtgtaagagtgtggtatagatctttatgcagctgatgtgggaggctctctcagatacgtttttagtgagaaaaaatataaaattattacatttatatttgtaaacctcaaaatttatatgtatttgtaaattctaaaacatgcttttcagattttttaacatttctgaaatcagcgtatctaacaattggtgacatagtttactaatttaaactcttggtgaagcatagtgcacattacaagtgataagatcttagatttgatgaaggatgatatgtaaatacgtggataaaggactctaagacagacatgggacgagattgaggaagtgtcagtggagactttgtctgtgtcatctatgttgtcaaattttttttacagtgaaattatattccattattgtgtaacgaaaaattttaaaaatacatatttatattttttagacaagatataattttagacaagataaggttgcctggatgtctctgatgtctgatccatttctctacttgggtgattatgcttgatattcagctttgagaactttaaggcctggatggttgatagagcgttcagcttcattaagaagttaagtagctgtgaagattcagtgggagagaattgagaactgaggtccaagagaagggaggagccgaactccagaattcagggccagttgcctcatggggacctttgcatctgtgtaaagaggttgaaattctctccccacaaggtggtgccaggctttttatactggactgggcataccctggagcaaggctcagtggatgggaggca

SEQ ID NO: 6333 - DNA, 1050 bp, Homo sapiens
tatttttatttatttttgttattattattttttaagaaacagggtcttgctctgttgctcaggctggagagcagtggcatgatcctggactcaaacaatcttcccacctcagctttctgagtagctaggactacatgcgtatgccaccatgcccacctaatttttaatttttttgtagagacagagttttactatattgtccagactggttttgacctcctgggctcaagggatcttcccaccttggcctcctaaagtgttaggattataggtgtgagttatcacagccaggtgcaataagtgtttatgattaatttaaaagcagatgctgtgcttttcaaaaattatgctcaattttttttttaatattacaaaggacttttagactggcttcctcctaaacatttcttcaactcctatcaagttcagtctgcaaatatcctaatttctaggttgtttgggaatgttaattgattgtctcatgtatgtatgtatgtatgtatgtatggatagacagatagatgaaggttgaaggatggatggatagattaaatggatggatggatagatagatagatagatagatagatagatagatagaaagatagatgaaggttgaagggtagggctggaggaggaattccagctttccagtagattttctatcaagcagtcattcatatatataacttcctatattgttagccaaagttcatccatgtctcttgtatttagctctctgtctgtattgtagaaagcttatttattatgtgagcattttgctttctcctatccctccctctttctttaacatcagttataacagctgtgaatacagtttataatatgagcagccatattcagtttttaggctttcaaaatcacaaatacaaaggaggatataatacatagtcctatattttatacaaattgggacacttttcttcatttcttatttcgtggcattgcctaactatagtcaagctaatgacccatgtagatgtagtgttgtacctggtgtccgtgtccctgtgaatgtgtcatgttgtg

SEQ ID NO: 6334 - DNA, 1044 bp, Homo sapiens
aattagctgggattacaggtgctcttcaccacgtctggctaatttttgtattatttagtagagacagggttttgccatgttggccaggctggtcttgaactcctgacctcacgtgatccgcccacctcagcctccaaaagtgctgggattacaggcgtgagccactgagcctggccaatttctttttttattgtgggataatcattccatacttctccctcctctctagtccccacccccacccccctttttccccccacaagtgaagatgatttcctgtgctggtctaggattagttttgttacagtctgtctttataagaacatttcttttccataatccagaagcattttgtaaaacctatgcctggaaattgagtcactttttattgcttagattttcttcacagaaaaacataggttctgttggatgagtatttgttgtgaaagcaaattattaaggggtgaaaattgtctatacaagttgatgtataggaggatatctgaactggattagttgctcttttatctgtgttttcaaagctctttaatagtaactcttataacacttataacagtgttatcactattgtttgggcatcattccattctgctagactgggaattcttttataatacagtgcctgataggcatccattcattccttgaaataatgtattgagtgctcattatgtgcttgaaatagagtgtgtgcaggagccagagcagtcggcagaacagatgcagcttgtgtcgcatgtgcgtacagcccatggcagggtggggggcaggggacccagcaaacaagatacagataactgcgcagtacagtgccaatatgcacaggaacagtgactgtcccctacctacataaatgcatagacctcatatgtgtattgtgaatcctctataattgttgaatttgactttgaaattaaacacttgatattttagactagtcaaaaatgggatatgttattattttaataaaaacaccattgtatccagccgggcacagtggctcacgcctataatcctagcact

SEQ ID NO: 6335 - DNA, 1045 bp, Homo sapiens
agagttttgccatgttggccaggctggtctcaaactcccgatctcaagtaatcctcctgtgttggcctcccaaagtgctgggattacaggcgtgagccaccacgcccggctgaaagcatgttcttgaatgtatatgtgtgttctctccccatgtgatttgtaaaccctccaaggcttgggtctcacattctcattctttgaatcttttatggcataatggatagagagtctgtgctcttgtccagttgaagtaagtagtgggcgctcaaaaaatgttgattggccaaaatatctacatcaagtacagtaacgactcatagctgctaacatcttttgagcaattaacatgcaccgtacactgtcttaagcactttatatatgtcacctcatgtaattcccacaacaactatagttatccccatttcacagatgtagaaactaaaacttagaggagtcagatacttggccaagatcacacgaccagaaaatgatagagctaggaaagtagagacaggaatcaaactcagtgagtctgattccagattctgcagccttgactcctttaccccatgcctggtggatcagtaacctttcagaaaatttttgtaacaagttctgaaaacatagatgaaataggaattttcccttaaactaaatggaaaactaaaaaagtaatcattagatggagcagatttctgctaaatgggaagtcttgggagggcctcattagaaaatgagggaatggggggccaagcatggtatcatctgctacccagtgagaaaaatatcgacttacgctgtgaacccttttattttatacatgtaccacctgaatgaggatggtatatttatgagctctcacatctcattgctgggtgacatcagggagctcttttttgggatagctgtccatctgttctcctccaggaactcctggatccgtgccactgccacttggctgctggcttcaaaagagcctgaatcagtgagttgcttacaccagggagaacaaacaggctcttctccttaaagtgtctgtaattat

SEQ ID NO: 6336 - DNA, 1033 bp, Homo sapiens
gagtttctagccagtgtaacaaggtatgaaaaagaaatgaaagtttgggaggaagaataataatgtctcttacagtattaagtattaatgataatactaatactatgtcttacagcatgcagattgagaggaagaactaatagtgtctctagttttagaccatatggtcatctatatcaaaaatcctaaggaatctttaagacagctgctaaaactagagaggatttagcagggtcctaggatacaaaatgattatttttaaagttgcatttctatatggtagcaatgaagattcagaacctgaaataacatttacaatagcatcaaatactatgaaaatatatacagataaagttagacaaaatataggcaaagcctgtaccccaaaaactgtaaagcattattgaaagaaattaaggcagccctaagtaaatggagaagtgtcccatgttcatagaagactgataatgttacaatgttagtacttcccaaactgatttatagagtcaaaacaagcccagtaaagatcccaaaaagctttttcctaaaaattgggacgttgatgaacaaatttgtgacaaaggatttgaaatagtttaaaaattttttgaaaaagaacaacaaagttgaaggactagttcagtgggaagaagaaaatctcaacaaatgatcctggaataactggttatacatatgggaaaaaaaatgaaccttgacccttatctcacctcatacacaaaaatatactaaaaatggtgtatagacatataaaaaactaaaactataaaactagaagaaaatgtaggataaaaccattgcaactttgggatagataaaaatttcttagattgaacacaaaaagtagaaaaatcgataaatggcactttatcaaaattagaaactgaagtttttccaaaagaaattggtaggaaaatggaaaggcaagccacaaactgggagaaaatattcacaacacttatatcttatgtgttatatacatacatacaaaggacctgtatccagtatatgtaag

SEQ ID NO: 6337 - DNA, 1080 bp, Homo sapiens
gatcaaaggtcttgaagactcttaaaatttctaaagtattatagaatcaataaaaattagaactgggaaagtccttagagattaactctagaaccgttaaaatatttgatctggaaggaacctttgaagagtcccagatccccaaattgtgtgaggtgaaattgtatactgttgtgtcctcagcatcctgatggggcccatccagtctctccatggcctcttgattataggggcctcttattgcctcaagaataatccattccacaaatactgtatgatttcacttatatgcgatagctagaataatcaaatgcatagagacagaaagtagaatggtgttttcctgggctgggggaagagaatatgggaaattattgtttaatggatacagagtttcagttttgcaagttgaaaagagttctggagataaatggtggtaatggttgcacagtattgtgaacttacttaatgccatttgaaccacaattaaaaaaataaaaactaagcaaatgaagcggaaaaaaaaaagaatccattccattgctggacagctgttggaaaggctctctatgatgactcctattggtgtaagttttgtactctgtaaccacaagaacgaatctaaccctttcacctggatgaagacacccagcgagtccaccccagtcttttaaagctaagtagcctttgttccttcactaggtcataatattttgttttgttttgcttatactttgtttgaatcatgatcaagatatggttcacacattgtgattggctgatacgccctttaaatgtctattaatctagcgattcttctgtatctattttttgctcgcctattcacttggtctcctgtttaatttgttgaagaaactgggccattttttccgtagtgttttggtactagcatctccccgctctatagattaacatattcctctgtcctctgtatttcctctgagtcggtaatgggcttgagagaccttgatttataaatgtttgtagtccaactactgtcatcctttggcatctgtgggggattgggtacaggacccctccctcacccctctaccacca

SEQ ID NO: 6338 - DNA, 1048 bp, Homo sapiens
gtgaagaaactgtataatcccatgaaagcaaaaacagtgctaataatgaaagtttggaaagtagaacgctaagtacctgttgtgaggttgtgggtggaaggtggccctgcccaagaggtaagtttatttgtacttcagagctcccataaaacagaaagtaccaagcatcactcaaggccaggtacagataggagctaaataggggaaagttggttaaaaatcttcttaagcctgggcaacatggtgaaaccctttctctacaaaaaatacaaaaattagccaggcatggtggagtgtgcctgtagtcccgggtattggggagtctgaggtgggaggatggcttgatcccaggaggtggaggttgcagttagccgcgattgcgccactgtactgcagcctgggccgcagagtgagaccctgtctcaaaaaaaaaatctacttaagcttttagacctgctctactctgacagaagactagtggtctgttctccagagcagttgaatatgaagcactgttgacttagggataccgtgtccagatgagaacagagctgccatgttttaaagaggattcattaaaagtctatataccaatcacagagacttctagctcccttccttaagtagccagacttatttctcatctcccctcctacccaaccccagccttccaagaagggtaagattcctttccttggaaaacctgaagaaaaacaatgtaaatagctggttgggatatccttttctaatcaaccagatctctgcgcaccctgagtgcgcagagaaacccaaagcttgacagagctcagtctatgcccacagaatgtctcatcttttttagtactttactgtcaaatatgaatggtcagtcaagaaaccagacgtctgagaaaaacataagcgcaaacagaaaaaaaaaagtaaattggaaaacaaaataaggagcagacgaacacttaaaaaaaaactttcgtgttttcaagagaaataagagatgttgcattctatgtgacagtaatgagaggcccaaagaaaattcagagaaaaa

SEQ ID NO: 6339 - DNA, 1037 bp, Homo sapiens
aaaatgttgccggccaggtgcagtggctcacgcctgtaatcccagcactttgggaggccaaggcgggtggatcacctgaggtcaggagttaaagacccagcgtggccaacatggtgcagtctactaaaaatacagaaaattacctggtcgtggtgacgggcacctgtaatcccaggtactcggaaggctgaggcatgagagtcacttgaacccaggaggcggaggttgcagtgagccaagatggcaccattgtactccagcctgggcaacaagagtgaatctgcatctcaaaacaaaacaaacaaacaaacaaaaagaaagttgcagtttgacgacatactcagcactctaaactttactctttctgagataaacaaaataatggctgacttttggttttcattttatattttgtggatttgttttggtgtactgtagacatctcttctcattaaacagaagaaattatgcagatgggaacaaaataagactgttaaaatcgcctgtactttatatacaaaattggctaaaatctgtatacaaatttgcaaagaattttgtccaaattatatacaaatttggacaaaagaactctacttttctaggcctctatgctttaattctgtgttctcacatattcaaataaatgtatgtgttaacacctttgtaattattttaatgttgtttgtaacagcattcacgttcacttcttgtactgcaatatcatagctgaaatgccaacaagggaagattaagcagccaaaggagatcaagagctaaaaatatacccctgagctgaagggtgacaaaactttctcctggtattaggaaggcttagactgaccagtaagaaagggggaagggttgatatgacacaggatttcatgtaaaggaaatgttttatttttaaggtaaaagctgttttgaggtctttttttctttttccaaaaaggaaaagtaattttttcaaattataaaattatatgtttattataaaaattcaaattatatagaaatgtatatattaaaaagtaaaa

SEQ ID NO: 6340 - DNA, 1058 bp, Homo sapiens
ttagacagtttctaagccagcaaaggtgtcaattttaatgccaacttgacagtttaacagttagtgtttgtaagcagtttagcctgaattatcccatactgctgtagaggagaattgttagtaacatcaaaggtcagaatgcttcaggtgactaataagaatggaaagagactgagtaggttttttgtttcttttccctgtctttgagtaactttgaatgactaaaattagtatgaaactaggttttggacccccttctcacctcacccggatgtaatgccaccaatttcaaataactaaaatgtgaccaattactttgcttcaagttctatacaaatatctctgaaatctgtaagccatatttcagctattctggtttttataatacattctaccctaaattaaccaaaggactttttattcagtgtattccatgtttcagcataaggaaagtttgtgcctgatatggcaggagaaagaacactatggtaatttcattgttacttcaggtctctttcaatctgaagaactgggttgtctggagaattgaacatagccaagcaatattatcaattagtaatgtcatcttaaaaatgttcacttttactaagttttattcagaggatctatgtattattagaaaaatgaagtatttctgacatggaacaaagaaagtggaaactggtacttaatgggggaagcaaaattagctgggactaaaacggacatgttttgttttgtgaattctacctaaatgtctctctatccacagagaaactagtattacttgaagatgtgaaagttcctgtggtagccataccttgaagcacagtgtttgtacataagtaaatatcttgattctaaattaaatccagatttaactaatatatattattttatatctttgttgtattaaaatgtttaaaaacactaaaaataaaacatttgaaagttggattacagtttcttattgaaatgtctttgcattattaatggagctggtcagttttttatataatgaattttagtttttgcaaatgattggccaggtgtggtgg

SEQ ID NO: 6341 - DNA, 1790 bp, Homo sapiens
acatgactgtgacagaggcaagataggatcatggttccatcatcattgtgtcagggaccttatcctatgggtaaatgggagccactgaagatccttgagcaggagtctctgcgttatccccactattggggctaagcattcccacagaatgtgctgagctttttttttttttttttgagatggagtttcactcttattgcccaggctggagagcaatggcgctatctcagctcactgcaacctctgcctcccaggttcaagtgattctcctgcctcagcctcctgagtagctgggattataggtgtgcgccaccacggcccgctaatttttatatttttagtagagatggggtttcaccatgttggtcaagctggtttcgaactcctgacctcgtgatccgcctgcctcggcctcccagagtgctgggattataggcgtgagccactgcgcccagctgtgctgagctttttaaagaaacaaaacagtgtttcaccagtgttccaaccagaactctgagcaaggccacaggttactgactgaacaatgaataggaaagcctttttttttctcttttttgagacagggtctcactctgtcacccaggctggagtgcagtggcgcgacctcagctcactgcaaccttcgcctcctgggctcaagcgaccctcccacctcagcctcccaagtacctgggagcacaggtgtgtgccaccacacccagctaattattttgtattttttggtagagatggagttttgccatgttgcccaggctggcctcaaactcctgaggtcaagtgatctgcccgcctcagcatcccaaagttttggaattacaggcatgagccactgagcctggctggaaagtccctttttttttttttcttttttaattgagaccgagtctggctcttgttgcccaggctggagtgcagtggcatgatcttggctcacttggctcacgatcttggaggatcaacctccacctcctgggttcaagcaattctcctgcctcagcctcccaagtagctgggattacaggcatgcgccaccacgcccagctaatttttgtattttcagtagagatggggtttcaccatgttggtcagactgctctcgaacccctgacctcaagtgatctgcccacctcggcttcccaaagtgctggtattacaggcgtgagccaccgcacccggcgggaaagtccttttatatcaaactttatatcaactctgaatggttaaactgggatatcagttgagaggagctgcatgaagcttgtacttaacttgtgtcctgactgttgagctataactccattatctgctttaataatcacattgtatattaaagactaaatcgggcagattaaccctgaatgtgatctggaaagccgcagaatgctcctcctttctcccagtcactcctaggatttgatagacagtctagatcagtggttttcatgttttagtgtggctaaaaatggcagcccgaggttgtatacccaaaaccaggcacactgtcctttatgcatgatttaatggattttcacaggcactggcttgacttttgagcccactgaaccctagcatgccccgcacctctggccgttggccctaactccccaaaatatgagttcatctgttcatttctgctcttcctagttttatcccagtcttgtctgcacttccttctccttggtttgaacttctactgttgccctcctcaccccatcccattgtgcccctctagaagcctgtgctgttgttaacaaactaccctaagttct

SEQ ID NO: 6342 - DNA, 1044 bp, Homo sapiens
aggacgtatcagggtaaagggcctagtcttaggtttcggttttatctaatttagttaaatcagctcatctcagtgaattttggcagatacataaatatccatacacacaaatacttgtttgattctttgtacttgtccagtcctaggaagtgaggctgtaggtaatagactgtttttccgttttgaaacgaattccccaagtttgtataatcatggttatctgttttagaaataattcgttggtggtatctcctttatgggtcgttatagttctattgtagctcctgaccgcataaaaaacattccaacaaatgggattgcttgaattttaatatcagcagtgggtcatgctcttgttcttggatagaaggtgggagaatagagacattaacactggaatgttttttttctaccagcaatgtgtattcctccatcatatgctgaccttggcaaagctgccagagatattttcaacaaaggatttggtaagaaccttatttttaaaacgttttagataaagagtgaaaatgtatgtttgggttgcttagcgaaatcagatcaatcattgcaaattgtaaatatcttgctgctttaaatttagagttacttatttttttgagacagggtctccctctgttgcccaggctggatgcagtggcatgattatacctcactgcagcctggacctcctgggctcaagcgatcatctttcctcagcctcccacgtcccaagtagctgggactacaggcacgctctgccacacctggctaattttttttatttttcgtagaggtggggtctcactgtgttacccagtaaacacagtggcctctcaaagcctggttggattacgttacagacatgagccactgtgcccagccttgtattaattcttctattagaaacttaagatacttagattaaacttatgtgaaaatagttcttttacagtctacatccccctcccccaatttcccaaaatttttaaaaactgtacttagaagatttgagcctttaagaaaaacggctcgtgctttaatttt

SEQ ID NO: 6343 - DNA, 1034 bp, Homo sapiens
gtgattagagggggtggggagaggggctgtaggtttaattgttcaccaatggctagtggtttaatcagtcatgcctgtataatgaagcctcatgaaaacccacaaggacagaggtcagtgagctaggtagctgaggttactggaaggtggcatgtctggagagggcattgaagctgtgtcccttcctatgttttgcactgtacatctcttcatctgtatcctttgtaatatcctttattaaaactggtaaatgtaaataaagtgtttcttgagttctgtgacctgctctaggagattaattgaacccaagaaggggcttgtgggaacctctgtttagaggtgccaggtcagaagcagagttaaaacaacctggggcttgcagttggcatctgaagtgggaggagggcagtcttgtgggactaagcccttaacctgtggcatctgatgtctccaggtagaattagaggacatttagccagtgtctgctgcagaaattattgcttgcttggtgtgtgaggaaagccctcacacatgtggtcacagaagcattctgtgttgtgagagaatagtaggagaaactgagttggtttttttctgtatcctcagaattgatgtcaggattgggatttgctagagtggctctagctagagtggctcatcgaagcatggtttaggaagaaaaaggataaatggatgggaaatgaggaacttttgactcctgggtggtcagatggtcacccctgctatggagccacaactgtgctgtgctcaggtacttaaaaattaccagtggaattcaaagatagatccaactccaagggagttggttcactgggtgcataaggaaacgcaaacaataagaaacaaacaaaatatacaatcccttgattattgttatttgtgatagctaaaatcaaagtgaaagagtgctggattgtaccttgatgctagaccaagctcaggtttcatttggtttaagccttggccaccagcctcaaagccaccttgcaagggtaaaaagtacccctaagacc

SEQ ID NO: 6344 - DNA, 1049 bp, Homo sapiens
gaatacaggtgttttggatgtggtttgtgtctgtatagttacatcatttctttctctggattgggctctttggatgttacacattataagagtatagacatcgaatcatttggagatctgttttggtcacatagtctgtttgttacctttatattgtagccctcagaatgctgaaagcaaagcaaagttgcatgtctaggcaacctaggccctggaaatgaaggcaggtgttcctggcctctggtgtgtcttcataatgttaggggtggtagagaatggagctagaaagaatctactctttactatgtcttactcttcagggttcattccagcccttgaagtcggtaactaagtcctaaaatgttgggattgtgcaaggaaggcaggggcctggattggtacatgatacctcactgggacctcctcccaaacgcagtggttacatacagccagaactcagcagcaccggcatttatgagaggtgtaagaatgtgaggataaaggattgtttgatctgattcttcagaggaattacttgtcgtttggagattttttttttttttttaaacattcatggttttgattctttaggaagagtcctggaagtagtaatgtgtgtaactaagtcatgaatttaaactttataccctgtgctttaaggctgctgtgtgtcacctctagtgagcctgacttgtaccacattttggtctggtttgttgtgctagactagaattaacaaagatgatttttatgagagtgcttaggcttttgtgctgtatggacagtttggggtctttggatacattccagtggctatcaagagtattgtgtcctactgagaatttgatttttgagttgaatggatacgaattaaatagtacctggtttgtttggcttaatacataatattgaattttattgtctcacgtgaataaaactgaacacttcatgattacatgatggggaaacatgtaggggctttgtctctattgaaatatttttcttacagttgtttttgtattttattttaggcaaaagtcaacaactct

SEQ ID NO: 6345 - DNA, 1031 bp, Homo sapiens
caggtaaccgagaaatggaagggagggctggggagtgagaaggacagagagcaccgcccgacacaaccagacgcgcggacccggggcctcctctctggaccggtgctggggccctggtagaaccagctccgggagccgaaattgagccatgaagagtgggccgagggaggggcgaggggaacgggcctcaggagggaggggcgggcccggcggcacttccgttgggggtggggctgcgggctgccgcgccggtcccgcccctccgccgcgcgggcccgcccgctccaggccaggctccgcccccaccgactcggagctggatctcaggccacggcgcccccccagtcgcgcccccaaccccggaggcctcgggctgaaccgggtttcgcaggagggcacagggcggctcccttttcctcacctgggggtactctctttttaagtcataggaacagaagcatctgcagactaggatcccaggcccaaacttgcacgtgagatttgttgaaacttaggtcatttggtactcctgacacctgcctggcccaggggtcctcacgctctctctgcggatgtgatcagccgtcctcttggacagtggggaatatagtccgtgctcatagggtcccacctatctttcaggaagaacaaaagcaaaaactaacactttttgattgttcattttgtgccaggtgccatttaaaaattttgtatgaattatgtcctcgcccacagcgactctctgaggtaggtaccatgaatgccccatttcatagataaagaaattgaggcacagagagaagaaatctgccttgcctcacccgcatcccatcctcatcccttctttccttcagatctggggcatgccaactccttactctgggggagtattggagggagaattctacttttctgatgggggagtaccagcctgttaaccacaaccatttgcagctgaagccagtgcagagcaggagggagatctgcacagaggagaacagtataaatggcatggggtcatctcagcccct

SEQ ID NO: 6346 - DNA, 1030 bp, Homo sapiens
aatttcccgtgtttgccccaagcagagaatcgcacctagaaagtttgtacattgtgggatacttaactaaaacattttcttccccagcagtcgaaggacaagaaaaagagaagttaaacatattgaaaggccactgatggaacactttgatctgattggagagtgacagcaggacccttgtcctaacgcatcctttctgggcacattctaacccctcctgccgctgctctaatgttaagagtgattggaatgaaaataattatcagtatttcaaacatgaagaaactgagttgcagaaattaacttatctaaggtcatggtgaagctgggacagaaatctacatttctttggcttgaatggccaagttctttgtgtgagcagttgaaggagaaagagtgatggcagcggctgggaactgagtactctcttgccgtctcacctcctcccaaataagcctttctttctttctttttgagacggggtcttgctctgtcactcaggctggagtgcagtggcgcaatcatggctcactgcaacctctgcctcctggactcagatgctcttcctaccttgggctcccaagtagctgtaactacaggtgtgcaccaccatgctcagctaatttttgtattttttgcagagatggggtttcatcatattgcccaggctggtcttgaactcctgggctcaagtgatccacccgcctcagcctcccaaagtgctaggattacaggcatgagccactgcgcctggccaaccctgttttctaatggtaagataagtaaagttcactgctggtaactccttctcttaaacccaaccaaactgaggccagtcttaacatgtgctcttgcatgggtatgtctgtgttaagtgtgcgagaaggtagaatattaactctcttaccatgtagctgaatttcttctctgttgattcagaaatggaaagaaaatgtcagaactcctgtaatgcctttaaaacaaaggtgcagtgaaggtattgaaaccagaaatgaaaataagtgggcta

SEQ ID NO: 6347 - DNA, 1141 bp, Homo sapiens
tcacatgtattgcttgtgcaataaagagatgataaaagtttaaaaggtaaatggttttttaaacaggattttctctccacccaatagctatcctttgactcgttctctagttaagtttttgtttttaatgagaaagacctttctaacttactctatttctttatgggtttggggcacagaccccttattttacttgcagtagctccatttccttcaagccactttgggacaaaacctagaagaaacttgaaagttatcacatgtctaagaaataaattccaaatgagtgggttctaactttgttagtgtaatcttataataggttattttattttcatatgtggccatccaggaagaatgttttggctctgagatgagtggccttgtgagagctccgtggtctacccagacaagcccggaaaaggggaaaaagggaagcatgttggcaaaggataggcccctttcagattttgtagggaagtgacaataatgactcaaatattattttctctgtgtgtgtgtctgcaaggctgctttgaaggcactggttttctcgttcaagatacattccctttctgtagaaaccttagctcctgatattgggacctcctgttcctctgtttgctaagacacttccttgtatttttcttttcttttcctcccctcccctcccctcccctcccctcccctcccctccccttcccttcccttcccttccctgcttttttttttttttttagacagcgtctcactctgctgcccaggctggagctccatctcagctcactgccacctctgcctccctggttcgagcgattttcccacctccgtctcccaactagctgggactacaggcaggtgccacagctaatttttacgttttcagtagagacggggtttcatcatgttggccaggctggtctcgaactcatgacctcaagtgatctgcccacctcaatctctcaaagtgctggggttacaggcttgaaccactgcgcccaaccctttgtattgtttccttccaccgttggcttttaatggttcctagttcctctcgggctgcctgatgatgtgataatccaaactgtttgccttttttttttttttaaatctctaaagactataattccttttaagaaag

SEQ ID NO: 6348 - DNA, 1049 bp, Homo sapiens
tttcctgcaattttattctatggatttcctatggaaaacagtcttgtgtatctataggtatgaatctaatttttcaaggattaaataaatagtggatggtgtgctggcaagcttttgtttttgacctcatggaaaagttttttggtttttttttttgtttgttttgttttgtttttttaaacttttggctgctttctactttggggttcttaggacaccataaaaataacttcttctccttcccttcatctactgtcaacacagacacagtctttcactttgctctgttctttgcacatcactttattgtgctcatggtctcagaaaaaagtcttagttaaatgaaacagtgaaacaccattaatgtaggtatggtcagcttatgtagtacaaatgggcttcatttggggcactatcttattaccatgtcattgtgcctagcacatagcaggtgttcggcaaagatttcttagatgaatgaatgtctacctagatgatgattaggaactccattagttggggttgggggcaagtttttgaacagtgaacaagaaagacattactctaacggcaacatgcattctaatgaggaaagagacaaaggtataaacaagacaagtatcagatggtgatgagtgctataccaagagttaaggtaaggtgatctgctgtgctatgacttgggaatcagggaagtctctgagaagataatgtttaagctgagatctgagtgacaagaaggagccagtcaacagaagatcaaagagcagcaagattcaggccaagaaagcaagcaatgcaaaggtcctaggctgacgcaaccttggagtgtacatggtgcaacatcgcggcagcggcatcaaaagctagccaggctgtgcagtggggagcaggcagctgtggtgtgcaatggggtcagcgacgtgcctggggccagaccagctgggaccttatgctacaaataaaatccatattcctccacttgctttgcagtgggaagctttggagggttttaagtggggctatggcttacattctaaatgtactgg

SEQ ID NO: 6349 - DNA, 1050 bp, Homo sapiens
gagctgtcaccatcctgactcatcaccttcaagcaaataatcaggctaaaaggataggctactgggacatcctaggaggatgctagaggagattggccaacgagattcactggactcttagtctctcaacctgtcactccacgctcatccatggaaattggctctgattcattactaatggagaaatagttcaagacttgctttgcatccctacacctatgtttggatgaggacttcaagagtgagaatacatttcagatacagttatggctaaattgtagtctttgcatgaaaaagaaatgacctggtccttgttaagagcagtggattcagcccaaggtggtttcctgatatagcagttgaagttgcagaagattcagagtgcaatgtatgtccctgcaagatactgtagggccagtaatgtttgtagcagtaattcctgtctggtcatgcatctgctagaatgtcgtatctagtactctgcacccactaccacctcgtagaaatagcttcacaagttatatggaggattggtgagacaggtgggagggtattcgctccaaggaggagaatgctgtgagatagccattttttctgcctttatattcttgttggggatatgttttttaggtgcctgtagctgtctcctgctgaatgggctttgttcagagatgcatttgcctgtataagggttgtggttttagaagactgcttatctccctcctagttgctcactcttacataggacagccatgtccagctgtaaaggtaatatactgcacagctgtaaacagcatccctaagaacaagtacatcaggaaatgtcttggggttcctagtagcagttagtgatgagaggaccaagcagctccagccttcttggttagctctgtggccttaggtaagctattcaacaatagtagtccttcatttctgagtctgcaaaatgtgcatgggtcctgggtaaggagaaggcatcacctgctgacctaaggaaagtgaaatatgagtgaatgcctttatgctttctttatggcataaacatgttaa

SEQ ID NO: 6350 - DNA, 1031 bp, Homo sapiens
tgtgttgaagaaataaactttggagtacatgcatttccaaaagtctctcttattcttttcccctaaactgaaaattggaaactatttgggcctgagaatcacctgctcccacaaataccctacatagtcctgccattgactcttggagttaggtcctcactcccctgggtacctttagtttcttccatctgtgtctgtgtttttaggtttccatgcaaaaggccatctaggatgaagacggaatgattcataaggaagctggcttctcattgggatgaggaagctgctcgcccctggggtgccagctccatgagggcaggaaccttgtgttttgttcgtttctgtatctctagtacctagtctatagcagaggctcagtcaatactcatcaaaggaatgaaccatgaacagcagagcatattggaagatccatcatgaaaaggttgttgtatgtgttctaattacttcagtcaacatggttacattaaaaggcaggaaagaaaccattgcctttagactgtgtgttaattgccacctgtacactggcagaaaagacagattctgggcatcgtatttgtttttccaaaggattttcctgggattatttatgatgggaaaacctactactaccacaatccccatgacttggcttttccactgggtagcatttcacggggaggcaagggtgtgatctgaagctgcgttctcctcgtcactcggggtggtactggagtcctccttctttctcaacccacctgctcatattagggcttttaggaagtaagtagctcttctcatgaaacatgttagggtacccacaagtctgtgtgtagttacaatgaaattttccgtcttcgccgctattgtattttttgtctatacctaaaggagcactacctagttgcttctttgctacacttaattgttttttatgcctagtgtagcactttactaagtgctatcttattctaaactacactgcgtatgtctttgatatcttctgttactcctatgtagcccaattgcaaatg

SEQ ID NO: 6351 - DNA, 1086 bp, Homo sapiens
atccatatggaattatccatatggaaatatcagtagtgctgaggttgagaaaccctgccccagagatacacataacctagtgaagtaagttgtacagattcatgtgtaaaaccattgtgttttcctggtattttatgtattccttaggtgtatcctgtgagtttggccttgcccagtgggttttatttactttagttcgctacatgactaatggctacaaattggactgcaacattctaggtcttggaaaatcacagcaaggccaagaaaagttggagtagttttattaaccagagtgtttatgttttcagaacgacaccgtaactatccgcactagaaagttcatgaccaaccgactacttcagaggaaacaaatggtaaggaagggcacatcaatctttgcttaattgtcctttactctaaagatgtattttatcatactgaatgctaaacttgatatctccttttaggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtcaggaaccaggaaaagtttttgattgtatactgagtgtcaaacactgcagagtg

SEQ ID NO: 6352 - DNA, 1289 bp, Homo sapiens
tgtatttttagtagagactgggtttcaccatgttggtcagcctggtcttgaactcctgacctcgtaatccgcccacctcggcctcccaaaatgttgggattacaggtgtgagccaccgtgcccagctgaggctgcactatttttaactgacgttcggtcatgttaaaggccttgctgaggtggtgacattgaagctgagatccttgtaaagatttggaagtagtctttgtaaagatacagaaacagtcttgtaggccccaggaacagcaagtgcaaaggtgggcagagtggagatgagtagatccggaatctccatgatgtgggggttgtaaatgcttgtctgtcataagggagtaatggggagttgaaatgggaagagatcccctcagccacttcggaggtgccttgttttggtagtgcaaaagaagaaaaaatagtgatctgtgagctcaagtctggacaagaacagccagtctcccaaactccctgttgagagaatgttgagtggaccatttgtttcctgtgaggctattccatacctaaaatcccttgatgatcctttctgttccagcaaaaacatgcattaaatgtacttgaaaagttttggtttagaaagctgtgtttcttaagctcagactgggtcagtttccctaccagagtggtgggtaatgattttaatgtttacaagtcacctggatgtactcttttctcattcagcatggcctgtatgagaagaaaaagacctcaagaaagcaacgaaaggaacgcaagaacagaatgaagaaagtcagggggactgcaaaggccaatgttggtgctggcaaaaaggtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagtt

SEQ ID NO: 6353 - DNA, 2232 bp, Homo sapiens
gtgtgtgtccagcacaatgttgctgggcagagcagaggggcagaggctcaggtatgtacttcattgacaagtgggcaaggccatcctgggtaccacattggcttaatgatctcttcattgtgaagtccggctacctcgtttgcataagaactacagtaatcaggcaaggcattgtcagaattgggaggaataaaatcagtgagtctggaaggagtgctctgtatacaattgcaaagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcacagccgaaggagtaaaggtgctgcaatgatgttagctgtggccactgtggatttttcgcaagaacattaataaactaaaaacttcatgtgtctggttgtttgaaatgtatttgcagtttcctgggactgctaggaggttagtctgctgatttcagttgctgtccaagttcacatgctccatgaagcattcagtgaaaacttaatgtcatggggtggtgtttgtttgctgcttggtttatagcttaggtgggttcatctgggagtcaagcttgtaaatgctgtgttaagaaccatgtccgcggtggacgcagtgtagtggctcacagtcatcagcacttttgggaggtttgggtgggatgattacacttaagcccaggagctcgaggctacagtgaggtgttttttttttcgagacagggtctagctttgttacctaggctggtcttgattgaactcgggctcaagcgatcctcctaccttggccacataaagtactggcatgagcgaccacgtctggcttagagtctaaaaagtaccatgtctggataaactggagaaatctcaggaagcagtagagagctgaaagacttggttgggcatgaaggggactcaggaaaagcaataccgtgaaggcagaagggttgaggttgcaggaaggaagggtagtggaatgttttggagaaaagatggtcacagcccctgcatggagcacctacagacaggagggcagggctgagaagagttaagtcatggggctgggcctgctggccagggggtggttggagttctgttttcatatctacagaggctgtgtacttcggtttgtggggcctctggccctgtaggttctcttgctaaggaatctgctactactttgctaggaccaggaaatggcttactagtacagaacgtgtggaagaatggggtctttgatgtgatttgacattttttgatgaacagtgcataccaggctgaaggtaatgctaggggcagcaaaggttggggtttgagatgcagtttcctgtgactgagctggagtgtggaagcagagaaggcaccctgtgagcagcttgcagaggcaaggtggtgaggatcctgacagtgctgcagggatgggatgggatgggatgggacaggacgtggagctgggggtggttgctaagttgatgcagggagagtggaaggaagcaattgagaactgaagggtaggaaatagtttctgatgtgaagaaaaagggcatagctgcagagagcctgaatgattgaaggttggcatcaaagtcacgaagtggggaggcttttctgttcagctgtgctcagggcagaagttgtagtctttcagccagtagccttgggaagggaggtgggatgaaactcaggcttggcctatttttccagaggatccacttgggttgtgatattatagaaaatgtggcagtcttgctgtgagcctt

SEQ ID NO: 6354 - DNA, 1067 bp, Homo sapiens
cccggcctaatctgcatgttaactccaagaagcatgtcttcctggacccacgctggaaagggtgtagagcagttaagcatcttaccagtgtctcacccatgaagtggtggggatgggattggaatgcagtcatctgactccaaaacactgcattttttcaggcactccagtattaagctactttgcactgtgcatataatggtatataaaactcatgactgccagcagggtgccagttgccatgggtttattgaacaagtgttagatggctagccaaattcccaatttactgaccacctgctgtgtccctgttctgcaagttggggataaagaagctgttctgtcttgaaagctctgaggtagttaatgacgatcccatgatctggcttctgttcctttctgtgaagtagcagatagtgtatgactgtgacgtgatagaaattgagagccaagaagatcagtgcagggaggctgggtcttggaaggcttccaggagacatacagcagtccccacctatctagtttcagttgctgtcggtcaactgcagtctggaaaattatcatggctaaatggtctgggatcacccaaaagtgatgatcctcttgaagtgtcatcagaaggtcaatagtagcctaacacgtcaccatgcctacgtcatttacctccctctcccttccacataggcattttatctcccatcaagaatgtgaatacatgtacgtattcagaggaaaagagttcatgcagcctactacagtataattattaatatcttactccctaaattatgaactttaattatgtatatatagcaacaaacttggtgtagatagggtttgcggtttcaggcatccactgggggtctaagaacgtttgccccatggataagggaggattactgtaacaccagcagtggcaagagacatgatctgatttggatgcacaggagaaagttctcatttgaggccatgaaaaataggaaagaaagcagggagatgggagcaggcagtgtgggacaaggtgagaccagtcattctgcaaggggaagagaggatgacactgggga

SEQ ID NO: 6355 - DNA, 1062 bp, Homo sapiens
aaattatctcatttacctttttttttttttttttttgagaatgagtctcgctctgtcacccaggctggagctctggattgcaccagtggcgcaatctcagctcactgcaacctccaccttctgggttcaagtgattctcctgcctcagcctccatagtagctgggattacaggtgtgtaccaccacacctggctaatttttgtatagtagagacagggtttctccatgttggccaggctggtcttgaactccagacctcaggtgacccacctgcctcagcctcccaaagtgctgggattacaggcatgatccactgcacctggcctcatttacctgcactcggagggaagtactattacccccattttatagatgaggaaattgaggctcaaagaggttaaggaacttggttaaagttacacaactatggcatcctatgataagcctgggggcatttgtggaacatcttgccaaggagctagaaatggtcctgagccttaaatgggtggaggtgattagctgaggcagcgattctccaggtgtggtcctggacagcagcagcagtgtcaccagggaacttgctagaaattcaatttcttgggctccaccctagaattactgaatcagaagctgtgggtggggccaggtaacctgtttttttttttgagttgcccaggctggagtgcagtggcgtgatcttgcttcactgcaacctccgcctcctgggtgcgattctccacctcagcttcctgagtagctgggactactggtgcctgccaccacgcctggctaattttttttttttttgtactttttagtagagatgggatttcaccatgttggtctggctggtcttgaactcctgacgtcaggtgatccgctggcctcggcctccaaaagtgctgggattataggtgtgagccaccgcgtccagccagaacctgtgttttgataagctctccaggtgattcagatgcatgctaaagtttgagaaccactgagcttagggaaggggaggatattccagagggggacagctgtggagacccggtaggacagtgc

SEQ ID NO: 6356 - DNA, 1021 bp, Homo sapiens
tgtatttctggcactgtccaataatggtagccactagcctcaggtggctgttgagcatttgaaatgtgactagtccagactgagaagtgctgtaaatgtaaaatacaaaatggatggtgaagatttatgcaataaaatagtgtgaagttatctcattaataattttttatattgagtacatgttgcaatattttggagataactgagttaaataaaatattgtattaaaattaattcaaccaatagtcatattacttgctttattatgactaaatatgactaaaatttaaaattccatatgtatcttgcattatatttcattggacagtgctggtttagatattcaaagaatttatctcaagagattagggagtccttggaggatggtgattgtggctcctctgatttctcatgggagaggttagaggggagtttgtcctccactccatgtaaagggttctaagagaattactcatagagatgtggaggagctgatgaagattggtgatatggtttggctgtgtccccacccaaatcttatcttgaattgtattttccataatccccacatgacaagtcatgggagggaccaagtggagataattgaatcatgggggcagtttcccccatactgttctcataatagtgagttagttctcatgagatctgctggttttataaagggcttccccttgctggcaagatggccaaataggatcagctctggtcttcagctcccagtgagactgaggcagaaggtgagtgatttctgcatttccaactgaggtaccttgctcatctcattgggactggttggacagtgggtgcagcccaagaagggcaagccaaagcagaatggggtgtcgcctcacctgggaagtgcaaggggttggggcactccctctcccagccaagggaagccattagggactgtatcatgtactccggcccagatactgtgcttttcccatggtcttcgcaacctgcagaccaggagattccctctggtacctacaccacc

SEQ ID NO: 6357 - DNA, 1045 bp, Homo sapiens
aaactcttagtatgtgtgaggcatgttgtggtatgtgacagcatttaattcatccattcattaattccttttccattcagtgtttgtggtctgtccataggtgttgggaatatggggcaaataagacaaatagttccaggtctggtggcgcttacagcctgggaggagctacacaatgaaacaattacaaaagcatttgatttgacgagcctgcagcctgggctgtggagttgaaggtggccagacaatggtgagggccagggtatagggcagagcacccaaaatgttccaggcagagagaaaagaaaacaggtgggagagctgaagggagatgcttgtgtctggataccaaagcatgggggtgggcaaggtggttctccaagggggtagggaggggctagactctaggggccccaaaaagcatgacaatagtgtttgaactttagctggagagcaagggaagtccccaaagcttttctggcagttgtacagcaggacaagttttcacttagaaggactcctccagctgctgtgtccagggtacatggataggaggagagtggaaactgctgaggtcacccaggtaagacatgtggaaagctagagccattaggatggcatgcaatgggttgagatcggttcaagagctctaaggaggaagagcccacaggatttggatatagggagagggagcatcaagactgttcttaggtctcccttttgagtgtctggttggacggtggcgtctttaattaagattggaaacacagagggataaatggactttgggaggaagatgattgcctgtgagacccccaggtgggtctggagttcaggagagaggtctggggcagatagtgatcaagatgggaagtcggaggtatagaggtggagacgggctcctctggagggctcaagtcttccagagaggagtggacagggcctggcatggatcactggaaacttttctcaatgctccacagcctctatgtacagtcctcaaattatatgccaattatgcaccaattatataacccttcttggt

SEQ ID NO: 6358 - DNA, 1052 bp, Homo sapiens
gggtgggtagtacagaccttgcacccacctgctcctggccattttactgagcctcagcagtggcgatgatcattgtcaggaaggtcccagccctgatccccatctgccagctccagcttggcttgcagggagcagacagcctgctctgttgtgccggctcctggctgcacagcctgctgtcgctctggcctccccacaactctgcccctcagaagcttctgaggggaaggaggagagggagcgctgcatgtttaggagatatggcatagacaaaccagatacaccagaatggtcacgttactctgcaagcataaattgagctcaggcaacaggcactaggtaagtgtttgcatgaaggtgcaacctgtttaaaaggaaccttaactggtctgggccagttgtaatgagagagcaccttgtaaatgggagagcatagccaggtgagcttggcagctgtcagattaaaaatcagttttgaccaaaataaatctattatggttctagaaatgccccctggaccaggaatgcagaacaggggctgtgtgactttattccccatcatctcttccacacctggcactgaatgggcactgaatccgttgaagactgaatgagttctaacatgtccatccatattaataactaagatttatctagtgcttgctacaggccagacatttggccaagcacgttgcattatatctaatccggcaatgcctctaagggatagggactcttacattacattttacagttaggaaagtgagacccactggggcaaagtgatttttccaagattacaagtgggaaatgatgcggctggtcttggtacctgggttgcctgaatctagatatggcaatcttgcagtgccattgggcagcttttcataaaacattgttctagttggcacagtttttcatacctgttacctgaatggctttgcaaaccagttagctctaagctgcccccatctctgggttggctactgcagcagcctcctccctggtcccctgactccccttccgcccctccaaatgactccccctggcag

SEQ ID NO: 6359 - DNA, 1063 bp, Homo sapiens
atagatggacaagatataaacagttatcaaaacctaggagaatatgccactttactcataataagagaaatacaattaaaatttcactgagacatcattttcatctctcagtttgcttaagatcaaaacagtggataacacactgtgtggatgggaaaacagacactcattgctgattgaagtgaaaatttgggggtacaactcaatggggggatatctggaatatctacggatgttacaaatgcttctgaccccacaattccacttgtaagaatatatgctatggagagattcccatacatgaaaaatgatgcatgtaagatgagttgttacattgtttgtaatggcaaacactgaaagcagcccaaataggcatcaaaagagagatgttaagacaaatcaggtgcatgcatatatgagtattcctgtgatgtacagatatggaaagattttcaagataggttgttgtgaagaaagcaagacatacttcagtgtgcatagaatactgccattcttgtgaaaaagtaaaggggtgtgtgtggaagaatttgtagacatatgtgtgcatacatgcacacttctacttaatatgtctgtggaggaatatataagaaactgataatgttggttgtctctggggagaggaacctcaccattgggaggcagggatgagaagggaaacttcttgttacacacatttttatacctttggaaatcgagaatacactacctctatagggcttccccacaaaaataacaaagagagtgagcagaagatagggagcccatgacagagactaagcctgtgcaggtggagtctcagagagaaagcggaagagagctgcactggaggagcccaccaaggaaaacatctcaagaaggaggtaggatcctggcctgaatgctgcaaagacattaagaatttagatgaggatttggagacgtgcagtcgatgtgttcatcgggtccatggtgacctcggtgagagtgcgttcaattcaattgagtatgtgactgtgtaagcccgaatgcaatgtttaggagagaacgaaatgtgcagaat

SEQ ID NO: 6360 - DNA, 1058 bp, Homo sapiens
gccttccaggttcaagtgattctcctgcctcaggctccccagtagctgagattacatgcatgcagcaccatgcccagctaatttaaaaaatatttttagtagagacagggtttcaccatgttgcccgggctggttttaaactcctgagctcaggcagtctgctcgccttggcctcccaaagcgctgggattacaggcgtgaaccaccgtgcctggcccctattttttatttctacagatttttcatatgaacaaaatcatatagtattttgtgactggtttttttaacttagcataatgttttaaaagttcatccacattgtagcatgaatcagtacttcatccctttttatggctaaataatattccattgtataaatacaccacattttctttatctttttgtcctttgactcacatttgggttgtttccaccttttgtctattacacataatgctgctataaacagtcatgtgtgagtttctatatgtacatatgttttcatttctcttgagtatctacttaggagtgaattgctgggtcatatggtagccttatagtttaatcagttgaagagctgccagacagttttccaaagtggccacaccattttaaactcccataagtagtgtatgagggttttaatttcttcacatccaacactgttatctgatttttaaattccagctatgctagtgagtataagtactaccttatcatggtttggatttgcatttccttaatgactaatgatattgactagtaatattgaccatcttttatgtgtttattggctatttgtgtatctttttttgaagtacagatctattcagatcttttgcatctttattaattgggtaattagtccttttattattgcattgtaagaattcattatatattctagattcaaatgttttatcaaataatatatgatttgcaaatattttcttccattatgtgggctctcttttcacttccttggtggtgccctttgaagcacaaaaggttttaattttgatgaagttcaatttatctgttttttattgcttgttctt

SEQ ID NO: 6361 - DNA, 1052 bp, Homo sapiens
atagccttgtctatgcagaaaagggttgctggcttctttgtggggacaaaatgtcccttttccctcctaagcaaaggggggaggagggttcttgttcctctcacagccaggggcaaaatgaagaaaggtccagagactgcggggtttggcgacagaaccagtttctccctcacgcacgcgcgcacgcacactcacttccctagccacaataacaacgatgtctccatccctggcccccatagatatgcctccaacataggacaggtgtccatgcttgactcattccagaaaattgcaggggcaaggacccaactgagaagagctgcagacttcactttttttcctgtttcttcctgatggcgggaggggtgaagggatttaggaaggaaggcactttgaggcctgctgcatcctgagagttttgtcacaagaatacctgcgtataaagccactgaccctgagggtccaacgagtggccatgaccctggcctcagggtgaggcattgttgtaagaaattcaggcaccaaccaattaatttccagaagcttctgtaggcacttggtcgtgggaccaggaagcagggcctgctggttcgtggctgggtcctctacattttcattcataactttgctccccagggccctggcccagcccctgtcactgctgcctggtctttatgaggctccttagattttgtgtggacaacaaaggccaggctgccacgattacccaggacactgctgcagccttgcctggcgacagctctgacctcttagcaggatatagtgctctctgctcatgccctttgggggagtgctctttgtccttaagagtccctcaggatggggaggcagcaatccacctggctgtaagctccggggcgttctgaggttgggccctgcctttagagaggatgaagggagaaggctgagaaaagcagtcctaggcataggctctggggagaggctagaccccatcatgattgagagggtctccctattaccggaggagatgggcgagaggaccaaggtgtcaggaggctgttgcttgc

SEQ ID NO: 6362 - DNA, 1162 bp, Homo sapiens
tccatccctctttcttttagtccttccacactcatccacccattcatccctccaccacctatccgtccttccatccaactacttacccacccattccccccatccacccatctatttactctttaattcactcatcaaatattcatggactctcacaccaggccaggcccgcattaagggctggggtttttgtttttgtttttgtttttttgaggcagggtctcattctgtcacccaggttggagtgcagtgacacgaacatgattcactgcagcctcgacctcccaggctgaagcgattctcccacctcagcctcccgtgtagctgggactacaggcatgcaccgccacgcccagctgatttttaaatttttgtggagacggggtctcacttcgttgtccgggggtgggttttgaagacagagccaatttagccctgccctgagagggtgtggtgtgcaatggagtacgactcagatcccagagccagactgagttccataaggcagtgctcaaagcctgtgtggtgaccatgacgacacaggggacgagggagaggggacgtggctgattctgcaggcagacattcggggaggaggaggcggcattgctcatgcattcattccccaggtgttgaccgagaaagtctgtcaggaactctttaagttcagagatatagcagggaataaagcagacaaaactccctgcccttacggcgcttgtactctcgtgaggaggcatggatgataaatacctaaaaagtgaataggtcaggtgacgctaagttttaagaagacaaatttagccaggtaggagcacagagtctacagtgtaaagtactctttcactagccaaggaaagcttttttttttgagacagggtctcactctgtcactgtaacctcgacctccccagctgaagtgattctcccacctcagccccctgagtagctgggactacaggcacacaccatcatgcctggctaattagtgtacttttagtagagatggggttttcccatgttgcccaggctggtctcgaactcctggacttaagtgatccacctgcctcagcctcccaaagttctgggattacaggtgtgagccactctgcctgacccaagaaaggcttctgttaagttggccatttaagatagctgaatg

SEQ ID NO: 6363 - DNA, 1101 bp, Homo sapiens
tcttgctctgggaggtgatttctctccagggtcaggctgctctgaagttaccaggaaagcctgcccacccactgacacagtcagatcccctcacaggcatccatatccaggtcataagtgctttggcatgccccatctgatcctcacagaaaggtttgtgcatgcttgtgattttgctctagtttttccattaagaaaataaaaaagaggtggggagacctgaggggtgacatggcttgctccaggtgacacagcccatcagtgaaaagtgacgtcttcaggcttctatgtgagtgcttcttcctagatgctgtctacagcctccccagacccacatgagacagactggggtctcaccttgtcgctgacctgccttgagacctcagacaacaccaataattaagcaagcccgagtgagcacatgctccgtcctcacctgtttattcacatgtcaactccgctcatcccattgcagccctgtaagaggatgggtgggtccctagtgaggggactgaggaccactgtggggaccccagagccctcagattcctggtgacagcagctggtctgccccctgtctgccagcctctgagcctctgctaatacaccctggaaggcaggagaagccggatgaccctgaggtcttttgcacctggtgccactgagggcctcagttgtgctgtcctggttgctctgcaaaagctttaggactgggcaccatctagagttggtgtatctggaaccagaaactctgttggctgccccagctctaccctgagtcaggggaacatcggtgttgccctgggcttggcctgcagagctggggtgggtcaggctttggggtgaccctgtgcctggcattgggaggtgctagcattgggaggtgactgatctggaagagaagccaggcctcacagaccatggtgatgttcagggaagaagctgctggtctttgcctgccaggcagacctgccctccccaggccccatcctggagcctttgctcttgctgtctatctcctggggagccaggtgtccagtggaaagacggggttccaagccacagagacctggactcaggttctatccctgccactttatg

SEQ ID NO: 6364 - DNA, 1412 bp, Homo sapiens
cttctgctggccctaagaacttgcttatgtcctgaacccagaaggggagagaaaagaatgtttcccccctcatcttgttcatggagtaacagagcacctgcatcttgcaggcactgagctcatcccttggtctcgagcagtggttctcaaagtggggtccccaggtcagcagcatcagcagcacctgagacctggctagaaatgtattcgttggctccaccccagacccactgaatcagaaaccccactgggggtggagcccaacatgcatgtgttttaacaagccttccagattattctaatgcatgggcaagattgagaatccctggcctggagatccaggctgcagtgaatcattcagccctgctctgggaccgcaccatccagacatcaccccaagtgtgttacactgagtaacaggtgcagccaggaagcaccagatgtaaatggcattcttataaaccattttgattttcattgcaacaaggcaactggatatttaaagaaacctcacagagaaccatttcatcaggtaaagaatcttctacaaaaagagaaattctctcatttcctccctcccctcagtgttctataaattcagtccctatctcaggttgtcttgaacggcgtgtgcttgtgcacgactaaaaccggtagctagcatgctaaaagagtgacatgtattctccagaatgcacagggacccctgcagctgggaaggagggcccagagcaatgaatggagaccagtctggtgtttgggcagccagtgggcatccactgggcaatctgctggggacttggagaggtttaataacagccaggcatatgtgatttccagggctgtcaagcctccatactctgggtttctcggaaaaggaatggaacgaccgattaggaagtcaagacgtagaaacatgaaatgtgccagccgtcagctgcttctgctggatgaatggataagagggaaaaccctacaacaggttttgggtcgagaacccatctgaaggttgtcatctcccatagcacagggtcagaagggagcgcgtaagtaccactgcatgcgccagcgcagtggcgcagtgacagagatggtgccatgcgctcctgagcttacaacacgtgtttccagagtggtcacagctggcgtggagcctgacctcgtggcttcggtctttgcagggtttagacctcaggtgcactagctcagagttagaggaacgaatagccttctgagtttcttgcatcaggaacctgagagtcttggcaattaaccaagtcagtcaggcactgtaagcagggaagggtggggtggagtcgggggtgcaaatggttggaggtgagatggtagagtctggtcagcagagtcacccagcaaagcgcagcccatctcagttcctctcctgccccttg

SEQ ID NO: 6365 - DNA, 1050 bp, Homo sapiens
ctgggggctggcaccctggcaggtcttcatgccctgccccttcgctgggatctgctggcctcactcttgtgcaccccagcagtcggtaggaagcatcactggacactcactgtagacctaagcacaagaggtggggctgaaggctaactccttgcttctgatacgtgagagctccttggggagatgtccacaaacgtggtgggtactgctggacctggtgaggggaggaggggaaatatggtccgggttggtagagaggaggcagtgtttaggggcaggggcagctccacgagaggacagagccaaagcggggtgagggaatggtggggtccgccagaggagtaagtcattcttaagtgtgtgtttggactctgccttataaatgctggaagccaccaaaggtctttgattgtgccaggcatcttaggtgtttgagggagattagcttggggaaaatgtacatgagagatcggggtgggggcaggagagggtgtgcagcaggtaggcctgtacccacattgctgggggctgggaaggaagggtgccggaagaaagcctgcattcccatggcccaggcagccaggctgctgtgaagggctgggaggtagagggaagggctgacaccctcagactcggacccttccagcctgtactgagaagggaccaagcagttccaagggtaaggtggtttgggggagcccaggctcttcctaaagggcaacgtggagtcagagcccgggtgaaggaggagctcagattgggcctcaggtcacaccacttcatcagttgcatgacctgtggactcggggatacagggagacacacagccatggaagtagctctctgcagtgatcgggggaaaggtggccacttctgaacagcctgtcaccatgcagggcacactgttgtgcactgggcactgagacaggcctggggggtccagtaccgactcggatgggggttaccttggactgactgggagctgcggtcacttggtggggtgatgggcatggcctgtcttgagtctgtgcctgccaggccctgaagatc

SEQ ID NO: 6366 - DNA, 1049 bp, Homo sapiens
ccccactgggtggcagctccccctgggatccgtgatcttaggtccccatgagaggcccagtgaggttaggccacctagccgaactcccacagtgtgccaagggccaagcctcccagtctgctgatcctctgacccttgccatcgccacatggtggagggcacagtgaccagggaggcggaacagctggcttctgcgggtgtcatcctgagtctgctgcagctttctttgtgggcttggcagaacatgcacccactctgggcctgggtcttgctgggtatgaaaagtgcccacattggggagtagctcagcaggtctgctctaggctcaggccatgtcccccactccccacaggagcctggcccgccccctttgtcccactctgccccctcctccatagcagtaggggcagcacatcccctagggtaccacagaccacgggacagggctgagtggctgctctatcctacagcccggaagcctcgggctgctgtgacctactacagcctcgcaagaggaaaaggacttggcttgtatttttacacactctctgttccctgggggtggccactatccctctgggtgaccccctcccctccccatctcatcccttcctaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactgtgagtacctcctcctcaccccattccattccccagcctttggggttgatgccttgggatctggataccctgttccctcccaggcaaggcagaggatgaagaattgggtgtgtgggctcagaatggaataggaggggtctaactgaggctacgtcgtgccctgtcagtgtccttagacttggctgttttacctaggatttcggattctctggagatgggggaagcttcaggctcttccccaaaccctcaccaccccatgcatacac

SEQ ID NO: 6367 - DNA, 1116 bp, Homo sapiens
gatggggaagtgtcaccactgagggtccccaccctgctggctcctgtccccccagtccctttggccatagccctgaaccccagccctgacccaccttctgacccaagccctgcggggtcccttgcgcagcacaggagggtccctgccctcccccgatggtgagcttgcggtttctgtgtctgcctctctggcccgggcagggagggctggagggagaggccgtctgtctgcctcgctggtgtgtgtctgtctccagttttcttgtccgcgtgttgtccatgccctgcttctgcttgctccatcgctcactccaagaggcccccatgtgggtgacagaaggtgggggcagagggggcagccttgggtcacagccaggggcagcaggccatcatgggcagcagaggtgccagggctcctaccctgaggtctggaagatggtgggggtcaccctggatgatggggctgggctgctggatggggctggcgggatgggactgagcaccggccccgcccatgcctacacagagctggtgccagactccgggaggaggcttgtcctcggcccctcctgttcttcacccccagccctgctctgtcagcctctgccctgcagcatcagaggagctctgtgctagctaggactcactcactgtgcagccatctcaggtccttgcccagtgttccccctcaaaccaggccagtggggctgcttttagatgcatgaggctccccatgtgacagactccaaggatatctcagtagagggtagagacagtctgcatcccctccggggccacagggaaggatggctgccagccagccacaggctcaccaaggagtggcgagcccttgagaagagggatgttggggggttgggggcggtgcaggaaccactcgccttcccgccttcccaccagcccacctccttgtgcttacacgtgaagcatgtgatttcagctgggaggcccaagtgacctgccatggggccttcccaggttagggctgaagtccatgcctgaaaagggtcagccctgctcaggcctcagctggtgggctgcgggtcccaatcctgaggcttgaaatgagcatgggggtgccccacactcggtgcagtgg

SEQ ID NO: 6368 - DNA, 1050 bp, Homo sapiens
tcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagctctcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctc

SEQ ID NO: 6369 - DNA, 1227 bp, Homo sapiens
agagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaggtttggcgaattagctattttgtggatgttaaggagtggtttgggtgtttttgcttttgttttaaac

SEQ ID NO: 6370 - DNA, 1010 bp, Homo sapiens
tcaatgagatgcgcctgaactcaaagctgatatcaggaaaggcggaggagagtaggggcagttgggcactgatgtggagattcaaaaaggcaccaggccctcagctgtgtgtccctggaggcctctgactcttcaggattccagggttagggcaaagtctgctttaaaatacctccagagctgcaggtagagcccagcagtggctggagcccagaagcagcctgccccctatttgaaccaagagcacgtctaaggtgagatatctgatggccacataccaaggtcaggcccccacctgccttgtacccccagagcagaaccccagtcctagttcccagaacagtatctggtttctgggctgccttgggatgtgcagcagcatcactggggactcccatacctggcccctctgagctaagaaatgcagcccgtgttgggtagccccttatctatcagagggaccagcacaaagtaggcaggagagaggctctactgaattgcactggactcaggacaacaatttatctcagggcacaggtggcattgaggttggtgggtagttcaggagcctgatggccttaactatgctactgccagcctggtgagctggtgataggggccacatcctcctcctttgcccccttggatctactttgagctccaggagcaggtggctgccctcttctagccccatcccagcctgagccctaccccctgccacagtcccaggtccagccctacacaggtcccagctcattcccatcctagacccagggcaggctctgcctcaggtccagccaaaggtctagccccagccaaaggccaaaccaaggtcaagatctagtgtggggcccaatgccagtgctgggtccaggttcagatccaggaactcacctttcttatactgagagaaagcagcctggaggtgctgtacttgtccctgtaaggcctcaacctgctgcctcagagaagcaacatctggaggggagaaaatggccaagtaaagactt

SEQ ID NO: 6371 - DNA, 1045 bp, Homo sapiens
aatttattccaacacctcattcattcattcattcattcgagacagagtctagctatgttacccgggctggtctcaaactcctgggctcaagggatctttctacctcagcctcccaacgtgctgagattacagggacacgccaccgcgccagcccgaacatctttatcttaaacccagaaaagtgacaggagtgtctcccctacaagatgatgaccagccctccagacctgagcccaggtgtgattccaaggcccctgtactggggccagacagggagactcgctctcagggacttcccaaccagcaccatcttctccctgcggggatggcgagggagcgcgggccggccccggccctgcctccgcgctcgcgctcgacggtgtcctgaagcgcgctcccggggaggtgttgcagccatggctacggcagccggcgcgacctactttcagcgaggcagtctgttctggttcacagtcatcaccctcagctttggctactacacagtaaggacagccgctggagcgctacggtctgacgaacgagcgagcgctcggttcaccccaggacctgggctcacaggccgcgggccgggggaagtcgtgcaagcacaatcccgactcccgcgcgctaggagcggaggggaggggaccagactccgcaatgagagcaagcatactggtccgccagggtcttgggcgggcgcccagggccctgagaaaccggctagccaggcttttcttatatgggggcggggacggctggggagctcccagccaactctgtgtctgggtttttcaagaggatggtgaagtcggaggccagcaatgcggctaccgcctatttccgtccagcaagacccttgccctctctggtcacagtcctggggctgggctacttcgcggtgaggcgtggggtggggcggggcgggcctctgttttggcccgccgggccctcgtagggcgaggggagctctgggaacggggcctgtgcgcacgcgcatctgacggttgtctcggttactcatgtaagcggaaattcggtgggc

SEQ ID NO: 6372 - DNA, 1033 bp, Homo sapiens
tttattaggtacctgtgaggtaggatcctatcctctcaaacttccatttctcatgctacagagaaagataaggaagatgagcaagtgcctggaatggggcaggctgagcagtcacacaggcatagaggcacgctgagaacctggaggggagactgcagagtgccttccctgatgctgcagccggaagtgatccttccctccacctggcccctgggacactgtgctctgcagtgtgcagggcctgatggcactgctagattgctccttcagctcagggccacagcttaaacagctttacctttcccctcagcacctgtcccactatcttgcacacaggtgctctaaccatgtttattgaacaaaggagggaaactgatttcactttcacttgttcattatcattccaatttttatgtgaaaatggcacaacccatttggggtaccctcaccccaaaataaaagcccaagtctacctttgactggtaccaccttttttgtggtttcgttggtgagaaacctttatctttttcatacctttctattctcaatcacttctccaaaagtgtgtctttccagctctgatttattcaaaacacaagcatttctgtttagagattctagcccatgggttatctggctagttattacctctcctgttcacttagttatactttattattgctcacaggctggggaggcagaatgactctgtcaccactaggagccattagggcttcttccctggaggactgcctgcttgctttctggggacactagccctcatttcccttctgtggtacagtggggcaaattatttgtattaagcaaacatttatgggaaacaacccgctcccgaaaacggagcccccaagtaaagcacaaccctgaaagattatgaactatgaattgtctctggtagagataaatttctgcaaacatatctcagtcttccctctgtttctctggtgattaagaagttcctttttggtaaggaaaaggatttttaaccatagagttaggcatcatggaaatt

SEQ ID NO: 6373 - DNA, 1084 bp, Homo sapiens
tctggcccatacagtgttcaggccttgtgtgtgtccttgtgtcctgtagagtccttgggcaacaggtggttgtgttcacactcattcttggaggcaagttttatggatgtgctcttgtgatggtggggcggtggtaggggggaggtggggatagggcagctgggtagccgtctgcctgtcattctccccagctggtttctgaggtcagacagaaggagggtctggtgggtgagtggtggtgtctaggctgtgcccgtcaattccacaccgtgggagaggtggagcggtcacaggttccgtttccagaggagtgtggtttcatgtcccttcttggcacttctttctcagaacattgcagaccagcagccagcctgccgtggctgcctcacaggaaggggttttgcaagtagccactccgtggaagctggtttctcactggcggatgtgggtgggtcgcctcctcacctctagggtggccttgtctcctttcgccttgggctgtgttactctcctcacctgggaagtggggggtgagcagggggctggcatgggaccactgccctacgggcctctgatcctgtccctacctgtgcacttgaggcactccctccttccccactgttcagccactgcattgggggcaggggaccgtggaggacttcggggtccacctggattgccactggggttcaaaaaggaaagcagcaaaggtaggccaggccctcagaaaagtccctcggaaatagcaccctcctgcagtaggatctctgaggttgctttgagggttagacacagataaaaaacagtggccccacccttcactctgtagttcacagggtcttcccacataggctgtgtaatccaagcttcattacagccctggaggacaaagctatggctatagtctgggttgaggtggagtggggggcgagtgacaggggagggagggagcagggggatggctgctggctgcagtggccttcctcacctctgagggctgagcttcagaggttttcagaaaatgttgcatgaatgagtatggagtcctcatcttggcttttcttcactgggcacagttggatca

SEQ ID NO: 6374 - DNA, 1033 bp, Homo sapiens
cttcatttaatactctctttttttcctgagaacctaaggggaggctgtttgttgtgggggaggaggggagaaataaactaccagctctcaaaagcttacagggtgccaggggagagagagacaactccatgagcaacccttagtgccaaccacaccccggggagtataatggagggcagaggagtaactttagaggtctgggcatgagcaagcacaagagatggaaaggagaactgtagaatgatgaatggtctgctggaaggagagagaaaaagttcatgatggatggagccagacatacgcctggaaaggaggtagggtgtgaagctcttaaatgctacattaagggggtggactttcctctgtgggcaaagcaggatcttgatacaaagaaggatgtggtcagatgaagttttaggagcaccactgatggcaatgatgtgattcaagtgatgagttttcaggcaaggagactagttaggagatttttgcaatggtcaaggccaatgagcaagggtctggacagagtctatgacaacgaggaaggagagaagggatggatatagcaaaatggtggtggtgaaatcaatagggcttggcatcaattagatgttgggatgagggaaagcaaagagcaaagacatccaagtcccaagctgggagatgaggagatggcagcaccatcccaccatggggagctggggagggtgtgcagatttgcaggaaagagaaagtgcttagattgactgcattgagggatttttaccccacagagaagggagataggtggaggctggaggagaggtgagagcttgggtgaaaagcctggtgatggagagagatgggctgggctcactttctgcagctcatgttgaggatgtaggcaggttctgctaattctccaggtcatggaaaaggtaataatgacaactgcattctgaaaatggaaaaaaaaatcccagaatctttatattgggttacagagggaactctgaagatgagacagctggaaaccggtttttaaaaaccattc

SEQ ID NO: 6375 - DNA, 1038 bp, Homo sapiens
tgaagagctattcatgtcttctttggatgacactattcctttgcccaaaagttatgtagattcttttaaattttcccactggatgctggtataaatcttaagccaaaactacatttgtaaaaaccatcacagactctgtaatcacgtccagttattaacagccgttctgtgttacacataatttttgcagtcatctattttgattggtcaaactgggacttaaacctagtttgttcctccatcttcagctgtgttctctgggatgggtttcttgcattacagtggatggttgggcaaagaattcatcgctgaaaattaaaaaggtcgctttatttcctgttctactaaaaaatagtttgttccttgactctgactctcatatgtccttctcttaattggttagtaggttgttttacttatgtttttttggttggttttgccttttttttaaactagcatttcagatctgctcggtagacctggtgcaccaccaccatgttggctgcaaggctggtgtgtctccggacactaccttctagggttttccacccagctttcaccaaggcctcccctgttgtgaagaattccatcacgaagaatcaatggctgttaacacctagcagggtaaagataatctgaatgtttttatattgcttctttttccatttgtgccctttctttttggcagagtatggctgctctgcctttagtgtgttatacgtcagttagccctgataatatccccaatcagctctttctccccattagtttgtatcattctggtccctccttatcccatatgaaatagaaaatgagtttctgtaactctgtcttcgcttacagcttctggagtttctcatttagaaaatttagagtacattgtgagggattgagagttacatagtgtaacggagatcctggagcacatagtcagaagtttaagaacccagggatattaccagttggccaatagcttattaataaattactaaatatattatctcttatttagaggttgataatatctgtcaggttaga

SEQ ID NO: 6376 - DNA, 1037 bp, Homo sapiens
aaactcacaaacaacctagggaggggttctctgaagggcctagtttccagaatgaggcggtcatggcttaagcgaccatcatttgatcaataaagcagagtagcaacaggctgatgttggggacatcggtttgatgttataaaatcgtgcacatgtaccccttttgaggcctgaatgaggttcggttatttattcatttctcaataatttactcagccattcctagggtgacaagtttggagtatatcttctgtgccaggctctcttctaggtgttaggtgtatgtctctaacaagatagaaggaaagaagaaaagaaaaagaacaacattcctctctttaattgctaatcgcctgggcctagggagtcttcattttaaaagcaagtagccctgcttacaaatgtctcctcaatcaaaggcatttgccttaaacttgtatggtctaaactctaaataaataagcttctcaagggcatgacaactatatcggaaactgtagcatcttttcaacatgaattaaacagaacatgtgaaggatattagcccagatatcatgttattacatatatatatttataagtatacacacatatgtagtcttaataagatgtgatattccaaatggccctatgtgctgagtcacattcaaagaaagcacaaactgatgtagatgcctgaaatgatggtaacatttattattgtgacatttactgagggtttactatgtgccaggtattgttctgagaactttgtatgttaaaaaaaaagcctcgtataattaccagaataaccctatgaggtaaggactgttattatccccattttacaggtgagaacactaatgtactattattattctattttataggtgagaagactaaggtacatgaaaaatagtaacttccctggtacaacaaagtcagtaagaaaaccaaaatttaagcccaagaaaccacattccagccagggtctgttcttgcatccccactgcgaaattgccttattcaatctgagtaatgtgaatctgtactctaga

SEQ ID NO: 6377 - DNA, 1021 bp, Homo sapiens
ggccgggcgcggtggctcatgcctgtaatcccagcactttgggaggctgaggcaggtggatcacctgaggtcaggagttcaagaccagcctgaccaatacagtgaaatcccgtctctactaaaaatacaaaaataagccgagtgtggtggcacgtgcctgtagtcccagctactcgggaggctaggagaattgcttgaacccgggcggcagaggttgcagtgagcccagatcatgccacactccagcctgggtgacagagcaaggctttctcaaaaaaaaaaaaaaaaaaaagaacatccgtcgtggacaagactttgcactctttgcatgtattgtcacaactggttgctggaggtattaagcacatcctgtgtaactccattgggagaggactcttggaagctttcacctgattttgccccatgtgacttttcctttcttattttgctttgtatcctgctggaataaatcttagttgttaatattactgtatgctgaatcctttgactccttttagtgaattttctattttgggagtgggcttggggactcctgacacaggtactgatatgaagttatctttctttacttcatgatagcatctttttttgttcctcatcttttatattagtcctttgaaatagctatggactacctactacctttggtttcagactaggatgaattctagaggagttgagtaaattggcactaataggttaggaagtagtttactacttgttacactctcagtctcagaatttttgaactcaataaacttttaactgatatttaactttcttgattaaatatagcattttttctgataaatattataatcattgtatgtgcacaatcttaggcaaaaacatttttttctcttgtaaacacagtgagccatactcagaatcttctttgcagcaatgctaggacaatacaagagctctcattgaagaatagttgaactacaatgtcatgatgattgattttctaacactgaaatatttaggaggtgataat

SEQ ID NO: 6378 - DNA, 1050 bp, Homo sapiens
actggaaggggcaggagggaggtgttgctgtcactgtattaggttgatgttgggaaacgttttaacatgtggagcctttgtgggttgaaatatgtctccagctacaactctgcactggatctgaagaagcaaaaaaaaaaaaaaaaaaaaaaaaatctgttcagtctactcacaaaacagcacattgtggaatattatggagaattgtaccaaaacaggaaccatataaatgatgcatagggacaagaaagaggaacaattctatagcgcacaataaaggaaacctaagaatgggagttacaaatagtaaagaagcttttttctttttttatttaaagttttttttttaatccaagttttcccacatgatggggctttgttttgcatattgatgaagaactgcacaaacagaactaatatagttaaaatcagcttgccttcccatagtagaagcaggttcttggaagttacaatttaaggtaccccaaaaaagttggaaatagaacaaaacaaacatgaacaatgaagcaccctgtgaaatgccaaatgagtcactccttttaccttttttggggtgtgcaggctgggtggaataaatggggcttggtatatcaaactaaagatgacatcttaattttgcattgaacattaatgtagcggatataatttgatggttgcacttcattagatttaatttctaggccaatatgttattttttaaagtgcagtttaagggttaggcatgctttctggctcatagtggttgaaagtaatttaaattagtggggaagtagcatgcttgcatcacatagagtgagactggtattcatttacctatgttgcagcaatttgtgttgcagtttaccaatttagtgtagccctgctacactaaattgttccttcttaagatttgtgggttttattttcattaagaatatagacatataaagtactgtagtttacagctagtccttgaaatgtcttttttaggatctgttaggaataagattgatattgcattgtgtgtaacctgcacaatgtggaaagctg

SEQ ID NO: 6379 - DNA, 1051 bp, Homo sapiens
ttttttaatggggattatgttgatttttatagctttttattacaaggaattctgaacatgcaggacttgaactttctcatgtagtagttctcagactagagaaacctttcctgttttgtggcttgggttagtgtttagcagtatttttagtaaccgtcctaagtcagtagctatgtaagcactgagtgaagatggagtcacagggcaaactgggcttgcttcccacagggagggctgggttttgagcaggaaggaaggcctgttcagcagtgccttgggtacaactatgtctgagtaggcagccggtaacacaatgtctcccttgtgcaaagtaactctcttagtgagtgctcagatatgtgaggaaaaagtatttgggtaagtgaagaagcttggggtgtttcaaagagattcttttcgtgtttttgtggtatttgggtttaagggagtgtactgtttgttgctgcaaactactggctttgttttcagtggcattttagactttttgaacaagctcttactgcaggcagattgaagcgtcttactttccgaaaatgtgagcttaattttaaaagtgtgatttgtttgtgatgaaaagttaatttgtgcttcttgagatcagtgaaaattaattgtagcagtcctttataggaatgagttctcttaaaaatctgctgtttcctgtcattttcattctgaaatcagagccaacttgtgacagtgatgaaaaccacctaaaactgattatgagtgtttaaaatgtataatgttgatttcaaggttaatttgcctgttttaaaacagtgtggcagttaattgtttacatgactgtaatgtaaaagtattataatttacttcattttgaataatattaagttcagttttcaccagaagaactggttatgcttttagaaatcttgatattgtgattaacataaatggctgatatttttaaactattatttttatttgatttacagcatttaattatcaagctataagagtcaacttttatggagtatgtacatgtttatagtcttttgcttttgaa

SEQ ID NO: 6380 - DNA, 1087 bp, Homo sapiens
tactacttctctccattcttgtggatatttgactactgttttgaaaagaaacttttttgagctaaggaacaaaagagtggagaatcctttttggatatgagattgttaacttctcttgaggcagaaataaattatatgattgaattatccagacattgagcttacagcctagttcaactgtaactagaaaataggcattggtatatagtgtttttctgttggctggtctggggagatgattttttgattaggagttttagtgtcaaagggaagaggtggtagggaatggtgggaaataggtaaaatatgtcaaatatccactgtgagccagtcattgtactagctgtaccacgtaccatcttttgtgtttgggtgttttgccctgaatcatgaagcatgactaaatagcagctaataagaccaggccacttctaataatgaaaaaagtagcataattcaggtagtagtaggtgaattggtaaccaatgattggtaccataaaaataaaaaagtgttttttgaggttctttgtgtaaagttgtaaatctcttaatggttcttttctgtcattatggcctctgaactcttaggtactacacacgggtaaaattgactttattttttgtttatgtgatgacagcaaaattatgagaagaaaattgcaaaatctttgtaggtcatctttaaagtttcccaaatgctaatagaagttaaaagatgactgagttcaaaatttcatgtcattgcctctttaaatttgtttctaatgtgactgaatttaaaaaaaacaatgtgatacgtatatatagttttcaaaaaaattcatacactattcgaaggcttaatgaaaaaaacagtatgtctggccccctccccacctcagtcaacctgttctcatctgaacaggttactgtccaaagcttctctagagctgtcatgcagggacttacttttgccataatctgggactggatccattctttcgatagcatgtcttctttcttcctagtttattctctcactttgctggaatatatctttaatttacttcctaagagaggattaatgaatggcacactgttttagt

SEQ ID NO: 6381 - DNA, 1002 bp, Homo sapiens
ttattattattctgtccataccaaggatcatggtagtaatggagataaaaataaagaggacacagtttttaacctgtacccagtacattgttcgaaaactataggttaaaaccggttagtgggtcttaaaatgaattttcatcatgactagaatttttggtaatgaagtaaaacagtataaaactatcaaaaggacatcacacgtaataaggacaaatactttttcatgaaatttgtttttagtgagagaaatatatgtatatctccctatattacacacatggatatgtgcatacacatgtaaatgcatacctattcatgtatatatgtacttggttgtgttataaaatgtatttttattgtggatcagtgtccccaccccccaaaatagaaaactctgttctagtagataaacaatactatgctcaagactccaaggccaataaatcatagagctgggacttcagtagtaaataaggcagctatcactgcatcaataaaacatgaaattatcaataaatttactgagagacatttgtgatgttttatttttaaaaacctgagaaactttgtagaaaccatttacgttctgtgggaagaccaaatattataaatgctacagatattaaagtagtaatcaagatagctagcttatagtctaggggaatatacatgtattaaattaaataattatgagaatgatgtgttgcaaagggtaacaaattaggtgttataaaaagattgtgtaagatacaatctgagtgtataataaattgtgtgttgtataaagattgtacaaaatacaatttgagtgtatggtgtgtatctacagtttttctcagtacgatttacagatttaatacagtttcagccaaaatcataacagctttgtttttggaatttatcaaaatgactccaaaattggaaacatcaaaggataagatttgtgtacattgaaaaggagaaaggggaaaaaaccctttagagcagggtataatactg

SEQ ID NO: 6382 - DNA, 1054 bp, Homo sapiens
ttagtgtttgctagtcatctacagtaacaacctgaaagcaatggtggcttataataatgaaatttatatttcacttacatattggctgtagatcagctgggactctgcttcatgtgtcttcctcattctgggatccatactgagacggatcagcccctattgtgggacatgttattgtgccagtgggaagagaactttgataggatcacatgtgaattctgcttggatgtggcacatatcactttcaaaacaattcaaggggccaggcctggaattaatagggcagaaaagcattatttgctcgtaggttgcagagtgatttattgggaagaagattgtatataaagcaatcaaaatcataagagtatagtacagtagtcaatctcattctctcatcttggcttttcaacttgttgactacctgtccttgcccagattgcttcccaaccctgagctttcatcctactctcagtataatacattaagtcagcaggttcacagcaggccatctcttaacactcagttgagaaccattgacttaggtaatctctgatgacctcccagtttagaaaaaaaaaaattgtgaatttgtgactgacattttaaaagcaaagttgacctctttcctgaatttgtgtgtgtgtgtgtgtgtgtgtgtgtgtgtgtgtgtgtgtgtgtgtgtgtgaaaaagttttttacatgtaaagatttttttttttttttttttttttttttttagacggagccttgctctgtcacccaggctggaatgtagtggcgcaatctcggctcactgcagcctcggcctcctgggttcaagcgattctgctgccttgatttcccaagtagctggaattacaggcatctgccaccatgctcggctaattttttatatttttagtagagatggggtttcaccatgttgtccaggctggtctcgaactcctgacctcaggtaatccacccacctcggcctcccaaagtgttgggattgcaggcatgagccatcgcacccggacaagaaattatgttttaaagaaaaaaaattaattcc

SEQ ID NO: 6383 - DNA, 1046 bp, Homo sapiens
tgggttcacgccattcttctgcctcagcctcccgagtagctgggactacaggtgcccaccaccgcgcccagctaattttttgtatttttagtagagacggggtttcaccgtggtctcaatctcctgaccttgtgatccgcccgcttcggcgtcccaaagtgctaggattacaggcgtgagccactgtgcccggccatatgatagacattttgttacacagtatttatttcttgtccctgctccatttccttccaggcagattattcctagtctttcttatttaagctgagttgcaataggtcatacttgtcttttcttcagtattctggtctcttttgcattttaatcagcaaatccccaactgtgtcacctttcatccaaaatggtttagcagtgcagtttcaaatgacacaaatactgcatctcgtgccattaaaattgtaggatctaaagtctccattggacctaccatgcctctaatctatccttttatttaatctcaggacagatccctctcccattcccttaatgatctcttccaaatagctctctccaagttccatgcttagctatacttctcaacctctgcaggtagccttatgtttgttcatccagtaaatatcttatgcttcctgccttcttgctttcttttttttgtttttttggttttttttttttttgagacaaagtctcgctctgttgcccaggctggagtgcagtggcacaatctcggctcgctgcaagctccacttcctgggttcatgccattctcctgcctcagcctcccgagtggctgggactacaggcgcccgccgccacgcctggctaatttttttttttttttgtatttttagtagggacggggtttcaccgtgttagccaggattttcttgatctcctgacctcgtgatccgtccgcctcggcctcccaaagtgctgggattacaggcgtaagccaccgcgcccggcctccttcttgccttctaatttatctatatttgtctcattcttactcctttgttccagttacaggggaaaagtgtcca

SEQ ID NO: 6384 - DNA, 1022 bp, Homo sapiens
cagtcctctttgaacatcttactctcataatttcaaatatgacatatatggctaacatgtaaaactcctttctttcatgcttggtaatccagttgcccactggacacacttctattgtatgtcccacccataagtacttctaacacagactctctctctctcaccccccacatatgtgtgtgtatgtgtgtgtgtgtgtgtatttgtatgtgagatgtcttaaacattttatttatttaatgaaaaaactgataactgttgagctcagaaaccaataccccaacatacagtactttgacatactgaactgaagaaacctcaagatctcttctggctccatcatgtccccacctcccccctactgcccacccacctgtgtaacaatatatttaaaattcacacatattcctctttggacatacttgttgttcttctgtattcaccatttcttttgttggcgcagctattcaccatgtcactcaagctagaaatacagtgtcacccttgaatgctcctctgttcttttctcacatgcagtgaattgccaaaaatctcaaaattttgatttcttctctcccttttcatctatattatcactctcttgggtcaggctcctactcttatctagattattataatattttcataagtgcctagctcagttttcttgctgttgttaaaatttgtcctctaaacacctgtcaaagccatctcaaatgcaaatctgtcactccctagctaaggccatgcgtgatagtcatggctctctgtgatctggcccttgcatagtttactagccaattgcttctcaacattaatcagaacctatgtgcaacagcgacactgcttatacttctccagacgtgctatgctttccctcacctttgtattatattgtatggcacttagaatcctttaactaaaattccaagcctaccacactcctctatcttctgaatcttgtgcttatcctttggaactccactgtagtccctcatttctgatgtgtgatgtcacttctt

SEQ ID NO: 6385 - DNA, 1026 bp, Homo sapiens
ttgagaatgccctactctagagcggcacagtcctatacaactttctgtgctgtccattgtagtagcctgtagctacatgtgactgttgagcacttgaaaatgaaggaagagaattttaaattttgtttagttgtaattaatttaaatgtaaatagtcacatgtagctaattgacatcattttggacaaagcagccctggacctaatgatatctacttacatggatatggaaagctacctagaacaataagtaaagggcaagtcagtaaaagcagttttcagaagaaatgaaggaaaataaaaaacatggagttcagatttaggtggaggaaaaaagagggaaaagagataagaatgagccgtaagagcagaaaatgatacttccagaggaaagtggggcaattatttttcttatctgaggggcaaaatacccggatacaatggtgaaatgagtaacgcgaaaagaagaataacaatatggaagatgcctaatcattcacatgaaaatagttgatattactgtgaatactgctggaggttgttggttatgcgagaaatcaagattcattttaaacataaaaacttacgaaactatttttaagcatagtgtacagatccatgtacaagcatattcttaaaaattagcattatcttggactgaatttatttttatgtatttccaatactgttttaaaagcatttaacatcagtatttaaaaatatgaatattctgcacgttaagtaaattgtaaaatcttatgatatgtaccttttgtagtccatttgtttgaacacctcaagttaaccagagaagccaaaatattagaaaaaagaaacatttctggactcataccttcaaatgccttattacttatccccttgaatctctacgcagggagaacaggttagacccaaaggatctacctgacctgtcatgtaattacctgacctggattactctgaaaattgagtacatgaatacacagactgttgtatcggtatcagtgtgaaaaggtgcctacaagtt

SEQ ID NO: 6386 - DNA, 1047 bp, Homo sapiens
cacttgaggaggcagtctgtccattctcagatctcaaaccccatgctgggagaaccactactctcttcaaagctatcagacagggacatttaagtctgcagaggtttctgctgccttttgtttggctgtgccctgcccccagaggtggagtctacagaggcaggcaggcctccttgagctgaggtgggctccacccagttcgagcttcccggccactttctttacctactcaagcctcagcaatggcagacacccctcccccagccttgctgccaccttgcagttcaatctcagactgctgtgctagcaatgagggaggatccatgggcgtgggaccctccgagccaggcacaggatataatttcctggtgtgccgtttgctaagactgttggaaaagtgcagtattagagtgggagtgacctgattttccaggatccgtctgtcaccccttcccttggctaagaaagggaattccttgaccccttgtgcttcccgggtgaggggatgcctcgccctgcttccactcacactctgtgggctgcatacactgtcctgtccccactgtccaacaagccccagtgagatgaaactggtacctcagttggaaatgcagaaatcacccctcttctgggttgctcacgctgggagctgtagactggagctgttcctattcggccatcttctttggtgtaatctacatgctttcttagatttctttctggggtggttataagtgatactgttcgttaaatttcactttccctgtgctgattgctgatacttagaaaaaaaattgatttctgggccatgtgcggtggctcatgcctgtaatcccagcactttgagaggctgaagtgggcggatcacgaggtcaggagatggagaccatcctggctaacacaatgaaactctgtctctactaaaaatacaaaatattatccaggcatggtggcgggcacctgtagtcccagctattcaggaggctgaggcaggagaatggcattatcccgggaggtggataattgcagtgagcagagatagcgcca

SEQ ID NO: 6387 - DNA, 1048 bp, Homo sapiens
cctgcgaacttataggtactgtgacagatactttcacctaaattatttcaggaattaatgatctagcaggagagacaatttaatacaaagttgattgttttaaatgccatataaatagagttacaaaattaaaaatagagttataaaattactggagtggagatggggacagatatgagtaactaaattataggaactaaaagtaagagggttcttcgagatgaaccagtccagcctctgcatctgacaaataaggaaactgaggctcaaaaatcagtaattttctcaaggttacaaggcttgggaaagatccaaggaaaaaaagtttccctgattccaaggtcagtgctatttccacagacctgcaaaggtaaacatacctctttggtgaaggaaacaatgactgttttcttaaacatgtctatgaagttaccatctgaaagtttctttacttagtagtacagtgggtagaagcttggttctgcaaaacgcatagggaggatttggttgagaatttgtttagtataaatatagcctttgaaccaaaacatttcacaaacagcataacagcaggtagtatctatggagagcatctggggtcatcaccttattcaatgttttctaagctgtttttgccaaattagcaaaagaaaaaagtataataatttcaaaagataagatttttatttactagaatatcctaaagattgttaatttagtttttgtggcttttttttttcccttcatcaacatagaaaatggatcttttatgtttctgttttatattgaacaatgtgggatcacccttaaatttaaagaagtatttgattatacctgagtcaaagaatgttgatacggaaagtgagaaaaatttttttcatttcagacccttcataagatctgtaaacactgttaaactattatcgtaatttttaatacaatattatttttaagtcagattaattggtctgaaaaaatatacataatttcttttgcagatttaactgggtatgatcatgatttataggctgattttccttaatgatat

SEQ ID NO: 6388 - DNA, 1029 bp, Homo sapiens
taaatctatttaatgtttttgttatgtacaaatatattaaatgaaataatgaataatgcctaggaaaacacaacaatagcaaagcaaatacttgtggctgccacccagtcatggcaatccttggtgttgtgtgtggtctctgatgccattgtcctgtctttttcttgtctctgctctcccattatgccattggcaaggagttgagaagttagtccattacttctctgacaaagcgtggtacagtacaatttcggattttttcctaccaccttcctcataatcactttttttggtttttttttccagtttgcatgatgcatgtcagagcctgcatgaaagtacaggcatgttacagatggctctatttccaccttcctttttatggttaaaatgtatttaataataacaataaacttgtatgtacccaggaaaaaaattagctaaattctgtgtctgttatgcagtagcattattacactttagaacatttcctgctttctatttggtgcactttgacatatttttactccatcaggacttgacattttagctgccatcttttgctaataaccctagaacaagaatgcttatgaaaactggcatgagtgcttttccgtatgctaatgctgtagatctttgaagtgtcgtaaaacagtaaaggtgaactgttttgctcattggtgggtactactttgccttttttcatgttcattatgtttcccccaatgggtcactgtggaatcacctctttccagaaatactgctccacactgtggcttgagtttagtatctgaaagttatcctgggtaggctagatcatctaagaaggaaataggacattatccaggaaagttagttccttaatattggtattatatctgcctgtagtgttttaaaatatattaaaataatcatctggttatactgtatattctgaaagcctgtgaactcatcagaactaaccaaattgcacagaatattaaattttagtgctgtattttaagaaattatctgatggttcaaattctg

SEQ ID NO: 6389 - DNA, 1068 bp, Homo sapiens
aaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaagtgtttcttattacatataaatcagttatatattcctttacatcttgttttacaaacacatgtgcatgcacacacacatatacacacacataccatttatgtttgtatttgttactgggtaaattttggagcgcttgagatacaccttgaaacctgtacctaaagatgtattcatttgtaacatatgttggtgctagagttttgctggtaattcaggcttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtat

SEQ ID NO: 6390 - DNA, 1050 bp, Homo sapiens
ggatcctcacccttaatactgtatgatacccgcctagtcaaacaccctgaagggtcctcctgtaatactaaaatccaaagttcttaacggtgaaaaggccctgcatgatctggcccctgagtactcctatcccttcctaccttgccgggcctgcctctgtctactactagaacatgccaagccagctcctgcctgtgggccctcttcgtacttgttccctctgttagtcctcaagagacacacacaactcattccctgcatgctttcaggtctttgctcaagtgtgtctctcagtaatgttttccttggccatgctatttaaggtcatccagcaccctgtatctccttttccctgctgcttttctccataacatagtcattacgtttgctttgtgtatgaacttgtttattatctatttcgtttcacaagaatataaactccatgaggacgaggatggctgacttttgttcattttatatgccaagcacacctagaatagtgcctcacacacagaaagtgtgctataaatatttgttgactgaatacctggattaattgaagctttaaattgtgttcagcggccaggcacggtggctcacgcctgtaatcctagcactttgagaggccgaggcaggcggatcatgaggtcaggagatcgagaccatcctggctaacacggtgaaaccccgtctctactaaaaatacaaaaaaattatctgggcgtggtggcgggcacctgtagtcccagctactcaggaggctgaggcaagagtatggcatgaacccaggaggcggagcttgcagtgagctgagatcacaccactggactccagcctggacgacagagcgagacgccgtctcaaaaaaaaaaaaaaaattatgttcagcttacacttgtaatctcagcgctttgggaggccaaagcaggtggatcatctgaggtcaggagttcgagaccagactggccaacatgatgaaaccccatctctactaaaaatacaaaaattagccagccgggtggcaggtacctgtaatcccagctacttggg

SEQ ID NO: 6391 - DNA, 1045 bp, Homo sapiens
agacctttctgttggaataattctcaattctttgtttatgtgtcttctgaatcacgtttttttgtttgtttgttttgttttttcttttttattcagttgctttctacatatctgtacctgattgttctgagctgcttttccttagcaaacttgcctctttggtgttctttatttttgttgatgtcataccaaacccaaaccttttcccatttcatcatatcttgtctgtagccaacatctgttgattctgctttatgatattgtaactcttctgctctctattcttgctaactgtggggcaattctgaattcatattggtgtgaaggtagtagtcaaatcataaaacgagttgggcagctttccttctttttctctttttcaggatcattttagactgggattatctgttccttgaaagtttggaagacctcccctatgtgaccatttaggcctagatcttttttctggagaggactttgagtaacacttcaatttctttaatagctgttggtttgtgtcgattttctgattctcatatgaattttaatgtttcacatttttttcaggaatttattttcaaatctagtgttatttggctttcacgtagttctccccccaccaccccgcgactccacccccaccccctaactctaaatcaagttctcatcccacctggactaatgttatgattttcttgccttcacttttctcctttatctaatcttatgtatttctgcctaaattaatctgtaagcccagttcttaccacttcgccactcagaagtttcctaggtcttccattaaatgaaatattttctgtggtatttgcctcagatttacctgtttttttttttttttttttttaataccttattgttttttctttctttctttctttctttctttttttttttttttttttttttgatacagagtctcgcactgtcgcctgggctggagtgcaatggcgtgagctcagctcattgcaacctctgcctcctgggttcaagggattctcctgcctcagcctcccaggtagctggg

SEQ ID NO: 6392 - DNA, 1058 bp, Homo sapiens
gtattctcacatccctcaattattacggaatgaactgaccatgcttctagccagggccaaaacctgcactgtgctcactcagcccttgcctctacactctgcagggtcattctcctccacaacaacatactgttgtttctctcatcttaaaacacaacaaaacttctctgaactccatttttccttctaaccgttgttcatttcccaccccgaccccttttttccctaaaagaagtatctgcactttgtttccaatttttctcctcctgatatttcaggaggctttccctcccagcaccctgtttcttgcactgctcttgcgaggtcagctctgaccctacctttctcatccttgaattatttgacctagtaacagtatttgacactggtgattacttatttcctgctcgttgaaacactttgttcacttggcttccaggatagcatacaaagaaattccccatctcagtcttttgtcacagagtccctccagggctcagtccttagacctctgttttaactatgctcatttccttgttgatcttatttgacccactggctttgaaaccctctttgttttaaagtttgacggaagtccaaattttaaatctccagcctgagccgcttctttgaaatgcagacttatgttccacctggatgtctaataggcaaatgaaatgcagctttctctaaagggaacttattcttcctccagtaacttaatgggccatgcttagaatggctctttttgtccaagaaaattcaaaaccaaaaccaaatctattttcttctgctttaacatcagtctacagattatttttggtctaaagcatgagatagggctttttatttatttttaatcaggcggctagctagtttcttaacagtattgaataatatatttttaattgtttgaattgtcatctttattgttctgagaataatatcaaggatttaagtgaaattgccatctaatgtttgcattatagatttcatgcccctttaaaacatgtgttatatcaattgagagcacactcttataaagtacaatcaatgat

SEQ ID NO: 6393 - DNA, 1046 bp, Homo sapiens
gtcaggctggtcttgaattcttgacctcaggcaatccacccacctcagcagaactcatttgggcctgttgttttctgttttggaaggttactgcttactgatgcaatatctttaatagatataggcctatttggattatctatatcttcttgtgtgagttttggcatattgtgtcttttaaggaattgatccatgtcatctaaattatcaaatttttaatcatgtttgttcataatattcctttataatccttttaatgtacatttagaagggatctgtagtgatcttttttttcatttctgatactagctatttgtgtcatctttttaattaattggcttagctaaaggcttatcaattttatgatcttttcaaagaaccagcttttagtttttcttactgatttcctattttcagtatcattgatactattatatttttatttcttttattccacttactttggatttaatttgctctttgttttctattttccaaaggtggaactgtgagctttggtccattcaacttatttcatgtaacgtcaattcaccgaaagagttaagagatttgaagcaatggcctgagtttgaatcctagttctccactcattgacaaaccacttgtcctgtctgaaccctatctcccataaaatggaagaaggatattacttaagttatgagattgcttgaaattcagttacaatgtgggtgaaaactgattttaaactgtgaagtgctacagttttgatattatcacttccttaaatgtacaaagattatttctttacaatcaccattggaattttgcctcaatttatggtcaaactttgtctggttttcagtttccagaatttccatctctcacctgctacccaaatcaggatggctaccaaacctgcccatcttcagtaatctttcgtttctctgattcatcacaggttacttatagggatccagttatcttccctgaatgtttctcagtatttgaattgtaaattataatcctgtcttggaacaaaagaacttgaactcatattgagtcct

SEQ ID NO: 6394 - DNA, 1035 bp, Homo sapiens
cgttcctaggctggtctcgaactgcatgttcccaggctggtctcgaactcgtgggctcaagcgatccacccacctcggcctcccaaattgctgggattacagacccgagccagcatgcctggcctcacagatatttcttgatctacattttattcattatttaggtccaactttagcatgtgtcatgtatttatatacaggttctaaatctttccatttgaaaaatactcatttttctatccaaaatgaattcaattttcctttttattctagtcccagtctgtgtatgagtaaaaccccaaggaccctgtatcctgattttactattttttgttaatggtttgaaacagctttattaagatataattcacataccatacaattatttaaagggcacacacttcaatggtttttagtatactcacggatctgtacaaccattatcacagtcatgggcaattggttcaggatttgggaagaaaacgtatggcattaggattaaaagtacaatgtttagagtctggctgatctgggtttaaatcccaaatctaccatgtattaactgtgtgactttgagaaggttacttaatcactatgagcttcagttttctttttttttcccgtttttatttttatttttatttttattttgaggcagagtcttactctgtcacccaggctggagtgcagtggcgcgatctcggctcactgcaacctctgcctcctgggttcaagtgattctttgcctcagcctcccaagtagctgggattacaggccaccatgcttggctaatttttgtatttttagtagagatggagtttcaccatgttggccaggctggtctcgaactcctgacctcaggtgatatgcccgcctcagcctcccagagtgctgggattatagatgcaagccactgtgccggcctgagcttcagttttcttatctgtaatatgggattactagtggtatctggctcataggcttattttaaggattaagcaagataataaatgtatagaatttagcacagtaac

SEQ ID NO: 6395 - DNA, 1026 bp, Homo sapiens
ttaaatttcaaaatagaattttgtaatttactcttaattttcttagtatgttgtattccaaaattatagaaagtgctataatagacatttatgtacattacataaagtaatagacatttatgtaatgtgggcatagatttaaattttttttaaattgttaaaatattaacatttaaccatgtctgctttagataggtttaatcttacaaggatctatctacttatctttctatctatttataatgtatatatccattttaaataataataacaatacatgaataaatctggtccaaacttctatcttgagaaatgtaacagcaattttgaactccttcatccctcaagacaattattcctcccttcccagaggtaaccatcctcctaaatttgatgtcattcccttagttttttcttaagttttaccacatttgtgttgtccctttaacatacttttttttttaagcttttcctgtttttgagctttatacatatggaattattctgtatatattcttcttgggcttgatttttttatttatattacaattttgagatgtcatttatgttgacattgttagccgaagttcattaatttttcactatttgatataatattccaaattactggaatatggaatattctatgaatataccacagtccattttactgctgcttgacacctcggtttcacctagtttttggtatggaaaaaatactgctttaaatattcttttgcgtggctcatggtagctaagtacaaaaggttctctaggttatatgcatagacctggattgttgagtcttgggtgtatacaccatcagctttactaggtatggcagaatgtcttcttttacacagttgtggaataagccagatgagttcaagaggagcaagtttgtgagaggatggacaagtgagttagtgagttacatttcatttgttttgagttttagcctatttagttagaaatgttaagtaggcatttgagatgtgtttacttttttagctccacccatctttg

SEQ ID NO: 6396 - DNA, 1023 bp, Homo sapiens
catcagctggagggtggcagaagaagaagagggtaatcagacaccttgacgggaggtttgctaatctggcttagcagggttctttgctaaaacaggaatttacaaggaagtacacagataggcctgggagaaaagttcaggagcctggctcatttggtcaagcaaagaatctttgccagagcccaggggtgtgcagttggtggcttacctgtaagtagctgtgccattttacatgctcactggcagtgtatgagagatccagtttcttcacattcgtgtccacatttggtgttgtcactatttttttattttagctgtgccagtaggtgtgcagcatagtttggtttgcgtttccctgatgtctagtaatgttgaccatatcttttcatgcgcgtatttgccgtctatatatcctcttcaataaaatgtctttatatttcttgcccattttctagttgaaatttttttcaattgttgagctttgagatttctttatatatcctagatgaggcttttatcacatatattgttagcaaatatattttcctagcctgtacctcatttttttgccttcttaaacaggtcttttgtagagcaaacatttttaattttgttgaagttcagtttatcgtgtttttttttctttcatggattgtatttttggtgtcattccccattccccattccccactctccagccccagacggccacgaatctactctcggtctctgtgaaattgcctattctgaatatttcctataagtggaatcatatgtctggcttctttcacttagcatatattcaggcctcatccctgttgtatcatgaaccagttctttttatggcttcgtttatttttaaggttgaataatgttccactgcatggataagaccacattttgtttagccatttgtcagctgatcggcaattaaggttgttttcacttcttcgtctgcatcagtacagctgcatgtgtacccttcagccctgcaccttccttatacacgatgcacagatgtac

SEQ ID NO: 6397 - DNA, 1030 bp, Homo sapiens
caggtagaacataggaggttatgtgagctgagctttgaaagatgagtaaaatttagatgggtaaaggatatttctggaaaagtgcatggatagaaaatgaatgtttttgtaggaatgtggtgaaggtcttagaaagggcaggaagtatgatgtgaagaaagctcttttagtgaaattactctagcagtgacatataaactatacatcattagagaaatgaagtgaggaggtagggagccgagtgaggagattgtggcactagttaggcataagctgatcagaattcaatcagggtggtgattgtggaaatagaaaagaaagactcaatgataaaggtattgcggcagaagaagggacaccgatgtgtgactagatgttggaaagagatgatgccgcctgaattttgagcctggatggtggggataatgttggcctcattagtagccaaggtaagttggatcctacttttctaaatgtagagaaacattaaaatttatgttttactgtactgttggtctcttaatttgtttatgtgcaacaagtttttttggcattatttttccagccttaacatattcaaagggagattttatgaaaaaagcaaagtatgacctcttttacaaaagcagtttttaaggaaataaactgtattctgttcatagttacctcttttgctatcatgttaaatgctatgtaagatttagtaaaacttaagaatgtttaaagtatttctacaggtataattcagacaccattaccaaaggatggtatcttgttttaatagaattaccgcttaaggaatggggacctgtgaaaaattcattcagtagaattcgatggttccatattaacagataggcattattatggtactgtccattagagaaatattgtacagtaaggcagtaagttaattatataaaactggcttttaaaatgcatttattaaaattcttatcaactgttaactgatgactgatttagaactttgcaatatttagaaacagtctaatactctctgttgaaaata

SEQ ID NO: 6398 - DNA, 1048 bp, Homo sapiens
tgcctttaaaaaagaaaagtctgaaatacccctcacaactgttaaaaaaaaaaaaaagttctttcaagcacacgtggagtgttttatgaaagtgaccatttactaggctatacagcaagttcttatacatttcaaataaaatcaaccatgttttctggcgagaaagcatgtaggaagtgaataacaaactgtacacattgggaaatttaaaaacacacttctgtaaatcccacagattaaatataaaataatcaatttagtgaacacctagaacaaaacaatagagaaaataacagcctgagcaaaatagtgagaccctgcgtctacaaaaaaaaataaaaattagcccggcacagtggtgtccccctgtagcccctactcagaaagctgagatgggaggattacttgagcctgcaaagttgagtctgcagtgagccatgataacaccattacactctagcctggactacagagcgcaagaccttatttcaaagaaaaagaaacttaggacatattaaaacgtgtgtgaaaccctgaagccttaaatattcatatttgaaaagaagattttaatactaataagctaatctaagttagggaaagagcatggcagtaaattcaagtgaagtaaaatagagaatacagataaaagctaacaattctagagttcttactctattccaagcaccgttccatgttctttacaaaggttatctcatttaatcttcacaaagccatatgaggagggtattgttattatgtgcactttacacaagaggaaacttaggcacagagagaaacttatccaagcctctagctaataaatgtgatagaattggggcttgaaatgatgaattttttaaaaaaagatacattgaagaggattaacagagctgaaagttgttttttatgaaaggctaataaactatttgaaagattgatcaagaaaaaatataaagtacaaataatactgaggatataaaaggaagatacagaagaaagtcttaaaaataaaatatcttgaatcactttataccaataaatttta

SEQ ID NO: 6399 - DNA, 1051 bp, Homo sapiens
agactcttccaagctgttgagactccctccaggcaggggaatgactatctgggtctgagattatgtcattaagttctttttttttctttttctttttttttttttttctttttgagacagagtctccctctgttgcccaggctgggatgcagtggtgcaacctccactccctgcaacctcagctgcttgggttcaagcagttctcctcagcctcccaagtagctgggattacaggcacctgcctccacgcccagctaattattgtatttttagtagagacagggtttcacatcaggtctcgaactcctgacatcaggtgatcaacctgctgggattacaggcgtgagccaccacaccctgcgtcgctaagttttttaaccagagaggcttcaggtttcagacacacagaagcataattctggccatacaaaaacctcagtttcttctgtcttccacccaatcaaagtctccttcaaaactttaagtaagtttctatttgccacttcaggacacacctgcactgaactagacactgacttagaaacttggtttgatttggcaaattttctgttaaaatgctccatacttttcttatgcctattagagttatttctgacctactgtatttactttcagaattttctgaagctataatctttcaggaaatagtactattttttgaaatagtatttctattttttgaaaatagtatttctattttttgaaatagtacttttcaaaaaagtactatttgaagaactcttgagtatttactttctgtaaaggaagttcacatgtggcagctttctcctgagtatctaatttgcaattgcctaactgctcagtgacatccactactgtctgttctttgtgtttggcattagctttgagaccagctttctttttcattatgcttttttggtgcagctgtcgtctaatacttgttgaatttggtctgtttcctggtagaatggaggaaacaaagtcttgctcattatcactgctgctgtcattatgagtgctggaagaacaattgctagaagattcatat

SEQ ID NO: 6400 - DNA, 1048 bp, Homo sapiens
atatatatgtggaaaaccctaaaaacttcaccataaaacttttagaactgataaatgaatttagtaaggttgcagagtacaaaatcaatatacaaaaattagtagtgtttctatacaccaataatgaactagcagaaaaagaagagagtaatccatttacaaaagctaccaaaaaatgaaatacatttgaccaaggaggtgaaagatctctacaaggaaaactataaaacactgatgaaggaaattgaagcgggcacaaaatatggaaagacatccatattcaaggatttgaagaattaatactgtgaaaatgaccatactaccaaaagcaagctatagattcaatgcaatccctatcaaaataccagtgacagtcttcatagaaatagaaaaaaaatcctaaaattaatataggaccataaaggactgcaaatgccaaagcggttctgagccaaaaggacaaagctagaggcatcacactaccagacttcaagatatactgcaaagctgtagtaactgaaacagcatggtactagcataaaaccagacagtagaccaattgaacagaatagagaacctagaaataaatccacatatttatagccagctggcaaaggcgccaagaacatgctttggggaaaagacagtcttcaataaatggtgctgggaaaactggatatacatatgcagagtgaaactgtacccctgtctttcaccatatacaaaaataaactcaaaatggattaaagacttaaatgtaagacaaaggcaccaaagacaaagtgaatcatctattttcttttattattattattttttgaagtatagagatggggtctcactacattgcccaggctggtctcaaactcctgggctcaagtgatcctcctgccttggcctctcaaagtgctggggttataggtgtgagccattagcgcccagctaaatactgtattttcagcccatgtttgcctgcaatatgaagagattgctatacttattgaaaagaagagaccggaagtggtggttcatgcctgtaatcccagca

SEQ ID NO: 6401 - DNA, 1049 bp, Homo sapiens
gtaagtgcttggaaggggcaaggcagcagtcccggggaagaccattacaggcatagggatctgcacgtgccagggtcctgcagcaggactgtgagcggcaggtgcaaggaacacctattaggctggaacggagggagggtggaccactggagactttagctttttgtctgagtgagttggagcaccgttggagggatctgaatggggtgtgatgtggtttaacatgctttctcttaggatcactctggctgctgtgttgcaaatccatagtgggcacaggtggaagcaggaggccagttaggaggtgccttcagcaatccaggcaaaggggttagtggcttggtccagagcgagcagtggaggtagtaggaagtgtgtgggttctggacagattctgcaggtacaaccagtggatttgatgacaggaaatggaatgcaagaaggaaagagggagttgtcaagaatgacttgagattttaggcctggttacatcagtgtagcgatattctaaaaataaaaaaaaaaagattttagacctgggacttttaagattttacaccaagtaaagaggctgtcaacggaggtgggaaagacttaggatctagcaaatttgggagggaagaggcaaggaaagataaatagtgacaaattgtatagttgctgataacattgttaagtcaatatttatactatttgagctgcctttttttttttttccccctctgagacagtctcgctttgtcgcccaggctggaatgcagtggcacagtctcagctcactgcaacctctacctcccaggttcaagcagttctcctacctcggcctcaagtagctgggattacaggcacccaccaccaggcctggctaatttctgtatttttagtagagatggggtttcactatgttagccaggctggtcttgaactccccgcctcaagtgatctgcctgcctcagcctcccaaagtgctgggattacagacgagagccactgtgcgggccttagctgtcttaaaaatagcacttatagcagcctgtgttttcttttca

SEQ ID NO: 6402 - DNA, 1049 bp, Homo sapiens
gcaagatctgacagcgtggacaccaaggcaggcatttcggtaagatttctgtgtattacctcagatacactcagacaactctttaagcaagttattttcttcagggtttatgtttagatttgcgggatattgttttctacactgatgtaaataactgcgagtggtgttgctccagttgtacaagtgtgtattcctctaaggattgatggggaggagtgtagagaacgggaaggaatggatgagttgcttgttaagggaaaagatgatattcttatgctaatccaggccctggataaggagcagagcagccatgcgaacaatggccttggagccaggaagtctgcagtgagtctattccttctcagaaagcttgtcagacccggcgcctggagctgcctggcggggagggacccctggaaaggagagttttctccttgctattttatggaattggctgctggccagcttgttggaaattcccaaacttctctactagaaagtgaaaatcaacggtggggggcttaacaggaagaggaaggaatgactttactctgtagtctgttttttcaactgacttcagccttttcctgtgtttttttttttttaagttccaattgaactgttggttcagttgtcttgctgtttgaggagttttaaaatcttttacttaaaaaagaaattatttatatttgagtaattctgccttaatgttattttcctgaaaagaaacagtaccagtctgtgtatatagcaaggggaagtaaatttatttagatgcccatttcgtctaactattcaatagcttttaaatggcagcatgattaaaaaattttgattatgcagcatgtcaaatatctgcatctccttatattcttcactttgcaagattagatatttttaatgtaaaaattccgatgaatcatttaggaatttaaaaaatatattttatcgttagatattacaattacataattttaagaatgattgtggccaggcacggtggctcacacctgtaatcccagcactttgagaggccgaggtggacagat

SEQ ID NO: 6403 - DNA, 1085 bp, Homo sapiens
agttcctgtaaagttgtagtggtcctacattctgtttgctctgatctctttggtttcactccattaaacacagttaaatatcttgtcttgatgtgtgttctgagaatttctgacctagccactggcctctgctttgcctgttctcctggcctttggtttagtgacctccgctctgaggcactctgctcctttcccatgctagaaaatgacctgctttatttggtattgtagcacttacctatgaataaatattaaaatagtaccaaatgtcagtatttattcatctttattgtctttctccgtcgaagactgtaagctttaatagatatgggactgtgttttgtttactcttctagtcacccagggcttaaaacagtggctaccaccgtgtactcactcagtacattttggtttaatggatgaatacagttaaagtgaaaaaagcaagttgcaaagctgctttcttagccatatatttttacactgaccaacccagtaacaacaagcacctgtaacaacccagttgtagtatctgattgtcttttttcactaaggatctagaactccttggagaaatcactgagttcaagttcggcagggaaagagcaaggtgatcttggtattttggccagaaagcaaggaaaagttcaaaggattcagtgaccagtttgaattgaatactaattgtagtggattcaaacaaatcaaatatgtttaaatccacgtgtttgtaataacacttaagaaaaaaactagttagggctgagggctgtgacttacacctgtacatgccaacacttgggaggccaaggcaggaggatcacttgagcctcaagagtttgagaacatccacggctaaactgagagtccctttaaaaaaaaaatagtttgagaccagcctgggcaacatagagctggtctctacaaaaaaaaaattttaattagctgagtgtggtgatgtgtgcctgtattcctggctgaggtgggcgggagaatcacttgagcccgggagcttgaggctgcagtgaaccaatgatgacgccactgcactctagtctgggcagcagagcaagactctgtctcaa

SEQ ID NO: 6404 - DNA, 1074 bp, Homo sapiens
tcagtttgggagtgatttgctaacacagtattggataatccagtgtccgactttctgaaaattgactttcaagcagtcttcttggtgttattgtcaccctcaactttacttccagacataaccacaatggccagttccgaagttcttgggggaactccatagtataaactggttgcttcttggttttctcaatttctaacctaagaatcagactttttgggtgtgcaaagtcactgctcattcatctgcttcatgaattccaacagtgtttactgttattttatctccttttctccttgcctgttagataaagaagtttaaaactctttattgctgttttagtggactagtaaaagcaagcaagtatgctcaatcggttattttaagctcaaagtccctttgtcaaataactgaatctttgccagtaagacaggtgataatatctcaaggtgattttaatttatattttcatattaaaatactttttttatacattggtttctttattacacaagggcactgtaatgtatatattattttatttatttatttatttagaaatagagtctcactctgtctcccaggtggagtgcagtgatctcggctcactgcaatctctgcctcccaggttcaagcgatactcatgcctcagccttgcaagtaactgggattacaggtatgcactgccacacctggctaatttttgtatttttagtaaagacgggggtttcaccatgttgaccaggctggtctcaaactcctgacctcaagtgatccacccacctcgccctcccaaattgctggaattacaggcgtgagccaccgcacctggcctctaatgtgtatagtaaaatattgttgagtatgcttttatttttcttttaagaaaagaaccatctatatttttatttaaatcatgtattcattttggggggcctgtttttccattgaattgcatagatttttttctctttgatttatagaagctctttatatttcagaaatcagccctttgtaatatgagctacctatacttttctttttttgtttttttttcatgctgcgttacctcag

SEQ ID NO: 6405 - DNA, 1027 bp, Homo sapiens
atcccagcactttgggaggccgaggcgggcggatcacgaggccaggagatcgagaccatactggctaacatggtgaaactccgtctctaccaaaaatacaaaaaaagaaattagccaggcgtggtggcgggcgcctgtagtcccagctactcgggaggctgaggcaggaggatggcgtgaatccgggaggcggagcttgcagtgagccgacatcgcgccactgcactccagcctgggcgacagagtgagactccgtctcaaaaaaaaaaaaaaaaaaaaaaaaaaaaaaaaaaaaaaacactttgtccttttatctgtctcttctgtttttgagactccaattatacatattttagattatttggtgttgtgccacagctctttaattcttcagtttttctcacttgttttttctctttgtattttagttcaggtaacttctatttacctattttcaaatgcacagatttttttttttcttcacctgtgtccatctgagctgtgtattgttgagctcatcaaacattcttcatctttaatagcatgttttccctttctcacattcctgtctgacttcatttttctgctgagactctccatctgtgtattctgttaccaccttcaccagttgccttccccttttaatcacagttctgtgaaaggccctcctgacagcttcagcacaagtgctgtctgacacttggcctcttgattgcctgccctcttggcagtgagtgattattccttgctttttaatgggtctcataagtttatttggatgttgtacatcatgttaagaatagcagagattgtcacaatgagatatcaacctcaccccaattaaaatggccattatcaaaaagaaaacaaatgctggggagggtatggagaaaggggaaccctagcacactgctggtggaaatgtaaattggcacagctactatggagaacagtgtggaggtccctcaaaaaactaaaatcagaactaccatatgatcttgcaatcccactatttggtatatatcca

SEQ ID NO: 6406 - DNA, 1034 bp, Homo sapiens
tcacatttacccacatagtttcacgttgtcccatgttttttttacctactctaccaattatttttgccctccagaagtaaatgaggcagagatttgaagggcatcactttattccaaagttgatcattagtgagggggatttttacagtcttctttccctcctccctcagctgcctcctggttagagatgctaacaagaattacgatggtcctaagatactggaggaagtaaaaaagttgaaggccctacatattttagttcacgtttggcatttcttggtctttaccctatgtaaggcaaggagaaaaagacatgaaatttaaattacagataaacacaagtgtattagtccattttcacactgctatcaagaattgcccaagactggataatttataaaggaaagaggtttaattgactcactgttccacatggctggggaggcctcaggaaacttacaatcatggcagacagtgaagaggaaccaaggcatcttcacaaggtggcaggaaggagaatgaacacaggaggaactatcaaacttataaaatcatcagatctcgtgagaactatcacaagaacagcatgggggaaccgcccccaagatccaattacctccacctgatctctcccttgatgtggggattatagggattacaattcaagatgatattttaggtgggggcacagctaaaccatatcctacaaggaatgactgaaactaaagatactaatttcctttcccttggttggccaggctgtcgtcttcattactgactaatagagaccaagcaggttggtttaatcccattgccctctagtgctttccaatgttggccaaaatgttgcctccattttaaacattcctcctggggaagaatgtctttctatcatacgataagggagaagagaagaggaagcaagagaaaagtttaaagtgttgtacagaagtttccaaccacaggaggagcaaaacaccaaagaagttgtagaatacagggtgtggtgaagagttggagcccaggccgtgctg

SEQ ID NO: 6407 - DNA, 1045 bp, Homo sapiens
tatttttctttttggattaaattatttgtttatgttctgaggaaaaatctttaaaagcttagttttattgtttttgttgttctttataaccttagccttcagaaaaataaatgtttaactttgcttcttctgtgacttgttcacctgaattcaagaaggtggaattgggcctaaggaggtggctcacgcctgtaatcccagcactttaggaggctaaagtgggcggatcacttgaggtcaggagttcgagaccagcctgggcaacacagtgaaaccttgtctctactaaaaatacaaaaataagccaagcgtggtggggggcctacaaaaattagccaggcgtggtggcggggagggggttgggcagtgcttgtagttccagctacttgggagaaccacttgaaccagggagagaggttgcagtgagccgagatcgtgccattgcactccagcctgggcaacagagcgagtcttcatctcaaaaaaggaaaggcagaattgaagaagctttggaagaggtgaggaatagagctgtggaaattactattttttttttaattgagaatctcctgtgtgtaggtgccttacaaactggcttcatgagtaccctataaaacagatgtttttatttttaaaatcatcatggttttgttttgttttgtttttttgagacagtcttgctctgttgcccatgctggagtgcagtggtgcaatctcagctcactgcagcctctgcctcccaggttccagtgattctcctgcctcagcctcccgagcagctgggattacaggcgcccgccaccatgccaggctaatttttttgtatttttaatagagacgaagttccacagtgttggccaggctgttctcaaactcctggcctcaaatgatctgcccgccttggccaccgaaagtgctgggattacaggtgttgagccactgcacctggtcattatgttttaaaattacatacaagttgttaaaaaaatatgaacagcagaaatagattttagaaaaacagaatgaaattatccatctcttcccc

SEQ ID NO: 6408 - DNA, 1028 bp, Homo sapiens
aagattcaaacctgtgtatctgactccaaagttatactatttatactattccaaggagtattttaagtatttgttccatttagttagaaattatttactgtgatataaagtctaatgaatttcaactttagatttatgattgcttttgtaaaatatacagataatttgcaaagtaaggtttttttttatttttatttttcgagacagggtctcactgtgtcacccaggctggagtgcggtggcacgatcacagtttaccacagcctggacttcctgggctcaggcaatcctcccacctcagcctcctgagtagctaggactataggcacctgccgccactcccggctaacttttgtctttttggtagaggtggggtttcactatgttgcccaggctggtctcgaactcctgggctcaagcgatatgcccgcctctgcctcccacagtgctgggattccaagtgtgagccaccatgcctcacacaataaagtttaattatttgtagtaatttcccattcaaacgaagaccaaaattcagcttgaagggaacattcaatagcattccacaaagtcaaatgagttttctgccttagagttttccttagctggtttaaaattccaggtctgtttttcttgatccatagcatgcttttttctctcttaaaaatattttagaagaagattgttaggatttagaaaaacatagcatataaattcttgaaccattcatttttaaaaataatttaatttgaaaggtaaaaatatactttctactttctgtctcactaaatcagtctattctggacttttcctataaaagatgtatgtggccctttgtgaccgtcttctttcacttggcagagtattttaaaggtttatgcgtgtagcatgtatcaggtacttcatttcttgttatggctacatagtttttgttgtatgactgtaccacattttaaaaatctattcatcattgatggacacttggattatttccactttttgactattctgaatgatgctgcggtgaa

SEQ ID NO: 6409 - DNA, 1491 bp, Homo sapiens
catcttctgattcattaacatgggatatctttctgtatatgtaggtcttttaaaacttctctcaggactgttttatcactgtcagaggataagttttgcacttcttaaaaccaagtaagctaagttagcaattcccaaaaattatatgagatggtaactcccgaaattctgtggcataacaagattatttccttaatggcaagcatattctggccccagaataatttagaatcaagtatagaattcaagagaatcaaggctgcagcagtaatactttgagtctatacccttgtgtatatttggcttaaatgttttaggagaattggcctttgaaaatttaagatatttgttatttcaaaataaaatgtgtaatcaactaatacaaagcaagttttgtactttttgttgaatttattactaagtattctttttgatgcaattgtaagtagaaatatttatttattaagagatagggtcttactgtgtggcccagtatggccttgaactcctgggcttaagacatcctcctgctgcagcctcctgagtaactgagattacaggtgtgcaccacctcgcctggctcagaatggttttcttaacttcatttttagattgttcactgtgaatatatcgaattacaatagtttaggctgggcatggtggctcacgcctgtaatcctagcacttggggaggctgaggtgggtggataacttgaggccaggagtttcagatcagcctggccatcacagagaaaccttgtctttaccaaaatcacaacaaattaattagctggttgtggtggtgcatgcttgcaatcccagctactggggaggctgaggtacgagaattacctgaacccaggaggtggaggttgcagtgaaccgagatagttccactgcactccagcctgggcgacagaacggtttttgtatgcttcaaccttactgaactcatttattcattctgatatttactttagtggattctgtatgattttctatatgcaagatgctgtcatttgcaaatagagatagtttttctttttttgtttccaatctgaatgtgttttatttcattttcttgcctaatgctcctcattagttttcaatgttgcatagtattttattgcatggacgcaccataattacttttaccaatctcttattgatggacatgaaggttatttccaaactcttgtggttataacaatgctgtaatagataacctattacaaagaacagttctcaactcttttggtcttgggactactttacctatttatgtataagtttcaagtttgggcttagaaagaatttaataatcatgctaattttgttttgttttctttttttttactcctggacccaagcggtcttcccacctcaacctcccaagtagctgagactacaagggtgaaccatcaccctgggtaatttttaaattgttggctgggcacagtggctcacgcctgtaatcctagcactttggga

SEQ ID NO: 6410 - DNA, 1042 bp, Homo sapiens
ttttttccttttagtgagcatgctttaacaaaaaacaataacagaaactgtgtcaaagaaaaggacctgtaatcttcagggtttgtagtctttttcctcttaaaaaacccttttcctaattaatggcagttacatctgcatggctggtttgggtaagtcttcattttgttgtattgctgagtaacagtcaacaaaggtttatcaactcttggttaagggttcctttcatgttgtgagtaaacatgaacaatataggatcttatccttttaagctatcatgcaagaaacatgtgaggtctcttaaaaattcactgtgctggccgggcatggtggctcacgcttgtaatcctagcactttgggaggctgaggtgggtggatcacttgaggtcaggagttcaagaccagcctggccaacatggtgaaaccccgtctctacaaaaatacaaaaatcagccgggcatgatggcgggcaggtgcttgtaatcccagctacttgggaggctgagacaggagactcgcttgaacccgggaggcggaggttgtagtgagccgagattgtgccactgcactccagcctggatgacagagcaagactccatctcaaaaaagaaaaaaaaaaaaaaattgtgctggctgggctcagtggctcacacctgtaatcccagcactttgggaggccgaggcgggtggatcacctgaggtcaggagttcaagaccagcctggccaacatggtgaaaccccatctctacaaaaatacaaaaattagccaggcataatggcgagtgcctgtaatccaagctacttgggaggctgaggcaggagaatcgcttgaacccgggagtgagccgagatggcgccactgcactctagcttgggtgacaacagcaagattctgtctcagaaaaaaaaaaaaaattaactgtgcttataaatgggagctaaattaggaaaaaaataaaaagtaaaaagaaaatgaaaataaaaatttaaaaaatatattaacaaattaactgtactaaggtaggattcttttttttttt

SEQ ID NO: 6411 - DNA, 1028 bp, Homo sapiens
tagtgaagaaaccttttccaaaggcctgccagctaccttcaactctcttagaccccagtagctaggattgggttggttacatgccacgccctggctgtaagggaggctacaaggaagacttactggcactttttggcctctgaagtacaggcagactgtgccagccaggaagaaaggtagaaaaggaataattggttttgtttgtttgtttgttttgagacggagtcttgctcttgttgcccaggctggagtgcagtggtgggatctcggctcactggaacctccgcctcctgggttcaagtgattctcctgcctcagcctccccagtagctgggattacaggcacctgctaccatggctgactaattttttgtatttttagtagagacggggtttcaccatgttggccaggctggtcttgaactcctgatctcaggtgatccacccgcctcagcctcccaaagtgttgggattataggcatgagccactgttcccggccagaaggaataattgttagacaactcacagtgtctgccatatttgccacagaaaataactgacttgctctctgctgtcttactgtgataatatatttttttaacgcaatttacaaaagggggggaacattcttaaatttgaaactaggaattatgatatttgcagtttcatattgtatacagtaaacagtcttcaaattctagttctccttgagatcttatacaatgataacagttttaaaattatgccttctgttttttgaacagctttttactattgacagcttttaaggaagtagttttcatgttgtcgtgtttactctcttactagacaggaagacagaacagaaatccatcctcaacttctggggataatctgaggattataatgaaatatcagatgcttaaatgatttcaacagacttttagatgaagttgccattagcaccttgttatcatcaatgtaacacataggcaagtggattaaaataagagggctaaactggcctttatgttgaaattagaagttt

SEQ ID NO: 6412 - DNA, 1021 bp, Homo sapiens
acacatcatcacacctggctaatttttgttttttgcttttttgagacggagtttcgctcttgttatccaggagtgcaatggcgtgatcttggctcactgcaaccttcacctcccaggttcaagtgattctcctccctcagcctcccaagtagctgggattacaggcatgcgtcaccacaccaggccaattttgtgtttttagtagaggcgaggtttctccatgttggtcaggctggtctcgaactccggacctcaggtgatccgccctccttggcctcccaaagtgctaggattacaggcgtgagccactgcgttcagcctaatttttgtattttttagtggagacgggattttgctgtgttggccaggctggtcttgaacccctaacctcaagtgatccaccgccccttggcctaccaaagtgctgggattacaggcttgagccaccatgcccagcctagagatgaggtcttgctatgttgcccaggctgatctccaactcctgggctgaagtgactctcccaccccggccttttaaagtactgggattacaggtgtgagccattgtgcttggccaacttcatttctaaataactaaaatttccttagctctgtttctactaggtaatagagaacaatcctgctaaacaatcttgccactttaggataaaaagtcagtagcttctggcttaactaaattaattacatgttaatctaaacccttggtaaatacttggtccttttggtaaatgttcagtttcctcacagagcccaccccttccctttttttccctatggtagatggtattggtagagaaatcttataatttttcctggcattaagggagagtcatcttatctttgtgctgtcctctgtccttctgagccattgcaaatgactggcttggtcttgaatgggattgtctgcctctgccacttctgaggatgatgtccctgctactactgtagcccctgggcaacacatctgtgcatgctgggtcctccttaatcccaggctgtt

SEQ ID NO: 6413 - DNA, 1001 bp, Homo sapiens
gcaaaggagctggatataagattaacatacaaaagtcaatcacatttctagagtgactaacaataacaaaggaagctgccattgacaataatattattttgtactaatagtaataaatgtaacaaagtatgtgcaagacctaaaaaaggaaaaatttttaaatgaagaaaaactaacaaagaatgaaataaacatatactttattcattgattggaagatttaacattgtgaagatttcagttcttttcaagttgatttgtaaattcagtgcatgttcaataaaaatcctcgtaagatttcaagggctcagtggctcatgcctgtaatgccagcactttgggaggccaaggtaggaggatctcttgaggcaaagagttcaagaccaataagattttcatgtaatttgataagattatatgatatttatgtagaagagtaagtggttgaaaacagcagggcattttaagaagaaaagcagggaagaataatttgccctatcagctatcaagacttagtatgaacctatagtaactgagatggtgtggttttgcccagttgaagtcagttaaattttaattttgagatttctgtaaaagatacaagtttagtcttttattatgtatatttgaaggtgttacattttggaaagtgtgtgtgtgtgtgtgtgtgtgtgtgtgtgtataaatgatagctaaatggcttctaagtaaaattcagcatatcttgtatatgttgatagaatagaaggggaaggaatgttttgaaataatgaaaataacatggtatgcaaatgctttgcaagagatttgggaaatgtagatatctctggttttaaggatgatctagattcaagtaatagttcagtaatttcataaaactcttatgacaaaattctggatggagaatattctatgaatcccctagagagtttcaggtttttgtagaattatgtgaaaaatcttgaactaattagataatctttagaagttacttcacaatc

SEQ ID NO: 6414 - DNA, 1033 bp, Homo sapiens
ttcattctttttatcagctacatagcattaagatgtaggatgcactgaaaattgttaatccagttccctgtttattgatatgcaaaacagtttatttctgataggaaagaattcagttgaaaaaagtaacttgaaattgtgattgtgaaatatgtgattattatttttattttcatttctaaaaataatttataaaacagtttaatatatttttatattagtatctgaaatttaaaaatggatatagaataaataaaatgtagtaatttatcatttgaagctcttggggaaaaaaaaaaacctttttttccttctaggatgtcacagaacatcctagagttgttttaggcattcaaattaatcctgcataaaaaccaagtgctttttggaattatttttcatttaagcatttcttttatctgaaaatctttttgaaggtcgtgtgttgtttactcttttgtaggccagcgttaatgactgccattgatggaagacatgatgtttgtatccgtgtagaatcaaagctgatagagaagattcttctcaacatttctgcagactgcctcaacagagtgataggtaatatatcagtgtgccatcaagaagttgttttattcaggagtataaatggtatatcggaacagaaagagcactgtactttaaattaagagcttttctgtccatatgaaaaccgaaggataatttagcttaagtgaaatataagcctatgtaagttagaaggttgacttgctttacacctgttagtacatgaacagcgggaggcacctaatttcttcttaacctacatttcctgttggtaagcaaaaactattttacttaactctagttttataagagtgaagtcaatgagtgtgtgacataatatatatgaagatagtccactgtcagtggaatggatttgcaagatcttcaaccgtgatgtcttagttgtcagtggctaagaataaagcaaagataatatatttgtcaggtattcaaactccattcctgttctcattagcctcagatcctc

SEQ ID NO: 6415 - DNA, 1294 bp, Homo sapiens
agactggaagtagatgttggggaaaaaatagattagaatttatcagtcacagggcctggatgctttataaggatcaaaaagaagatgcctagactagcatttgaaattgaattttttctctctctccaaactggcagtacattggcatcgcctgtggagctttaaaaattatttactttattgggaaataattcaaacacgaagataacaaaaaaggctaatgtggtgaacatccctatacccacaacttggttttactaaattttaactttgtgcttcagttacttgccttaaataaattgaggtctactggtccctttcctggatcccattcttcttcctttctcaccagtggtaattgttgtcatgaattgagcatttatattatcccatgccagttttatacataaatgggatattgttttgcagattttaaaacttttaagagtggtatcaaagtttataccagtccaaaattctatttttatgcaactttttgtttttgatgtaatgtttgcaattctagtcctacattttaaatgtatgtatttcattctacatctataccaatatctagccattattctgttagtaggcagttaggttgttgaaaaagattttttaaaactatgtttagtctctgaatgggcaagaattatgtattttactgatgaagtaactgacagcaacttctttttggaagcagtattaagtatagtggttaaaataatggattctggaattggactatttgcatttgaatcttgactctactatcctattgaataactatgatttttgacaagtttattaatgtctttatgccacagtttccttttctgtaaaatgaacatgggaattattcttgtcttataggattattgcaaagattatataagattaattcatacaaagcatttagtacctggcgcagtaattgcgcaataaatacttttgctatttaaatacccttttgtttacatagggggtgatgctatatgtattttcagtaacttactatttttacttaacaatatatttgtctctagacaaatatagaactgtctcattcttttaaatcctgtgttatttcatgggacatatgaatgactcgatttgtaagtcaatgctagttaaattgtttaacccatcatcgaattttactgctgtaagaggctgttgctaatgcagtccaaattctttttatagaaaccattttcctactgaagtttttcttagtttttaactctttcaggtaatgctacagtgaacattcttgtagtctgttttttac

SEQ ID NO: 6416 - DNA, 1048 bp, Homo sapiens
aatgggagttcactcatgatttggctctatgttgagtaggagtggtgagagaaggcatccctgtcttgtgccagttttcaaagggaatgcttccagtttttgcccattcagtatgatattggttgtgggtttgtcataaatagcttttattattttgagatatgtcccatcaatacctagtttattgagagtttttagcatgaagggctgttgaattttgtcaaagcccttttctgcatctattgagataatcatgtggttttttcctttggttctgtttatatgatggattactgatttattgatttgcatatattgaaccagccttgcatcccagggatgaagccaacctgatcatggtggataagctcatcagggatattggtctaaaattctttttttttgttgtgtctctgccaggctttcaggatgatgctggcctcataaaatgagttagggaggattccctctttttcttttaactggaatagtttcagaaggaatggtaccagctcgtctttgtacctcttgtagaatttggctgtgaatccgtctggtcctggactttttttggttggtaggctattaattattgcctcaatttcagagcctgctattggtctattcagggattcaccttcttcctggtttagtcttgggagggtgtatgtgtccaggaatttgtccatttcttctagattttctagtttgtttgcgtagagatgtttatactattctctgatgatagttatatttctgtgggattggtggtgatatcccctttatcattttttattgtgtctatttgattcttctttcttttcttctttattagtcttgctagcagtctatcagttttgttgatcttttcaaaaacccacctcctagattcactgattttttttgaagggttttttgtgtctctatctccttcagttctgctctgatcttagctatatcttgccttctgctagcttttgaatgtgtttgctcttgtttctctagttcttttaattgtgatgttagggtgtcaattttagatctttcc

SEQ ID NO: 6417 - DNA, 2060 bp, Homo sapiens
ctttatactcccactcccaaccagagacacattgtttcagccacaataggttacatcactaaccttttttgggttttgtaaaccattaaggattacatgaattaccatgtaatcctgttcagacttggtaagacatttactgaatattgcttgttcttattccctagatataaataaaataataacactttattcaaaagagctccatggagtaatatttactaagggccaggttgctcagttttatgcacagaaaggcaatacagtgttgaaatacacatctgtttcaagttcccatatctataagacacttctctctctttaaacttaaaggaaaatatgtatgcacacttatatggatttacaacagtacagtgatctgaatttcggaacttaactttcagtataaaaagtttagttctctgccacacggaatttcagccgtatgcttgtgtaatgtatataaagatttaaaaaaatagatgggattatttaaactaaaaaaagatgtggaagttactcctaagtgtaaatactatgttctatgacattaatatatataccttattttctcttaatttctatttgaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttactaccaggacttttctcttccccatgtcaaaatacaatcaataattgatggtaaaagtttggaaattcaagcagatttgactcacctggcaatttttttttattttttatttttgttatacttttaagttctagggtacatgtgcacaacatgcagttttgt

SEQ ID NO: 6418 - DNA, 1028 bp, Homo sapiens
cagctgagacctgggttgaacactgtaattgtgtggctttgagcatcttctgattgaagttacacatttcaggagactcaattttatgcacgtggtattgccataagggtaattgctacctccctgtattatagcggagttcctctgggcatgcataatacctttctttcatcatgctcatcaagacttattcatactttgttatcaattatcctagtagctctacatattaggtagttacaagtattacaaatcatagattaggccactaacataaagaaatgaggtaaattccctgcagtcttcttgtggggccatgtaacagtagagaccacttgagtttgccaagtttggtggccaagtcccatgttttgtctgagaacagacagaggctcagggatattgggatgatatttggtatgaagggtttcttatttggactgcaccaagttaactgtgtgctgtgaaacattatatggcttcattttcattgggagaactagtgatataaatgatgtaacgtgaactaagtgatttagctaattacacatatttttggatgcttctaaaaaactaatatgtgatccttggagtagaggaagttgtacattcaaggttttctaccctttttgtgtgtgtttattttaatgaggacaatgggaactacaccatttctttcctgttagttcatcctggattacctttttatatccattaaacatagaaattctgaagccatgtctgcctacatgtcatcctgattgcctttgtgtataattgcagatcaaatgtagaagcagtgactacttaaaaaaaaagttgttatagaccaaggcttgaggaaagagaaaggtacagtgacaatgagatatcttgggggaaatttggtcccgtagaccaggggttagcaaatcatatcctgtgggccaaaccacagtcacctgcctgttttggtaggcctataagctaggaatggtttttacatttttttaaaagactgatggggagaagtgaaaggaaaaattata

SEQ ID NO: 6419 - DNA, 1063 bp, Homo sapiens
ctaatttagtgagatctgagagccaccttagagattacgtagtccagtttttctccaccctgctaagcttcacaaaatattgatgcctggacctcactcctagtgaatatgattgaatggatctgtgttggggaatggaggcagtcttcaaaaactggctacaaggtttcttggttcagccaggcttgagaacctcagcctagcctaattccttccccatgcaaatgaaagcattgtaacatgcctgagggccaccggctcagatgagttttctctacttcagaaagctattttccctttccacatttcttttttttttttttttttttttaatgtaaagccatttcccagccagtgcagtcttctgtggtcactacattcctcatggaatatttaaaattaaatattccatgaggaatgtagctggaacgtttaaaagcttactatccttgtcctgttttaccgttacctaatgggaagacagctttctggaaaaacctgaagaccattctttcttagtgagctgttcttgacggtggtgactttatctttggaaatttgcccgattcccatatcacaattaaggaagtggcttaagaaagtagcttgtaattctctagagtgtaagtctccagatctcactgttgaactttgtatgttccagtaggactaaatctaaaataatttccttgtcacatttgatagacatgagtattagggacccacattggaagaaccctccaaaaacggacctgtctttcctttgtgagttttcagtgtaattctagcatttctgggagaaatatgtaagtacctcaagggcagaaatcctgcccacttaaatgtttcataattatcacctaaaacttagaatggatcaaattaactaattagctttgtaccttttcaacacaagctaatagattgcctgacttcgtttatctgatcatgaattttgatcaactttatctcattaggtttaaaaattaatatgttgcgttatatagcacttatctttacagagattattcatcttcaatgcaataaataaaagaaaagccaa

SEQ ID NO: 6420 - DNA, 1027 bp, Homo sapiens
gattcaaattctaaatatacgaaaggttatttccatttcaaaaagtgatgcagaaagacaaatagcatgttctctcactcatatgtggattctaaagatgaccgcatagaaatagagagtagaatagtggttaccagaggctggtaacgatagaagggaagggaggatgaatacagttacataggaggaataagtcctggtgttccattgcacagtgaagtgcctatagtagctagaagagaggatgttgaatgttctcagcatgaagaaatgataagtgtttgaggtgatggaatgcttaccctgatttcatcattacacaaggtatacatgtatcgaaatatcaccttgtacttcatatatatgtacagttatgtctcaattaaaaatttaaaaaactcttaaaaagaaaaaagaatcaagagagaagaatacaaaaaatgatgattaagtggaaattaaaccatagttttatctggatttgatgtaattttttaaatgatttgatttagactgtgctattggacaatgccacctattttctttcatatacacttttattctaatgttctaatcaattaagtcctgtatatttaatattcatttctgtcagggttgaatttgatccaggagaaatggatgtgtactaactagtcaggtgtaactggaatcttactataaagtaaaaattattgtaggccttctaaggaatttataattcattaaaatacatataataacactaaaaagctaattaatatataatattctagttaaaaattaggcatatatgactatatgcaatagtgtggaaaacaattaggcatggaaattattgttagagtttattatttttcaaaagataatgataaaacacacctgtaaatttaatataattataaattcgtcaaatctcaggatggtaaaaccttaaatataccatttgtaactgacattatgtattctctttcttcttcagaggaaaaccctgaagaactatggaaatttcttttttattttatttatt

SEQ ID NO: 6421 - DNA, 1164 bp, Homo sapiens
tctggaccacttcctgataaggggcagagttagatgggatgccgaggatgtctgtgtgttctctatgtacacacagcaagacagacattttttcctttaacatgtgttttgctttctatagagagaatcctttttctgacagtcactttctttccaaagcttagaacatcataggctctttggcagagagtacagctttcaacaagaaaaagaaaagtttttggccactctgcccccttgcagttcaagtataattcaaaatatctgcttctatttgtttgccttttgcaaaacctcaagggtgattttgaaataaataggaataaaatatttgactgaaccaaaagagcccagtacctggccatccgaaagtatttatttatttgtttaaacattgctggagtaatagaaaatttaaatgcagttatcaaagaccaaaagttcagagattaaatactatgttagagtcattccttctaattaattttgaactgttttcgaaaaacgaagaacttgctggggagacaatgatcaagatcgtaacaaagttcccctagaagattaacagagcttggagtttactgtggatctctgcctgtgtggagaagaaacagtcaaactagaggaaacaaaactgtctctatagacaaattaaattttagtggatgttcatgtgcacaggtgggcagcagcaccttagtctagtatgttgggattgggatcagagtctttttccataaatgcagcagcattgagcaatataattccatctaaaatcttattgtatattttctcatctgcttacttttttttgtttgtttgtttgtttttgagacaaagtctcgctcttttgcccaggatggagtgcagtcacacagtcttggctcactgcaacctccgcttcctgggttcaagtgattctcctgcctcagcctctcaagtagctgggattacaggcatgcgccaccctgcacagctaatttttgtatttttagtagagacagggttttaccgtatcagctaggctgatctcaaactcctgacctcaagtgatccacccacctcagcttctcaaagtgctgggattacaggcgagaaccaccacacacagcctcgtttgcttacttttcaaaacagctctgtgtttgtgtgcgtgtacatggt

SEQ ID NO: 6422 - DNA, 1047 bp, Homo sapiens
gcagaacgtctagctttagagagttttaggtaacttcacccagctgatcccactgtgcctttaaccaccttcctcttggccccttctgacactgataatgcctgttccctaaccattggcccctctgcctggctctgtctcactagcaggcccatccccactctgtgctctgcctttcttaacacccctaaagggccacgcaggaaaggatgggacaagttgattatgacatccctttctagctctaaggaattcaataattctgatattcatccctaaagaaatttatcagcagctattaattgggctttcctaatttgacactgaaaggccggtagggtcccctaagtcttgaagccattttcctggtcccgaatccagcagattccagcctatctggtttggggggtgtctacagtgaatcatctgtattcacatttatagagaactttgccatttgcatgttcatatctgtcatcttatgtaaactgccaaacagttctagttgtagccctctttagtttctattttcccgaagtttctatttcccaaagcaaaaagaggtgagttttcatttcttttttttctttttttttttttttttttttttgagacagggtctcgctctgttgcccaggctggagtacagtggtgcaatcatggctcactgcagccttggcctcctgggttcaagtgatcctcccacctcagcctctccagtagctgggactacaggcatatgccaccatgcctggctaatatgtttttatttttcatagagatgaggtctcactatgttgcccaggctgatctcaaactcctgagcttaagcaatcctcccgccttgacctcccaaagtgctgggattacaaaccactgctcctggcagagttttcaaaaatcctctagctcttgctaaaaaaagttggtgctttcttagctctggtgggtatgcaagtgtaatatttaaaaggctcatagatttttacagttcagaaacctggattctgtctgtcattagaaattcaattacacaccgcagacatc

SEQ ID NO: 6423 - DNA, 1052 bp, Homo sapiens
tggcttcattaatcatggcacattccctcaggtccataaataactgcatttgcttcctctggagttaaatgttttctttattcaccttcctttcattctcttctgaatcttgaacttgagaactctcacaaaattgtccctaatattattttgtgttatacgcttaaccatgagccctcattttctcatctgtgagtataattgagagaatagcctatttgtgagggcatcattgtaggaggaacaccgttttgtacatttttttacattatctagaatcatagagaaatgagatgtttttagaaagccaaattttatccctttaagccccagactgaaaaccaactacacattaactatcttatttagaaacatttcaaaatagtcttactaaaaaaaaaaaagtattcactcaaaaaaaaagagaatatgttcaatataaaggaacttttaaaaatgactctgtcattattagttttaccagttattaaactgggcactaatgtaatggtgccctgaagatggggagacctgtgggattgttggctcccacactaaagaacccccataactctgtatttcagtttcagtgttagaaccttgtatagtcagggttctccagagaaacagaacaaacaggatgcatatctgtgtgtctatctatatacagatatgcatctctctatatagacatagatataaaatatatgtaacatatttaaataaatttatatatatgcatgtacatatattaatttatacatatattaattatatatatacattattttaataaattatttattattatggagccttatctctctatgtattatacattgatatctatatataacatatagatattatatctgaattatataatatttctgatatatatctgaatagataacaatatatctgtatgttacatatggatatctatgtattatatataggtatacaataaatctctgtctatacacacacacacacacacacatacacacatagaaagagagagatttattttaaggaattggttcgtgtga

SEQ ID NO: 6424 - DNA, 1048 bp, Homo sapiens
attttaaaattagccaggtgtggtggcatgcttgtagtcccagctacttgggaggttgaggtgggagaactgcataagccccggaggtagaggctgcagtgagctactgcatgccagcctggtgacagagtgagacctgcctcaaacaaaaacaaaaacaactcccctcttcttctttcctccagctcctggtaactaccatccttcctccagcccgtggtaactaccattgcactctctgtttctatgaattcgactagaattcatagaaatttagatacctcatataagtggaatcatgtaatatttgcttttttgtgactggcttatttcacttagcctaatgtcctcaaggttcagccatgttatagcatgtgacaggatttccttccttttaaaggatgaatgatcttcccttgtatgtgtataccacattttatttacccattcatccatctatgcacatttgggttgcttccacctcttggctatttgaatagtgctgctgtgaacatgaggatacaaatatttcttcaagactctttcatttcctttgaatatacacccataagtaggattgctggatcatatggtagttccatttttaattcactgaggaacctccatactgttttccatagtggttgcaccttttacaatcccactaacagtgtacaagggttccaatttttatttttctacatcctcaccaacaccaacacttgttttttttcttttctgtgtgtgtgtatgtgtgtgtgtgtgtgtgtgtgtctctgtcacccaggctgaagtgcagtgacgcaatcatggctcactgcagcctcaaccttcccaggctcaggtgatcctcccacctcagcctgctgagtagctgggactacaggcatgcaccaccatgccagattaatttttatattttatgaagagatggggttttaccatgttgcccaggctggtctcaaactctgggcttaagcaatccacccaacttggctcatgctgggattacaggcgtgagccactgtgcccagccattttctgtttt

SEQ ID NO: 6425 - DNA, 1049 bp, Homo sapiens
ttcattaatgttttgtagttttcagcatacatattctattcatgttttgttaaattcgtaccttagtatttcagtatttttggagctattgtaaatggtattgtttaaaaaatattagtttccagttgttcattgctggtatatggatgtaaaattttgaatgtgtgtttaccttttgtcctctgaccttactaaagtcagttctaggaggttttttttaaatcacttatttggtttcctatgtaaacaatcatgtcatctgcaaatagagacatttttatttcttctttccctatctgtatgtcttttatcttcttgccttattacactgaatgaaattccaatataatgtcaaatagcaatggtgagtgaagacattcttaccttgttcctgaccttaatgggtagaattcagtctttcaccacataatatattagatgttggctttttgtacatgacctttatgaggttgtgaaatccccttctaccctcgtctgctgagaattttttttttttaatctgaatggatgttgaagtctgtcaaatgttctttctctctctctttctttctttccttttttttttttttttttttgatagagtcttgctctgtagcccaggctggagtgcagtggcatgatctcagctcactgccacctccgcctcctaggttcaagcaattctgcttcatccttctgagtagctgggactacagtcatgtgccaccacacccggctaatttttgtagagatagggtttcaccatgtttgccaggctgctctcgaactcctgacctcaggtgatctgcctgccttagcctcccaaagtgctgggattacaagcatgagccaccaaacccagcctgttaaatgctttttctgtatcaagtggtatggtcatgtagcttttcctctttactgtagtaatatggtggattacattgattgatcttttgaatattgatccagctttgcattttcaagataaacctcattttggcatggtgtataatatttttatatactgatggattcaatttgttaatatt

SEQ ID NO: 6426 - DNA, 1050 bp, Homo sapiens
gaactcttgcctggttgcaagtgtcaagccaccgattgctttcttaggctatctatatggtctcttcctgagggctattgtccgttaatacagaatacagtacactgttagtggattagcgagctcggtaatccggtctcctaaatgaacaaaaaagtagacgctttttgaggttgagcatatttcgattaaatcttggcttaggccctagatcaagggtttagatcagaataaaatgaaaattagtgttgcacgtacgcatattgcatcagaatcttgcagtgattgttttagtttcctgagttgcattgatagattcttttaaaatatgactgatttgcataactttagaagcagaatcattttcagtatatatggtgcacattgagggcaaaaagtagttttgttaatgtttaaacttaagttacctacaactttgaactgtatgtagaagttttgtagtttgaagtcaatagtgccataatataccttataaggcgttcttactagatctttgttatatttacctttttctctccctatggggtgatgtaggatagtgcttgaaatttgcacttcagtagcatttaatgttcagtgctcttgtcataaacatagaatggatattgagtagtttctgatcccagatggtaatgtgtaggttcaagggtattgtgtgtagcaagtgaagattgcagaaataaaacttcagttcatgcttgaaatttaagtattgttgtgatgccagaattgctgctcaccgtttttaggtttcaggtcctctgacaccttttggtatcgttaattttactgatttgtgtagaatgtcagttgtattttaccagctaatatctagaaatgctggcaagaggggtttactccagctttagattgtaggtatgttagcttttttcatacagtgtattaaatttactgagtcagcttgctgaataagacagaagcccaagaattttaacagtgtgtagctttagttgtctaaaagttaggccttcgggcttcaaaagttagtggtcatcgaaaagcattaat

SEQ ID NO: 6427 - DNA, 1049 bp, Homo sapiens
ttatttcatttgacctgtaaactctaagtaactttgcatggaaaatgttatcctgattttatagacgagatagtgagtttagaaaggcagtatggtggaatggagcatagatttggagttggctagacctaaagtccagattaaatctctgctcaaggctgggcgtggtggctcatgcctgtaatcccagtgctttgggaggccagcgttggcagattgcttgagtctggaagttcgagaccagtctgggcaacataggcagaccctgtctctacaaaaaaaaatacaaaaattagtcgggtgttatagtgcgcattggtagtcccagctactgaggaggctgaggtgggatcacctgagactgggactttgaggctgcattgagctgtgattgggacactgtactcctgcctgggtgacagagtgagaccctctctcaaaaataaataaataaatacatccccgctcagccacttatcagttacgtagatacactgcctaaccttagtgaaccctgtttcgacaactccaaaatgggagtaaaaatcctaaacttgtacagtggttttttagttttgttaaaagtacaggtgaggtttttttcagagtattggttgccatctgagagtgatcccctttcacctcctctaggacttttagcattttctggagacattttggtggtcacagctggggtggtagagtgtgctattggctaggggcttgaagccagtgatgctgcttaacatcctatatggcacaagacccctccccatcaacaaagaattatctagcccaaaatgctgtgtaaaatgtctggtatataataagtataatatttgatgaaaatcagtacctttgcccccaggtgtgatatttaagaaggtcaacttactaaatcagtgatggagttagtcctaacatctgggtgttctgactgctgctaggccagtattctttatatgataataagaactttgtccacagaagatatccctaataacaaaaaaggtttatttgaagaggactcatgtgttctttggctgatt

SEQ ID NO: 6428 - DNA, 1064 bp, Homo sapiens
catttccttttcctgttgtaagaacattacattgtgttgaaattaaagtggatatagaaggtaattagaataaactgccacatcatttttatagtaaagtggtaataacactattgctttctgtttttttaatcagaaggagtatgggcttataatgatgttactgttccctgaagcatattttgaatgatacggtttatatttgcacagttgcccaggtaatcattgtgatattaattgatcaatttgctatttatttgcgttttaaatcagtactagtatttgtgcttaaaaattttgcatatgttttatcagatttaatttttaagtgtcagatactaaaacaaataaccttaactttattaaattataattttttatcatgaggtggtattcatttattcatatagttagaacaaaaaatatttaaaatattgaggtagaaacaaattagtctctttttaattaaaagccagattacttgttagagtaacattttcccaaatgaggtaaaattgttgcgactgttaaacttaaggaaattttgatctaggtgtggtatataccttcttgtggggtgctaatgaaaacagggatggcaaaaatattttgtttgtgagtgtatgcatttatgctttttgacaacctaagaaacactcttacatctgagtatctttcatggactagctgtaggaaatctatataaaatagcttagtatactgaaagtatgacatagttttacatatctagattgtggttgtgattatatataatactataaaatatgctaacgtgctgcttaataatactatttggattttttttaatactgaaaaggtcacacagattgtgattattgtgtagtgtccaagaactaaggcctaccatctgttactcaaatgtatgaaaaagttaagataatttagtgatataagtggttttgacaccactgtttttggaataatctaattatgatttttataaagactaatatcaaattttaaacgtttgcaaaaatgaaacctaatagttatactgttatttatatttttctattacaata

SEQ ID NO: 6429 - DNA, 1056 bp, Homo sapiens
acagttggcactttttcaactggaaaattcaaggaactgctctttctgctttctgctcaatatgaatcttcaatttagaaatgagagtccatcattaacaattcaacatagcttattaataggaaaaaaaaacctagtaacaaatgtaaaatctttgattaaatgagaaagtcatagaagttcatcagatttgtatttaaagcatgatttcattagaaaagttgataataaggatttaactgtgacataattggaaaatacttgtttaaacttaaaattttgaaaagaaatgtaaatgtgatgtaacttatgaatcagtggttgagtttcttttttgctcacaagaaccctaactgtgtgttacttgaaagcactgatggaaatcagggaaaaagctccagaagttcctacgaaataaaattaaatgataaagtcctggtatctgctaacttgccttccattcctgttatcttttcttcttagtctgacttcattaattctttcaccctggctactggtttagctcagtgttttatgagccaggcagcttcagactttgcttttgatgctctttgttcattacctctaaagctgtattatcactttcattttatcattaatgtttcatgtatatgttatagtttcatattgttactgcaacttttacttagctataatttaaaaaatatctgtgatctgtggaaataattattctatggcagaaaagtagttattgcattttactttataagttgtttaaggataagcatacctatatattaagcactacaaagaaacttttacaatggctttatttttagcaaaccatcatagttaaaataagatttagtgtacatgtcaggaacacagtcttatgaaataaggtttagggagctatttttagttactatatcctacttgaaaattgtagttaaatttctagcatataccctattaatttagatgcaagtacagatttgagataaggtagatacattatttggatgtcaactcggaagttgttcaagaaaagatattttgttatttagatgtaac

SEQ ID NO: 6430 - DNA, 1054 bp, Homo sapiens
tcccaagtttcgtatcaggaaaatataataaatttttgaaaaatgtaatgggatatattgtatttataatacagtaatcactatgtaaccaacatttttatttccatcaaaaattagttataaagaaatagaaatctaagaagtttaatagatattaccattgaacactagatttgtattagtatcttttatatttatctctctcatttcctatattggccatgtttacttttaaaatagtaaaagtcataagctctattttaaaaataaatgttagtttattaacccaagaataatagctaactataaattcatatttgataaaataaaaagatgacattcatcataagggatacatacctgtgctagcatatggcatttttaaaatcacatgagtaatttgtaatcatcatagaaatattagaaaatacaaataagcaaacacatactgaaaatttagtgttcccaaatctaaaacagagacactgtttttttcttttgggattgtattttagatatgttcttaagttataataaagtaaatacttaaaaggcaaattgatacattaaggatttcaaagagtaaaactttttgttaagctttgatgttctttagaaagtttagattattccacaagtcactgtcgttgaaagaaaagtagttacagtggggtcttatgggataaggcattaccatttgttcagttgagagacagctatcactatgttttaagcattgttcatatattagctcatttaatcctcatagcaaccttatatgataggtacctttattagccccattctgcttaggaagcaacagaaagagtatgtattttgcctaaggttgcacaataagttaagctggggttccaattctagcaagttggttctagagtgtatgttattaaccattatgccgtagtgcctgcaagtagatctctagatgtcagaaatactcatcttcctctggttacctggttgttataaatctttatgcttaatacttatgtcattatatgtaaatttcgtattaaacactcaacttattcag

SEQ ID NO: 6431 - DNA, 1232 bp, Homo sapiens
tagctgggactacaggcacgcgccacatgcctggctaatttttgtatttttagtagaaacgtggtttcaccatgttggccaggctagccttgaactcctgaccttaggtaatctgcctgccttggcctcccaaagtgctgggattataggcgtgagccaccgttctggccacctcctacttctttcattagtcttaattccttagtggatttgacagtgtttatattatctacaccaatgcatttttttgtatgttaataataggagatatttattgggcatttatttacatacttatttgcatgtgtaactgttgtatagccagtttatgtatataatcttactaaatctctacagtaaatctatccccatttcatagatggtttaaaagaagttaacttccccaagcattacttttagtaagtagtgagactgaaggttgagttctggtctgtcagattccgaagttgtttccttaggaaccatattatcttgtgtacaactcttgggctaatcttgttaatattctttatttgacctcacactgttgattcataccatgtttaaaattgaaatacattacctatatttaaaaattgagacctcacataaaaagctatatttctagctgcttttgaaatttcgaaggatcttccaacacttggctgacattcctgcgtgacaaaaatcagctggagctgtgtaatgtccgacctgtctctgtcaatgaacagattattcattgtcatttctcatctgtttttgagattgtaactttgattctgtataactcatagaattagtagttagacctatatatgttagttattacattatttgtatatgtacagactgctttagacaatattgtagtgttatatgttaattttatcaattaaaatgtgctataggatcattgtagagatcttgtctctaattaacaggattcataaagagaaaacaaaggagagaaacatccagattgaaaagacctacatagtgccaagcacaataaaagaaaccctatactaggcaaattattatgaaatttgttttaggacaccagaaataaagataatatctaaaaactttttagaatcgcctaggagggattaggaatatgaatagcatctaacttgttggcagtagaattgaaggtagaaggtggtaaaacatcaccttgaaagttctgcattcagcctagaattctgtatccagttaaaccatcaatc

SEQ ID NO: 6432 - DNA, 1051 bp, Homo sapiens
tttttctgtgctagttgagatgaccatgtgatttgttttcttctttctattaacatgatatattgtttttcatatattgagccatttttgcatcccaggaataaattttacttggtcttcgtgtataatccatttaataagctgtggaattcagtttgttggttctgtgttgaggactttatatcaatgttcctaagggctactggtctatagttttcttttgtagtttctttgactttgctatcagggcaatgctggcctcattgaatgtgttaggaagtgtttcctcatccatttttggcaaaactttgggaaaaaacgatgttctttaaatgtttgatagaattcacagataaaaaaatcacatctagggcttttgtctggaatttttttattgttattattgattcagtcttgttactagttataggtctattcagattttctttttgtgtgtgtgattcagtattagtacattttgtacttctcgttatttctccatttaatctatattatctaatttgttggcatacaattgttcatagtactgtcttctcttttttttaaacttctgtgcagttgatactaatgtccctacttttatttcagattttagtaatttgaatcttctttatcttaatacaggtaaagctgggtcaattgttaaaattttttcaaagaaccagtttttggtttcattgatttttctctgttatttttctattatttatatcctctctaagctttgttatttccttcatcctgctagctttgggtttattagtttgttctttttctagttccttaagatttgaagttggattattgatttgagatcgttttcaattaaatgtgtacaactacaaatttccctcttaggactgcttttgctgttctgtaatttttggcatgttgtgtttttttgttttaatttatttctaagtattttctaagttcccttgtgatttcttctgcgtttaaccgtgtattttttaatttccacagttggtgaattttctactttttcttcagttattgattttattgattt

SEQ ID NO: 6433 - DNA, 1047 bp, Homo sapiens
tagtttgagaattatgtatgcttaactatgagatacagatactattgaaactagtcagttgtttataggtacttgtaaaattaaaaatatattccaatagcatgcagatttttcatagaggaaatttgaaagcatggaagcacctgaatttacagtactctgtattagtggcatcacaagtttttaagcaaatgtattagctctaattgcatacacttaatcttttaagctttggttttattattataatatgggggtgataacagtatctacttaatagaattcttgttattacatgaaataattaatgttaaacacagcataatatgtgtcacattataaagattcaggcaatgtttgttagtattagtacttttttttcttcctaagtgcaaaagataactttatatcacttttaaacttttcttttagttgtgctgaaagacattatgacaccgccaaatttaattgcagaggtaggtatgaatgtactgtactatgttgtataacttaaacccgatagactgtatcttactgtcataacaataatgagtcatccagattatcgagtgagatacatatttaagaattatctttaaaaatttcaaaaattttaattttactgttgtgttttaggaaaaagtattgcataaagctattaatattgtcaggaagactaaagtgcagcatagactaagaattaggaaaattcctagactaaaaatagtataaggagagggtttacctactatttgaggcagttggtctaatagtaagcaatcacagggagaaagcagaactacttaactcttctgtgttgaggaatgacataaaaggtaggaaaggatataacaaatgttgataagaggagtctgatggatgagaggagggaactgctttaaatgagtttctacttcagacataagttaattctcagagcccacaaaaactttcacttttatttgtgaaatacaactcagttctcatggcttaacactttaaaccatgagaaaactgaagagttgagaagcttggcagatgctgctg

SEQ ID NO: 6434 - DNA, 1050 bp, Homo sapiens
gttttacccttatattcacattgaggtccagatcctggttttgaatgagataattacgtgcagtcggactgttttctgatcctaaaaatagagacaataatatctatcttgtaaagttatggtagtgttaaagatatataaaatgttggcaagtaccttaatatacaataactactgctatatgttgtcattgtaataataatcatatttcttcctttgttgaattgctttcctgtagtaatcttattgtgatcatcctgaaacatagatttccgagcttcaagcaaacactattatgttgaaaaatctacattatttctaagtttagcagtgccagtggaaagtttattgaaatagaaaattacttttttaactgaggagtgtagattgtgaattcgtgattcatcttcttaggagatgatcggaatattgataaatattgatgcatagaatatgaacaaaacattacatatcttgtgctgtgatattaaagtagtattctgttctggtagtagtatggcagtattttaggtctgaaagatgtacataatctgtactttgaagtctgttttttaagagattaatcacaagagatttacataaaacaactaaggttaaaaataaatggtggattagagatacatcaggcaaatttcaatttcaaaagcagatgacagaatctcagtatcagggtagcatttaaagcaaaaagcattaaactggatcaaaaatgtcattttacatcaacacagggtacactccaggtaaagacttaacagttatgaacgaatgtgctaaacatcaaaatgtattaagtaaaagctgaaagaaatgaagaataattggtagaaaagcaatgataggaatccttaatgtacttcaaaaggcacgaagtaagaaggtacagtcatgtaccacataatgatgtttgagtcaacacctgacctggtatacgacaatggtcctataaaattataatggagctaaaaagcttctatcacctagtgatgttgaagccgttgcaatgcaatgtatcactcacatgtttgt

SEQ ID NO: 6435 - DNA, 1050 bp, Homo sapiens
ttgctgttatagatttactaccattattacccagattttctattttactaaaaaataataacacagttcgttatgataaatcagtatagatctttaggctcaacacaaccctgctaccttttaaacttttttattatacaacaaacacatatgcattatcaagaaaagatgagtttagcaaaatgaagaaaaatagtcttatcaactagaaataagcaccattaaaatttctgtgtgttaaaagataatatgctgctgaaactttttttttcttgaaatgtccctcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagattagcctggccaacgtggtgaaatgccgtctctactaaaaatacaaaaaattagccgtcatagtgtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttccaggcatctgtctactcattcttgccatgctgagggctgtcatttctcaccactgaatgcctttttttttttttttgtgcttctttttaaaagtcttttcctgtttgctttgaacttcaataaaaacagggggtaagaaggtaatatgcttttattt

SEQ ID NO: 6436 - DNA, 1491 bp, Homo sapiens
ataatgaatactcatagttaaaaataatcaagtaacaataagacacaatagtctgaggcttaagaaacttttccttcataatcagctagatgtattacagaactcctgcctaaaaagatctagaggttaaagtgtactgtagactcaggtattatcagtgtacccaactctataacaacatacatgattccattcagttgttctttgatctgtgatttagagataagatgatcataaactctttgcttatacttttagatttgtgggtcattgatcattggatccataagagatgttataggtgatcttttccaatcctcttaatttataaatgagaaaagaagatacagaaatgttatgtattgtggcccaggttatttaacaaattactgggtatatggcaggatttggagttagaactcaaggttgtcttgtttctgtattcccctagtcagctcttcatagacctttaggacttagctatattctgaagtactataaaaagagaaataaacatggttttcactaatgggaatttcatttagaaaaacaaattttcagactattttctatttttcagatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagttt

SEQ ID NO: 6437 - DNA, 1018 bp, Homo sapiens
accccttcgcaccaaactgacaagtgctctgaagaaattgtctaccaagagactttgtcacaatgctttagatgtgcagagtttaagtgccctagggtttgtttacaagctggaaggagaaaagaggcaagctgctgagtactatgagaaggcacaaaagatagatccagaaaatgcagaattcctgactgctctctgtgagctccgactttccatttaaatacatactctaggaaattagctctaagtttttcccttcattttgggttctcctgtttgttttttttttattattttaatcccttgtttattatagagctaatatttattgaatagttattgtgtaccaagcattgtgctaaatactttatatgcattatgatgaatcttgtgcggttttctttctttttttctttttaattaaaatactataatccattgagaaatagcaatattctagctattgtaacttctaaaaatggtatggccattagatctgtgctttttatctctgctctttgaatttctcatattatatagtaaatatattcctacgtaaacctttgatacctagatcaggaatactcttccaggagtacaaaattacattattgatagttaagctcttaattgtgtagcttgcaaaagacagcactttttagttacagatgttttgactttgatgaggatatttagctatcaatctaatagtcacctaaaatatcttttttgttggaaaaaagtttataataaaaaagtttgtcatctctagtgacttcaataaagaaaaaactagaagaggagaaaaaggatttcctcaaattttaaatatgtaacttcagggattcaatccccaaatgtttattaagtagctagaaataattatgtggaaaaaaatgaataatggaaaatagtgagtctcaaattgttctctttttttttttaactaaaacaaatctgcaatgaatctagatgcaattaattttattccttccaactaaaattacaatatttttag

SEQ ID NO: 6438 - DNA, 1033 bp, Homo sapiens
cgagattgcgccactacattccagcctgggtgacagagcaagactctctcaaaaaaaaaaaaaaaaaaattctaacaagttatccagttaaaacatgatactgttttgcctatgaaatgattaaaatgttaaaaaaaaatgagataatgtgctttcatatattgtaaatggttctagaaagcaaattggcaatagtgtgttaagagtgagaacattaaaatattttatatcttttcatccaccaattcacttttaggtgtatactccaaggaaatgggtttatttctatttctaaggaaataataagaatgcagaagaaaatatgtaaagatgtttggcaaaacttggtgaataaattaaatgtttaataataagggaataattaagtcatttcacatgttttatatagccatcaaatgttgtaaacaatttttaattatggggagaaaaagcttacaacataagtgtggggaaaagaatagaagggaaatattttaaaatattaatagtaaccaaccagagtggcaggattatacatgataatattctttttcatagttctctgtatttttccatgaaactatattatttaactaggaaaaattaaagaattcattgaattgagtagatgaaaggttgtgatttggtagtgacttatttggataggtaattaatatcttgattatttaaccttaatgaaaatgtttttttaattttttaaaacaatcttttttttaggttactgtgcataatgatagtgatgatactctttatggtaaggtttcgttgctcacttatctttgatgtatcgattatatgaagtacacttgaaaagcttttaatttttaaatcacttctaatgttttatttttattattaaaaaatttttaggctgggcgcggtggctcatgcctgtaatcccagcactttgggaggctgaggtgggtggatcatgaggtcaagagattgagaccatcctggccaacatgatgaaaccccgtctctactaaaaataaaaaaattacctgggcgt

SEQ ID NO: 6439 - DNA, 1030 bp, Homo sapiens
aaattaatgagtatttttggaatgaattgtctgctctgccattcatcttgttcatttggtacttctgggtgattggaaaaccctctgctaagattaatactgaacacttagcccaggaagatagatttttcctctagtttacatgtgtaagtagcttttttcctatcagaatgttcttttagggatggtgattcctgtttgtatgtttgtttgaatagtttttccttaacacttgagtgttcatttgacttaaatttataaaataatcattttctagtggacagttcttgtcttttctgttttaaaagtcacattgaatattttaacaggtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagagtatgtattaagaactcatacttctatgcttgtcttcttattctgaagttaaggttaaatcttaaggctctctctcttcagtttttttcaacagtacactgaagtttttgtgttcaactttatattttgaaaaatttcaaacctatagaaagactagtacaatgaatactcatttatccttcacctggattctccacttaccattttatgagtatgtgaatacacatcttttggtctgtacaatttgaaaataagatccagacataatgacaccttacatctaaatatttgaacatatttttctaagaacatgggcattttcatcatgatcacaagaccatgaaattttcatacccaaaaaatttaatattgatacactaatataacctcgtatactgtttgtattgagagtt

SEQ ID NO: 6440 - DNA, 1030 bp, Homo sapiens
tatttatttttgagagagggtcttgccctgttgcccaggctagagtgcaatggcacgatctcggcttactgcaacctctgcctcctgggttcaagcgattctcctgcctcagcctcctgagtagctgggagtataggcatgcgtaaccatacccagttaagttttttttgtatctttagtagagatggggtttcaccatgttggccaggctggtctcgaactcctgaccttgcgattgcccgcctcggcctcccaaagtgctgggattataggcatgagccaccttacctggccacctattcccatctttaattggccataactccgtgagtatagatggagtcctcttaccagtgtcctacaaacactagtagacctgtgttcatgggtgtgctttaatggtgttgacacatcacacatcacagtactcttctggattgcagaagtataagtagaacgatgatgtattaggctaaatactctcattttaataatttaccttcatgtccctgaaagcaattattgaacatatgtttggaaacaagaatgatagcttcagatgtagtacaagtcccactttatctggtcactatgtgattagaccgtgttacttgggcttctgtaatgtattaaatagtacctcctcagtgacgaaaggagcctttaatagtctagtttggctggtgcagtggctcacacctgtaattcgagcactttgggaagctgaggtaggaggattgcttgagctcaggagttcaaaactagcctgggcaacatagtgagaccccatctctacaaaaaagtaaaattagttaggcatgatgatgcacaggtgtagtcccagctacttgggaggctgcagtgggaagattgcttgagcccaggatttctaggcagcagtgagccatcactgcactactgcactctggcctgggtgacagagtgagaccttgtcttaaaaacaaagaaacaaaccaaaaaacccagtttttttttttcatttcaaagttgaaatttttgtataatgttg

SEQ ID NO: 6441 - DNA, 1050 bp, Homo sapiens
gaagtttacttttacatgttttgtatgtttgaatattggcttatatggtgactttttggttttattaaggtttgccagattaataacaattttcttatttttaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaata

SEQ ID NO: 6442 - DNA, 1042 bp, Homo sapiens
tcatattgtacattattcttatcaagatcagatgagatgaaaaaatgtaatagtactttgtaaaccctaaaactctattataactgtattttggtggatgaaattgtgatgaggatgaggacagtgagtctgtgtgacttcatacttttctagccactttcatgggcatagaaaacttttttcttgaggactgcatgaagttttctatataataaggttgacaatgaatttattatactatactgtgaatactattcattggattcctgagaagtccctgtagttcctcttcactaagaatttagtaagaactcctaaaagttaaactatagaatagcctcagttccatcttggtctgtgttctttatctgggctctactgatttgtgtctgtagcccatgtcaagtgtatctctacatggtataacttttgcatatgctttaaaacataattttatgtcttcaaatcagaattggaaaaatggaaggaaaaatgcaatgatttggaaaccaaaaacaatcaaaggtcaaataaagaacatgagaacaacacagatgtgcttggaaagctcactaatcttcaagatgagttacaggtatgactttatgtatgtttttatgtatgaatgtatctgtcttcattatatttctaataagaggagaattcagtattttatatttagtaattcacttagatatgggtgaaataatacctggcaaatgttaatatgtaaatataacttttcagtgcacattgaaatgacatggggaagaaattccaagatatagcctattaagtgccagtgaaatatagtgattgggtccttagttttatgtttcacatatttaattcataaaccactgcttctaatgtccttgtgcccatttttctactccttaaacttcttactcatcaaatactgctgtggagaaaatgaccatcaggagaattattttgattactttaaatctcttcaaagtttaattattggaatagaattgtatatctgaacacatataaaactatactatatagaaggtat

SEQ ID NO: 6443 - DNA, 1042 bp, Homo sapiens
agcagtattttatggttttatacattttctttatcagtatttcatgatttttgaacctattgtaaatggtcttgttttctgttttcatttttctgttgtttgttgctattactgtaattttacccactaattttccaaacgttggcagaaatgttgatactagtttgaaagctatagctgtaattgtgtattgaaagaagttaccagtaagctgatttttggaatgagatgggatatggataaaaataacatggacatttaatttataaaatgatatgtgttgttttatagttaaatattttatctagactacttaatttgtcttgtaatcttgtttgcagctatatttatggtgttacatataataatttctaaacattcttagattcataatatatcaaggttgattttaatattttctttatttcctgattaggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagtcagtagtcttttttgctatgcctttttaattgaacatagtaattacttaattgactaactcttaaagaataaaaaagtgtaagtctcaatagaccaaaaaggaatcagagtatttaaaatgtggaaatttttcatgatttagagtcttgaaatttatcattaagattgatttgtcaatcaatgactgagatgtagcattttctccaatattttggttatatctctcagtaattagaaaatattagtatttctaattactttggtagagtaattagaaaatcaacaatttatggtttagtccccagtctgcgtttaaaatatggaaatgtgattcaacatgaactcttggtgattttgaatacttgggcccatccttaactttattttataaagatacaaattattttgaaagtaagcctaatggtag

SEQ ID NO: 6444 - DNA, 1032 bp, Homo sapiens
gcagtttagttacatatgtatatatgtgccatgctggtgtgctgcacccatcaacttgtcatttagcattaggtatatctcctaatgccatccctcccccctccccccaccccacaacagtccccagagtgtgatgttccccttcctgtgtccatgtgttcccattgttcaattcccacctatgagtgagaacatgcggtgtttggttttttgtccttgtgatagtttactgagaatgatgatttccaatttcatccatgtccctacaaaggacatgaactcatcattttttatggctgcatggtattccatggtgtatatgtgccacattttcttaatccagtctatcattgttggacatttggattggttccaagtctttgctattgtgaatagtgccacaataaacatatgtgtgcatgtgtctttatagcagcatgatttacagtcctttgggtatatacccagtaatgggatagctgagtcaaatggtatttctagttctagatccctgggaatcgccacactgacttccacgatggttgaactagtttacagtcccaccaacagtgtaaaagtgttcctatttctccacatcctctccagcacctgttgttccctgactttttaatgatggccattctaactggtgtgagatggtatctcactgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggtcacctattcactctgatggtagtttcttttgctgtgcagaagctctttagtttaattagatcccatttgtcaattttggcttttgttgccattgcttttggtgttttagacatgaagtccttgcccatgcct

SEQ ID NO: 6445 - DNA, 1044 bp, Homo sapiens
ggcctgcagttctctttttgttgtgtctttgtctattcttggtatcagggtaatactggccttgtagaatgcatttggaagtattccctcctcctctgtattttggaatagtttgagtaggattggcattagttcttctttaaatgtttggtagaattcagctgtgaatccattggatcccggggttttctttactgggaggctttttattacgactttgatctcgttacttattggtctgttcagattttggatttcttcctgattcaatcttgggtaggttttttgtatctaggaattttgtccatttcttctagatttttcaatttactgacatgtagttgctcatagtagcctctaatttctgtggtatcagttgtattatctcctttttcatttctgattttatttgaatcttctctcttttttttcttggtctggcttaaggtttgtcaattttgtttaacttttcaaaaaccaactttttgtttcattgatcttttgtatttttaatttcaattttgtttatttctgctctgatctttattatttcttttctactaattttgggtgtggtttgctcttgcttttctcgttctttaaggtgcattgttaaattgtttatttgaagtttttcctgttttttttgatgtaggcacttataactataaattccctgtgagaactgctttttctatatcccttaggttttggtatgttgtgttcctattatcatttgtttcaagaaattgttcagtttctttcttaatttctttattgacccactggtcattcaggagcatattaatttccatgtatttttacagtttccaaaatttgttattaatttctagttttattccattgtagtcagagaggatgcttgatgatgtttcaatttttttgaatgtgttaaggcttatattgtgagctaaaatgtggtctttgagaatgctccatgtgccgaagaaaaaaatatgtattctgcagctcttggatgaaatgttctgtaaatatctgtttaatattagatccttgtggtct

SEQ ID NO: 6446 - DNA, 1034 bp, Homo sapiens
tgttaagtaacttgtaagtggtagtgcatagactttaaatcaggcagactgacactagagttcacattcataaccactcctcaaatgtcctcctactcttgacatctagactcaggatggacctgtgttacaggaaggagaggttgttatatttaacaaaagtgttcaatttttctttttcagttggctattcagttgttgctatcaatcatatcgttgactttaaggaaaagaaacaggtaaaataatatttctaaagttaataagttcataaataagtatttgtaattctgtttgtattggtaatttggaagctacagattagaatatttcttaaatgcacccctttgtgcactactacttttctattttatatagaaacagtcgagctgatgcatatttatacaatgatgatttttgtgaggtaatatgacatagtgttcaggattcttaaaggtgatttgaaattaagttacttttcactgttcaaaaagtgcattgttattggctggactgtaatcaaaatatttagtcctttttattctattgtcatgggcttattaactactttctctcttaaacattactaataagtatgtatatttctctttaggccaacaactgtatcctgtagattatttcagtctaaaaattagttttcattcttcctattcactgatgtttacagttgcttctctatttagctttctttttaaaaataatttttaaaagtttttttgaataccagaaatcaccttgctttctttttaaaaaaaatgcatattttttctgagaacacctcgtaatttttccattatgccttgtgctattaatggatacaatctgcagtaactatttatcgtttgttgtaggaaattgaaaaaccagtagctgtttctgaactcttcacaactttgccaattgtacaggtaggtgttttgttgtttacgaagcataatatctatttattcagttaaaaggtacctaattattgtgctattctctagcttgagctgcaccttactctgagtacc

SEQ ID NO: 6447 - DNA, 1485 bp, Homo sapiens
ctcttcaggaaacattcttttactatcaattcagcattgctttgatgatcttctttcctgaagtcctacaatttttaaattatctcgttatgtagtttaagatatatacatctctttctgtggctgtattgtaaattcctagagaacaaggactgggttttattgatcttcactatcccttatagccagtaccttttaatgaatactttccactggtaaaaaggaaaatcaattattgtcttttgtgcttttttgacatcatgtcttttttaaatagggaaaatcaagaccaattaaaattttaactagattaacaattattgtctcggatccatctcactgcaatgttttggtaagttaattatttttcttctctccttttggctttgtgagttgtattgattaatgttgaacaatgttgcattttgtcttccccattttacattttccctcgcccccgccaaaccatgacacctgcttgctctccttgtcctcagaattcacacagtgtaatatgtctgttccacttactcatggcacatgtgtagtgataccacaattaaagaatcccttggcaactgttactcattgaactcacgtgcaccagacttaaggtgggtgctggggggtattgccatgaataatagcacaatccttgaacttataaagcttaaagtttaattggcaaggcaagcactgaacaaataataattacaaatgtaaggaatgttccaaggtagggaagtggtaaataaaggatgctctgggagtatgtaacctgagtaagttgatattcaagctgggagacagaagagtcagtaaatgttaaataggtgacaagcagggagctaatgttcccagataggatggattatgcataggtcctgaagctaaggaaaacgtggtattttctgggaagtgaaacaaaacaatagggctaagcctagtgagccggttacatggcataaggttaaagatataaatttgggtgaggattccaagagcagttggaagcccttgaaggttttaactaagggagtgaaatgaggtttgaattacagagaatggattagagggagttaaggagggtacttaagaggcatccaggagggagaattgatgggatttattggttaattgggtgtaggatgattactccctaggtggcctgagcagccaggtaggtaatggtgtaccatttcctgagacggaccatacaaaccagcaggtttgggggcatcctgatgagttactgtgagagtttcaaaagagcccgtcaaaaaagatgtgcacagtggctcatgcctgtaatcccaacattttgggaggcctaggcaggcagatcacttgaggtcaggagttcaagaccagcctggtgaaagtggtgaaaccccatctctactaaaaacccaaaaattagcaggccgtgctggcgggtacctgtaatcccagctactcaagagtctgaggcaggagaatcacttg

SEQ ID NO: 6448 - DNA, 1019 bp, Homo sapiens
atctagtgctgcagaaagggtaagtctagcatgaagtactttgttttcatctttcaggttataaaacttttcagtttctaggggataaattaaaatagtaaatgaatatttgttgcatttttttctattttaactgcatttgctcattgtaattgctaaatagtaaaatttatccccactttctttaggcttcaacttttgtttatataatcagtttttcttttatactgttacaaaatgcctttcaagcttctcttatattttcaaaagctatgaaacccatcaaaattataaggacttaaatttatgtaatttttttatttttggatacttaaattttctattaatttgctataagtcattgaaatgttataaataattttctcatatctactctttgttcattttatttcagcctttagaaataagagggccatatgacgtggcaaatctgtatccttttctgagtaaaaagttgttgacattgtctttcaggaaattttgaatttgaagtcgtattatagttgaacatgtatttttctcaaccttttactgtaagtttaccaattaataacttcaaaaataaattatataacattatagagagctttatgcttctgttttttaattaatcatgagatagaaaagagggaatgagggacttcatatgataaaagcttagagttaaatgagtcttttctcagatgcatgttccagttggactaagaactgctgttgaattaattagcctctcaagatgaccaggttagctggcactttctgttatgtttgtgttagtctcgtgtccttgggtgactctgggttgaaatctttaatgctcccccaagaggcttgctgtttgggctctctgaaagtgacgccaaggctgcggtgtccaccaactgccgagcagcgcttctccatggaggtaagcaagttcttccagtacaaactgaatggtcatgttaaaagcaagtcatttttacagccatacctatttttattgccctaccctacag

SEQ ID NO: 6449 - DNA, 1068 bp, Homo sapiens
aaaagtgttttaaaataattggcagagtagatttactaagttaatcttgataaatgggaaaataatgcttaacactttatggttgactttacgtttattacttgaaataaggaataattcatagctaaatttctgttcaagttcttttgattctgccacctttgtagctaatgggtatctctctctttctccataatccctttccatttctaaggacagagtttgggtctgttttcatgacactatggcctttcataagttacccttccaaactctattttctcctaatttttttgtattcctacttcacatcagccatattgtcccctaaactattttacctaggttcttcttatctttctctccatgcctttgtaaaggaatatttctctttttcttactccgtttaccctattctgagtagtgtcacctttatataatacctcattgctttaaccaggcagttaattcttgtggatgcctccattcctattatatttgctcttattgtgcttctcgcatgcatgtagtatagggaaaagcactgtctgttaggaatcttaataccctctgtatggacacagtgcctagcctattagtaggtttctaggaaaaattggttaaatttaagttgaactctgctgccagcctaatctaagcatttaataatttctatttattctttgttcattgtcaccagttaaagagatcaataaatttatgagtgattttattcattaactcaactagtatttactgaacacattttgcataaccaggccattgttgagtgttggcaatataatgcaattgattcttcagaggtaccttgatgttctaataagagagatagggtacatgctgtaaaatgaggcaagcatgtgctccacatgggagccatacacttgattgctgtgtttgctctcttgatttgtctgtctaccatatataaagtgtctgctacatcaatgtctgtgactgggttctggctacataagatgccatggacagaccattagagataacactgtcctgcagttttacccatgaggtaatctttaggaatga

SEQ ID NO: 6450 - DNA, 1049 bp, Homo sapiens
aggagatgaatgttattctcatacctgcttacacaacatccattctgtagcccatggatcaaggagtcattttgaatcaagtcttattaagaaacacatttcataaggctatatgccgtagataacgattcctttgatggatctgggcaaaataaattcaaaaccttctggaaaggattcaccatgctagatgccattaagaacattcgtgggtcattggaggaggtaaaaatatcattaactggaatttgaaagaagttaattccaacctgtgtgaatgacttggaggggttcaagacttcggtggagtaagtaactgttgatgtggtggaaatagcaagaaaactaaaagtggagcctgaacatgtgactgaattgttgcaatcttgtcataaaacttgaacagctgagaagttgcttcctatggatgagcaaaggaagtggtttcttgagatggaatctactcctagtgaagatgctgtaaacattgttgaaatgacaaaaaaaggattttgaatattacatcaacttagttaataaagcagtaacagggtttgcgaggatgtactccaattttgaaagatgttctattgatagtaacatgctatcaaatagcatcagatgctacagataaatcttttatgaaagagttaattgatgtggtaagcttattgttgtcttctttcaataaattgacacagccatcccaatcttcatcaactaccaccctcatcagtcagcagccatccacatggagggaagaccctccgccattaaaacgattatgactcactgaaggctcagatgatcattagcattttttttagcaataaagtatttttaagttaaggtaggtacagtgttttttagacatcgtgctatagcacaattattaaaccacaggataatgtaaacataacttttgtatgcactagaaaaccaaaaaaaattgtgactcactttattgtgatattagttttattatggtggtctggaggtcaaaaatcatggacctgtgtgttctctcctgggaagtctttgacattgcc

SEQ ID NO: 6451 - DNA, 1035 bp, Homo sapiens
aatgctgacaaggaggtggagcaacaggaactctcatttattactagtgggaatgtcaaacagtacagctactttggaagacagcttggtggtttcttacaaaacgaaacatactcttactgcacaatccagcagttgtgtcctttggtatttacccaaaggagttgaaaacttgtggccacacagaaacctgcacactgatgtttatagtagctttcttcataattgccaaaacttggaagcaaccaagatgtcattcaggataaactgtggtacatccaggtaatggaatattagtgctaaaaataaatagctatcaagccatgaaaagacatggaggaagcttaaatgcatattcctaagtcaaagaagccaatctgaaaaagcttcatactgtgtgattccaactacacaacattctgggcaagcaaaaccatagagtaaaaagatcagtggttgccaagggttagaatggaggagggatgaacaggtatagcacagacgatttttagggcagtgaaactactctgtgatataacagtgcatacatggtattatacatttgtccaaatccctagaatgtagaagaatacaaaatacagatgtggcatggaggaagaaagaagttagatgaaaacaaaaggaaattttgagttctgaagaggaaagttgatggctgggaggtggctgcatttgaaatgggttggtttttttatattgatttgccaaaagtaagtggagagtaaagtgtaaagctgaagtggaggagagttgaaaaggtttggtaaactttgggtttgcgcagtggggagccaaaggtgatgagggcttgacaagttgctagaaggccttagcctagtgataggatgaatcactcctgtatttcatgactttctccagcaatgctcagaaaattggaagtagagatgctgtgagtatcactgaaactgccaactccatatgggcccttggttgagtaggaaggcaagtgacactagagtgtcgatgggctgggagaatagcagggaatatgag

SEQ ID NO: 6452 - DNA, 1054 bp, Homo sapiens
catctccctgtgttctgtccccatttttccatgccatgaaaggtgtctgttcatacctatctccactagacagtgcactcagcaaaggcagggaggtgatgttttgaaatcccagtttacaacatggtgcctggtacatagtagacacacataataatatatgctagataaatgaatataagatttctctgtaaattattgagaatctacacttgctgtttgaggttcaagatgaattctacttagtaatatatgacataaaaattgtattgctttaatttctattctaatatacccttaccaaatatccaagctgataagatctttccatatatacatacatatctacatgaaaatggaagaaagttaaaaagaccaaagaatatacataaatattaaatatctaggataacacacttcatagagccctgcacaatgcatggggtttatctgttctttttcgcttaggccttcttgcctggtgggaaacagttaaaatcctaagaagcatctgagccagtattgagcacattaatattttcatattgaacacgtctatattttcaagttgcactgaagttatgagtataaaaatgtagttttgaaaggttttcctcaaccatgtggaaacatacggagattttaactgctgaaacaatttcaaatagtttacaaatcaataaaagccagacagaaattaaagtgtatcttttttcctgaggttaatatcttagtttgtttgtgctgctacaacaaagcaccacaaactgtatggtttatatacaatagaaatttatttctcactgtttttaaggttggaaaacccaacatcaaggcatgggcagattggtctctggtgaggacccacttcctggtttccaggtggcacctgatccctgtgacctcacatagtggaagggactcgctggctttctgacatctcttttataagggcactaaccccaatcatgttctcatgatccagtcaccttccaaaggtctgacctcttaatcccatcaccttgggggttaagatttcaacatatgaattttg

SEQ ID NO: 6453 - DNA, 1047 bp, Homo sapiens
tcctatcatggtccccccagtgacattactaatcttaattacctcccaaagccccacctctaaatgccatcaacgtatgaatttgaagattaagttatcagcacatgaaatttggggaactcattcaaatcataaacaggagcttaggtcccatcaaagtgaaagcttaccaggaagcccaatgtgtaaaaaaaatacgtaaacagagttatgtgtttgaaggtggagtggagaactatcttctcccctcctccctccacccacagcccctgagggaattctgagaaaccccaaggcagcaagaacaaaaacaatgtctgcagaaagattttttaacactactgtaacacctcatttgttctgtattgagttcattttccagaaaaccttttttttttttttttaagaaacccatcttggatgaaattttgtttaagtgtgttacttttttgccttcttaacaaggctgaatgaaaaccttttaatctgttcttgatgacttttgatcatagtgatgaacatttagttaaggttctgtgctttaatgtggtgatttccaacctcagagtttctgaagtgttaggactgtttactggcactatgcttttgaaattgttagaagaagcagggtggcatcaagggagggtcctggacttgggagctacactgtccaggattatatccaagccttgcattttattagcattgtgaccaggtgtaaccactgtttgcctcaatttcttctttcccaaattgagaagaataattgtactcaccccctaggattattgtgagaaataaataagtttttatatgttcactgcttagaaccatgccttcgtataaaatgtgctgtataagtgctatgatgatgatggtcgatgtatctgtttttatggttcttctgtcttttttgatgtagtatggtggttaagcctatagactctgaagcaaaataacctggatttgaatccaccaccgttgtgatctgattgttttaagctgattaatttttgtgaacctaatgatttcagtaaaacccaccat

SEQ ID NO: 6454 - DNA, 1028 bp, Homo sapiens
agaagttaacgcctatcagttggagaaaaagcaaatattttgcattgacagtctcccctaccctctattattgtcattttcttaagccatcactgctctggcttctagaatacacatttttgaatgaaggtttttgcagtgaatggtctcttgtagatctcaaagtccactagaaagagtactgggtttttgtttgttttgaacgttgcaaacagtaatgcttctttaccactcaccctccccccaccctcaacctccacaacgttcccgtttgcttatagttgtcaacgaccatgatctctggacccacactacagtaacaagtttgtcagtcattttcagataaggtgcaaatcaagggatggctttgtccccacttcggcgcaggtgggacagacttggggaagacgcagctgaagagacaaattctcagggtgcgtcagtctcatcactgaccgttgcttttaaaccctccagggaaaatatgccagtcattgttatgatgtaaacaaccgaaggggtggacggtgaggataagaagaaccgagataatatttggccagagctacgtgtagcacagggagccagggcggcagctgcacctgcgagcagcgcaggcggcaggcgcggcctccgggcgtggtggtgggcgtggccgggcggcgggggcgtggccgggcggcggggcgggcggtgccgccggttggaagtgggtggagttgcccttggaggcggcaccggacctgggccccgaggcccgccgcgccctgtcgggcctgagccgagtggccccacagagccggcgcgctcccgcctgcagggggagagcagacggggcgcggggaccggccaggccgcggcgggtgctgtttctgtttcactttccttcactctgaggccggcgcgctggcgggcgaggagcggcggcggtggcggccgctgggtaggtaccgggcgggctggggagctgcagggacgccagactcctcacccaagtttgcgcctcaggcgagagcgacacctccaga

SEQ ID NO: 6455 - DNA, 1069 bp, Homo sapiens
tgaaatgcataaatgaagctttataattggtgtgcaaaaccagacatagaacctgcccttctggactctctggtcaagtgaagaaagagtaatcaagttaagaaatgtaaaaaaaaaaaaaaaaaaaaaaaaatgctgttaagtgcaatgaggaaggacagactatgatataatagcagatgtgtatcaggatactggagcagaatgatatgcagaagaaactcgtgttttgtgaaattcctgaagctacagaccatatgccatctcaggcagatagtagcccttgagtagtggtgcagaggactacttatgggtgggaggcagggattattagtagctctctctgctttgatatgggtaaatgaagttacttcagtcttctttcagatgactatgcaagtgcatttcaactctttctcacctcaaaccagataggttggtgcttccccattctctcagagagaaattctggatccagcactgctgggctgccctgtagaagtaggtagatatagaaagaagggcccaaaaggtgagctcatcaaaaggaaataggaggtagagatggtggggcagcccagggtcctggcaggagatgcaaaaaatcacatcatcatatcacatgatcacatttgatgacatgatcaaatcagcatcataaaaaccacatatttagactcttcttacctactaatacctcttcccttcagtaggccagggacatttgataaatagataaaatttttaaatgagttaaaattttcaaacacaaatgagttttagctttaaatgatcacttaatactagatgaactaaatccgcattaaccatggtttacatggctgtgagataattttaatagcctaacaaaccaaaggaaataaacatgtctgcacaaataattattttattatttaaactaagtaattacatatcaggcactttgctagccactgggggtagagtggtaaataagataaatgtgaaatgtatacactattgagcaaacttatatgccaagaagaaatttctaacacatgtatttagatgtatgttcttttttttttcc

SEQ ID NO: 6456 - DNA, 1055 bp, Homo sapiens
gtaagagagagacaaatcaagggtacatgtaaggaagtgatttaatgactgaccatagaacagattagtcctaaattgggctggaaggacagaaagggcatcaaagtagtaagtaatgtttcagaggaaacagaaatgaaactaagttggttcctgatctgtttgtatgtagtgagaagtgctgttttttattcactcctactattaaatagtctgggaaaactttacgaatgaccttgtcttgaagaataaggtagcattggtttggtcggagagtacagagagtatttgagccaggatgtaaaacatgagggagaaaaatgaattggaaaagacaaggaattcttgggataattgaataagccagttggctagagaagggagacagtgagcaaatagtaccagttatggtttgtaggttggactcaagttatataaacacatgaagtcaggtagtagagagaaattagtccttgagcagggaactaacacaatcagattagcactttaggaagattgattatgaacatgtctctgctctgctcaaagcagaatggtaattaattgaaggaatggaagaattgttgggagaataggtgggacagatattgagagggagctctgaatgtggcttggtgagtaaatgtgtaaatgaagggaaagagagaagttaagatcattctcatattttgagctgatttggaaaaattatggtatcacttaaaaatttagtttaaaaaaagcgagacaatgactgggctacttagtattttattggaggaggatagatgagacaatcttgacatagattaataaaaggaggtacttgaaatgtttagcatctgttggaaatatggaacttgaaatcagcagagatgtgatatatagtcaggcagatagatagatggatagatggatagatagatagatagatagatagatagatagatagatagatagatagatagataatctgcctatatgttagttttgaagccacaaaagcagatgaaatccacaaggaagacagaaaaggtcaaagagttcagagtaca

SEQ ID NO: 6457 - DNA, 1047 bp, Homo sapiens
ggctgattttatgaatagtaatttgaaattttgagaacttaattttatcatttgaaaagtatttggttttaatttgaatatatacttatttataaacgagtataatttatatatacacctataaataatttggaagtatttttatatattctgtccactttctaacatagtctaattactaattgtaatcatttttttggctaaatacagctagtcctgaatctttcatttggatgtcccaatgagcctagaaatcttaagctatgttaataagtttccaattttttttttttttttttacaaaatatttccattgctgagttggttggaacattttaaagatactaagttcttcttcaaaaactgttaggaaattttttaaagttgatttttgttttgattatcaatgtatgattgcttaactttaaaatcaactttgatttatagctaacttagttttgtttaaattatacagatgatacttcaaaagctgacaaaccgaaagtagatgaagaaggtgatgaaaatgaagatgataaagattatcacagaagtgacccacaaattgctatctgtctagattgtttacgaaataatgggcaatcaggggacaatgtagtaaaggtgagtgaacaagtactatggtatttttatgatcagtttatagtaaacccttgataatttgttgacaaattttctaatgcttcaaaatgtttgctttcaaagttttaattaacataattaaataaaatgccattctttgacaatcctatgcttagaaatggttactattcccacaactgaactgtcttgggccaatgccaccatctagtggctaatgcccagaatcacacctctgtttctccttttatacctttgctggaaattcatatgcatggtttctgttttttagagtggtgaccaacttagacttagagaatttcatgtcactggtagttctagcccttttattcattctcttctaattttatcctttatttctctatttttatttgcaactcaacaagatttccatgtcagagctaa

SEQ ID NO: 6458 - DNA, 1029 bp, Homo sapiens
tctgcttttatagattttctttggtctttaaatggtgttactttaataatgttttctacctttttattacaagcagcttttatttttattacaaatcttcactacttcagctgttagatttttgtcactttatcctagcaaatgtcagccactgagaatattgtttatctctctgtattctgtgttttattcaaatgcctatattcattgtctctaattttcttttacttcctctgtgtacatctataggctagtgggttgaattttttactaatacgtttaatggcattttcctattaggaagtgaaaaacaatttttcacttcagattaagttttcctggcatcttataacaacatatatgagcacagtaattcagtgaatatttatccactatgtgaacagtagacagtgaagatgtaagtagtaagaaaaaacatctttcactcaaggaacttggttaggtcttatacatacaaatagttaaggtaattgattttgttaaggggaatttattggacagggcatgtaataaagtgcatctatctttagagaaatgaccactgtacctatttatccttacagtattttcagttgtttcttatggtctttcccaaaagtcatccccctttttgggaagttctttttcatagagttcatggtcatcctttagctctccaatacatgagttagctcatactgaaagttaaatcaatggaaaggctgaatatcttctcataaacaaacgtaaagtccacttctctgcatgatttctcatatgaaagtataaaagattgaattttagaaatttatttgaaaaattaaccacccctgcttgttgttctcctttttgacatctttgacactttgctattctagttgaccttttatccattcactttttcctttatggacttttcttcatccttgtaccttcattcttagtttataaatgacttttactaagctaccctgattcttcctttttttcctgtggcattcctgctttgtctccactgcctctacttct

SEQ ID NO: 6459 - DNA, 1027 bp, Homo sapiens
ataagatagccaagagaagccctctttgaggtggtggattgttgatcaaaagaaattgagagacgttgctatgtgaatatctgaggtagagcactgaagcctgaggcaacacactgcaaaggccctgagaattgattatgtctggttatttgagaattgcaaggaggccagtggggctggagcacgacagtgcagatctagtagggcttatttttaattaattatactgagactgggtggggaattcaattctacctcacattttatatcagtataggtttatgatggcttaaaatggtaaatattttaaatgatactataaaagatcaagaagaaaatatagttgaagaactgatctcagagtggggatggcctttcacgttgtacctaaaaaaattgaattgactattaatattaaaagcacatggcaaaaatatcataaaatatatttgcaatgtatgatagaaaaaggtttaatgttattaatacataaagaattcatacaaatatgtaagaaaaagctcagcttttcataaaaatgagcaaaggacatgatcaggcaagatacacaagaaggaaacacaatgggctaataaacatataaaaatgattaactttcttagcagtcaagaaatgaaaaaaaaatactatcttatgcttattaaattgccaaattaagaggtggggaaagatagtactcattattgatgaggctatagaggaatgggcattcaaatttcttttaaaaatgtagaaaaataaaactacattttattttttttttttttgagatggaatcttgctctgttgccaggctggaatgcagtggtgcgatcttggctcattgcagcctccgtctcccaggttcaagtgattctcctgcctcagcctccttagtagctgggattacaggcatgcgccaccatgcccggctaatttttttttttttttttttgtatttttagtagaggcggggtttcaccgtgttggccaggatgttcttgatctcttgacctcgtgatctgcc

SEQ ID NO: 6460 - DNA, 1042 bp, Homo sapiens
tgtttggtgttcttttgttgtattttttagaatgggggtgggggcctaagtgtccttatgaagctgtggtccacgacaggagcttgttgggggagtaccagggttctgctgctttcctgcatctgagcaacacaacagagatcatcagttttaaatagagtagccctcacaatcaaaatatcatagaatatattgtaaagttatgttgctaattttcctttgaaatataaaatattttaagctttttgtcaaaagtggtaacatcttaatacaaataaaaacctttttgtggttgtaagatttagcttataaatcattcaaattgaagtgaaagaattaccaggtcattgttaatgacttagtctattaagaatatatgtatttttgtaaaggaaaagcacttgtagatatttaatcagtacaagatatgtcttttgcagaaataaaatgctgcttagagattctccttaaatattttttatttttgtgctcaaatgtattttctgttgatctatggaatgttctgtacaaagctgtataattgtactgttgggctagatactttttttttttaatctggacttagccaagtatatttcaccatgttaaaatacagtatctttgttattaaaaattaaattgcataatttattattgtttgtcatctttaatattagtcactgtagattgcagccttcattaaaaatatctcctttaagtactagtcctgtagcaaattttattgaaatttattgagtatttgagatcataaatattttctaaggattcttcagctgtttattttaaaatggcacactgtccctcaaatactagttaaggtgtatacacacacacccttgaaggattttttgttttgttagattaatcaaatccaaaagaacgttttgaaagtaattaggaatcaaaggcaggcccaagtgaattgaaagaaagactgtttccttcagccagttagatagctaagctttgtttattaatactttccatgtgcacttgcctcaggaattcattaggccaaagc

SEQ ID NO: 6461 - DNA, 1030 bp, Homo sapiens
tttctccttacaaaggccttttcctccttcacgactttgctgtcatacagtcctgctccttcagcaagccctattcttcctgtgaagttctgctcctcctataagccctgatcttccttaaacagctttgcttcccctacaaagccccactctacctacaaagccctgcttctcctgcaaagcaatgttcttcatacaaagcattcctcctactacaaatcacttttcctcagacagagccctgctcatccttacaaagtcctacttcttcaataatcccaacttatccttaggaagccctgctcctcctaacaatgtcctgtttctcctacaaagcactgttcctcctcacaaagcaccactcctacaaattccactttatccttacaaagccctgctcctcctgcaaaccctgctcttacttacaaagtcctcctttttaaagagagcttctttttccaatgtcctgttgctcctagaaatccccacttcttcaaagtccaactcctctttacaaagtcctgctcttccttcaaagccccaatccccctacaaaccctgctcctttacagagccctacttctccctatagagccttgcccttcctacagatccctgctccaccttacaaagtcctgatgctgctacaagcactgtttctccttataaatatgtgctcctcttcacaaagacctgctcctacttacacagccctgctctcctacaaagcccagcctctccttgcaaagccccgcccatcatacaaaccctgtttcttatttaaaagccctactcttcctacaaagcccactcctccttacaaagctctattccttctagaaaagccctgctcctcctaaatccctgtgcctcctacaaagcccgcatgccttcacaaagtgcaactcctcttacaaatctcagcaccataacaccccttctcattagaaattgtgctcctcctaccaagcttgctccaccttccaaaagcttgttcttcctaccaatgcctgtttctctttacaaagcc

SEQ ID NO: 6462 - DNA, 1035 bp, Homo sapiens
tcggttccgctggatgtttgggttattttctggggcttgggcccccactttctctaagagaatgacctgcatcttgagtcggcatgatctgttggatgagcataggtgtcagcaggcgggagtgggttttccacggaggtgcctgcctgcctgcctgccttggaggcgcgcagatttttgtccttttcttcgcttttctttcccttcccccttcagattaaacaggctctgcggcgagtttccacttaattgtgacctttccgttgctgtcagtgtagtgggaggtagatgcatcagtgatggttttatttttcatatggtacagacatgtgactcaggtggggggaggctttttgaaccttttatttaaacccaagttatctaagcttgacagggatgatttcccagctgtatcttcgtaagggttatttggagagcgctgtcaggcttcaaactacatattgccagatgatgtcatgggacagccccctccccctctttccctatttttactggtggttgtgactggttaatttgaagcacaatttaaaaaaaaacctcggattttgcaattttttattttgacataatatttaagtactttttgaaagtttgctttgatatatttaaagatcatgacttgtcatgcagctgtgtgtgacaaaatagtaaaagtttagtgaacattatacattttctttattcctacttgcggttcatttcttaaaacctccctcttaaatgactaagaacttactaaaatagctcactcttcgttaagtactgtattggtgttaggaataattttcggattcggtaggtttttcaaaaatgtctgagggccctgataactggaaattgttaaaacaagctctttaaatcaatgcagcaaattgcgaacagtaatgatacacgtttaaaagcgtagctacaattgattggtagattggagctggggttagggattaccctagaaaatgctttgaaggaatttgtcacccagctgcttggagacctggttcctgctgctggtac

SEQ ID NO: 6463 - DNA, 1046 bp, Homo sapiens
aataaagaagaatgaacaaaggctccaagaaatatgggattatgtaaagagaccaaatctacaactcattgacatctcagaaagagagggagagaaagcaagcaatttggaaagcatatttgaggatatcatccatgaatatttccccaacctcactagagaagccaacattcaaattcaggaaattcagagaacccctgcaatatgcaagatgaccatccccaagacacacagtcctcagattctccaaagtcaaaatgaatgaaaaaatgttaaaggcagctacagagaaggagcagttcacctctagtgagaaccctatcaggctaacagcagacctttgagcagaaacccttcaagacagaagagattgggagcctatattcagcattcttaacaaaaagatattccaaccaagaatttcatatacagccaaacaaagcttcataattgaaggagaaataagatacttttctgataagtaaatgctaaggaaattcgttaccaccaaacctgccttacaagaaatccttaagggagtactaaatatggaaaggaaagactgttaccggctgccacaaaaacacacttaagcacataaactattgacactataaagcaaccacaaaatcaagtctgcataataaccagcttaacaacatgatgacaggaatgtaaaaaggctaaatgtctacttaaaaggcacagagtggcaagttgtataagaagaaagaccaaactatatgctgtcttcaagagacccatctcacatacagtgacatccataggctcaaagtaaagcaatggagaaagctctagcaagaacaatagaaaagaaaaaagagcagggattgttattgcaacttcagacaaaacagacttttaaaccaacaacaatcaaaaaagacaagagcattacataatggtatagagttcagttcaacaagaagacttaactatcccaaatatatatgtacctaatacagcagcacctggatttataaaggaacttcttagagatctacaaagagacttagataaccaca

SEQ ID NO: 6464 - DNA, 1027 bp, Homo sapiens
cccatgctcttttcactgtatagccgcagtgtaaatgaaagtctctgttaattaaataacaaataggttattgttattttataatctcaaattttgtttcctgaatttaccacgtacttattaagcttagtgtctttccttttacgtgttaacagaattttaacacaattatctttaatatctttttcagaatcctcagtttaataacacatctacgtatgtcatctatgctcacttgctacgacagatagctaccttagtggaagctgaccatcatttcctagttcactggtttaaaaagtaaatcattctatgatattaagaacttttatagtctcacagttttaagtttggtattagtaattttacaataaaatatatttaaatattttcaggtctttagaaatgatgcttatattcacaatgcttcaaaagccagttacaaaaatctactttagtactacataaaggataattaaaaatctgtttttaatgtaagtaaccaatttgtttgcacaagctgttgagaatttctgtctactgccttcactttttatatagcacattcctattattggttttttacgtatctcaaagatggtgactggatttgctcagacactactattttaatgtgtgtctttttattttctatctgtaaattcataaatttcaccattatttaaatggcgctttctccttacctaaaaatgtcattgtaaaatataggctagccatcaatatcaatttgtaaaagcataatacttttttcacagaactatacccacatgaacaatgacttctccatgactgataaaagtagaaaggcaaaatatttccaaaagaaattttaaatgcagtaaattatcattattcatagtagttatattctataatgtcaccacaaacatggaattaataaatacagaaccattgcttcaaggggaaatacagggttaggttcctgtgagcctctgatcacatttttgtcagccaatcagtatataactttgctttatgagtgttt

SEQ ID NO: 6465 - DNA, 1048 bp, Homo sapiens
ctatctttttaccctgtttctacccttggttcaggaaaataaaatgttctccatatatatttaatatatatatttatatttgctgagatttgcaaatatatagtcccataaataatccaaaatttttaacttgaaagatggtttgtaacagaattattgttgaattgattagcttctaatagatgagatgtcatgtacatgtttaccactttgatttttttaagtcaatcatgttaataataacattattcgtgtgtttttttaggcatgtttacatatcacaaggattcacactgccattggtttagcagctttaaatgtgataactattctgaattccgattggttggaattgtatcctttaaactttccactaggaggtgctaatagattagagatttttaaagattttatctgtattttagaaaactgttttctttagccattttatccaaattaaatgttattgtcaaatgtactattagattttcagtaatcttcattatgtgtaatatatgtcagtagacttaattgaaagaaatgagagtttgatttttttctgaaaaccttatctcaaaataaaaatggttctttcctatttcacatataattgaagttatcactaatttaaggcattttttaaaaaaaatcaaagtatttcccatttataatgaagtattttttttctgttctttcactttgtgctcatttccctcagtttactgaattgaaattgggggaattaaatctagctctttaatatgcctccaaatcctgaaacataaaggaagcatccataaaaattgaatggaatgggaatatttaaagcatatagtattattttatagtatttttaaaaattttataagtccatctgcaatcctatgattcctatcaggtatattgtagagggcatttctgcattgggtaggagattggacaagatgccttctacattagctttttagattccaagaaatgtaattgtttgtggaagaaaggagggaagagtaaataaataagcactggagataagaaagtataaaag

SEQ ID NO: 6466 - DNA, 1083 bp, Homo sapiens
atgcatgaaacactggcataaaaataagttgtgtagcttaggaccttgtaaacagcagagcactttagaaaaaaatatattaaaaaactgagttggcattttcatttttttctttgctttgttatttgatgatatttttaattcatacaaatgtatgtctggtgcgtaaaaaattaagaatgttaaatcttacatatgaacaacactggttttttaagtcagactgatctgggtctgaatattgggcctacatctttaccagctctctatccctgaacaggttacttgtatatttacatgtctatttttcctcaccagtaaaatgagaacaaccacttttaagttgctttgaggctgaaattaaaggaaacaatgcatgtaaatgcactcagcacagtgattatcatagaccaaacactgagtaaatgctgattctagtagttttaagtcttttaattcagggggctctcaaaatttagttttaaatcttacaaacttctttaaaaatgttttccttttctgtagtgtattcacatttttattcattgatttctctgacagctgttctgatgctgtgaagttcataaagactgaaggaaagagtcttaagatagctgtaagaatcctaaatgatgataacaacactatcagatagtaggtgggggagatgacaccaaaaggattcagaagataatttttacatgtgcatcaaggggcatctactgtccccaaaatgctcttttttaaattactttttaatactaaaaaccggaataatagtatcattcattatattatctactcctcggctgctagatgttttgtgtatatcactcttttaatctttttaaccatcagtcctcaacctttttggcaccagggatcggttttgtggaagacagtttttccacagaaccagggaggagtggggagagtgggaggtggtggtagttttggatgaaactgttccacctcgggtcatcaggcattagattctcataaggggcatgcaacctagattccttgcacgtgcagttcacaatagggtccttgttcctatgagaatctaatactgccgcttat

SEQ ID NO: 6467 - DNA, 1120 bp, Homo sapiens
ttcttgagaccataacaatagagattttatcaaggattactcctcagtttgggaagtatggttttttgggggttgtgggggtgaggcacagagtttcactcttgtcgcccaggctggagtgcagtggtgcgatcttggctcacttcaacctccacctcccaggttcaagcaattctcctgcctcctgcttcagcctcccgagtagctgggattacaggtatgtaccaccacgcctggctaatttttatatttttagtagaaacagggtttcaccatgttggctatggtggtctcgaattcctgacctcaggtgatccacccacctctgtctcccaaagtgctgggattacaggtgtgagccacagtgcccagccaggaagtatcttcaatctaaagatttcgccaaactccaagcaacttttttttttttttttaaacatagctacctattgactgcctccaaataatttcctttaagtgcccaagatgtggcttcaaacattaaaatctcagactattaatctactgtctcagcatagcagattacattcactcacatattgtagtccttacagtgtgactgtaaaatcatacctctactatcagtcaccagactggtttcagacatcttaatgactagggaatcatgttgatacagacattgacacagaagtctgtgtcttggaatgttggtaactatgtggatataatcactttacccattctacccatatcgatcgcctcagctaaaacttcagtttcagttatgtctttctctttaactctgatttcatgcaaccctcttctctttccagccttattttgacagaaggctactacttgaccttcctttagatcaccaatcctttgggacagatatcttcccagttgacactgtctctcataacagctagttattttactccagctatttctgtgcacatctaactctcctttctgggggagttaacctgtgagtcaccattttgattacttcagatatgcttattactgctgaagaatagtaatccttattctaaaatgcttgggtacatcaaataactttatagaggtagctttacaggtttttctttattttgattctttttctcttactctc

SEQ ID NO: 6468 - DNA, 1049 bp, Homo sapiens
ttataattggattttctggttttatatttgggttttttccctctcacacattttattcaaccattatttgaatttcattaatatatttgattaatatttcagtcaactccattacatttggcagcaggatataacagagtaaagattgtacagctgttactgcaacatggagctgatgtccatgctaaagataaagggtaagcatttgaacaaaaacaaggactttttaaatgttaccctcttcttaaaacaatctttgtaaccttagaaaaataatattttttactaaataacattaatatatattgagcttttacaatgtacaggttgctctgagggcgcaggaaattataaaaccttaagcccacagctcatagaaggtttacattacacttcagagggcatgaaaagatacctaagaatacaatgaggtctctaccaagtgttgagtcatagagagggatagcactgcaggagttcccaggaaggaactctcagtgatggttgactggagtggttgggaaatccctcagaatgaggtgtgacttgacctggactgtaaagtcaagtctcaattcaagaaagcagagtttgcgggacattagtctgtaagacaattgggataagtgggggctgctacagcaaacgttaaagcacatttaaaaaacagtgactagactagctttgctggagcagatgattcacacaggagacaaatgaagtttaggattagagaaataggtaagaaccaggttttggaggactgggtatttagcctaagtaattcaaagttcaccctgtgatctgaaacaaaggggatgattattctaaaagaagttttaggaggtgcgtttgaaagcaatgtgttggctaaattggagagagaggagactagaagcaaaagcagcaattaggaaagtgagcattctagaggtttaagcataatcaggatccataataatggtggcagaagaaatgaaaatgaaggcatagatgcaagagatattgcagtgtaagaatgggtaagatttgttgaatggatacaatga

SEQ ID NO: 6469 - DNA, 1034 bp, Homo sapiens
cgcccaggctggagtgcagtggcgcaatctcggctcactgcaagctccgcctcctgggttcaagcgattctcctgcctcagcctcccaagtacctgggattacaggtatgtgccaccatgcccagctaattttctatttttagtagatacagagtttcaccatgttggccaggctggtcttgaactccagacctcaagtgatctgcctgcctcagcctcccaaagtgctgagattaacagacgtgagccaccacacccagtccaaaacttcccattttgatcccttttagatgagagtagaagatatatattatctttggaagtggatcccaggatgttacctataccttttaacttctgttaccctgcacccattctactccttcagcacttttccccactttcagcagctgttacgggaagagaaagaggacacttgtttccagtgcctctttggttcctttcgggcctgagtcttatgaaatacgttttcccatagaaacaactttataataataattagatactctgagtagcatattaaacttataatgtggctgtaatgttatacatttgtaacagtaatgcttttgcttcttgtaaaactgaatcttgactccagcagaacatttgaaagttgctatggataagaatgaaacatcaaacagattgcacttggacttaaagacaactgagtggtactttcctaagacctagtattttactaaataagaatgaaaggctgactagaggtcatacctacagagggagttagctaatgtgagggtgtaagtagttaccaggatagtaaagttaagcaaagtcaggagaaagcaagtagatagggattgagaatgcagattctgagcagtgctgagtcaattggcaacacttgcctaaatagtttggctaccagaagctggcatttaacagcaaacacccagtgactgctttccatgaccagggcatttgctagccatggaaggcactaagacacgatccctggacaaagcattcaaataatgaaggtctgg

SEQ ID NO: 6470 - DNA, 1034 bp, Homo sapiens
gttcacgaaataagtcgcacaagaaaaagatgggagaggagaaaatactttggtgtttacttcttgtttaaacaataatacagagtttttaaatgacccattaactcaattttaagtataaattataatgtgacaacttaagctgtcataattttgggccaatagtagaatagtattgcaagcaatataatcatggatgcactgtactctgcacacccaaaccacactggaatctgtgattttaggctctcggtttggtttggtttggtttggttttttttgttttgttttgttttggtcgaggggagagggtctcactctgccacccaggttggagtgcagtggcacaatcatggctcattgcagccgcaaccttcccgggctcaggtgatcctcccacctcagcctcccaagtagctaaaattacaggtgtggtgccaccacacatgttaatctttttattttttgtagagatagggtttcaccatgttgcccagtttggtcttgaactcctaagctcaagcgatccacccacctcagcctcccaaagtgctggaattataggcataagccactgcctctggcctcaattattttttaatgaattttttaaactaaagtatatttagttgagggccaccatgataataagtggaaaccatctgatatgaaagatgagtgccctttatgatgtcttttgctccaaaggcaaatagatgaaagttaaaagtgcatattttaacttaatatagaagaaagctttgtaacaacagaagttctctagtaattataaaaagccatgttactgcaaattagctccccattgtcaaaaatactgaaagagtaagaagctggttcaccttagttgaatgctgtagaaggaaatttgtgtttgattggttaaactagtttgacttcagtggtccatacttagccaactccagtacttggaaatggctaaaattaaaaagcctaacaatacaaagtgttagcaaggatatgtagcaactggaactcaaacgttgccacgtagc

SEQ ID NO: 6471 - DNA, 1054 bp, Homo sapiens
gtcgcccacgctagagtgcagtggcatgatctcagctcactgcaacctccacctcccaggttcaagtgattctcctgtctcagcctcccgagtagctgggattacaggcacgtgccaccacgactggctaatttttgtatttttattagagagggggtttcaccatgttggccaggctggtcttgaactcctgacctcaggtgacccgcctgcctcggcctcccaaagtgctgggattacaggcctgagccactgtgcccggctatattctgttatttcttcatgtaaagaaacctcaacctttgcaagggtgttttcttaacctttaaaatattgcatgaacacaatgctacttggaaacagttttgaaaaggatattggtcacattaaggttttcatcacaccagtgctagctttttcaaagatacaggacaactgtaaagtttgattggaatatgtaataatagatattatctgataggtaggattttcaggttctgtcagaatttggtaattgttgtaattcaatcaaaagtcaagagcaaagttgcgtcaaaagtaaaacaaaaagattaaataactacttgattgttcttgattggaaacacgaatgttcttaaaatcagttatgtatagtccttgattaatgctgcaatttaaattatttagcattgtgctgctgcatctccatatcccaaaagaaagcaaatatgtgaactgttgctaagaaaaggagcaaacatcaatgaaaagactaaagagtaagtatacatttaatgattaaatatcattgagattttactcttttggaaaatatattcactgtctggctgattttttctctctaagattcttgactcctctgcacgtggcatctgagaaagctcataatgatgttgttgaagtagtggtgaaacatgaagcaaaggtatacttcctttttggtaatctttggtaatccaatgagttattttttatttagcaggtgaaatgcctgacttcctaaactatttactttctcataagtattacttttttttccttataatctatg

SEQ ID NO: 6472 - DNA, 1048 bp, Homo sapiens
agtctctgcatttaaaacattttttaaatgttctcccctgactcaccaaaaagaacttatttctgccttaaatagatttaggttctacaaagtataatcagtataattccttatgtagttcaagaattatctttcatcagttatatgtaattatttaaattaaaacatgttcttctgtggcattattgttcatttattacttttcagaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccaggtatatttaaatacttaactgtaaagagtatgaattacatagcatatgtttatggttttctaaataattctagtataaagttaaactagtaagcaatgggaagcaatgttacctaattctgtacctagattttagaataaatataataaacattttatattttaatccacaagtatgtttactagcacctagagttatttttgtctagagccaactatcatgtgatagttctcttattatttttagtttttctctttggtacttttatattcatcaaatataaaaatatttgatgaattatttacttacaagccagatttatttagcattgataaaatggatgatactggttcagtacagataccagtggatattttacaataacaagaatacagagatttatactttatttaaatgttcatgaaaagtaaaaatagtataacatgaaagttaatttttaatgaaatatgactttattttgaatgtagtttaaaattttgactacattaatgcattaaaaaatccagtaatatttaactgcctctgtattctttttataataattctttgtataaacattagtaacagtgatgttaaccttcaaagtagagtctcaatataaatttagtttttctttggtatagttaacactgactattttctcattgaccaaag

SEQ ID NO: 6473 - DNA, 1006 bp, Homo sapiens
atctgcttaggggagatgcagctttgctagatgctgccaagaagggttgtttagccagagtgaagaagttgtcttctcctgataatgtaaattgccgcgatacccaaggcagacattcaacacctttacatttagcaggtaagtgaatgaagtttcacagatttaggctggtaatatctgagattcattttacccaggtaaaatattttctgtaactaaactttaaaaattcaaatcaggccaagcatggtggctcacacttgtaatcccaacactttatgaggctaaggcaggaggattgcttgagcccaggaatttgagagcagcctgggcaacatggcaaaaccacacctctataaaaaattacaaaaattagccaggagtggtggtgtgcacctgtagtcccagctattcaggaggctgaggtgggaagattgagcccaggaggtcacggatgcaataagccttgattgtgccactgtactccagaaacaaagtgagaccctgtctcaaaaaataaaaaaaataaataaaaattcaaatcaagtatcttctaatgccaccattatactcttcagtgtatttgtacaggacgaccgtacttgaagctattagctgagttcgagttcactttattactagtatgttacattcagtaagaacaattgaagtaggctctgccagtccccatgtgctttgggaatcattattccaggtaatcattttattggtatcacctttggtaaacaagttttgaaaaatatgcctacttgagccagccttccttataggaagctaaagctttctatttttcctgatggtagctgctaagcacaagcaggaaaaaaaaaaaatctcaaaactctcagaagttacataagcctctcaccaaagttatctgttgttttggtttgtgagagttctcataacaaaataccaaagaccaggtggcttaaacaacagaaatttgttttctcacagttctggaggctaggagtccaagttc

SEQ ID NO: 6474 - DNA, 1026 bp, Homo sapiens
ggactcatacaagtttgtctaaatatacatgatttaaacatggtataaaaagcaagaaaaaataatgcaaaatttctgccatttcgtgtaatgtgggagatggaaatgtatgatgttcatttcagtcttgtattataacttggtgttatacatgatttttacctttaaattctcactccatgtaagttgagacctcactgtccaaagaaaccaattactctatgtgtctttcaagtattttggaagtgataagccacaaatgctaacatggtgagaaaaagctttacttccactggctatcaggagtttctagtccatgcaagacaaaatatgacttgacctttgattggaagttgtgctgtgcatatttatgttagcttttatatctttcttgtagcctatctagaacacttaacattactgtgtccaagttgtctttgtaagtcacaaataatttgtatgcataaaatatttctgtccacttctgcagcgttaaataccataccttgagacctagaaagacttttagattaatgtaatattttatggtagttttataattgtattcttctttacttgatctttttaaattcttttgctttaaatcctttagcaaaaggataaaaactataatagaaataagttttatttcatggctttaacagcacctaagttcctctactagacttgcagagatgtgtacctctgagttctctctagcaaaaaagcatgctcttgtggccttctggggaagaggactctgaggcccactctggtttgacttgtatgtgattgcagacctttgacttgcagcctctgagacccatgtacctgagttcaagaagtggtatgtaacacccatgaaggcagagactttggtaggaaggttttcataggaaagatacaagcaaatcagtcaatataattttgggaatctacaaagctaattgataacacaaaaagcttccaacttgaggcaagggggaaatgttttccagaaggtaaattgttaatagagtccaatga

SEQ ID NO: 6475 - DNA, 1048 bp, Homo sapiens
attttaaaacttgcttatggcagatgttgtctctgacacgtaccctaggcggatgatgtcagcgctcttctgacagcagccatgcccccatctgctctgccctcttgttacaagcctcaagtgctcaatggtgtgagaagcccaggagccactgcagatgctctctcttcaggtccatctagcccatcaagcctttctgcagccagcagtcttgacaacttatctgggagtttttcagaactgtcttcagtagttagttcaagtggaacagagggtgcttccagtttggagaaaaaggagggtgagacgttctacaaaaataactttctaactggtattgtagccccgtatttgtcatttgggatgctaaaaagtcatttttaaccttaaatacaaggtattagtataaaattagttaacatagccttaaaaaggtttaaccttgtattactttcttccttccaagttgacagttgaagagtcttgtgctactaacctactatttatttatttatttttgagatggagttctgcttttgtcgcccagactggagtgcagtggcgcgatctcggctcactgcaacctctgcctcaagggtttaagcaatgctcctgcctcagcctcccgagtagctgaaattgcaggcacccaccaccatgcccggctaatttttgtagttttagtagagatgggatttcaccattttggccagactggtcttgaactcctgacctcaggtgatccacccgcctcggcctcccaaagtgctgggattataggcgtgagccaccgccccccgcccttaatctgctctttagatgtaaaccttttctgttaaaattcatcccaccttatgcaacagtgtggagcttgttttcataaacttttttgtgaagtagcttacatcctgaaagataggaaaactggttttaaaaatatagatgcaattaaaaacaaagtttaaaataaaaatgagagtactgagactgccccattgattagcttttttctaatgttgaaattttgtagctttctcttgttcagtat

SEQ ID NO: 6476 - DNA, 1836 bp, Homo sapiens
gaacaattcttatagatctgtctcctgatgataaagagtttcagtctgtggaggaagaggtatgttcatataacttcaatagtaggtttgccgtatatatttagttcactttgtatcctcttgtttctttttcttcctttagtttgcattatataattttcacctataaaatctgttttcaagctgattatctaatattactagagtaatattactctagaaaatattactcatgaatttataagactcatattctttgttttttgtgtttgtttttgtttttgtttttgtttttgttttagtagagatggggtttcgccatgttgcccaggctggtcttgaactcctgagctcaggcagtccacctgcctcggcctcccaaagtggggcaccatgcccagccctcatattctttgaataacaaaaatattaaaacctgttttgtattctcaaaaatagaatcagacgagtcaagaaccatgttccccaaatcagaaaataacacaaatgctaatgcacatatatttcaaaccatttttctgacagatgcaaagtacagttcgagagcacagagatggaggtcatgcaggtggaatcttcaacagatacaatattctcaaggtaataaattagtgaaagtaaagttttctgagactgtcgttttcaaagcctgaagccataagtaactttcataagaatctaatctgtctagcctggtaagtccttgacttggcatcagagactattttgggaaagaggatacccttggaaggttaatattctccaaatccctgtgctatttttaataaaggataataattcaattcttgttgaacatattcaagtttatgggttatgctttatcttggggtaatgctaaatactataggttcaatactttatataaagtactgttaaagtactctattgtaacaaagctgaattttttttgtggcggataccatctttatagtcatacaatgcttatttttttatcctgattgactacaggtttctgaaagtccccaaatatattatctttttataaactttaatagtactctcttcatcttttccagaaaaatatattttaaaaatgttttgagtcatttagtgactgctgtcttactgatttcagttactcttcttaggaactttttcaacattatgtttttcttgaactatagtaatcaaaactgcacaccatacttgatgcataatgaattcgtattaactacattgatgcagtatattcctaataattgtaaaaataagacagaattaatatgtgacaaatgcctttctaatacacaaatgctaaactctgaacagtatcaaatctttcagctgtattgtattactgtttcataacatactatgagtataatatgtaatcaggcaaatacatgcctactacaggtacatttcagtcaagtccactttgtctacaagcattaacaaaatgtgtggagttttgttaggagtgagagcaggagagaggttgtgtgtttgatttctaaagtagttggatttgagaaagatacagttttcttcctctaataaaggtattttcatgcgttgtgtaataaaaattttttcagtgatgaaacgggttttttttgttgttgttgttcctttttaatgcataaatgagatctatttgtgacagttacgatccttgattacatctgtggcaatattttgcattatttgagccaagactaaaaccatcagcttccaggtgtgctctaggaaccagcagggggctgtagcacctttaaacacagctaagaaacaacactagtattgtgaattttgttcctagaaatactccta

SEQ ID NO: 6477 - DNA, 1029 bp, Homo sapiens
accaagttcccagatgtgacactgtatttctgaccactgatctagaaaaaaacccctagagcagtactttgcactttggcagcacattggaatcacccagggaatattaaaaaactattaatgcctgtgtcccaccctcacagaatctcttttaattggtctggggcatgatctggatattagaatttttaaaagcttcccagttgatttcaaagggcttccgagctgaagaattgcagtcatggagggaaacaggttctttctttgtgtttgttttgttcttactgttacccctctaaatttaggcctgcataggtagtacacagtaggccctcctatgtatgacgtcccactcacttctattttagatcataaattggagtggttaggaggcatgtaatttcctgtaaattgaacactgctgtttttatttgtcatatatggtctgaaggctaaatagttctgattattagtaataagcagcattctaatacctccctcttctttggaagatagaaccatcaactggtctacagaaatctcctgttatcttctaaaaagaaacaatgacgttaatactaaaaggttgtttgaaactaagaaaggctagtcacatgcctgagaggagtgagagggtaatctactgaaactggtggtgaggggagactaccagtttacttcctatctaaggaagtaacatttcagctgaagtctgaaaattgagtgggtatcagccagtggaagagtggtaaaatagataacattccaatggtggagaaaattctgtggatggggaccattaataaagcaagtttggcctttgtgaagaaaagaaaactaatgtgcatggggcataatgaacataaaatgagattcaagaaattggagccattgtacagaatttggattttctcccaagtacagtgacagcctctaaaaggttttaagcagaaaagtgacttgatctaatttttgtttgttttaattagttggatgggaaaggtttggacaggaattacagaagaaaca

SEQ ID NO: 6478 - DNA, 1047 bp, Homo sapiens
agcagcttaagaaacacctaggaggatgaataaaagcaagtctgctactagacatagtgaaactgcagagcatcaaaagacaagaaaaaaaatacttactagaaaagacaaaggattaatacactgacagcagatcagtggcagcaacagaagccagaagacaaaataacttagaagtgctgaggaaactactgttagcctagaattctatacacagataaactagtacttaaaaaagaggatgaaaaatgcatctgctcttttgctgagagatctagtagattgttctttagcaaagaaagcagttgaatccaaaagagcaggatgcaagaagcatagtgcacaaagaaatcggcaaacatgtcagtaaaaaggctgaaataatataactgataaggaataatattcaagaccaatctgtatgatttgctactatttgtatacgtaggaaaaagtacaacatgcatttgcttgtttatgaataaaattccttcaggatacacgtgaactgttggaaggaaacctcagtgccactgggatcagatgtgaaagactaaactgtatatccttttattccttttgaattttataacaggactatttaaagcactataataagcattgtctgcaatacacaagtaatagatttgagatttttaaaacaaggtggaatgaaagtactagttgacaatagtatgggaaatagaagctttaagatgctgatgaaatttagactttaagtcaagtatgcatattaaattttcaaagataatcactaaaagagtagaaatcgaagtgtaaagattgaagaaaggtaatacaaatgaaccagtcgaataaaaataagaataacaggtgactcgtgcacttttttccccaaaaaatatgtcaaagaatcaggtgaacaggaaatatctgtaaaaggttaagagtatcctggacgcacctgaagaagaaaaataaagcaggagaaccagagatgaagaatagaattaatgctgtcgtaactgagatagtgtgatattgatataggtgtagagtctttga

SEQ ID NO: 6479 - DNA, 1042 bp, Homo sapiens
gtgccacagaacactagaacttgtttcttctatttagctgtaaatagacggttaaccagcctcccccatccctcttgcttttcctacccttcccagctgctagtaaccacttattctactcttgacttctctgagatcgactttttagcttccatttatgagtgagaatatgcggcatttatctttctgtgtctggcttatttcaccataatgtctttccggggctcatttatgttagcgtaggtcttcattcatagcatctgctcagtacgtttattgacttaaacttgtacatacgaggaaaagcatttgagaataaccattgtatttttgttatttcaggctagatcgcctttttattttactggatactggcactactcctgttacaagaaaagctgctgcacagcaacttggagaagtggtgaagcttcatccccatgaactaaataatctcctgtctaaagtaagaacttttttttttcttttagcataatacaattgtagagacttattcatggataggaacacaaaaataaaggtaaacatcatcttaatttttaaacatttttgctatttcttttttttttctggtcacaagacttaaactttttttttttttaatcaagtttagtagcttaagggatttgagtatagatcgttttgcctgtggcacaaatttgaatctgtcccagtttggtaataaactaagttgtttatctggtttgttagtagtctaacttgttcttaatgactaataattatatcatagttggtagtcttcaaatggatgagtactcatgggcaatgattgaaatacatgagaagctggagtcttgttacattctaagttatcagctgtttgaaaatggaggctttctgctttggtgtatcagtgttttcataatcctagtccattttcttcccttaagcaactgctgtatttttactaaactctgtatgcgtattgaagtgtacctgtatggtaataagtggcaaattctacacatttaatttcctgatgtgcagagtaaagcaggag

SEQ ID NO: 6480 - DNA, 1080 bp, Homo sapiens
gagtttgagaccagcctggggcaagatggtgagacccttgtctctacaaaaataaataaaaaacacttagctaggcatggttgtgtgcacctgtagtcctagctactctggaggctgaggcagaagaagtccttgatcccaggagtttgaggatacagtgagctgtgattatgccactacattgcagcctgggcaacagagcaagacctcacttcttaaaaaaaaaagtttgtgtgtgtgtgtgtgtgtgtgtgtgtgtgtgtaacccatgcaacccaagtaatgatatgctattttctttcattccacactttggctatatggtcaaattaatatttttaaacctcatgtagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtctgtagtggttctgagaagaaagtctaaaatttgttttttcagactaatttgtcactgtggtatgctgttcattagtcacacgtaaactaacatgtcatgaaatgtaaattaactgaagtttgcaggtggcgggggatgctatgaatgggaggtaacccagcagtatttggtttaaagctacaatatgagtattttttctcctttaagtgaatatgtgcatcattagttgatacatattaatatttcagcaacaattttattatgtagtatggaaattataaagtgttccccaagagccccagtttaatatattataaaatcaggattagtatagatcgtggtagtgttttcacaattctggaaatttgagagattgattgttttgtttttatcacatatttctgatattattgggtttactcatgctggtgtccaacgcaaaaactaagagtgaaaaataagacttggataggtattcacacctgtaatcccagcactttgagaggccaaggtgggtggatcacctgaggtcaggagttcgagagcagcctaaccaacatggcgaaaccctgtctct

SEQ ID NO: 6481 - DNA, 2036 bp, Homo sapiens
taatatattcacttttttatcataaaaaatgtcaaatactcatttcatcttgtttagtatggtttctattaaaagatctagttatttttgcagagaattaagaggataatttgcttaagttttggaaaagcatagtttttctaataatggaggtaaaactcttcaaaatcttttcatttatatcactaaatagtaagtttactaactttactagtgtattcatggacattatcagagatcaaaattatatatattttggttttgccatattcttatttcatagatctatgaagaagtctaggtaattgtatttcaaagaaaagcctggctcagcgtggtgggtcacacctgtaatcccagcactttgggaggacgagacgggcagttcacctgagatcgggaggtcgagaccagcctggccaacatggtgaaaccctgtctgtactaaaaatatgaaaattagctgggtgtggaggcgggtgcctgtaatcccagctactctggaggctgagacaggagaatggcttgaacccgggaggcggaggttgcagtgagctgcgatcgtggccattgcactccagcctgggtgacaagagtgaaactctgtctccaaataaaaaaaaaaaagaaaagtcctataggtgattctgatatgtaaccaggattgggaactgcagtttcttgggaactcagttttttagtgctagtaagtcacagcttgctgaacagtgcttgtttaaaaccctgtagttaggttttctttaaatgttgatctgtgtttgtcccctcatatatattaatgacaccatatatgattagtatacatactggtctgggtttcctttgcagctggttgtgtagattatttcccccaatagggcttcgcctggaatgagaggaccaattttaggctctgtgtaagtgtattggggttgtgatcaagcagtcttttggatgcctagtgtttttccctcctgggtagaccaatctttaaaaaaattttcaagcagctttattgagatataatttatacattatacaattcatcatttaaagtatacaattcagtggtttttagtatactcacaggtatgtgtaactatcaccacaattttagaacattttcgtcactttaagaagaaaccccatatccttagctatcacccttttatcctcttacttccttccctcctcttcccagcaaccatgagtctacttttggtctctttagatttgcttattctcaacattttatatttggtcacataccacataacagcatttaagtcagcaacagactaggactgcatatacagttgtggtcccataaaattatattactgtatttttactgtaccttttctatgtttagatatatgaatacttaccattgcgttacagttgcctacagtatttagtaacatgctatacaggtttgtagcctaggagcaacaggctataccatacagtgtagctgtgttgtaggctttatgatctaggtttctgtaagcacactgtgatgttgacaacaaccacaaaatcactgaatgacacatttctcggaatgtactcatcattaaatggcatgtggctggtaaattgaatcatacaatatgtggtcttttgtggtggttttttttttacctaagagaatattttcaaggttcatctatatgacagcgtatatcagtacttttttttcttttctaaattttattactgttaagggatgtatcaggttttttaaattgtggtaaaatatatataacaaaaaatttaccatccttaaccgtttttaaaacttaagtttagtaatgttaagtacagtcacattgttgtgcagccagtctccagaagtcttcatcatgcaaaactgaaactacctattaaacgtcaaatccccatttccccctttccccagcccctggcaaccaccattctttctgtctccatgaatttgactactctagatgcctcatgtaagtgaatcctacagtgtttgtcttcttgtgatgggcttatttcacttaacttga

SEQ ID NO: 6482 - DNA, 1017 bp, Homo sapiens
catatgagctaagttggactatagcatgctggaccaatcacttaaggctataatttatttatttatttttttcagcagatggtgatgatcagtttcttctattgacatttattctcataactttttggtgatattatttttattttgaagtcttacctcttcaaggccttctctatgggttaggatcatacatttgtgcctcataatgtagcataaaaaaagttaagaagcatatgtgtatctgttgggagttggaataacagagaaaagggaggaaaagactgaaattatggtacagtcatacaacaaaagagtgtgaacctgtcaaaaaagaatgtgatcgatgtatatatactgaaatttatagacttggtcttcttctgaggctgagactataggtacttattttaatttcaaaagttccaactcagcattcttttattcttttagactcttcaggcagctgaattgattgactcagagtttcgagcaggaatgagcaatagacaaaagaacaaagctaaaagaatggccaagttatttgcaaaacagagatccagggatgcagtggaaactaatgagaagaggtagtaatctttttttgcctattcacttaaaacaagagggctctgtggctttaatctgtgtctgcttgatttatagaaacattctgctgacatatttagctggggagtactgtttggattctcttactcaattgtcagagagtattcattgtactaggaactgagaccacttccccagaaaaatccacatgtacagacttttttcctactaattatcagttttgaatgagggctgaggatctccaaaggggagagcattccaggcagaagaaacaagtttaaatgccttaaacatggaataatcaagaaacaaatagaagggcagtatggccttctatactgggatgagtgcacaggagagtgatagagaatgaaatcagagaggtgtctaaggaccacaagttaagaatactcccttagtaaagtggga

SEQ ID NO: 6483 - DNA, 1046 bp, Homo sapiens
taaacttcaattccacagacagtgtcctgttttccactccctacctcactttgtttgccaagatgtccctataatccctgattggcctgttctttaaaaaccaagcataagtgttatcctcctctgacaagtctcccactaatctcttcttctaagaaggaataaggagtgctctgtattcccacagcaacttgcacttacctcagttatatgttacattttcttaattatttatatctctcccacattagtctctgcattttttgagcatattaagacattatatcttatttatcttttaataaatattggttgaatgattgaattaatttgggggtaactgaggcttttcctcagttgtctacagtcattgaaaagtgacatgagcatagtggatttaggacaatgtttttaaacttttagcattgtaaccctgtttcaaataaatcttatacattgtacatttcaaatgggtagtttttatggtatgcaaattatatctgaataaagttgttaaaaaaaagactgactgaacagtctttcaatggggcttgcaaagtagtctggtacaacagtcctgtagccttagatagctcttggtaattaagtgaatgataactgcaccattttgttctgttctgttttgttttgttttgtttcttttccttcttccattgcctgggcatttccaccagaagggaggttaaagaaagaaagagaatgattcagttagcaacacttagccacttagtaaacagccactcttaagttttcacgagttttagagttgaaaagaatatttttcccaaaaagaagtttgtgagttttggaattccttcatgaacagttagtttatatttgcctgtagctttcttgtttcaccagagtattctgcgggtgttaaatgtgattttcctcaaagtcatttagacatatttaaaggttagataattttattcttctcaagagaatgtctttcttaaagaatataatgctaatgttaaattttagtcagattaaaataaaatttagttgggaagttttag

SEQ ID NO: 6484 - DNA, 1031 bp, Homo sapiens
tgtaatcccagcactttgggaggccgaggtgggtggatcacgaggtcaggagttcaagaccagcctgaccaactggtgaaaccccatctctactgaaaatacaaaagttagctgggcatggtggcacgcacctgtaatcccagctactcaggaggctaggcaggagaatcgcttgaacctgggaggcggaggttgcagtgagttgagatggggccactgcactccagcttgggcgacagagtgagactccgtctcaaaaaaaaaaaaaaagttacggcgtccaacatgatgttttgaaacgtatcagaccaattaatataccttagttcatacagtcatcatttttttggtgaaaacccatttaattaagttttaatcttttagcagctttcaagtgtatttatcattaactgtagtcaccatgctgtacagatctacagaatgtattcattctatgtaaactttgtaccctttaaccagcatctatccatttcccctcagtcctctcccttccacgcactaagcacctagtaaccactattctactctgcttccatgagtttgacattttagatttccacatataagtgagatcacatatttgtctttctgtgcctggctggtttcctttagcataatgtcatccaggtttattcatgttgtcacaaatgacaaaattaccttcttagaggctgaatagtatccagttatatatagatacactacagtttctttatccattcatcacatagacgaacacttgggttgattccaaatctcagctattgtgaataatgctgcaatgaacacagaaatacagatatctcttcaatgtactgatttcatttcctttggatatataaccaaaagtgggattgctagattatatggtagttttatttttaattttttgagtaacatccatactgttttccataatgctgtactaatttacattcccaccaacaatacgcaagggttcctgtttctccacatcttcctccacacgttttgtctttttaataatagct

SEQ ID NO: 6485 - DNA, 1068 bp, Homo sapiens
taattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgtaaaatatatgcaactgtgtgttatttgtaggaaatggtcactagaaagagcaaaagattattcaggtatacaggttttttttcattgtttaggattttaactcaaaactttatgtaga

SEQ ID NO: 6486 - DNA, 1029 bp, Homo sapiens
gtggggagagaataaaactgggagcaaggaaattgaagttggggtgattgggaaaacaggccagcctgggtgggcatctggtggcaatgacaagccagaaaggaaatctggttttcaggagtataaaaagtgaattatatgaaggttgcttggaagaaaattccattttgtccaatatctgcttttaactttcacagggctcctgttttgtttggttttagtgctccattgaaacttacagacaagtacacagatcatagtgtacaactcaatgaatattcacaaagtgaacacactttgtatatccaacacccaaatcaagaaattcaccagcactctagatgctgctttcaagccccctcgcagttactcctttgcacatttatataaatggaatcatacactgtgtactctttttgtgtctggcttattttgaccaacattaaatgtgtgagatctttctgtaatgtggcatgttgtagatcttcattctccctgttgggtaggattccatatgtggatatgctataatgtatccattctaatactgtaggccatttggatggcgttcagtttggggctgtacaaatactgctgctgtgattattctcgtacatgtcttttgaacatactacatatttttggtgggcatacaccaatgagtgaaaaagtgggtcacaggatatagacaaattcagtttttataaatgttttccaaaatggctgtaccatgctgtggtttgaatgtgtgcccacagaagttcatgtgttggaaacttaatccccaatgcaacagtgttgggagatgggacctaagaggtgatgaggttgtgagggcagagccctcataaagggattagtgttgttatctagagagtggcttagttatcatgatagtgggttgttacaaagcaagtctggccgctggtacctctccctgtctcgagtgctcagttgcccttctgccacgttatgacacagaaagaaggccatgctcttggattttttgacctccagaacggcgagaaa

SEQ ID NO: 6487 - DNA, 1049 bp, Homo sapiens
acttaaaaaaaaaaagaaagaaagaaaaaatagctgggtgtggtggcccacacctgtaattgcagctgctggggaggctgagatgggaggatcacctgagcccaggttatggaggttgcagtgagctgagattgcaccatgccactgcactccagcctgggccacagagcaagaccctgtctcaaaaaaaaaaaagagatcatattctttagcctgtccttcaggacactcaccattattcacagaccatttattatgctccctattatgtttaagatatgccgtacatagctggcaccaactgcctttttaaagcctttcttctctttatgaataagtgtataagtacccaagtcttttgcccaagccaaactggcttgcgcactttcttccaaacataaggtggtttttgtttttgggttttgtttggcatcttttctttcaaagctctacccatttttcaagacctagttaggttctgccttgtttataatgctcttctgaccatgtctgcagaaatatttttctcttcttctccagactcatgtagcagttcatcttcagtgcctcctaattcttttttttttttttttttgaggcagagccttcactctgttgcccaagctggaatgcagtagtgcaaccttggctcactgcagcctccgggttcaagcgattctcatgcttcagcctcccaagtagctgggattacaggtgtgtgccatcatgctcagctaattttttgtatttttagtagaaacagggtttcactgttttggccaggctggccttgaactcctggtctcaagcagtcctccccactcagcctcccaaagtgctgggattacaggcatgagccaccacgcctgacctgcctcctaattctttacatgccgtagttcacatagatgacaatatttatatggcccattggagtaaactgaaagggatttgcctctctggaggaagcacattatggctgctttaaagtaccttagtaaaatgaaacacgtattttttgtactgctgtaattttctaagaaatggga

SEQ ID NO: 6488 - DNA, 1090 bp, Homo sapiens
ttgtcttcatataatgacagtgatttgttctttgttccctgaaccaatcatgatacttcccagatctccttttgctttgtaaatgaatatgccccaacttggtgaataggatggtgtaggagtaacatcagcaagtaggtggcatttagaaaagctaccagaagggtaataagggtgaaagaaaatgaattgaaagggtttaaatgaatcttaagatcttaagtagtggcgtggcctgttgaaaaattggggaaatgactaggaatccagaacattttccactgaatgccagggtgccaagtagaattgctttatgtgctaatggtaagaaaactgcatccataaattttaggaacttgaatggaaagctgacaccatcactgtcatcattgtcaatgttgttattgctagtggtcatatggaggttatatatgtgctaggcaatttttaagcagtttcttaatcacatgtttaatcttttacaataggggaccttaacataaaacattttttatgctaaaactcctttggtggtctggttaagcctatgggttccttctcagaatgtttttgaaagaataaaacaaaatatataggattagaaatgaaaccaattatattgaagtacagctatcaaaatattaaaagcctaaaatagtaatatgaactttaacacattaaaatacaagatttatcagttggcctgataacatttagctcattgtaatttgaaattagttatttcgggatctctacagctgtaaagtaatatgaaaatttctggttgctatactcatttctaattgctgtgctgctaatattactgtggtttgcttgcactcattattgaagaaaagctacattttatttagagcttagcaaaaataaacgtgatggtttttctcccctcattcagatttaccgatccccaccccctaagtttttcatggaccccagattaagaacccctgctttgcaacaactctgtgaaagagattctatcattaaacctatgtagttagcaggggtttgaacccagacaatctggctccaaagtccaggttctttaaccagctagaatatcctgaat

SEQ ID NO: 6489 - DNA, 1121 bp, Homo sapiens
ttttgaaaatgtggcaacataaatgcagataatgaagtgcttttctaatatgagaagattaataataagggcaaacaaaatgtccttggttctctgtttttctctaacatgcacaggaagaaatgatagcttcctttgaaggggaagtagtgtagtagagaaagtagtgttttcaaacatttggaatttgtggaccatgtgatgggtcttcagtgcataccactgattttagataaacacaaaagaataattcaaaatgtttttattgtaagatcaaagaagtatttttaaatcagtatcaggaaaagcaatgattgttcacattattgtaccaccacatgaatggtgaaagactcactaaagtccaagttaaggtttcatatttaactgatttcttttcttgctcttagttgtactaaattagatagccccacctttgaattatagagttgggaagagcaacaattaaatatttctattagatgttttagatattcaaatggacacaaaaattattacaagaattctcactgaaaactacatcaagttgacaagtgtatggcactcgaaagcaaagttgagtattttaattttggagatggcaatgtgtagatctgtccttttggttgaattcagttctaggaaatatgttttcaggtttagtgcagtaattgaatatggttttaagtctacctagttgttagaaaagagtaaatcttggctgggcgtggcggctcacgcctgtaatcccagcactttgggaggcagaggcgggcagatcacgaggtcaggagttcgagaccaacccggccaatatggtgaaactatgtctttactaaaaatacaaaagttagctggacatggtggcgtgtgcctgtagtcccagctactcaggaggctgaggcagaagagttgcttgaacccaggaggcaaaggttgcagtgagccaagatcgtgccactgcacacaagcctgggcgacagagccgagactccatctcaaagaaaaaagaaaagagtaaaactctttggttaagccatttgtatcattatttagtctgcatattttgttactaagaattgtggccgggccgggcgcggtggctcacacctgtaatccca

SEQ ID NO: 6490 - DNA, 1031 bp, Homo sapiens
attttttgagacggatctcgcactgtcatctaggctagagtgcagtggtgcgaagttggctcactgcaacctctgcctcctgggttcaagcagtttctcctgcctcggcctccctgggattacagacatgcgccagcacgcctgactaatttttgtattttttgtagagacagggtttcaccacgttgcccaggctggtctcaaattcctgacctcaggtgatccacccaccttggcctcccaaaatcctgggattgcaggtgtgagccaccacgcccaggcaagatttattttctttaacttctctcaacattgttttatagtttttagattttttttttagtttttaaatttgtttctaaatattttgttctttttgatacattgtgtaaatggaattgttttcttaactttgtttttagattgtttaagtatgtagaatacaatttttgttttctgtcttggaacacaatcagcaacaattgatttttgtaaattgaccttgtatcctgtgaccttgctgaacttgcttaataatttggatacttcttgatggattccttaggattttctaatataagatcatgtcattgttgaacagaaatagttttactttttgtttcccaatctgaatgcttttttttttttttttgaggcacagtctcgctctgttgcccaggctggagtacagcgccatgatctcagctcactgcaacctctgcctcctgggttctgtcagttctcctgtctcaccctctccagtagctgggattacaggcacacgccaccatgcccagctaagttttgtagttttagtagagacagtgtttcaccatgttggccaggctggtctagaactcctgacctcaggtgatccacccgcctaagcctcccaaagtgctgggattacaggtgtgagccaccatgcctggcccaatgtgaatcatttatttcattttcttggctaattgccctggttataacctttagtgcagtattaaatagaagtgatgaaagcagatatccttggc

SEQ ID NO: 6491 - DNA, 1503 bp, Homo sapiens
ggctagagtgcagtggcacagtcttggctcactgcaagctctgcctcctgggttcatgccattctcctgcctcagccccccgaatagctgggactacaggcgcctgctaccacgcccggctaatttttttgtatttttagtagagacagggtttcactgtgttagctaggatggtcttgatctcctgacctcatgccgcacccggcctctcattttctaatgtcatttacaactagaagttttcctctaagcactgctttagctgtatatcataatttttgttgggttttcatttatctcaaaatattttctaatttttcttgtgatttcttctttgactcactgattatttaggaatgtagtgtttaattttcacatatttgtaaatttcccagatgtccttctgttactgattttttttttatttcattgtgatcagagagcatactctgtctgattttttaactatattaaaactttttttaatggcctaacgtaggtttatcctggagaatgttccatgtgcacttgagaaaaacatgtattctgctgctgttggagtagtctataaatgtctagttgattctggtattttcaagttttccatttccttgttatcttttacctgtttattatttaaaatagagtggtgagtggtggcttgtgcctataatcccagcactttggaaggtcgaggcggggggatcatttgcgcctagaagttaaagaccagcctgagcaacatagtgagaccctgtctctacaaaaaaaaagaaaaagaaaaactttagccaggcatggtggcacatgcctgtggtctctgctagctcaggaggctgaagcaggaggattgcctgagcccaagagttccagactgcaacgagctgttattgcactgctgcactccagcctgggcaacagagtaaaaccttatgtcttaaataaaaagagagagagtggggcatagaagtctccaattactgttaaattgcctgttcctctggttccatacgtctttgcttaatttattttggcgctctgttaagtgcacatatttataattgttaggtcaagtgcacatatttataattgttacgtcgtcctgatggattgtccctttaccattataaaatatccttttttgtttctaatagcaattttgtcataaaaatcccttgaccaatatttgtatagctatttcagctctcttatatctcattaagagtaaattcttagttttcaagttaaatttttgtcatctttattttattatttatgtattatttatttgagatggagtcttgctgtgtcgcacaggctggagtgcagctgcacgatcttggctctctgcaacctctgcctcccaggttcaagcaattctcctgcctcagcctcccgagtagctgggattacaggtgtgcaccaccacacctggctaattttttgtattttgaatagagatgaggtttcaccatgttggccaggctggtctcaaactcctga

SEQ ID NO: 6492 - DNA, 1044 bp, Homo sapiens
atgactaggataccttcagaataagagttccttttgtttactgctggatcatgtttggtcttgctccctaagtcttaaaagtagattagttttaagaagtatctttcaacagtgtgagactttctgggtacacactgtatatgaataaaagtagctgaattacaggtccaaaacataactatacaatctttttttaaaaggaggggaggataactgctctttatcaagagaatctaaattctcttgatgtcttcattttccctttacattgccagatttcttggctcctttgactccttcctttgctccttgtcctggatctttaaggaaaagggcacctattctttatttctcacctgaggatttcctgaaattgtcttatttgtattccagagctatataccacaagttttttctcagacacctgctgtctttgattatgccttctactccactgtcctataatgtttaacatcgtttgcccttttggggtgaccatatagtttagaactggaagaaataatagctgacacaagatcgttactacgtaacattaagtactaagagcttcatatgaattattttaatttttacaaaaactctgatatacataacaccttcattgtacagatgcagaaattcaggcccagagatggcactttgtcccaattcacacagcagacccaacctaatccttacccaccttgttttgttacagcctaatgagcctaatacacaaccttctcatatacagggaagaagaaaattcagtggtaatgtcaggttaccttcctcagggtaatggttacctgaagtttataactcattgttcttttctaaaatacagtttttcttattaataagaacaattatattatcatcatggaaaatgtgaaaaatatacacatatgtttaaagaaaaaaagactgtgttatacagttaactggcatatatgtagtatgtgcataattagtgctgccagctgtttttatgtgttaataaaggatgattggtggtggtgacttttttcagcaaagtttttc

SEQ ID NO: 6493 - DNA, 1052 bp, Homo sapiens
atttgaaattatgagaaaagtcttgagctaacccttaaaggaaataatttgaattggtagaatgaaataagcaaggaagcaaaaactatagtacacatatgtgttaccatttagaaataaccttcacatgtaatgtctcacttgaaaagattttttttttttagcccagaaatgagactagctatgacagtaggtggatagtgttgtgtgatttaagagtattgggaagatgacttttaccttcctgagcacatatgatagagaatgtgcccctctacaccatcagtagtatttagggtttgccttctaacacttgattgtttttctctgattccttaacaaccctgcagtacaagtaaaccaaatcaaggaatcagatcactgttattttcccatttattttctttccttctccatggacctgtcatagaatcaatactttttagttgtggggaacttgaataggaccttcctcttgcatttttattgaaaagacaacacaataatttttttttctcggcactgtattgaacacctagcactgatgcatttaacccttgcaacaattttatgacatagattattgttataaattattcctagtttactggtttagagagtttacaggtccagtgccacacagcagagaagcattaggactcctgtcccttggctccttaagtgaagcctggtcccagaggcagctggaacattttatcctggaacagtggaaccttaatatgtttagcctagttcccatttttgcctctagtgcaaagacagcccccattagcattgcccattcttaattacagtacttacttatccttgattctgagttaaaaaaaaaaaaaccctgttatttcatcactgtttcatcctcttgttaggattctggccaggtgctgtagctcatgcctgtaatcccagcacgttgggaagctgaggcaggcagaacccttgaggccaggagttggagaccagcctggtcaacatgatgaaaccccatctctaccaaaaatacaaagaaaaaattaggcatagtggctgta

SEQ ID NO: 6494 - DNA, 1049 bp, Homo sapiens
ctactattcctgtcatgctgatattaggcaagatgattcgctgggaggactatgtgcttagactgtggcgcaaatactcgaataaactacaaattttaaatagtatatttccaggtaaggcactgaactgtggttgtaaagtgcataccaaattgatcttgaagaacaataacatgcttttttagccatgtttgaaggtagtctaactcttctgatttattagcactaacgcactgcatttttttcctctagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttggtaagacggctttaacattacttatattaccttgcaaaagagaatgaagtgtatttgtttttaaaaggtggggaactgtataaatattcggtctgtggctcctatgcattaagcctctatttgagcctcactatcattcaatagcttgagtggaaataaaaagaggagaaaccactgcagcagttctggccttttggaactatgttgtaggtgctttctctcctggcatatgcatgaatcatcacacctgtccctcttgccagtgggattacagtactttacgatcagaccacctggttcaaatcccatcacagaaattgtcttgctgtgaaatctaaatcaaatgtctggactttttgttcctgtagtatggtgatggtaataatcaggattattgtgaggattgtataagtactagcacatagtaagcactcatgttgtttgctattattgttactcccacttctcccctctggtggcatgtaacctgcacggaccttggaggactgaacaaagggggcaaacgtgggaataaaagacaaagacaagagagtatatttggaagaaggggtcagggggcaccttgcctctagtggacaagggccctgagctttacacagccctctgtat

SEQ ID NO: 6495 - DNA, 1050 bp, Homo sapiens
atggaattctgaaaaataagtttggcatttttacaagttaaaacctgttagtggctgggcacagtgtctcacttctgtaatactagcaccttgggaagctgaggtgggataatcacttgagcccggaagtttgagaccagcctgtgcaacacagcaagaccccatctctaccatcaaaacaaaacaaatctattcgtatctgctctaagaagctgccagaattgtaatgtcttaacatatctttgaacatttaaaaaattatatttgtgaaacttgagacacttataattttactgtctgctttagcaatatcacttagtcctgatttaatctccatcaccaacaatgtggtcaaaatttcgcatttttcttgacaaatgtagttagtgaaaatgtcattgataacctgagaactaagagctcttgaatgactttgtgtatttctttttatagaccatttaatttggcagagcggaaagctagcgcccattcaatagtagaatgtgatcctgtacgaaaagaagttagtgtacgaactggaggattggctgacaagagctcaaggaaaacatacacttttgatatggtaacatatggtgcaatttctttattatccactaatgtaaaataattttaatatacatattttacctggaaaatggtgtatacttagaaatttcagttgtctctgaattgtcagatggcttctagtgggctgaattatgaattagttaacatacgaaaaacaaaattattaaaatgagtaattttgaggttgatttttttttttttaatttttttcgttaggtgtttggagcatctactaaacagattgatgtttaccgaagtgttgtttgtccaattctggatgaagttattatgggctataattgcactatctttgcgtaagtaaaagggtgttttttctgatttatgaaaaagcttaaatgcttgtgttttttgttgttgtttgtttgttttttgagacggagtttcactcttgttgcccaggctggagtgcaatggcgcgatctcggctcactgcagcct

SEQ ID NO: 6496 - DNA, 1034 bp, Homo sapiens
gtcagcagttcgagaccagcctggccaacatggtgaaacccggtctctactaaaaatacaaaaattagctgggtgtggtggtgcatacgtgtaatcccagctacctgagaacgagactctgtctcaaaaaaaaacaaaaaaacaaaaaaccaaaaaactagttaatttaaaaaaaaaaagaattttttttaatttttttttttttttttaaattttaaagtgatggggtcccactgtgttccccaggccagtcttgaactcttgggcttcaggagtcctcccacttcagcctcctgagtagctgggattagaggcacatactaccttgcccagctaattttccaaattattgacagttgggtagaacctttcttctagtggttacataattgagtcattaacttactttacatatatagataataaagttatgaaattgttaccataggagatatggaataggcttaaagcatagtttcgctgggcagaattattgaacttggcgttttttttttgagacggagtctcgctctgtcgcccaggctggagtacagtggctcgatcttggctcactgcaacctccacctcccgggttcaagtgattctcctgcctcagcctcctgagtagctgggactacaggtacataccaccaagtccggctaatttttgtatttttagtagagatggggtttcaccgtgttggccgggatggtcttgatctcctgaccttgtgatccacctgccttgacctcccaaagtgctgggattataggcgtgagccaccgtgcctggccgaacttggctttttaagtagataggttccattggtttctatgtaatgctcagggatgaagatggctaagaagtgtgacaggtttatggagggtgtgaagactactgtagaacagactgttgtaaatgacttctctaacattaggttagttgtttctttttttgttttgttttaacttgctttgccatacttatgtttaaatatattataaaggaggcccatgtattttaactgccacag

SEQ ID NO: 6497 - DNA, 1031 bp, Homo sapiens
taagctgagatcatgcaactacactccagcctgggtggcagagggagaccccatctcaaaaaaaaaaaagtatgtgtataaaaaaaaagaaaagtatgtgtatacacacacacacacacacacacacacacacacacacacacacacatatagtagggaaaaaaagttcatttagtagcttcatttttttttttttgagacaaatcccactcttgtcccccagactggagtgcgatgacgcgatctcggctcactgcaacctccacctcccaggttcaagcgattctcctgcctcagcctcccaagtagctgggattacaggcacctgccaccacgcccacctaatttttgtatttttagtagagacgtggtttcaccttgttggccaggctggtctcaaacccctgacctcaggtgagccgcccgcctttgtctcccaaagttctaggattacacgcgtgtgccactactcagcctagcttcgttcattctatgctataatgtaaaagaatctggacattgcatatgaatatatacaggaggacactcctgaagaagttatctttttccttcctggcagagtttttaaccttaaaaagccagtttcttaatggctttttccacacagtcttcaaagaaaattgctgtggtcattagcagtgggtggtgtatggagatttaattgaggacttagaagcaggccaagtgaatgctcgctagtgtggtagaggctgcttagagaacactgaagatggcgttggatgtgtgagaacagagaggaaaaccaagaaaagtaacaaagatggtaaaatgtacgcttattttattgctatcatctgccttaagtggaaattttatttatttattaatttttttacttttagaggtagagtctcatactgttgccaaggccgcagtacagtagcatgatcatggctcactgcaacttaaattcctggactcaagtgattcccccaaccacagcctcctcctgagtagctagtactacaagtgtgagccaccaggcctgg

SEQ ID NO: 6498 - DNA, 1035 bp, Homo sapiens
ttttttttgagacaaggtccctctctgttggctggagtgcagtggcacattcactgtaacctcaacctcctggccttaagtgatcctcccaccttagactcccaagtaggtgggactataggcacatactactatgcccagctaatatttatttatttattgtagaaacaggatctccctatgttgccaaggctggtctcgaattcctgggctcaagtgaccctcatgccttggcctccaaagtgctggaattacaaatgtgagccatcattgagtttaagaatagtctaaaggaaattatcctaagggtcgagactctgaaaattgaagagaagggaaaaaaggattgaacaacttcctttttaaaggttgggcatagtggtcttaatgactagattttaaaattagatataactataaaatattacttgtaagttattatataacatattttagataacagaactacattattctcacaatatcttcagtaattgacctttcctttccatgacaggaaactctgagtacattggaatatgctcatagagcaaagaacatattgaataagcctgaagtgaatcagaaactcaccaaaaaagctcttattaaggtaactgtgaatttttgtagagtaatgtaatcttgtttgacaaatgtgaaaataagaaactgaagtgggagataatagttaaacaagatttgttaaattgcccatggaaggctttttatatagtgatttaaactaaatgtcttacatgttaacatatttttttctaatgctagtatgttgactttaccaactttatcaactgagttggtactcttagcaaaattttcatttatttacatttacaaaatttatttatttgcatttttgaggtataatttacatgccataacatccacctaatgtaagcatacaattcaatgatttatagtgcatttacagagttgtggagtataaccacgatctagttttagaaaatttgttatcactatccagtttccctttgctcctttacaatcatgtgg

SEQ ID NO: 6499 - DNA, 1079 bp, Homo sapiens
ttcgacctcagtctcccgagtagctgggactacaggtgtgcaccaccacgtctagctaatttttgtacttttagtagagatggggtttcaccatgttggccaggctggtcttgaactcctgacctcgtaatctgcccgcctcagcctcccaaaatgctgggatcacaggcgtgagccaatacgcctggccccaatatggttttaattagcatttccctaatgactaatgatgttgaacatcttttcttgtgcttattatctatttgtttatcttttttggtgaaatgtctattcaaatgctttgcccaattttaattggtttgtcttattaagttgtaaggagttcatgtagtctagatacaagcccttaatgagatatgatttgcaaatatttcctcccagtctggctttactttttcctttccttgatgttttttttttttttaaataaagtttttagtattgagatgattatagattcacatgcagttataagaaataatacagagaaaacaggccaggcacggtggctcatgcctgtaatcccagcactttgggaggccgaggtaggcggattgctttagatcaggagttcgagaccagcctggctaacatagtgaaaccctcatctctactaaaaatacaaaaattagctgagcgtagtggcacgtgcctgtaatcccagttactcaggaggctgagacaggagaattgcttgaactcgggagacaggttgcagtgagctgagatcgagccactgtactacagcctgggagacagagtgaggctctgtctcaaaaaaaaaaaaaagaaaaaaagtaataatacagagaaatcctttgtacattttgttgaactatagaatattaccacggggatattgatattaataacaatccactaatctttcccaattttccttacatgtgtatgtgtatttaattctagacagttttgtcacatgtataggttcatgtatttaccaccacaatcaagatactgaacagttccatcaccacgaggacccttcatattgctcttttgtaaccacttttcttcccaccatatccttcctttcc

SEQ ID NO: 6500 - DNA, 1075 bp, Homo sapiens
cccgcctcggcctcccaaagtgctgggattacaggcgtgagccaccgcgtccggccagaggtatagttcttataggaaaggcaggacacatgcttgattaatttcctttatttgccaattttgagaataatgagttggtttcctaggtttcttagtgtcattataaactcctagatttaaactatttgtgttaacccattgtagttgttctcctcaccgatgctcagattggctcatcttaggccaggggtatgttagtctgttttcatgctgctgataaagacatacccgagactgggcaatttacaaaagaaagaggtttattggacttatagttccacatgtctggggaggcctcataatcatggcggaaggcaaggacgagcaagtcacatcttacgtgggtggcagcaggcaaagagagagagcttgtgtggagaaactcctgtttgtaaaaccatcagatctcgtgagacccattccctgtaatgagaacagcatggaaaagatccgcccctacgattcagtcatctcccaccaggtccctcccgcaacgcgtgggaattatgggagctacaagatgagatttaggtggggacacagagccaaaccatattaaggggttacatcttcaagtggcttactgagtccttttgattaacctagtaggctttgcttagcttatttccttgtcttatttgacaagatgttccgtattcatcttgaatattttctgcctcagtcctggaatcagatgcttttataaggaatcctggttcattttagtgtgaattactcctaccaacctgggtactggaggttgtggtttttcttgggaagtccatatttctagaatgagtgtatttaaaaaggagctttgaaagactttatttctaaacaaattaatattgattaaaaagtatggttataactttttatcatacttctttaagttttaaaagacataaaaaggctaactttacattttatttgttgcatgtccttcccaaactgaatgaaaaaagtactaaactgacacctacaacattcctcttgtgtaggagtatacggagga

SEQ ID NO: 6501 - DNA, 1052 bp, Homo sapiens
acatactttaagtctcagtttttaacccctaatcttaccccttccttctaagatacctgatgccttcaagtcccacatttttccagcattctgtggggcatatttatattctgtatccctgattatagacacttaggttgcattccctcctctctctactttgagttatagtccgtcctctgttagctttctagcttctcaaatctggaacacacatgcttttcccctcataggtagggattcttagtttcagaattgagggcaagggaaaaatatttcatttataaaacaaagacaaggaatataatttgttctttgtaatttgtatttattgcttattgacacaggtatcaagtgacacttgggtatcaagtgatggtgataaatgttggaaatgagtttgtgtagctgtcacaattgtgttagaatacattttataggagttagaaaaaaatattaactgttaaactcatattaaactttattttagagtcatgagtggaaaattaactgttcaagaagagcagattgtagaattgattgaaaaaattggtgctgttgaggaggagctgaatagggtaagcacttaaaatgatatttactgttatgtgaaaagcaaatattgaaagaaaattttagaatgaaagatctaatattttttccttcaagattttttttttttagacggagtctcgctctgtcacccaggctggagtgcaatagcgtgatctcggctcactgtaacctctgcctcccagggtcaagcgattctcctgcctcagcctcccgagtagctgggattacaggtgtgcaccaccatgcctggctaattttttttgtatttttagtagagacagggtttcaccatgctggccaggctggtcttgaactcctgacctcatgatctgcccatctcagcctcccaaaatgctgggatgacaggcgtgagccactgcacccagctccttcagatttttttggaaaaaaaaaaaagattttattttgctgacccttatactgaaagtaagttatatcatgattttttactatca

SEQ ID NO: 6502 - DNA, 1032 bp, Homo sapiens
cctgggtgacagaatgagactccgtctcaaaaaaaaaaaaaaaaaaaaagaatggagaatggaaatgtaaattttaatgtgaatgtttagctaccaaagtatttaagatatcatttagaaaggtttacagaagtggaaatattctttttaaagacctatttgtttatttctgaaaccagaatgtactcaagactgatcttctaagttcactggaaatgattttatccccaactgtggtgtctatactgaaaatcaatagtcaactaaagcatattttcaagacttcattgacagtggccgataaggtaacaaatgctatgttcttaatatctcaaaattgatgtgttgtttaagaaggaaactcatttttgtttcttcaaagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggtatgttgtttagcggacttggggagtacagaaagagagttttaggatgatttgatatgacttgataattaatctatgttacacaatctgaatactgtaaaagctgaaacctgaaaataccatagccactgttgcttataacagtaattattgtagaacaattgagaatacttctcttaatatttgaagttttgctacatctagaaccccatgcagaaccacaatatgacaaaacagtccttttctcacatcaagatgaaagatgaatctggaaaaacatacctttagagaagaatggttataacatttaaagtgaaaatgtatctacattaaaacctgctaagttgtttctaggatggcatggatagttgtctttcataaaccaagtcctactttctcttatttctgtctcactgatagacatttaaaacatagtaaatcgatacaacttttaattcttattgattataaatgtaattcatgatttatct

SEQ ID NO: 6503 - DNA, 1193 bp, Homo sapiens
ttattagaaagctttatagctaatttaaacataacatttgtaatgttcatgatttgttttacatactaggcaagggaaactgcttaataacagaataaatgactgattgtccaatttagggactagacaagaggctgtagtagatgccctgaagtaacattgcctagtaagaggaataaaacaagtagacagattttgaaagcatcataactggaggagggttgtgaaaggtttcatgagcaaagatgatcctttcaaaggtcatttaatggcaatgctgtgaaaagacagtggccaaggcatccattctcaatgcagaagatttactaagatcacgggccctggagccagactgtccacgttcagatctgccacttaagagctgagtgatcttgggaagttatatatcctttgagtcttaattccccatttcaacagtgtcattctcttttcctataggaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggtaataactttgtaagtggaacttactttggggagaataataatcagaaagttaaatattcttggctaagaatagatttcaaaacaaatgatattttaagctataatgacttaaacttttaagtataatatttggtatgcttacagatgatctcgttttgtgctttgttatatgtcttctcaatcttggaattaatttaacatttgtacagtttctttcctgtatttatccttggtttctgacttagtagtttcttcaaagaagggcaccctgtcttttgatatgtaataccttccacttatatatgctttttttttttttttttttgagatggagtctcactctgttgcccaggctggagtgcaatggcacgatctcagctcactgcaacctccgcctcccaagttcaagcgattctcctgcctcagcctctcgagtagttgggattataggc

SEQ ID NO: 6504 - DNA, 1050 bp, Homo sapiens
tgcctggctaattttgtttttttttttttttttttttttttttttttttttttttttagtagagggggtttctctgtgttggtcaggctggtctcgaactcccaacttcaggtgatctgcctgcctcggcctcccgtagtgctgggattacaggtgtgagccaccggcccggcccctcctacccactttttaacactgttgagaacatagttggtttatgattcatctcagcattgatgactgagtacacaatcaatgtcaccagtcccttaatgttctctatgggtaagtaggaggattccaatgaaatacaacttccaagtgaggctctataaagtgctggtatcttttcctctaatttgagggtacaagcctagacagagtgtgtgaaggaaaaatttccttacgtaggacattggtatctacatttacagttgaagttctacttctgagatgcatatgcttgtaccttttttttttttttttttttttaaatatatatagagagagggtcttgctatgttggccagactggtcttgaactcttggcctcaagcagccctcctacctcagcctcccaaaatgctaggattacaggcatgaaccactgcgcctggctgcttgtaccttttttgtgtgtatgtcttgttttgtttttttgtttttgagacggagttttgctcttgttgcccaggccagagtgcaattgcctgatcttggctcaccacaatctccgcctcccgggttctagcgattctcttgcctcatcctcccgagtagctgggattacaggcatgcaccaccacacctggctaatattgtatttttagtagagaaggggtttctccatgttggtcaggctaatcttgaactcccgacctcaggtgatccgcccgcctcggcctcccaaagtgctgggattacaagcgtgagccaccgcgctcggcctgtaactgttttttaatagatctacagctccttcccttaaggtctaaagattctccatccctgctttcaacagttaacaaagttccaactcagattctcata

SEQ ID NO: 6505 - DNA, 1057 bp, Homo sapiens
cctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccacttaagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacattaacctgcttgctccataatttcttatctggcaatgggtatatttagagggttaggcaagctgcattcacattcccaaaataaactatgcaggtaccaccaaagaagaaggagcctagtaaacttgcaggcttttagttgcactccaaggggctatcctaggtgcaaggttagtgagaagtaggccctcacacagcctgaagtccagctttaagtcatctcattccatgactgtttaagttatctgagaatgctgatgcaact

SEQ ID NO: 6506 - DNA, 1041 bp, Homo sapiens
aagaaagaaagacataactagaaaaggaaactaaatcagtattcctcatacacacagattttacaaaaaattttagagaattaaatccatatatgtggatttaaaagtataaaatacatctatataaaaagtatattctgtatatgtatatatgtgtgtgtatatatatgtgaagaatacatcatgatcaagtgaggtttatttcaagaaagatgctggcttaacatttgaaaaatcaatgtaacattgttcaccatattaaacaaagaaaagttgtatgatcatatatgtggagaaagcattgacaaaatcgaatattaattcctgattttaaaaaccctcagaaactagtaatggaaattcctcagcttaaaacagggcatctatgaaaatctagagctaaattgtgcttagtggtaagagtctgaatgcttttcctctaaaatcaggaatgaggtaaggatattcattctcaccacttctattcaacactgtactagaatgttgaatataaggccggtataataagaccatttaaaaaaaaagcatctagtttggaaaaccgtctttatttgcacactgtgtgatcaactattatagaaaatcctgtggaatgtacagaaaagctactagaactgataagtgagtttagcaaggttgtaggaatcaggtggatatgcaaaagccaattgtgtttctctgtactagcaacaatcagaaattgaaatttaaaatttgatggtatcaaaaatatgaaatactcagggataaatctgactaaagatgtggaagacttgtatgtgaaaaatacaaaacattgctgatataaattaaattaacattgctgatactaaactaagtaagtggacacatactgttttcatggattggaagacagtattgttaagatgtcagttttctccaacttagtctagatattcaagataatctgaataaatcccagcagaatgaaaatttatagaaattgacaagctgattctaaatttcatgtagaaatgtaaaggacctagattagccaaa

SEQ ID NO: 6507 - DNA, 1048 bp, Homo sapiens
tggtggtgctggttatctatttagttaacatgaaaatgaatcatttaaaaataaacatagataacttgattgtgaagaacctcagctctttcataagtgagaagaaaccttttttgcttgcttaaataataaaaagtataataaagtccctatgaaacacagaaaattattctggcaaacagactcactgttatataggcggattacacagaaggtaaagagtaacctttcgtattgtaggcagaggcattaacaaataaccaaggaaacaagcccaacaagattaagcaaatgttgctaagtttgtaacatatttcataactggttttcagactcaggtattataaaccaaggcagatatacatcattttccaagttttgtccttcactgtgctctttcatattctgaaacaaacacttgactctagagcactggttctttgtttggggtctgtgaggtcaaaattatttttaaataatcctaaaaggttatgatgatgaaattttatgtgtcgacttaactaggttaagggctgcccagatagctggtgaaacattatttctgggtgttccagtgagggtgtttctggaagagactagcatttgcatcagtagactgagtaaagaaggtctgccatcgccaatgtgggtggacattcaatccactgaggcctcaaatggaataaaaaggtgaaggaagggtgaattctttctctcttcttaagctgagacatctgtcttctctggcccatggacatcggaacacctggtctcaggtcttcagactgtggggcttacacgagcagcccccctggtttgcaggccttttgacttggtctgaattataccactggctttcctggttctccagcttgcagacggcatgttatggtacaacttggctttcataatggtgtgagcccattcctgtaataaatcttttatatgtctttatatatcctattagttttgttcctttggagaaccctgactaattcagaaattatttatgttaacatgcattgcattcatcattgctgttttcaca

SEQ ID NO: 6508 - DNA, 1026 bp, Homo sapiens
tttattctattctttcaaattaattgaggttttattagtggcttaatatatggttagttttcatgagtattctatgtggtcttcaaagtgtatggttttttattaggcttcacagttttatacacatacatgccttattaattaagttcattatatcttctaaagcctcatgttatttttcacctgatcattcttggattgagagagatatgttaaagtccccttttattaacttgtttctcttttttgttgcatctcctttagtttctgttcgatgagattggttttgaatttttgggtatataaatattaatgttacatctttattttgaaaaataaagatatttatagactttatagtctttagcattgtaaatcataagtgaattataaatgcacaaataataagtgtaaagctcaattaattttatgttttgttttctatgattgagtagtattctttttgttttgctgtgaagtcagcccttcagtgaatttcttcttaactgtagattaagattcctgtaaaagacttgggttgagtatatagttcatctcttaagctattacgcaaagtgcacattagatctgctgtagtcagtctgatatttttgtttaattttctgaagttttctgggaaagcagtctatatttgcattcattaatctacttgtttaaactttttgaattaaaatttattttcgcaattcattttatcctagaggacaaatacaattaaatatagtgggtgttttcatctctcattttttgcattttaccaaatgcccaaaagtcaacaggaagagatacctctttggtcaggaatgtaaaaacaggaaggaggaagtctattgcaaatctgtgctggctgattatgaattcaggtttcaccatggaggatgttcattaatgatcatcagtgtgctgtgctgttattcaaaattacagtgagtattaatgtcagtaatacagaatgtcaacactagttataggaggcaatgttaactaacacacgacactagactt

SEQ ID NO: 6509 - DNA, 1677 bp, Homo sapiens
cctatctttccccatccttccctgctgtgaacccgtaccaattactgaactttgtactgtttctatagttttatcttttccagaatgtcagatagttgaaataatacagtatatatataatatgttcagactggcttatttcgcttggcaatatgcatttaaggttcctctgtgtccttttgtgacttgataacttatttcttttttatcactgaataatactacactgtatggatgaaccatagtttatccattcacctttgaaggacatcttgttgcttccaagttttggcaattgtgaataaagctgccataaacatttgtgtgcaggttttatgcatgtaaattttcaattaatgtgggtaaatacctggggatgtgattgctggatcatatggtaagactatgtttagttttgtaagaatctgccaaactgtcttcagaagtggctgtactattttgcactccctccagaatgaatgagagttactgttgctccacatcctccacaggatttagtgttgtcattttttcggattttgcctattctaataggtgtgtaatgatatctcattgttattttaatttgtaattcactaatgacacatgatgttgagcatcttctcacatgtatgtcttctttagcgaggtgtccaagtcttttgatcactttttaatttggtggcttatttttggattgttgagttttaagtgtgctttttatattttggattcaagtccttgattcaatttgtgtttcgaacatattttctcccagtctgtggcttgttttttcattttcttaacagtgtttttaaagagtaggaagttttagttttaatgaaattaaattggaaaagtccagtttacctttttttctttccctcatgcattgtgctttggtgtttctaaaaactaattgccaaacccaaggtcatctaaattttcccttgtgttatcttctagagtcttagagttttgtgttttacatttaggtctatgatctattttgaattaatttttataaaaagtgaaggtcactgtttacatttatttattcacttttttgcatgtgaatgtccagttgttccagcagcatttatttaaagaacgactctttttccattgaatttcctcagttaactgtatttgtgtatttctgtgctttctgtttcattttaacctacttgttaatcttttcacctttaccatacagtctttaatattataactttatacagtattaagtcttgaagttgggtagtgtcagtctatccttcaactttgttcttcaatattgtgtggctattctgggtcttttgcctgtctatatgaacttcagaatcacattgttgatattcacaaaataagttgctggggttttgattgggattgcattgaatctgtagatcaagttggggagaactgatatcatcagttgatgatattgagtcttcgtattcattaatatggaatatctttccatttatatagattttctttaattatttctatcagagttggtattagttccagaaaattttttgttgaaggtttttatatagatacatttcatgttacctgcaaagacttctgtttcttttttcccagtcttaatacctttttttcttgttttatttcattagctactgcttccatgtagtatgatgttgacta

SEQ ID NO: 6510 - DNA, 1056 bp, Homo sapiens
caaaaccccattttacaaaaaaatacaaaaacaaaaaaaacaaaaaaacaaagaaacattagctgggtgtggtggtgcattcctgtagtcccagctactctggaggctgaggtaggaggatcactgcagcctggggaggttgaagctgcagtgagctgtgatggtgccactgtactccagcctggatgacagagtgagaccctgattttttttttttttttttttttaaaaaaaggaaatgagaaggcaaaaatcatgaataagaaaggagacatcactacaaattctatacctacagacattaaaaagataaaaaaaaactatgaacaaattttttgaaccaattttgaccataatcagttttgaaataatctgaatttctctctcttcaaaataggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagaggtgataggtgtctttctttcttttctattattagataattttttttcttttggattgtaatgtacatctgtgtgatttagtcttcctgtatgcaaaataaatttatgttgtaaaagttgtcagagtcaaaatggagtcagtgtgtcaaactttgacaaaatggaggctgagaaggccgtgaagggagggctgtcatggacgattagcctggtatcaggagctatcacaataaattttttgaaaccatagcttactgcatcagccctacaaggacagctagccgcttacatgtgaacacttgtctgtttcaaaacaggccaggcacagtggctcacacaggtaatcccagcactttgcaaggttgaggtgggtggatcacttgaggcaggagtttaagaccagcctggccaacatggtgaaaccctgtctctactaaaaatataaaaattagctgggcatggtggtgggcacctctagtcccagctacttgggaagctgagaca

SEQ ID NO: 6511 - DNA, 1032 bp, Homo sapiens
gtgggtgataacctaacaattaatggttattctgatcacttaaaaacatacaaaatataggctatactcatttatgttattgtagattagtggcagtaaattagtagtaataaatgtttacctacatattgatattctgctattacccaggactattcataccacttccttttcaattatgaagcttagacagaactcagggatgctaccatcttttaaaatattgatcattcagttagaataaagtatttttatagttgaaaaaaagaatacagagtataatggaaggaaccgtgaactagaaattagaagatataaattctgccttagggcagtgagaagtgggttctagaatcacatagacccagagtttctgttctgcctgtgctgttgactaattgtatgcctgcaggttctttaagctttagatccttatttgtgaaaatgggtttattactaatttcagaattgtttttagttttaaatatgatactttgtatgaaaacacatgatttgaaaactgtatgttcattttcttcctggtttctggttttccatgtgttctatgagcaaatcactttacttttttgagttgtttttctctttttaaaaataaggaggattgtttgaacccaggaggtggaggttgcagtgagccgagatcgcgccactgcgctcccctgggcaacagagcgagactccatctcaaaacaaacaaaaaacacgaaacaaacaaaaaaataagatttttctttttattgggagtaatattatcctctccccttcggatattaaaagcaatatcaccggcaagttgtacacctgctgcgttattgggagtcatatcatcctctcccacctggatattagaaacaatattacggggtggggtgtgtacaccctctgtgatattaacagtaatattattctctccctcctcgatattaggaaaaatatcacagcggggggtttataacctctgcgatattgggagtaatattatcctctcccatcctggatatttggaacaat

SEQ ID NO: 6512 - DNA, 1129 bp, Homo sapiens
ttttagtaaactgtgttaaattatttaggatgttaactaaccacattcattatttattaagtttaataatatcaatctttgtttttagctcaacagaaatagacgatatgcttagaaaatcaacaaatctgctgctgaccagaactttgagtagctgtttactgaaccttattagaaaacctcatataggtttgacagaggtaggttaaaaagacacatatagtgaaatgtttcattgtatgaaacaattattttaaattattgctgaacgtcattctgtaaaactagcttcctgttttaaatgtattaatataagcagatttgttttcaaaataaaaacaccagtgtaaattccagaaatgtgaggatcccaggcacagtggctcatacctctaatccgagagctttgggaggccaaggcaggaggattgtttgaggtcaggagtttgagaccagcctgggcaatatagtgagaccctgtttctacaaaaaatgaagactattagccaggcgtggtagtgtgcaactatattcctagctactctggacttgagcccaggaggttgaggctgcagtgagttacaatcataccactgcactacacagcctgggtgacagcaagaccctgtctctggaagaaaaaataaaaaaatgagggaaaagggttcatatggggaatagtagataaagatgttagaatatctatttagatttctgattgccagactacaggaaaagtcacaatcctaattttttacttgctaaatgtttaagatttgaaacatactatgaaaagttattttaaaataactggtatttagactcttggtgtgtgtgtgtgtgtgtgtatatatatatatatataaattcatacgcagtatttgcaacaggcttttaaaatcagatagttgtatcctataatgctgcaattatgtagaaatggtacagttgctggaagtaataatcccatttttaaaaattaggtgattttacatacatgtaacctgtattttactagatatatcttgtgttttctagctggtacaaatcatcataaacacaacacacctggagcaagcttgtaaatatcttgaggactttataactaacattacaaatatttcccaag

SEQ ID NO: 6513 - DNA, 1034 bp, Homo sapiens
cactgtgagtgaatctggtgtacactgtggactttggaatttgtggggtatgtagtaaatctctgtactttctgttcagttttgctgttaacctaaaactactctaaaaaatagtctatttaaattgcaaaaaaaaaaaaaaaaggcgaacacacttgtaactatgaggtcaagaaataaagcattactagcaccgtagaagccttcctcattcctctcctttgtcactatcttttttcctctcagtactgacttttaacggcacagagtagttttgcctttttctgggttctatttaaatgaaatcatacagagtgcatctttttgtgtgtctgacttcttttactcagcaggagttggggtatttcatttgtgttgttgtatgtagctgtagtttatttattttgaattcaatatggtattccatgatagaatttactacaccttatttattagtgtgaactgtatcacttttggctatttagaaacttttcttttgctttcatcctggttattgactggatacgtgacctttgacagatgttatggtatgggtaaaatataatttatttaatttttagtagtaaagatagaaattcaggaactggcataaacatttagaactaatgaggtattattggcagtttaaaattttttcattttaattataatgttttgttgttttatctatgtaaagctgatgtattgctttgtgaaggtacttgcaaaattacgccttgactgattaattgcatgtcagcttctgattacttatatgcttttttattgatggagtgttcctttgtaaaattcattttattgtgtatgcaatttgattgccattttaaaaaggcaatgtatatgacatttatttcttttgtcatcctttaccaccaacttcttttctggtcttcccccattagagaggactgtataaagcagttttatgcttacagctgatttaatacatttgaatgacataaaatcctaaaaggtaagttagaaaacaaccaaaagcaaaagcagattgggta

SEQ ID NO: 6514 - DNA, 1030 bp, Homo sapiens
gttgttattttgtcccatgtcaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgtaagtataaaaattttcaaaaattgttttatgtttgcttactaaagtatattttagaatttagtttgaggtttccttgcttaaaccaacttcttggagtgcatgtttctttctccattattataaatccatttgtaaggaattataacttagccaaattgtttgaaattttaatttattttatttttaaccaaaataactgtaactctctttccaccaaagccaaggcaaaaccctgaaactgacaatatagacttaaatagaaataatctctaatagaaataatttacatagagttaacacaattgctcgtctccctctcccgtctccctctccccacggtctccctctccctctctttccacgtctccctctgatgccgagccgaagctgcactgtactgctgccatctcggctcactgcaacctccctgcctgattctcctgcctcagcctgccgagtgcctgcgattgcaggcgcacgccaccacgcctgactggttttcgtatttttttggtggagacggggtttcgctgtgttggccgggctggtctccagctcctaaccgcgagtgatccgccagcctcggcctcccgaggtgccgggattgcagatggagtctggttcactcagtgctcaatggtgcccaggctggagtgcagtggcgtgctctcggctcgctacaacctccacctcccagccacctgccttggcctcccaaagtgccgagattgcagcctctgcccggccgccaccccgtctgggaagtgaggagcgtctctgcctggtcgcccattgtctgggacgtgaggagcccctctgcctgg

SEQ ID NO: 6515 - DNA, 1047 bp, Homo sapiens
tattaggtcatttgactatttaaaaaactgtcttctctttatcaaagaataaaaaaaattttattttttgaaatctttaaattatcactggctaagtaaatgactattattttacagtcacctgtgatcctatatttatttgtttatttatttatgagacagagtctcactctgttgcccaggctggaatgcagtgtcatggtctcagctcactgcagctctgcctccagggttcaagcaattctcctgctttagcctcctgagtagctgggactacagacacgcaccaccatgcctggctcattttttttttttgtatttttagtagagacggggttttcccatgttcaccaggctggtctcgaactcccggcatcaagtgatccgcctgccttggcctcccagagtgctgggattacaggtataagccacagcgcccaaccacctgtgatcctattttaatcaagtgttttaaacctttgatatttgacatacttccccaaatttcagattctaaaattgtctttttgaactcaaacttttggatattccggaaagggcccctggaagctcaagagagacatattagggcttattcgatataagaaaatcatgtgagaaacattgtcaaataagaaatggtatttaacttgctttgaattatatttatacaaatattcatgtgttccaaaattatattggattcctgaaattctgatgtcttgatatatgttatcagtcataattattatgttattatatgtcacaaaaataacaaaattcccttgtcaattggtgtcttttaccatggctattttctttttttttttttgagatggcgtctcgctcttgtcaccaaagctggagtgcagtggcgcgatcttggctcactgcaaactccgcctcctgggttcaagcaattctcctgcctcagcctcccaagtagctgggactacaggcgtgtgccaccaagcccagctaattttttttgtatttttagtagaggtggggtttcgccgggttggccaggctggtctcaaactcctg

SEQ ID NO: 6516 - DNA, 1024 bp, Homo sapiens
ctatttcatagcatattgctttaacacttttatatgaagtagtataccaccaaatataaaggggttgctaacacctttatttacatttcagttggggttcttcacttttccttcttttttttttttttttcagtctgtgatccatttctgtcttaatagggtggttgacagttcttttcaagcatacttagaaaggcaaaagagcccttttcatagtacttataaggggtcatgcttctgtttttttttagtttgaatttgatactgcttcatgagttgctatgaaagattaggaagtaggtccagtggtcagattttacctgcccacccggactttgccctgaggtcaaactcctgatatttgctgttctgaatagaggagttgatgacaagtatgagctgatacaagaggaaagttagaaccatatcaaagctgaaggcaagagaattgggactctatgagagactagctaaaagatagatcatcgggattgccctcttctaaggaaaaggaaatagctgacctgtgattgaaaagactttatcatcctgccaatcacatacttgctaatggaagccagttatctcaacaacatcttaagtcctactgctctagtagacaatgtggaggattagcggtactggtgccacattatgtgaatatgctgcctccatcaatttaaatgtgctttgtgaatatgatttgttcgtgtaaattttttttacaagtaaagcctatcatcctgttaccccctattctgaaattaagttgctaaatgatggacttgatatacttatttgtgtctgttttcatttacaaagaccatatgttttgttaaatataatatttcaagtggatttcagatgcatatgtgaaattcttttggcaatatatgaaaacttaaaaaaatttaaactatattaagattctttgtataatatgcagtattcagtgataattttttataacttatttttttaataactcattcttaatacatagagatatttcactaaatatcac

SEQ ID NO: 6517 - DNA, 2054 bp, Homo sapiens
tagttgaatttaccctgagcaactggtttgtttttatttcaagagaactgtgagttgtacaattaatggtagtttattctgtattttggagacagaaaaactcaggaatatagcatagcatcacatgtattttgtgtactaacctcctcatctttcctactctcattttctcgtggccctggcttttctcagttaactaagttaaatttgtcttgcatatgtttttgtaaattgccttaaaacccgtttggaacaatgcaatatgtaaataaattaagcgtttgttagtggactcctaaaactgttcgcagtaaaaagcattaggtgtgggtagattttgatttatttgcttgtttatttgtcatttatttcttcaataaaaatgattgagtgccaggcactggggaaaaagaagtgagtggtagaaattaaataagagccagactattggagagataagttagttggcagtaatgagataaagttgaagacaaagactattggattctgaaagacagctaaaggataaaaagttaggagtgtaaaaagaaagccaccaaagtatctgaatgacttgttgacaagaacactattgtgtaggaaatcagagacaggatggagtcctgcacttcttaataactactgcatgactttggaaactgtttcctgaactatttcaactatatatattaacaatggtttaatgaaatctgtgagggaaaatgttgtagagtttacttctgggagagagcttttacctggcatgcttaatcttgattgctaaagttaggaattatgtgaagcttgcagtaaagaggttatcagttgattgagtcagcagctaccatctattggtttttaacacttcaacagggcagtggcatcgctatgccaggttcatatcataggtgaactattaaaagctgacagtttcttccaccagtcttgcttgaaaagggaagtaccctgggcacccacctccttgttcttagcccctcacccattttcttttatccttttatacatggcctgataatctctctctaccatacccccaaatgattataaggtttaggaaagaagttcccatgtacatcaccatagaaagataggaaaaccctgataaacatacacttgtatttgactcaaaatgaacaactttgagttctgtctaaagggacatgaacaagctttgaatcttatgaaggaattgtttggccagaattcttgccatagagactggacgtctgccaggactttactttgaaatttctgtcttctgtttctaatcttaaggcatcacaacatacaattcttttgccactggtccagtttattcttttatgatgaggaagaaggcacttttaaataacaattatttccactataattaaacaaatcttcttttgtttgcattattttgttactatattgtatacacaccctgcctgcttaaacttgcccctgtgactacttcacaggaactttctttagaagttttaaagtcgttgacttcttaaagtattaatgggatttgccaaagttgtagtatctgaatgcttgactagatatagtagcaggacaacaagcttgttcacacagctcctccagcaagcattttttcctcagacaatcctaaattcatttgaagtgccaaagaattaaaggaagatacatttgggtttacttctgaatataacaagaccagacatctcacaaagtttaccttaaggtccagatattagaaaagtatgctgcccttttgggaaagcttagattttaaaggattagtctgaacctaaatgacttttgcgtttttcttctttttgctccagtgtcataattccggaagtttatagtttatgtgcttaaatatgtaggtgataggtgcttatgccttcagctatcgatatgaactttgaactcaaatttttatgattattttaagagtaaacgttagagctgttttgtagtttggaaaattaccctgtaaaatgatttttcaaaaaccaaaaacaaacactgtgataattacaaaaattgtttatgctcac

SEQ ID NO: 6518 - DNA, 1032 bp, Homo sapiens
gttggccaggctggtcttgaactgctgatctcaagtgatccacacccctcagcctgtcaaagtgctggtattacaggcctgggccactgcgcccggccagcttccttgtttagaacctttcaatggctacccaaagttcctgaacaaggcatatatatccttttatgattcagctcctgaccccttctccagcctgtcttatactacccccttactcatatttcagtttagcagcactaaagtacatggcatttccccataagcataactgtttcttgtccttgtgtctttcctcacactgttccatctgcttgaaataccacgagccctcctttgattaactccttaagactcagtttgggtgtcatctaagacagctgcttaggtctacttcccaccccctaagcaataattgatgctctgataatagcctatacatatgtccatctgtgtaatcagcatgttagtttgtaattatgtttgtgtgaatatctttccctttatacttgtgaacttcttaaatccaaagactgggccattaccgtcttttcatcactagtgtcaaatatagtgcttgtcacatgtgaacacaatctcttttacggaagagaaagttgggactcagagtttgtaactcccttaaatgattcagtcaaaatgaaagtagcttgatttttaaaaacctgggttgggaggaaatttagtagggcacagactaaacactactggtacctgctatagtatgctaccagaactgtgagaaatacatttgtattgtttataagtcactcgatctgtggtactttgttatggtaacccaaacagactaagacagcgtcataagaagtattaactctgaagtattttcttatttaagtgaagtataattggatagccaaataatatccagagtattgattaagtgatacaaaggaagagcttgatttttttccagccagatggtgccgatttctaacattctgaagcaccataatcaaatatcagatattttactattattattattattat

SEQ ID NO: 6519 - DNA, 1045 bp, Homo sapiens
atcatatgcctgactttatcctttaataagtaattgtaaaattgcttttgggtaatctggggagatttttgtttttgttcatgtttgatctacatctttgaacttcaggtgtatgtgttaaccaataaatacacctgttgagaccatgtcctactgtttatttacaagactgaaagagattttgtgtgattaataacaaacatattatttgtgcattgccatctgaaggaagcaaaacttaagtagagaagtgagatttttcataatgtagatcttaatattaagaacatagtgcatcctgtgaagcctaaccaattgtgagaggcagtccgcaaggcagtgactgttggggtagagtgaaggcaagtattagtgtttgtacctggcaacaccccagtttccccttttctacccatcacactctgactccaaagcaatcatgttcttttaaagtcatcccaatcaaagaccagggtcatcttggtcggaacaggcatggatagctgcctgtggaaatgggttcagtccataaaatctggcctggcataatgttaggtgggacccaggaataaagtcctggttttttgttttatccttcacttcaatagaactgaattataaaaagtgaaaaatgaccttataattgttatgcgtgaaggagactgatagacaattcagaaatattaacgctactttctccaggaagatcatttgacttacttaacgttagacccaatgctgtatcatgatggagtctctcctctttatcaataccccagtgaaaagctgggagagatacagggatgtcacttcactatattcacttgccatagtttgcctgcaagccaacattggcctttttcagagagctatcagcataagctaaagtagcctgtacttataaagcctaagaaaaaagctcccaaggaaacttggaataatggtctggcatcatcatttaatcagttatttcctgaatatctactgagtggttagactgtgctagacacactttatgagcttgcctgcccagttttgaagtttg

SEQ ID NO: 6520 - DNA, 1031 bp, Homo sapiens
aaatacagggaaaggtggccgggcgcggtggttcacgcctgtaatcccagcactttgggaggccgaggcgggcagatcacttgaggtcaggagttcgagactagcctgaccaatatggtgaaacctcatctctactaatagataaaaaaaaattagccaggcgtggtgacgcgcacctgtagtcccagctactcaggaggctgaggcaggagaatcccttgaacccgggaggcggaggttgcagtgatctgagatagtgccactgcactccagcctgggcgacagagcgagactctgccgcccctaacgccccgcccccgccaaaaaaaaaaagaaagaaacagaaacagaaaaaagaaaatacagggaaaggaggttggtgggactaggtggtgggggagatccaaaccgtctgggccagaggctagaaactagtagtcattcattcactgccagagtttctgtgcaaaggttaggaagcagatgtttgggggttctttcacgttctgcagatctatatttccatcattttgtgtctcaatgacttggtagtagttttctgtcctacgacccacgatatcaagtcaacagtgtgttatcaacagaaacacataggaaagaacttcctgtggcagcaggtgactgagagacgccataaccttgcatttctttaactgatggatgagctactgcaatctttcaccttataatggcaaaaatccaggactaaccttttgatagatgatttcttctactcaatctccacagttctaatatgtttagacgttctgatttcacacaggacaatcttaaaagtcacttcactaccattctaaggaggtctctcctgtttttactgatatcatttatccctgtacttctcttgtgtaatatttattacagtttgaggattcatgaacccttgtttgtttccttgttattgcctgcctttactacactgaaagccccataacattagggaacatgtcttttttttttttttaaaccagtttacacccagcatgtattag

SEQ ID NO: 6521 - DNA, 1035 bp, Homo sapiens
tttaacctccttaattagagttacttttatatactatttatatgcatcgtatgcttcactagatttttgcctgctaaagtttatattatatacttgtttctaaactgtcatccagtactgttagcagatactgagtttctccttacttaatttggccccttattcttaattcctttcatgcctgactcccctgaatgttatacctcttttccagtaaatgtcttattttaggttctcttcactttttcccactgtgctctctcaaatgattattaagatggatctgaactaggctaccttctaaaacagaggacctatgttaagtaatgacatttcgtgcctatatactcagaattacattatttaccaacagctttttattttgggccaagatatgtccttgattgtgacctacttctttcaggctttatttaatggttggagaccccttcattgttttttaaaccaaacttttccacaaaagaattacacatataattacacatatagaacactacacaaaacataaatgtacaagttgactttttttttttttttttttttgagacggagtcttgctgtgtcacccaggctggagtacattggtgcgatcttggctcacagcaacctccacctcccgggctcaagcgattctcctgcctcagcctccccagcatctgggattacaggcacctgccaccacgcctggctaagttttgtagttttagtagagatggagtttcaccatgttggccagactggtctcgaactcctgacctcatgatccacccatcttgacctcccaaagtgctggggctacaggcgtgagccaccgtacccagcccaagttgacatattttagaaggtgaatactcccatttatctaccactgagattaaaaaaaaaagttacaataccccagaagcctccatccatctttctccataccctgctggtttggatatatcatttctatttagagcagataggttattagacctgtttcaaacttgagatttaaatttttaaactcag

SEQ ID NO: 6522 - DNA, 1057 bp, Homo sapiens
aatctcggctcactgcagcctccacctcccgggttcaagtgattctcctgcctcagcctcccgtgtagctgggattataggcacaggccaccaggctcagctaatttttctttttgtatttttagtagagatgggttttcgccatgttggccaggctggtctcaaactcctgacctcaaatgatccaccctccttaacctcccagagtgctgggattataggcgtgagccaccgtgcccagcctagatctggatttcgggatgcccccgtgagttatactgtattattatggtgaatgtaatgaggcaacttctattgtggaatgtctgatgttaactaatgttggattatttacagactgtggctccaaactgcttcaactcatcaataaataatattcatgaaatggaaatacagctgaaagatgtaagttcatttccttttaagttatgggtaaagagggctaattcatttattcttaagttttacagaaattggcaacattagtgctgtgacagaaaaactgaatggtttgagagcttcatttaagtctctttctatacattcgagaatcatttcttctaagcatagtcccttttttttttttttttcctgaggcaaagtctcggtctgttgcccaggctggagtgcagtggcatcttggttcactgcaacctctgtctcctgggttcaagcagttctacctcagcctcctgagtagctgggattacaggcacgagccaccacactccgctaagtttttgtatttttagtagagatggggtttcaccatgttggccaggctggtctcaaactcctgacctcaagtgatctgcccacctcagcctttcaaagtgctgggattacagctgtgagctaccatgcccggcatcatggtctctgtagggtagacagccctagaaattatcactgccaccaaatacctcaataacatcccttttctatctaaatctaatttccctaatttgcccaatcattttattgtttcttgttttttcagtatttttctctttttgagatggagtcttgctctgtt

SEQ ID NO: 6523 - DNA, 1098 bp, Homo sapiens
atgtagtatttttttctgaaccatttgagaatgaattgtacatatccacagccgtttaaacccatatacttcaatgtgtgtttgttctcccatccaagtactaaacagactcaacgctgcttagcttccaagatcagccaagatcaggcgcgttcagggtggtatggccgtagacttcaatgtgtatttcttaagaacgaggatactcttgcccacaactatagcacagatagcaactttaataaatttaacatggatacaatacttctataatctaccattcctactgcagttttgtcaattgacccacattttttattcctccagtataggctaacattttaatctacgttggttggaatttttgtctacagaatatttagtggattcttgtcaaacctgggcgaagacctttatagcattccacaggactttttttttttttttttttgagacagagtctcactctgtcgccgaggctgtagtgcagtggcacggtctcagctcactgcaacctctgcctccctggttcaagcgattcttctgcctcagcctccagagtagctgggattacaggcacctgccattgcgcctggctaatttttttttatttttagtagagacggggtttcaccatgttggccaggctggtcttgaactcctgacctcgtgatctgcctgcctcagcctcccaaagtgctgggattacaggcgtgagccaccatgcccggactccacaggacatgttattttgcccacttttgttctacatttttattggtaacttggaggaaattgttaaatgcatgcctaacaaacgtatagatgacacaaagctggaaggcatatctaatgcaatgatgtttgactctaaaaactcaaaactaatacaatcaatatttatgatagctatcaactccgtgtattgatactgatagaaagccgatgcacacagtgagaagaggtggcataaggaaatgtttattgagggaacatcgccatcatgtggccttttagaatactaccccttgaatcttcaactaacatgtatttttgtttctcatacttaagtgatgtatggttcctttttttttaatt

SEQ ID NO: 6524 - DNA, 1061 bp, Homo sapiens
accagaacagggattctttggtctcaccttatcccaacccccattcaaatttaggaaaattaaaggcagtctcccagaacccactcagacccactcgctttcacagccacatcttttcagctccgccacctcccggtgaggggggtgttatcctcgttttacagaggggaaactgaggtgccagtgatgtgactcattcagaatcccacagcacccccttgtggtgtggagctatggtcaagacttgctgtggaaaccagtggcttgcgtttcttgatttttttttctttttttgagacaggttctcactctgtcacccaggctggagtggaggggcttgatctcagctcactgcagtgtcaacttcccaagctcaggtgatcctcccatctcggcttcccgagtagttaggaccacaggagcatgacaccagcccagctaatttttgtattttttgtagagatagggtctcaccatgttggccaggttggtctcgaactcctgggctcaagcgatccatctgcctcatcttcccaaaatgctggaattacaggcgtgagccaccatgcctggagaaatatttttgttttaaaaaatactgtatttatctttcaaaggtgatactttaaaaattcaacaagcgagaaagtaaagaaaagggaatccttctacactgttggtggaaacgtaaattggtgtagccacagtggaaaacagtttggaagtttcttgaaaaattaaaaatataatatgattaaaaaatcccacttctgggcatatatccaaaggaatcaaaatcagtatactgaagagatatcttcactcctgtgttcactgcggcattattcacaatagccaagacgtgcaagcaacctaaatttccaaaggacaaatggataaagaaaatgtggtgtatatatacatacagtggaatattatttagacttaaaagagaaagaatcttgccatttgcgacaacatgaatgaacctggagcacattatgctaagtgaaataagcctaacacagaaggacaaatactacatgataccaattatatga

SEQ ID NO: 6525 - DNA, 1464 bp, Homo sapiens
cagagcaaacttagggggaaaaaactattaattcaataaaccaatcatgtgtacattaaaattccacttgtgggaagaagtctggaataacaactttcagggaagtaaaaaaattccagaactgccactagcctgtgccttagtcaagtgacttccttttggcttcagttcctcccctttaaaatatcagggtagaactagtattcctggctccttccaactccatgttccttagtggtaacataaaaatgaataagtgacttgatttgctcacacaggtatttatttttcattcattcattcatcccaaaaatattaagtgccttcatgagccagacactcttcaggtgactcactgtgcatatcaatatttatagtcaatttggataataattataccattgctgatttaaatttcttttttaaatttcatcaaatatagctgggttgggctctttaaaaatgaaaactatctcttaattattttaagttttaaagacatgggcataaactggaactaaaaaaaaattagtatcaacacaatgtaagtttattattgtttcttgcttcagtatgttccagtttcatgcagatacaaaatgcatccatgtgcagaaatggagaggggataagtggggtgagggataaaacgtctaggtcagactcagtggctgtggcttttgctctatgggactacagtctacattccgagcactcaccattcacagctgctacctcttcttgtgtttctcatagtcttcatatactgaaggtttgtctgaaatgaggtgagcttctctattatttctttatccatggagtttattcctcaatttggcataattcctcaagtgttgaggggcagggggagtaagagagctgaagagtttttttcttctattgacaccatgccaatgggtaagctgtacactctgtctccctcgtaccttcgtttcctccttaggaagacagtggatttagaatttagataccactgtctactaggttgagcatgaccatctgcagaagttagagcaaaccaaagcagagaggccaaaggcatgagaggttcttttgtacaacggccttgtttttgctggagagttatgcttgccaaattgctggctatgttcctggaccaaatattccaaaatgtactttgtcaggagaattttctatgattaagtcccaaggacagttttacataatcttcccactacatgattttaagaaagcattttgggagagcaaaacgaacctgggaagtaatacacaaatgcctcattcaacaaacatttgtttacctgtgatgtgccaggctctgagcaggtggtggttaatgttttctcatctaacctgccctgattctccatgagatgaggatcactggcttgctttgttttacaaatgaggaaactgaggctcagagatgttaaacaattacctcagctaggattataaagg

SEQ ID NO: 6526 - DNA, 1048 bp, Homo sapiens
tgagtatgtgtgtgtgtgtatgtgtgtgtttagctatttataaaataatgacttcacactgatacctccaattcccttcaattcaatataatgtcacaaggttcttccttaccttcccgtactccacatttgtatttcccttttactacagtgagagtcctggatctctaaaatatcaatatatttactctctcatacagtatacatgaaatagtttcatagttactatgtcaataatacaccaaaataaaacctagtaagtaaaattcgagattttcctaaagctttttttgtctgtagaatatatcctccaatcccacctgaaatgagaaaaaataaataaaaattaaaaaattaaaaagataaaataggatatatcctacaaagggtatactattggattgttatgttcaaaagtttcttggattatttctttttgtgtgcgggtatatgatcaatttgatatctatttgtatttatttgtatctgtttgtattcatttttatggtttgctctttccaccactgtaattttattttttgaaaatgtagaccacgtatgtggttcaaaggtgaaaaactatatataaagtatgatacactgttataatggtggctgtcaatgagccatgccttctggtattcacgccttgtgtagtctcctctcccactgacactggaatggccacgggacttgctttggtcaatgagacacgagtaaatataatcgagtagaggcttgattagctcttgcattgaggcttgtcttctgggaattctccctcttggagcccagctgtcagctgtagagaatccaggctattctccaggagacagaggctgggtagagagatctgggagaatgagacagcatgtggacagagagaggccaaggggaggagaactgagttaccccagctgaagttccagctgcagacagcccatgagtgattccagctgacaccacatggaggacaagcaccaccccagaatggtgagaaattatagtcattaaggcactaaatttgggatagtttgctgcactgtaa

SEQ ID NO: 6527 - DNA, 1033 bp, Homo sapiens
gattttagctgctgctattgtcattatgatctctgtgactactaatcgtaagaatgaattgtgaagatctttagtacaggaatgtgctctttatgtctgagcaaatattttgcacattgccacagtctttatttgttagcacgcatgacatttttactttgctatgtggtcatttatagtcggttgcccctcctagattgtaagcctgctggccggagggagcagctcttctagattagcctttgcatgcaccagtagactcagaaggccttgcacttagcaggtcctcaagaaaggcttattgaatgcactgggaagttataggtggagggctgggatccagcttgctccagagtgaggtctctgcctcagaaatatcctcgcagcagttgaataagggccaggactagggtttgggatttcgcatttcaaccaggaattggagctgccaagatgctagtcacaatagtgagagccagccttccagtcgctgaatgaagttgaaaagtagaacagatttggaaaacagaagttatttcatttttcagggtgaccagattagtttttctttattttttttatattgcatattttgaattattaaaaagtaaatggttcagaacatgagattcagatttgtaaactgccagaatccaggttgaagaaacaggcagtaagagtgtcagtagaaattatccaatcatcaagggaaaaatgcaagtctgagagtctcctgacataattaaggaagtgagtcttccttatggtctagtggggccttccttctgtcacggcaattaaagacacatccctaggcacaaaaacacatcacatggaaagttggagagcccctcatttctctagtcttttaatacagcagaaaagaaaaggtacataatgcggtggtctgcttggtgaaggagactggttagctatttaaccaaacctattttctcttcctcttcagtgcccagctagaccatatttccagactcccttgcagttagatgcatccatgtgcctgaattttggc

SEQ ID NO: 6528 - DNA, 1032 bp, Homo sapiens
gttatgtctaaagttatatggtgctcagtgaggactggaaattgtcaggaatggcttcatggaaagtggggcttgagttagacctagaggggtctgtagaaggaggtcagacagggaaatattccaggtggaagggtgaagatacggaagcagaattgagagaagacagttaaaaccagtatggagaagacagcattttatgattcaataaatagaagccaatcgatcaatttagttcatttcctcttcccttccactttagggttttaagtcaggaatggcaatactgggcacatgtgctacctccagcccactgcacccatggcagatgctactaatcatgacacttgtttttcatgaatttgttaccaaaacaccagaggtttggtttaggtcctactgctccccacacagaatgccaatcaccaagtcagcaagcattgccagggaagaaggctttaatcggtgctgcaaccaaggagatgggagatgaggtttcaaatccagctcctggactgacaaaaattagggtgtttatatagcacagaaggcgggaaaacaggaattagggaattaatcatgatcaatgagggatttgatatctcactgtctggttgtggtgatctattgagtttcagtcccttgtctgagggtcagttcctgaggaaggcactcagttaagacaaatacaagtttcaagtgttaagatggagggccaatttttatgtttattcagtgacccataaatatcatttctatgggaaaactgggtcagtttcaagttcagacagggcctaaaatttttttcataatgtatcataccaagcagttcttttttttttttttttttttcttgtagacagagtctccctctgtagccaggctggagtgcagtggctcaaacatggatcactgcagcttcgaactcctgagctcaagtgatactcccaacatcagcctcctgagtagctgggaccacagatgtacaccaccacacctggctaatttctatttttcatttttattttttgt

SEQ ID NO: 6529 - DNA, 1027 bp, Homo sapiens
gtaagcccagaaccttctgggagaggtgcttaaagaattgggctgggggccagattctctcctcattctgtgcttactattgaaataagcaaaataatctgctaccattaacacctttctgctctagtagcactccctatgcctaaaccatagtactttatatttatatgatttttttgtttttctgtgtgattgcacagaaattctttctggattggcaacacatcccattttccacttagtaaatgtgaccaccttttatgctttggtcaacattttgacatttgtcactgaatcttcatttcctttttgtgtcatttattattttataactagcggtggccctctcaccatttaatgcttataaaattatgaatacatcagaccataataagaattgtccgtgaggcttgtaaacagatgttggggtgtgtgtgcgtgtgtgtgtgtgtgtgtggtgtgtctgtgtgtgtgtttatgataacagtgcttacataatctcaacaaccagggccctggggactcacactcggcaatggaacagttggtttaaattaggtttccatgtgaaatatggtatcgctgtttttttcctagcattgtgggaaagtatatggaaaatgatttgactgataggaaataaatctggatgagtgatcaggattgtgacacaaaccaagtggtggtctccacctgccctgtgaagcagacctctccagggggaggtgagttaaccctttccagccactggactagtaagtcaatgcatggtatcagaacagcctgaaagaatgacaactttccagagaccctgatttgccatcaatttcaactagaaaggagctaaagccatagagacaatatagccagaggcctcaacaactaatgagttgggtggctttgagaaactgtttttttacttttcaggatctcatttttatttgtgagaagtgtttgaatttccaactcaaagagtcagtagggttatgatgctaagtgtttgctgatggtttcccattttaggata

SEQ ID NO: 6530 - DNA, 1083 bp, Homo sapiens
cagggtgctcttataattcttcccaaacctcacagctactcctgccagaaaaccactagaaacactcatagaaatctcaaaaagtgattataaaaagttcaagatttatttttgctgggcccggtggcttatgcctgtaatcccagccctttgggaggccaaggcaggtagatcacttgagtccaggaattcaagagcagcctgggcaacatggtgaaaccttgtctctacaacaacaacaaaaaacaaacttcaagatctcagcaggaagggaattgggttgaaaaaatcttgaaatgtcaatggggtcttcaagtaggcttgtctaacttctgtacagatgaagttgtgcctagcgagctgaagtcgcttgtctgactaataaacagtagagccgggtcatgagcctgaccatgtgttcagtcacaggggaggatcctttgtcctaaaatgcttaaggcatttcttttgattgtagagagactaacccttagcctctttttatgtctaactcctgaagattaggaacatctgaattctgaaagcattccaattacatttcatatgaattataatgctcattaataattacttttttatttaccagcataaagaataaataaactatgcgtttgtatgtttaaaaacatatagaggcatggagacctaagagtagcatgtggcaccattgttgggaaatagaaatgaggagtatgaaggtgtgtagagaagagtatagagtcatataggagctgcaagttcttattgtcatcattttcaatattgttgaccctctttggcatgctgcaccttaagaaggatttgtacatttggaaaaataagatataagtagatgatgccagaaacctacaatggaagctgcttcagctgattaagaactcaaaccttccagtcacattgcctgggactgaattttgacaccacctcttactatttctgtcacctaggtaggtagctgaatcttactaagcctcagttttgtcatctgtaaactggaaatgacaatactacttgatagggtttttgtgaggattataaattaagcaaattgcacggcatact

SEQ ID NO: 6531 - DNA, 1047 bp, Homo sapiens
cttacctgcaggtggggtgcaggctaatggggattaagtttgaagacagatgcatatatatacattgcaatttctgaacatttttttttttttttgagatggagtttccctcttttgcccaggctggagtgaagtggtgccatcttggctcactgcaacctctgcccccctgggttcaagtgattctcctgcctcagcctcccaagtagctgggattacaggcacccgccaccacgcctggctaatttttgtatttttggtagagaccaggtttcaccatgttggccaggctggtcttgaactcctgacctcaggtgatccacccgcctcagcctctcaaagtgctgggattacaggtgtgaaccactgccccagccaacaatgttatttataggaggctttcatattattaacagtaggcaggaattttattttttctttcatttcccatgtgttttaagtaggcaggaattttgatttaatttgtaaattttttttacttatagactaatagaacttaatatagctagatgacattcatatggccacattattcatatgtgtcagagcactggatttgaagtcagaaaacaggtgccctaaagttaatttctctaagcctcatttttcctgatagaggtctgaatgtcaagactctaggagtcagtgcttcctttatatgacattcttgggaaagaaagggcagagtcagagaggcacagtttttcttaaatgaattctgaacaccttaaaggcaggaactgtgacattcatctctgaatctataatacctagccactggtatgaagaacaccattcagattgggttgaataggtagctttcatggattcccttttactgtgctctagctaggtagtgtaattttgagcagaatctccatcctcagtgaaaataatcagaaattacccctgtctcacaacacaacccaagagatccaaccctacccctaaatgcatagttgctattctcaactctgaagctccaggtgagggctctctttggaagtggcttgtttgggatggaat

SEQ ID NO: 6532 - DNA, 1040 bp, Homo sapiens
acatagacacttatctgtgtttcctggtagtgctgattttttttcccaagtctttatatgaatttggtgaataaagggcattgctaaggtagggaaggaataattggagatttttttccctttatctgaaaagaaaattgactttatagattttgaaacatacagatccatgtggctttctctgtagttgttgacttctgaaacttcctaaatattgtggcaaaagctattttcacagagctctttttacaatggttgggttgagtaggaaaaactaaaggctcttttagtgatttctttttacatctagatagtctccattctccctaatatgaaaaccaatgaagtttttttgtttttattaaatatgacatggaaaaatctaaattcctataggtatagttttttcttaatttaaggttctcagaaacaacaaagtcagccacgtccttttttccacctagaatttgtgctagttgacaaaatcataattcatccatctgactgagccatcataaacatctctgtcctataagtctcccttacttgttccatagtgcctccaccagtcaactaaaataaaaaacgacagtttcaaagtgagtttctcaaaaaaaattcctttctcaaatcactaaagaaaaggcaaaatatgaaacttctgatgttttaaaagattttaaaagctccccaaagtgggcagctttttaatactctgatataattatttacaaggagaatgaaggaagaatctattgaattcaaacctgttttgttcaggatcaactgtgctactataattaatgtttaaaattttaggaaaactgaaaataatacgtaattaattgctctagaataaacacaaaagtctattaggattttagaatgttgtgaagctaccattatgttaaattggggagctagctcaagagccttttatatcttttccctgtgtgtcactccttcccctacctcagatcccgtattttcttttaaaaaccccccaaaaaacaacactctagggacctacactaaagcac

SEQ ID NO: 6533 - DNA, 1870 bp, Homo sapiens
ccatgagttatttcatgaaggttgccactgtagcactttgatgaactagtgcagttgtttgtagcttttggtatattcaaaatcacctgaaagcacccagatatagtggctcatgcctgcaatcccagcacgttgggaagctgaggcaggagatttgcttgaggccaggagttccagcctgggcagcatagcaagaccccatctcattttatttaaaaaaatttaaaaatcacctaaaaacacatttaaaaaattagattctctaattcacagcctccgcctagtcagattcaggagacctattatttggctggtgaatttgcatttttagaaagttgcgtggttgggcccagtggctcatgcctgcattcggagcccaaggtggggggactgcttcagccaaggagttcaaggctgcctaggcaacatagtgagaggctgtctcttcaaaaaataaaaaaactagctgggcatggttgtgtgcacctgtagccacagttactcgggaggctgaagtgggaggatcacttgagccagcgaggtcggggctgcagtgagctatggtcacaccactgccttcctgcctggatggcagagtgagactgtctccaaaaaaaaagagaaaattgctcacagttgattcagattgtcaactaggttttagtgaattgcttaatcctaggtggcatcttcaaattacaggatggtatggtgcttaaaaatgctggttctaaagttaggctgcttgggtttgaattagcttactagctctttaattctggacttctctggatcttaggcaactcatccataaaatggggataataataatgcctaattcatgggattgccatgagggttaaataatattttacattctttgttttaactatgtggcatatagtgaagattcaaatgttattattcagacagtagcaagactactataacaccttcctcagcttcaccactgaaatccactgatttgaagaaaggaagatactggatgaatttttgtgtcctgtctggggaaacgttacacaatttgtgcagaagaagatttttaaacataatttatacatgggattggatggatgttaaaatagattctgatgtagtgatatgacatttcccgaagtcttgaagctttgactaaaaagcaaatctgagaaggaaccgaaaggaatgctgagaaagattaaaatatttgtatcttttattgtcttaaggaacttttatagacaggcaaagccaattttttagtttaagtccatgaaatgtttaacttggcttactcatgcatttcatacttagtatgttgtggtaggaaggttttgggaaagagtggaaacatttggagattttgagacgatacatctgttatccatctctaaatgtatgcagaaaggcaaagtgtgtcctttttgagacagcttttttctccctaggaactctgttagctacactatgagttatcttcagatagttatggctgatagttgcttggaccctactacagtgattcttaaatttagtgtttaaaattacttggaagggggagggttgttaagaatgcagattccttgagacccaagtagatcctgggtggggtccaccaggaatccaactttttaaaaagacccccaggtgattctgatgcaggcgattccccgactataaccactgaaatactgggctggttaataggcaggtctcctcaggtagtgactgaaagtacaacacacctttatagctcacattgctttactgatttaaaattgggtcatattcaggtactatgtaattgatgagtataaacagaggtgtataatagagaacagattcaaaatacaaatctttaagtactttg

SEQ ID NO: 6534 - DNA, 1028 bp, Homo sapiens
tcagacatttaagattgctacagaaccctttttagttcttattaattagtttggaattttcttactatttattcattcagcaaattattgtgagtcctctatgtatactaggcacataggatattaggtaaacagaacattttatttaaaaagtttcagataagggagtcctataatatcaatgtttacaatattacctgataagtgttataaaagaggatatgaggatgcatcagtactgaggaaggggtgattaactttgagacaggaagttaggaactttacagtagatgaaacatgaaagcttagtattttactaaagaagagggtttgggttagaatgagtgtgatgacaggacaagtaaaaataacatatatatagaattatatataaaatagctcagcactttttgggactgcagattctcatctggatgattgcctctagggtgcatgaggtatgtgtcaaaaactgaggcaaaaaggttgggtctaaattatgggggagctaaatttgtctgacagaactaagtaatttgaactgattcagtgagaggtggcagtacagggaacatttgtgggttttttaaacaatggagacatacttagaactacatttcggaacggtgacttgcatagcggtgtggcagatgatttgcaacttgagaaactggagcatggagatagttatggtagtttatgggtgtttgtcagtctccttttcacaatgtgatatacagatagttgatgtaaataacattttttaaaccagtaatattggattagagaaaaaaagtaaataactagataaatctttcaatctctgcaagaaggggtggttaataagttgagtgagacataccagtagcctttttgtgaagctttaaggaaaataaactttgaactggatttttgtttttgaaggaattgagatgatatgaaaatagagtcatgtgaaaaattatgcttaccatattttgtaaggaatttaatgaggatgggaaaagagccagaatagctatttggct

SEQ ID NO: 6535 - DNA, 1045 bp, Homo sapiens
agcatttacattgcattaggtattataattaatctaagatgatttaaagtatacaagaagatgtgtataggttatatgcaaatagtgcaccagtttatataagggacttgaacatctgagaactttggtatctgagggaagtcctggaatcagtcccccacagataccaaaggacaactgtatatttttcctagttgtagaaagagagtagtaggaaataatattgtaaagataatttgtgtccccattgtggagagcttttaatgctagggtaaataattaaaactcttccataaatagtagggagttactgaggatttggggacaaggaagtgaaatattctgttattttctgcttatacttggtagtgttttctagttgtaatggcttatctgtcattttcttcctctctcctgtgtttgtctaaattctcccctcgttcattcagtaagcatatttgagcaccacctatattccaacgaaagaaggagctagaataaggcctttctgttgaaaccagtgatggaaacataaattgaaacactgtgctgtgatactagctcagggagcatgagatggagtgttttaaattctttgaaaataaagaatagcccttcagcaacagaaagagacacaaaatggaataaggatttcattacaggccctgggagtacctggcatgtctgaaggccacatggagatgggtcagtgctgggaaggatagaggggacccatgggccaaagcttttattggcatccagggcatatcgaagcagatttcctgtgggggaattctaattaatgggtttaaagtaaactggtaagagttctagaaggtcactgtggcatgtctgcacaattcacgcagggtttggcagtcaatggggccaggtaagtaggttgtattcagctgtcccatagggaggtgatcaacaggaggtccaccttgaggaaatgggaaaaggtgtagaactggaaactgtcaaggatgactgagccctgcttctagtatgagaaagttaaacttatatttaaaaactgatg

SEQ ID NO: 6536 - DNA, 1025 bp, Homo sapiens
ctatccccccaccccaatttctaaaaaaatagatggtgtcttgctatgttgtccagtctggcctcgaactccagggctcaagcagtcctccttcagccgcctgagtagccaagactacatgtgtgtgcccagtgttgaatccccttttaatatacaagtctattgaaatgattattagaatttatccaatgagtctaaaaggttaaaatagtcaaattgatgtaaatgttaagcaaaattaattactttttggagggctggagctcacattactgttggcagtaagaagattcaggattaggtagtcacaattttctatagtgtcaaattccacagtttgagaaactatgggatttacattcctttatctcagatacgtaagtgggtttgccaattcttaaagatccaagcactctacattctgttatttaaaaaagcattagtggagaatttgcatgatatcaataaattttgcccctttttagtgagctttagcctttgataaggtatggtaggcaaatggtctgactcttaggtcctatgtagctttttttgtgtgtgataaaagaaatgaagaaattttaggagaatacaagcacacagatatgtgaagcaaatgttaacatgtattaataagctagagtcatttacccaacctgtattataaaagccactaagggagaaggcagggaaatggttgtattagtaggccttttcccctcttttctcttctaatccccacattagccttttcttagtgtgcctcttttctttttcaactatatgttttcaacaatgaagaaaccattagactgctatttctcagttgatgctatttcctaactggggcaacttattgctcaactcctttttgctaaaaagattggacacaaattagtagagagaatggaagatggtgtgtttgtgtctgtgtgtgtatagatgggcgtgtacatgaacatggtatttatatagtgttgattggggtggaggatgaatttaaagggggaaagatggattaacac

SEQ ID NO: 6537 - DNA, 1034 bp, Homo sapiens
tttgaaggctgggtgtggcggctcactcctgtaatcccagcactttgggatgccgaggtggttggatctcttgaggtcaggagttcgagaccagcctggccaacatggagaaaccgtgtctctactaaaaatacaaaaattagctgagtgtggtggcacgcacctgtaatcccagctacttgggagactaaggcacgagaatcgcttgaacccaggaggtggagtttgcagtgagccaagattgcaccattgcactccagcctgggtgatagagcaagactcttaaaaaaaaaaaaaaagaaaagaaagaaaataatttgaaaacacatagttgttcttaatatttctaccatacctgaagcaataaggtacttttcaatttataaatacttggggtttgggaaggcctaataggtaacacctttagcaacccattcaagtttgggctcaatagagaaaagataggaaaacaaatggtacttcaaaatatgtcttaatacagatacattgtggatcaaaagatgtgggtttgttgtgtgactacagttggcctccttaatatttcacttgtgttaaatttactcagcaaaacattaacacagcaggtctttcctgtggggatggggagcagagaggtacagaggtaacttggcctcctaacaggagagcagaacagactatcttcagcagcagtgtctgctgccaaaatttggtccctcaggtggggatgaataagggggcagagagaagctaggaatgttcctttctgcttcccctcccttcaacacgaacaacatagcacaagagtgaccccttccccaaaagtgccctacagatgtcattcatatagtcagacactacctctggaatcctgaaagaattgttctatcttttgtgtgggtgtgcttgaacacatctggtttgttttgctaagaagcctttagtgttgatttatatttaagaaattttaatattttggggggtgggagaaagggaagagagagagagtgagtgtgtgtgtctgtctgtcggtc

SEQ ID NO: 6538 - DNA, 1052 bp, Homo sapiens
atgtagctagtcagtagttagaccatgtgcctcctcctctccctgtaaactaacttaatttcttttttcaagagacttggtattgctatgttgcccaggctgtcttcaaactcctgggcttaaatgatgatgctcctgcctcagcttcctgagaagctgggactacaggtatgtgccaccacacctggcttgtagttaattttctttacaagtgatgaaaatagtgaatagtttatctattggtacttaaaactgtgtgctgtgatccccaagccatgtgctcagacactctggtgtgctgcacttaacacactggggtactgtgggatatttaaattttttgaggcaaacagtgatattccacatcagttggatatggtggagactggtaattagaagcagtacacagttccaacattaagtgctactacatacttttctgtggcatcatatctttgtgaatctgttttttctgaggttgctgtgataaaaaccagatactgtaaaaaagtcagcgtgggactggaaatgagggttatgtctaatctgattttaaggtttgagaaattgtatacaatgcacaaagccacacatgcccaaattggtaattaattgcggttatttaagaatgaggccgagtatagtggctcacgcctgtaatcccagaactttggaaggcagaagcaggcaaatcacttgaggtcaggagttcaagagcagcttggccaacatggtgaaaccctgtctctaccaaaaatacaaaaaattagccaggcatggtggtgcatgcttatagtcccagctacttgggggatgagacaggagaatcgcttgaacctggaaggtggaggttgcagtgagccaagatcatgccactgcacttcagcctgggtgacagagcaagactccatctcaagaaaaaaaaaaaaaaagaatgaaagaaaacatatttcttttttcaatttatgtgtattttttttttttagcagttactaagtgttaggaaatatatccttattaaattgtttggacatagctacttattaaacaga

SEQ ID NO: 6539 - DNA, 1013 bp, Homo sapiens
ggcacataccaccatgtgtggctaattttaaaattttttttatagagacggggtccctttggattcttaattaataaagacctcaaagggtttttgtttatgggattatcagttattactatacccccagttaaaactgaagtgttcaagtattaatcatttaaatatcacaagaataaagctattatatgttaacaaaaacaacatatttgtgaaaaatgactattaaaaaacaagtagtggggagagtggcattgttttacatttttgcagatctctttaatgtatggcataaatgaaggctggattctcatatctactcttgcacttagttttttgctttatattgttttagtaaatttaagtacatgaagaaaatctcacagttatgtatgtagtaaagagaagaacgttttaatagtcttttcagataattgtgggcattcttctctgatgccactccaaaattcatcaagtggttgtttcttaaaggtaagttatagtgtggaatctgaaaccatataattctgttatagaaaaatgcattggtctttcttgcactttgcatggatatgtgtatttatgcatggttttataatatcatgcattggtcatttggaaagtactggtgcaccagatacgtagatcttccaaatgttacagcattgcattataaaatatcaaaaaacgacagtattatcaccactgatctcacaaaaatctaactctgggaagctgttaaatatatggtggcataggcccgggcgcagtggcccacgcctgtaatcctagcactttgggaggatgaggcaggtggatcacgaggtcaagagactgagctcatcctggctaacatggtgaaaagccatctctactaaaaatacaaaaattagctgagcatggtggcacgtgcctgtagtctcagctactcgggaggctgaggcaggagaatcgcttgaacctgggaggtggaggttacagtgagccaagatcatgccactgcactccagcct

SEQ ID NO: 6540 - DNA, 1027 bp, Homo sapiens
tcttttcaatataagtgctttttttctggctgcttttaaaatattcttcttaccattatattttagcaaataattatgatgtcttttggtgtggttttatctgtattctgcttagaatttattgaacttcttgggtctgtgggtgtagtttgacaacatttcagccattattgtcttaaatattgttctccctcgtaccaacactccaattacacataatttaggctgcttcatagtgttccctaaagctctgcttatatttcttcaatttttttccctttctttgcttaattttggatagtttctgttgctctgttctcaagttgattgataacagtgctacagttgttaatatgcaagatctgacgtgaatattttactgggtgacattaatcacagattaaacattgcagaagaaagtaagttcattgataatttcttagttatgggataaattagctccaaagaaaaaattacgttagatgtgaactaaaaaagtttataaataagccataaaggagtcaaactgatgcacaagaagcttaacttctggacagaacaaaatcaagtattattcagccctcagccgtctaaaattcacaatgtcttacatccaacaaagagaccttttgggtttttcctgaatgttttgtgtattcccagtgatgactttttattctggtggtgataatgtgaataattctcacccctgggtaagctctgggaagtgttttgcttgtagctcctcaggttattgttcttttcccaaaagttcttctttgcccagctttgtagggttttattgtacacgtgtagatcagtattcagctgaagactcaagaatactgctatgctagtttctggagttttttcctttttttttttttttttttgagatggagtctcattctgtcactcacgctggagtgcagtggggtgatctcggctcactgcaaccctctgcctcctgggttcaagtgattctcctgcctcaacctcccaagtacctgggactacaagcacatgc

SEQ ID NO: 6541 - DNA, 1049 bp, Homo sapiens
gagaattgcttgaaaccaactgggaggtggaggttacaatgagccaagattgcgcctttgcactccagcctaggtgacaagagtgaaactctgtttcaaaagaaaaaaaaaaagaaatattgcaagaattactgtaatgtgatacagagacacacaatgagcacattgttagaaaaatggcacccatagacttgcttgacattagggttgctacaaaccttcaatatgtaaaaaatgcaatatttgcaaaatgtaataaagcaaatcacagtatagtaaggtatgcctatagtatatttataacagctattttatcatccttgtgttataatcctattatctgtgacatttttatattgtgactgttgattaatttttcttctcattatgcattatatttttctgcttcacatctctgtttttattgaatgtcagacattgtggtttacataggtggatgctggacttttttgtgtgttcttttagatactttttggctttagtctggtttgcagttttttggaaatggtttgatctttttgacctaatctttgttggagtggttccagaatagcttttagtttaggagtaatttgtcctcactactgaggcattattcttctaagcactctacctagtactcttatctatcaggaggcctttccactctggctggtcttgtgtgaactttaagaatgtcctattttttttttctctggtggttctttctctggctgtagttaatcacacacatgcacagatcagtactcagccaaaaccttgagaggactctctgcagctcccttcttttctggttttctggtttgtaacttttagctgtcttggactctccaactctaaactttctcctcaccttaggattgatggaccactgagacctggaaatgtcaggtacttgtagggttaccttgcttatttcttttctcttaaagatcactttcttgtgctgcccagtgtctgttgtctggaaactatagtttaatatattttgtccattttctaatgatttaaggggaaagggtaaacct

SEQ ID NO: 6542 - DNA, 1033 bp, Homo sapiens
agaggaaagtaaaatagtttataggccaggcatggtggctcatgtctgtaatcccagcacttcaggaggctgaggcggataggtctcttgagcccaggagtttgggaccagcctgggcaacatagcgagaccccgtctctacaaaaaaaatctcaaaattagccaggcagcccgcatgtggtcacaccactcgagagggtgaggtgggaggatcgcttgagctcaggaggtgcaatgagctgtgattgtgccactgcactccagcctgggcgacagagtgagaccctgtctctaaataaataaatagttaataataaaatgtgctaaattggtctaaatgataatgttaatgctagacaatggcaccacataaagacttaaggactttaatactagaaataatatattgtcactgttacttctaaaatttttctttttatatttattggaaaaagttaaagtaatgagaaggtacaagtgtctgctcttccacctgaactgctattcttgatcctactgtaaacactgttagcaatttggtgtatattctttctggtcttttttctatgtacataaagtgtgcatctacatatgatcaattttaaagcttttcttttttattttttcacccacaatttatgccataaggttattctgtggctttctttcttcacactataatctatcttgaacatcttccatgttagtacatacaagtctgtctcatatgtactacagctacattgtattccacaatttggctgtactataatttatttaactgttttccttgagatagccaaatcaaagacatatattttttcctgccattctataaaaaagacatatatgttaacatccaagtactgtttttcatccctcaaaagagattaaaatgaatgagaattacccatacgaggatgactgaaaatcattcataaatatttaccaaaggtctcaaacaaataacctttgactgtttatttcagttctaagaatttactctgaggaaatagccaggattggatgcaaa

SEQ ID NO: 6543 - DNA, 1029 bp, Homo sapiens
ggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgtaggtagagtcatttttcaaaggaaaaagtttaagtggtgagtttatattccacaatttggagtaaacaaaatgcaataaatttttaaaatagctttgaagatacttcaaatttttacatcttttcttttgtaacagttaccacaaagatattctggaggctagagtaggattgttaaatactactgttaacctccaaagtactatagtacagacattgtttccagttctgaccttttgaagatattatagaccagtaatgaacagatttggttgtaaattatttaagtcactgaagatgtcatttatcttcattcacaagttggggcaaattcgagttacctaggaactggaaatgttggtgggagattgtttattgtttgtttagatgtttttccatagtatggtgtccatttgttttttaagggaaattttttgtcttccttaaggaattcctatcactcagagaattttagccattctggttctagtctaacaaattattcatctaataatttgacattaagaaaactataaataactggtagaaggaaagtgctttgcacttcagtggattgaagacttgactttgagagtaagtccaaaaacatatatgatgtttctcagtgataagagtaaaaagtaatgaatcctgagagttcttaaacagcatgctacttggcaagacttcatattttttagttacaattcttccactgtttaactccagtttgaaatttgaaatctaatatgtagctaaatctgtgacttgtaaaactct

SEQ ID NO: 6544 - DNA, 1040 bp, Homo sapiens
cgcgcgctgcgggtgcggcgaggctggccctataaaaatgtttctgtttctgacatcctcgtgcagatacgcagacgtctctacctacaggatcatgggctagcgggtgctcaatcacagcagccagcgttggaaggcgccttgcaaagtattaacagcactatcaaactttaattgcgtagttcggaaccagatatgtgaggaaactgggttctccacgatcggccacctcgcccaatctcacaggatagttacaggctgagttcggcagcgggacccagtttcctcctgagagaggtccaggtaaaggtttacggttgccacaggtcagtcctgacgaaaaccgcaagctgcgccaaatctcgcgcagcggggcgggagggcgggtggggaatgtaaggtatcgcgagatgacaggattttcccgcgaaggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggtgagtgaggaaaaccttttgggcgcgggtggcagcctgcggggctgaggtgggcaagcatggaggctgcggcggagtttcggggagggagccgaccccgggcagggactgaggaggaaaggagggttgggaaactgcaacggtgagtggaggacaccccggaatcgcacgtattagcatgccggtgaagatttcacataggcaactgcattttcccgagcatcccgagttgtaaactgtggtccaggcgacttgtagacattgtgaagacttacggtgtcttctgagaggtgatgctggcgtcccctcggtcttcagcttttgctccagtgcatctcgggtgggagaaaggctgtttcttgttggagttgagtagttggtaatttttttaaaactgcaatttgaaagctttctcccccgtcaggctcggaggctccagcaatggtt

SEQ ID NO: 6545 - DNA, 1561 bp, Homo sapiens
gtcaccgcacccggccttcaattgttttttaaatggaccttccaactcagtagtgccagaaaccatgtgttcaatatttgaaattataatattttgatatacgaattgcatctatcagattgcctgttaaacccaaaaactattttttttttaacagttatttgttccagtttttggtttgaaagtgtttggtttaaaaaatgttattttagccatttttattaaactttatgccaaaaaaattaaggtatgtcagaaagtgttcataattatggaaattttctctttggataggctcgcatgtcttgggatagagagtcgacagaaattcggtaccgtagacttcaacatttgcttgaaaaaagcaatatatactccaaatttttattgacgaaaatggaacagcaacaattagaggtatgtatatgtaactgactacaagtgaaagcttaaaaaaatttaaaaatagctttattgaagtgtatattatatacagtaaaatggacagattttaagtgtacggtttgctgagttttgactagtaaatatatagatctgtgtaaccaccagcacaatcaagatacagtgcacttccatgaactccaaaaaattgtcttgtgctgacagtaatccccatggctggtgtccagcaactactgatttgctttctgtcactatagaccagtattgttttttcctagaaaattgtataaatgaaatcatggtattgtgctagtgagtaaatagttggtcttcatcaccatttcctggtatacaactcttgaaatccttggaatcttcaaagtaatagtgtttttttttttgtttttttttttttaatgctaatgatcaatggctagctgcccttaggtagcttcaggatgggagcctaagaaagacaaaacctggattagagggttgggatttagcctcaccctcaactttgaggaaaagagactgaaagttaacttgttcaccagtggtcacgattgaatcaatcacgtctatgttatgaggtcttcattaaaaacccaaaagggctgggtgtggctcacatctgtaatcccagcactttggggagcctaggtgggtggattgcttgagcccagaagtttgagaccaggctgggtaatatggcaaaaccctatctctaatagaaaaattagctaggtaaggtggcatgtgcctctagtcccagctacttgggaggctgaggcaggaggttggcttgagccaaggagattgaggctgcagtgaactgtgatggcaccactgcattctagcctgggtgacagagcaagaccctgtctcaaaaataaaacaggctgggcgcagtggctcacgcctgtaatcccagcactttgggaggccaaggcagacagatcacttgagcccaggagttcgacaccagcctgagtaacatagtgaaaacccgtctctaccaaaaatataaaaattagccggtcatggtggtgtgtgcctgtaagcccagctactcagaaggctgaggcaggaggatcgcttgaacccaggaggcggaggttgcagtgagccgagattg

SEQ ID NO: 6546 - DNA, 1186 bp, Homo sapiens
aacaaacaaacgaaatgccaactatgtttaattttgaaatttctcttctaaatggaaaaaaatggacagaagtagagcccttgggaaaaagcagagattatgaacaagttatagtagggaaatacagaaaaatattacatgtaggtaagtataatagtgaaaaattgtggatgtggctcaattgcaggaaacatattttttctcaagttaatcagtgccttttaacgtataatactatgaaggtccttaataaaatcaatattctgaatccttgttttgtagggtaaaaattcaattgatgcaagtgaagagaagccaggtaaatatccttattctagttttgaagaatatgcgtttatatttctattttaattgctatcaaaaataaaatttttttttatagttatgaggaaaaaaagaggaagagaagatgaatcatacaatatttcagaggtcatgtcaaaagaggtaaaaataaaagggagagggcacctaacatttgatgttgagtaaaatgtaggttttaaaccaccttaaatctgtaaagattgaatattcaatatcacatgaaatatgttttgaatttaatattatatatcatttataggtgaagctgccaaaatgtttgaagctatctaccaacctacagtagacttgagactaatctgaaactaatgtcatctgaccttcatagacttttttttttttttgagatggagctctgtggtccatgctgccttgcagtgtcactatatctgctcactgcaacctccacctcgcgggttcaagcgattctcctgtctcagcctcccaagtagctgggataacaggtgccaaccaccacgcctggccaatttttgtattttcagtagagatggggtttcaccatgttggccaggctggtcttgaactcctgacttaaggtgatccgcccgcctcggtctcctaaaatgccacattacaggcgtgagccattgcgcccatcctcacttaagtggcaaataggcttacacctttaggttgttctggttttcttttctttctttcgtttccttcctttctagcttccttcttttttttcttcttttctttttttgaggcagggtatcactctgtgactcaagctggagtgcagtggcacaatcatggctcactgcagcctcgacctcatgggctcaagtgatcc

SEQ ID NO: 6547 - DNA, 1051 bp, Homo sapiens
tagcaatgagatgtcatatgttgcctaggctgctcttgaactcctgggttcaaatgatctttttgcttcagcctcccaaactgctgagagtacaagtgtgagccagtgtgcccagctttttgttggttttcttttcttttttttttttttttgatgagacggagatttacccttgctgcccaggctggaatgcaatggtgcgatctaggcttaccgcatcctccgcttcccaggttcaagcaattctcctgcctcagcctcctgagtagctgggattacaggcatgtgccaccacacccggctaattttgtatttttagtggagatggggtttcagtgtgttgcccaggctgatcttgaactcctgacctcaggggatccacccgccttggcctccaaaagtgctgggattacaggcgtgagccactgcacccggcctttgctggttttcttatttgggttattacagataacagtaatagctttgactctacctattatcttgtgcttgttaagtacctagtggacttgtatagcattttgcaaggaactgtggaaacaacaggcatgggcatagagcttaaaattacatatatgttgcggagagttggggggaaagggtagggtagtaaagacactgtctgaccagagcagataagtatttcagggaaaaagatggtaccagctctttgttaaacgagtctgagcctggcctagtcagaaattgtcactataatttaactttttgtaacccctaaccttgtcttaagaactttattcttgttttttgttgaagacttttacgaaactgaaatcatatgctcttttctaaaaccagcttctttttttcatttctcactttttacttaaaaatatgaatgaattagagcatcttcagttctgacaaaccagttccttagcatgtttttaatgtgtcacattcttcctttttttttcttggagacagtcttgctctgtccctcaggctggagtgcagtggcgcgatctcggctcactgctacaagctccacctcccatattcaagcgattct

SEQ ID NO: 6548 - DNA, 2403 bp, Homo sapiens
gagactggcagtttcaaaaaacttgaagtaaattatatttgcctccaatttgtatataagtgaaaagagtgatgaaggaaggatgaagctgtcgatgtaagcatggtcaggagtttaaggctgccataagtaaagtaggaagctattgaaagattttaagcaaatttccattttggtaaatcacttggctagtttattcagagatctgtgggcatagtagtttttctttctttctttttcttttctttttttttttttaagacagagtttcactgtgtggcccaggctggagtgcagtggtgatctcggctcactgcaacctccgtctcccagttcaagcaattctttcacctcagctccctgagtagtccagcgcctgggactacaggcacgtgccaccacgcctggctgtttttgtattttttcatagagaggtggtttcaccatcttggccaggctggtctcaaactcctgacccgaagtgatctgcttgcctctgccttccaaagtgctgggattacaggtgtgagccaccatgcctggtcccataccagttattctttcatttactgttacttctttcttctgtatatttactgaatttcctgctctcttttcctcttcgcctaactaaattctttccattgtttcattctcaccttacttgctgaagaatctctaaatctgtgaatgcatttggaggggtataacccaattgagtgttctgccactgtggaccctgctcctccaagttatcccttctgtttcttcaccttttccttcctcactgggtctttgcctttcaattatagatacattgtgttttcctgtctgcagaacaaaaatttttgatccagtctttctagattgccctgttttttattctttatttccaaggttttttttgagacacagttttgctcttgttgcccaggctggagtgcaatggcgccatctcggctcattgcaacctccggctcccaggttcaagcgattctcctgcctcagccttccgagtagctaggattacaggcatgtgccaccacgcctggcaaattttgtatttttagtagagacggggtttctccatgttggtcaggctggtctcgaactcccgatctcaggtgatccacccaccttggcccccaaagtgctgagattacaggcatgagccactgcaccggcctatttccaagctttttaagagtaggctggactggacatgatgcctgacacctgttatcccagcactttgggaggccagggtgagaggatcacttaagcccaggagtttaagactagtttgggcaacatggcgaaatcctgtctctacaaaaagaaatacagaaatagccaggtgtggtggtgcatgactttggtcccagctacacaggaggctgaggtgagaggatcacctgagcctggggaggtgaaggctgcagtgaggtgagattgcgccactgcactgcagcatgggcaagagaatgaaaccctggttttttttttttttttttttttggagagagagtctcgctctgtcgccaggctggaatgcagtgctgcgatcttgactcactgcaacctccgcctcccgggttcaagtgattctcctgcctcagcatcctgagtagctgggactacaggcacacgtcaccacgcccagctaatttttgtatttttagtagagatggagtttcaccattttggcctggatggtctagatctcttgaccttgtgatccatctgccttggcctcccaaagggctgggattacaggcgtgagccaccgcgcctggcccttttttttttttttttaaagagtagcctgtgcatatttccttacacattatgcagttgagcagttttacgcctaccagttgaatttattggtatctttgaaattgatacctagcacaaagcaaacaatttatcttttcctctcttccgaatcttgctcttttgttttctctttttttggtgttaatatcagaaccagtatctactgtgtcatctaaaacaatttaggaggttatctgaatttccttatatatctagatttttatcgatttctgtgagtcatttcatttgctgctactctggtgtttatgcccttactgtgccctatttatagtagtttcttaattgatttttataatcctagtctagctctcattgtcaagagtaccagattggtttttctgaaactcaaatataattactcataacctccattactttttatggtttcacaaggaattgcattttcttgtagaaaaatttgagaataaacaaaatacaaggaaatcacctgaaaagctgtcacacagataatcactaacattttggtatatgtatgttctttttctttgtattacggaaaatctcaaaaattacaaatgttta

SEQ ID NO: 6549 - DNA, 1049 bp, Homo sapiens
tatattcccatgtatatatatgtgtgtgtgtcagccacttacatgtcctgttactcttctatgaatcttaaatttgatattgctgttttgaatctacttcatcccctatgccttctatattctctctgcttgaaatctaccctcactatcttgaatgatgaagcctggtgacaactttttagataattttatgtaagataattatttgctaagtcatccagtgacatactcgggtattgtttgtctccctaccagcagcatctagtaggtacttcaaaatcagagcactttattctgtatttttaattttttctgtctttgcctcttacccaggaatgcaaactcagatgtctatccacagaggcctaaagtgggctgtaacatggtttggcaaactttttctgtaaatagccagatagtaaatatttttagcttttgagtagttttgtgggcaactactcaaccctgtactctgctgttgttgcttgaaagcagccatagacaaaccgtaaacaagtgaggctgactttgttccaatttatcccatttctttgcttttaaaaaaatacctgtgtattcgcttagctggagttggtctacaggctgtagtttgctgaccccaggactagaggtttgttgccatgtgtgaatttgtacttaatctactcagattaaaagaaagaaaagctggaaaatcactgtatttgatgaaatatcccattgtataagtgttcccaaattagcctagaatgttatgaaatattatgagccagtaatgtctataggcttatttctgcctgaaggctactagttttatcttgagaatctcatcctcatttcctggcaaaatgagcacagaataaatgcttgttgaataaataaataaatgaacttcatacattattaatttgtttttgttttctcaaactactaggaaattttgtctgtggctaaaaaaaataaaaaggagaatgaggtaagaaatttataatgtaagattaagtttagaagtcatatttactcctcagttactagtcctttttctttaa

SEQ ID NO: 6550 - DNA, 1004 bp, Homo sapiens
ttcttcttattgactagtattctgttgaatgaatgttacaattttctcatccatccccttattgatgggcatttgggttgtttgcagtttgtgacttttatgagtaaggttgctatgataatttgcacacaagtccatgtgtagacatgttttcatactttctgcctgtgtacctgggaatggtattgttgtgttacgtggcaaatgtgtgttcataagaaagtacagattttcccccccaaagtaaacacatcattttattctctcgccagcaatgtttgaaaactccagcttacattattgtcagcatttgatagtctttttaatttcagccattttattagatgagaaatggtaacttgtgtggtttttaacttgcattttcctaattactactgaagtagagtatatttttatgttctttgataactatgttttctttctttttttttcttttttgagatggagtgtcactctgtcgcccaggctggagtgcaatggcacgatctcggctcactgtaaactctgcctcccaggttcaagcgattctcctgcctcagcctcccaagtagctgggacaacaggctcatgccaccatgttcagctaatttttgtatttttagtagagacagtgtgtcaccattttggccaggatggttttgatcacttgacctcatgatctgcctgccttggcctcccaaaatgctgggattacaggcgtgagccaccatgcccggcctgtatgttttcttttgtaaagtatctgttaatatcttttgcccgtcttatttatgcgtactgtattttctgtgtaacagtttaataaattattgagtatcacaatattagaagtttggaagagagatacaattctaatgatcttttcaaaagtatgtgcctgattttaatttgtaagggttattctcagatttttatattttattttattttattttattttattttttgagatggagtcttctgtcacccaggctggagtgcag

SEQ ID NO: 6551 - DNA, 1033 bp, Homo sapiens
tgtgttcatggctcactgcagccttgacttcctgggtttaagtgatcctcagcctcccgagtagctgggatacaggcagttgcgtgcaaccacacccagctaattttttgtatttttagtagacacagggtttcgccatgttgtccagggttgtcttggatacctggactcaggtgatcctcctgcctcagcttcccaaagtgctgtgattgtaggattagccactgtggcagcctgttatttttttttttagtagcttttcatttgtagagggatggcgatgtctccagttttttaatccaggtgtgatcttagtcttctatacttaatgattataggactcagtagattttgttagttgcattttctgataaatggtggcatacagcagcattttgtataacacatcttattaaactttttttctctacaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttagggtaatgaattggaatttttaatacaagatactggttttatttctatagtagcctaatgatttgaggtaccacaacttgagtcatttctatcatgtttcactattatacatttgtatgtggatacttgctttctgatttctttaccctgaatttttagaagtagaaattaccttgttaatggcttccagcacttttatggctttgataaaggactttccagtgttgttataatttatggtgtgaatatatcagctttaacataattctcatctttgggtgtgattttttaaagagaagaaataaaatattgtaatcctgtagttgtttatatccaagtttaaatacagtatctattattttgtccagatgctt

SEQ ID NO: 6552 - DNA, 1699 bp, Homo sapiens
tcactgtggccttcacctcccaggctcatgtgagcctgctatctcacacgcctgagtagctcatgtgaacctcccatctcactccactgggtgagtagctggcactacgggtgcgtaccaccacaccagctaatttttgtattttttgtagagatgggatttctccatgttgctcaggttgatctcgaactactggactttagagatcggcttgccttggcttcccaaagtgttgagattataggtgtgagccattgtgctgggcctgactttgtttttttgtttgtttttttttcattttctcccataatagttcaatgatttgttagaattgcttggcttattttgctatagaaaaatagaaataaaattttttaaaattatattttttccctcagaatgatttatattttctaaatagtcaatatttacattttgttcttaagtctgataaaaatcaatataaaatttttcagatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacaggtacaaatgatcttcattggtttctttgtaatacataaaacatgcttttcttcatttatatcactttctcaccatctgggagcatttgtctaatttttttttgttgtcgaaataatagattatattgtgcatatacctgtagaagctggaaacttttattaacagaatgattgggatgaaggccatcatttgtaacaatataattaaagcttatggcagtttaacctatggcttagaatcatccagaaatagacctaatctcggaatgtattacagatatatttgtgacaggtactttgaatatatggaatttacttatcgtattttaatcaaataagagtatttgaagacaagttatttttagagtatcttattggactatttggtagcattttcgtttctattttcttgatgttctagctacttatttaaataatttccagttagcataacagaattgaaagattgaccttttttctttcatgccttctgttttcatttattggtgttttgaacttcttcctcactgctctacctcattcatttataattcttgactgctttttttttcctttctctggccatgtgagaaccctcttagtgcagtccccttaggtttatcttgcttgcttggaaataggaaagtatttaatggtttcaacataaaatcaaaacacataagtcataaatagaataattatgacttgcataattatgaccagtattgtcaggttttatgtgtctgctggtaaaactttggaatatgatttgcagaaatctcagttcaggagtttagcaaagtttatgaatgtgtacagcattaaaaagtatttaaaccaggccgggcatgaaggcttatgccagtaattccagcacttgggagtctgaggtgggcagatcccttgaggccaggagttccagaccagcctggccaacatgacgaaaccctgtctccactaaaaatacaaaaattaggccggacgcggtggctcacgcctgtaatcccagcactttgggaggccgaggcgggtggatcatgaggtcaggatatcgagaccatcctggctaacaaggtgaaa

SEQ ID NO: 6553 - DNA, 1392 bp, Homo sapiens
tttttggtttaacatattgccaggaaaataaatcctttcttggttattttaataaagaagatacagtactataaacttttttcattcttttgggatgtataaagcaaaatgcaaaacgttctctatactctttcctcaatttgtcagtcccattttttaaggatagttatatttttcagattgttatttatatttccagaaatacttcatatttctgtatgttaatataaattagattaattataaattttcctgattaagatatatgagaaatcacagatattaaaatgagaaagttaaaacaatttccttgataactttatgaaagtgagtgggtgactttctgtgaaaatataaattgcttaaataagggaaaattctagtgctatttgatgtttcagcacatatggaactaataaaagctcaatttttagtagtctagtgtaacattaatatcaaaacttgggaaaatattagaaaagaaagctacaactgcgttgactaaggtgtgaatagggaaatcttaaattcaaaataggtggagttcaaactttattgcatattttagtaggtctcttccaggaacagaaatatctatcagttttaggaatccttgtaagtggatcaaatgaaaacatgatcatttcagtagttactgaaattacatttgataaaattcaacatccatccctcataatagaggttttatttttagaattcttgttagaaaaattgtgagatcattgtttaaaaatctttttcctcaattcgttttctagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaaggtgggtaagccagttatttaatgatttaacctcaaaaatctgtgctgttagttaaaattactttcttttcagtgactgaattaaaatgccaaatatttggcaagttctttgtggtgtatattgtatgttctactcctgccacaaattatgtgagagcagattaagaaaagattatttaaaacttacttgcattgattaaaggaagactgctgaatgcaactttaagataatatttttataataaggttcttttatgtgttacctttgtaaaacattttaagatggatttttcttactatatcctcattaaacaaccagggacaatagagttgttaaattatttcctatctcacataaaagaaaacctaggtgtaaagttgttacaagataagactagttagttagcaccagagcca

SEQ ID NO: 6554 - DNA, 1023 bp, Homo sapiens
ttctgaaactgctgaagatattattgctaaagaaagagaacagaatgtattgcatatgctgcaccaggttttccatgttttcttattctgcttaaccataggctcgatagagtataaaaggaactctggagatcacctgtctaaccctttgtagtagagatttgaaaaatgaagatcctcctacatttaaatgactcctttgtcctttcttctcccagaggtcacatggttttatgacagaactcaagtgcttacctaagttttgtccttttcagatagtatactcattttacccctaatggttactgataagtttgtcaagcacaaaacagaagtatgtggtttttatggaatgcttgccaataatacttttataatttacatccttgcatggctgctgtctaatctatttttattgcttcctgtaattcctaccccatcctacctatctttaatttagagaaacattatctttcaagggtaatctagtcatatgggcctgaaaagcttctcagttgtggtttagcaattttattcaaagtctttatcgttttttctgatattaaagtttatacatgttcatgagaaaaacgtgaagcaggagagaagtgaaaagtaaaaatatcacttcctcttaaaattgtatttcctagcagtgcatgtggaatgattatgttgtgttatatgacaatccaaactcttttctgtctttgtgtaaacacgtgtgttttatctatattttatgaagaaaaggactttaaaaataaaattgttccttaagatagtcttttaaacagttatcagaaaattattttccttttactacatgtagatttaaatcagtttttaatagctgcttattatcccattgtcttgttctactataattaataatatctatctcttcctcttttcaaaattttcaacaatataaacaaggttgtagtatctgtatttaaaactacacctttgcccatttctggctatttccttaggaaagaattcctagaatgtatgtgtcag

SEQ ID NO: 6555 - DNA, 1049 bp, Homo sapiens
ttgactattggtagttccttgtggccatattccaacatgtgttggaatatttatttattaatggtttataataactatatgttaaaaataagttaatgttgcaaataatttctttcccctcactttttgggataaactttgtttatggtatctttgtgtgtgttcatgtgcacaagcgtgtgtgtttatatttaaaattttctttttttcccactgtgactctgggcaatgacagaaatttcaatgcaccaatagttatagaagcttttaaatgtcccagtctgaattattggagtaaatgacttatttaggaagagatgtgtttggatatcacatcctcatcagtagtgtatacatccatatagtgtagcaaaggattaagtttctgttcttaggaaatttaattagagtcaagacaatgaatatttatagaatttgtcacttacacgttacctcacagtgtatacaggtagatagatattccttagaaatgatcatctgccttttgattgaacatttgtagtaattgtcatagttgataattccataagagggctcactggaattgttttactatagataacttcagatttccattaatattaagatatgataatgaacttttattatatccaaattcaacagttttatcaaaaataggggcagttttgaatgttctagcaataagaatattctctgtaatactgtgcttaaatttgagtttatattacttttacgctttgtcctaattatgttttaatgcattactacaggaaaaagttttcattcaaaatgaattcagattaggtggagatagttttaaatcgctagtatattttcttaactattttctatatgaaagaattcctttcctttttttatgcaatgtttacataaaccttgcatagtaaaaaaaattttttttactttccgtttaaagttctctaagcttgctacttttctatttccaccccatattgaaggccaaaagcagtataacctttacaaattaattatttaaaattttttattttaaaattatgcgtaca

SEQ ID NO: 6556 - DNA, 1075 bp, Homo sapiens
tgtttactatctttggtaatagtctgtctatgattagctctatacctgttgggtatttaagtccagagtcctgaaaatgagctttattatatatgattactatatgtaaaccattgtcagtatttaatggcaggggtataaagagtatacaattatttgtttattattattagtagtagtagtagtattttttttgagtcaacgtctctgtcgcccaggctagggtgcagtggcaagatcttggctcactgcaacctctgtctcccaagttcaagccattctcctgcctcagccttccgagtagctgggattctgtaatcccgccaccacgcctgactaaatttttttgtttttttagtagagacgggatttcaccatgttggccaggctagtctcaaacttctgacctcaggtgatctgctcgcctcggcttcccaaactgctgggattacaggtgtgagctactgcgtccgacctagagtatacaatgattttaatctagtatttgtgctcttttagtgacccgaatattttaatgcataattattgtctgttgcttctgtgttctctttataaatgtgataatcatttgtaaccaccccagctaatgaaagagaataattttaagcctgaaactttagaacttatagaaggaaacttgtatgtctgcatccctaggtcagctggctttttactgagtcttaaaacctcattctattaaaaaatttttaatttttaaaaaaacttttagttttttgggtacatagtagatgtatatatttatgaggtatatgttttgatattgatacagaaatgcaatgcataataatcatatcatggagaatggggtatccatcccttcaagcatttgttaccctttgtgttacaaatgatccagttatacacttttgtgtgtgtgtgtgtgtggagacagagtcttgctctgtcacccaggctggagtgcagtggcacaatcctggttcactgcaacctctgccttccaggttcaaacaattctcctgcctcagcctcttgagtagctgggattacaggtacccgccagcacacccagcta

SEQ ID NO: 6557 - DNA, 1036 bp, Homo sapiens
cctatcactttgggaggctgaggcaggtggattgcctgagctcaggagttagagaccagcctgggcaacacggtgaaaccctgtctctactaaaatagaaaaaattagcggggcatggaggcatgtgcctataatcccagctactcagaaggctgaggcaggagaattgctagaacctggcaggtggaggttgcagtgaatggagattgtgccactgcactccagcctgggtgacagagcgagactctgtctcttaaaaaaaaaaaaaaaaatcccagaatgactttttgtaaaacagactgttgttaaaatttatatgagagagtaataaagggccagaaccaagacagttttgaagcacaagatattctataccaggtataaagtcttattaaaaatttaaaagtcataataatcaagatggtagaattagcacatggtgtgatatattggctagaagtacaatatggtgaatctagaaagacaactttcacgaaaagctaataaatgtgaaatggaacttcaaacaactgataggaaattcctattaatcaatagatgatctggggaaatagtaattaataggggaaaaattaacttagattctcctctcctcacactgcacttacaaacttcagataaattaacaatccacgtgttcaaaacctaaatattaaaggtagaattttaacctaaaaagacaagaaaatatatttatgattttagaattagaattctttataatacagaaatcacaaattatatgataggtttcatagattttaattacattaataggaaagactactataagacagatgacaccataaagagataagagacaaaccacaaataatatttgcaacatataacaggaagtgtttaggatatgcaagtaaataaaagttgataatgaaaacggataatataagagcaggctattaccaagagagaaagaaatgtctgatgaacagacaaggatgattagaaatcagtaatacaaatgaaaatcagatttcatttcacagctgtcatg

SEQ ID NO: 6558 - DNA, 1621 bp, Homo sapiens
tgtttctcaaggtaagctttttgtggtgtgttttcagctattaaacgaatcgtgattgggcctctttttaaaacgtttctgacaacatgattcaaattgatattatttattgctctttgacttgtttatcttaccttaaattcagcaaaagcgattttgactagcaaactgatgctttagattgtatgctcccaagagtctgattctagttgttgtattaagaatagtgtacctttttgctttcactgctattaaatcttggtgattaaggaagagagtgccctgtattactgtgagttttataattttggacagatgactcacttctcataacatcatattggatgtttcttttacgatttcttcttcttatacttctaaaatgtacctgttttaatgtttttcccttagatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatgatctcattaaattatttcttcaggaatagcttaggtgcaataatagcaaaagacttggctgtcggtaggatttggttattttgttttcttggtttcattcactagtactataggagtgtgtcatatagagatttcaagtggacattgtgttagcacaagagaagtttctgaatgaaactttagggtcttgagaaacgactagaaattggaaatggtagtgtatcatgcaaaacaagacagaccctgaaaatttatagtagtgggttaactagaaccaaatataagagaataggccttaggaatatgtaagtaatgcacaatctgtaatagaacagcataaaggccaaaagaggcacaatttagaccctgtgtgaaaggatatcagacaatgaggaagagaaatcctgaatgtaccctggagaggggacatactccataagccatacatttctgtgttagtgtttatttcatggaaaaatattgctgttgccatgtatattcaaatgcagatcagatgatctgttaaggataatggaaccgtcacttaagaaaaacttaattttttttccctgtgtcctattggcacaggtcttttcttttaaatttttattttaatcgttttgaggtacaggtgggttt

SEQ ID NO: 6559 - DNA, 3874 bp, Homo sapiens
aaagttgtcaccgttgcatctgtaaacctagcatctgtgcccatctgtccccatctgccctttattatatactgcggatatattgtttgtcgtagcttgagccaattgcaatgtctcatttcttttataacaaagctccttgaaaaagagttctattatagcaaaactccttgcctgtattcattgtttttagtttgttctgttttttctgaacccattccaatcagatattcatttccattggagctggtatttttaaggtctcgtgacgtcagtgacctcattttacttgatctattagcagcatttcatacagttgttgactcttctccattaaaacatttactttatttggcttctaggaaacatattttcctgctttttcttcctatttctctgactcttttctcagtttcctttgctgtttccttttctatcctctaaacattgaaatatcctaagcctagtttgggattcccttgatggtcttcatttctttaatgggaactgtgctggtgactcaaatttatatctccagccagaacctttctcctgaattccagattcacatatccgactgtttactaggtgcttgataactatatctgtacttttcatcttgtttaatccaaatttacttcttttgcattttccttagttcaataaatgacaactttattcttccagttatttaaaccaaaaatcttagagtcattcttctcttccttccctcatatttcatgtctgattctaaaggaaatcttgttgcctgtactttttctttctttcctttttttcccctttttttgagtctcgcactgtcgcccaggctggagtgcagtagtgcaatctcagctgactgcaatctctgtgtcccgggttcaagcgattctcctacctcagcctcctgagcagctggggttacaggtgcatgccaccatgcctggctaatttttatatttttagtagagactgggtttcaccatgttggtaaggctggtctccaactcctgaccttgtgatctgcccgccttggcctcccaaagtgctgggattgcaggcgtgagccaccacatctggctttttttttttttttttttataaacagtttcacttcgtcacctgggctgaagtacagtggtgtgatcttggctcactgcaacatctgccccccgggtttaagtgattctcattccttggcctcccgagtagctgggactagaagtgtgcgccaccacacctggctaattttcttatttttagtagaaacgtggtttcaccatgttggccaggctggtctcgaactcctcacctcaactgatcatctgcctcggactaagtgctgggattacaggcctgagccaatgcgcccagcctactttctataaaagtcgtcatgtctctgcccccaccccccgccaccccccacatagtctgtttcatttgattttccccttagtttagtgttttattttgatgtttcttcagatgccttgggatcatttactgttcctcatatttaagagcaaatgcttaaaaattcttagaaataccttcttgaaaagcctgcattcctaccacctctcaccacttcaacatgaaataatgatcccttacatctttttagtgtagttatataacttttgattggctcaataattacttttattatggctgtgtaagtattattaaagctttagataagccatggaatatgctgtgattttattttcattcttgtgcagctttttttttctccctgaagttaatacttaactgttttttacctaccagtaatttatatctaatcactctggaaatataagcccctcagtatattaaaacagatctcatgattcagtaataaacctccccctccaaatatatcccatcacctctactccctggaacattcttctagtttggactgtagaactgattccatctggaaccttcctttaccatactcctgggtattcctgttggctgtttcatgttttggaattactgtttactgtgtcttgtgtctccccccccccccctttttttttcctttaagacagagtttcactcttgttgcccaggctggagtgcaatggcttgatctcggctcactgcaacctctgtctcccaggtttaaactattctcctgcctcagcctcctgagtagctagaattacaagcgcccaccaccatgcccagctaatttttgtatttttagtagggacagggtttcaccatgttggccacgctggtctcgaactcctgacctcaggtgatccaccctcctcggcctcccaaagtgttggtactacaggtgtgagccactgcgcctggctggatctaactttttttcctccttggtttactcgctcactttgatggattatgttgtcttgtgttttcccaagaaaagaattcaagggaaatgaattttttgagaactcgcatatctggctgtatttttgttggattcttatatttgatggatagttctggtttgggattttagagtaggaattattatcttctcagaatttcgaaagttgttgtgttgtctcagaacttccagtgttgtgggagagaaaattaatggttccttttttttttttttttttttgagacagggtctcattctgtcacctaggcatgaatacagctcactgcagccttgacctcccgggctcaagtgatcctcctgcctcagccaccaatttagtttggaccacagccatgcaccaaatgccctgctaaatttttaattttttgtggagacagggtctcaccatgttgcccaggctggtcctgaactcctgggctccagcaattccccccggcttggcctcccaaagggctgggattacaggtgtgagctcctgcacctggcccgaatgctgctttgatttccagtctgttgaaggtggggggaaccagccttttgttaatgtgagcttccagtgtttctttgtcttttgtattctaaattaataacacagtgatgtgtcttggtatgggtcttttttttttttctttttttttttcatttttaaagagactcctgctatgttgcacagacttgtgaattcctggtttcaagttatctttccccctatgtcactcaagtaatgtggactacactcatgtgacaccatgcccatctttatgttgtgtatcttatttttgttttgttttactcttgaatcagctcagtctgaaaatctgtcttttaattcatggggattttttagaatgatttcttggagggttttgtcttttgaatgtgtggtcccttctctgcctagaatttttttgtttgaatgagacatggtcttgctgttgtccaggttggagagcagtggtgcaactatagctcactacattcttgaatttctgggctcaagccatcttcccatctcagctttcagaatatcttggctacaggcatgtgacactatgcccagataatttaaaaaaaaaaaaaaaatttcttgagacagggtcttgctatgttgcccaggctcgtcttgaattcctgttctcagagggtcctcctatgtttgcttcccaaagcattggtattatatgtatgagccaccaccactagcacttctgcctagaactcgtaacaaaatttctttcccccatctgcatagtcttgtttcattaaatgattcttccctttttaaagtttagtctgtcttttattttgatgcttcttcaaatgccttgggatcatttactgttcctcaaatttaagagctagaagaaatctctctaagctccatgcatgagggttctcaacaggtggattttactccagtgtgatttcactagaccatttatttgagggtcacccaattgtcagtatatgtat

SEQ ID NO: 6560 - DNA, 1031 bp, Homo sapiens
atatatctgagagaaattctctaatcacttgtcctgtgtgagtatatgtactttgccagttttcttttggggtgaggaggagggacagtgtattagagattttactgttcaaaatgtagacttcctcagttttcagtaaaatactctaccctgtctatatgtggattcccctattccagactgattcacccttttcagtgagttagtcgtgacatttcttacactgtgagggggagtggtaattactttacagggaggtatggggccatggtgtttgactcttctttcaaccacttctgggttttttagtgaaaacctctatctaacactgatactttcatttctgttgtctattgagtcagttaacactgatccatttatttttcagttcccaaaatcttgctttgccattgcttctattttattgtctgggggtgtttaacacctgtttcattttttacagtcatttagtttccagattttagtaagggacagaggggaatagatggactcatttcatgatgtagaaacaaatactccctgtcttgtcttacatgaaaaattattcttaaactaggccttatctttgagaacctgatcaaagtataaaaaatactttttggctttatttctttagtgagtcactattccatattttgaaggtgttaagaggtatggtaaaggtggtacttgaacatttccaagcaaacgtgtgatgaaatctttcatcaatgtcttagcaatggtatatgatttttttagtcttagcaattttagataagttttttttttgtcttgtttttttgagacggagtcttgctctgtcgcctaggctacagtgtagtggcgtgatctcggctcactgcagcctctgcctccgagcggggtccagcgattctcctgcatcagcctcctgggtagttgggattacaggtgcatgccaccacacccaactgatttttgtatttttagtagagacagggtttcaccatcttggcctgactggtcccgaactgatctcaggtgatctg

SEQ ID NO: 6561 - DNA, 1301 bp, Homo sapiens
cccaggctggagtgcagtggtgcgatcttggctcattgcaacttccacctcccaggttcaagcgattctcctgcctccatcttccgagtaggtggcattacaggcatgtgccaccacgcccggcgagttttgtatttttagtagagatgaggtttctccatgttggtcaggctagtctcgaactcctgacctcaggtgatccacccaccttggcctcccaaagtgctgggattacaggcatgagccactgcgcccagtatatatccaccactttaccatccacattagcatttcattagcttctctttgcccttttagttaataaccccatctcagggtgattcactttcataatccgtattaccatggattaattctgcatagcaaaaactatgataggtgtgttaagtaatgaagtttggggaatgttaataagatgatttctcttactgtagatgaaatacatcgtaagagaatccctcgtgagaccagatcagttacatgtatatcttgcctctcttaagtctctaccatttattactgtacttgagttaggatttggaagtgccactgaacactaaaattattctgtctgggtatttgaatggtgtgagacaaaaatccattttaatgttttatcaagttgagatgtctcacatgagtagttagtgctgagaatcagacacaggcacatttgggagcatggcgtggcaagaagctttgctttttcctgttcctattgtactcaaacttgtttctacatttttcattgatttctcttcgtactagcactagggcgcaagagaagccgtactggaatattacactactcagcacaagacaggtttaatctttttcttgggggacaagattggaaaattgaggtctgagcagacctgaagagaggcatccagcaactctgagattaaattcatcattgatcaattcgttattgtttggaattgacgtttagctgtgttcctcactcagatacgtgcatgatagctgcttgctaatttggtcttagctcacatttcacctagaatgtatggtctccctctcccctgcaaaatatcccactgttgctaatctgtctgcctcataatttccatgagattgagcatcttgtttgttttgtcaccactatataacagcatgttggaaacaaagcagtaataaagctagaaaaaccaagcgaatacactggattaaaaaaaatactgtttcctagaattaaagaaataaatgaggccgggcgcagtggtgcctgtaatcccagcagtttgggaggctgaggctag

SEQ ID NO: 6562 - DNA, 1585 bp, Homo sapiens
tcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggtttgtaggacccaaaaagaagttaggcttgagaaattttaagtgaagagaacaattctagttcagagtgattggctcttcctaaaagctgacatttgactgaaaattttgaggggagggaaagaaacaataccttttacggcatgtaataggaagaagacctggattttagttgctgctctgatgtcccaacttgggtaaggcaacataacataaatgtcagtttcttcagatttgtgatgaagctgataatccatgctcagcttcctttatgggtctcttgcctatcaaataaggtacagtatgtgaagatacattgcagattatcttatgcattgcttcaggggatgattaaaccatcctttattatagccagagtctagtctaagggaagaaggtcattctctataccagtgaaggctccatccaaaccagtgtttgggggcatagtcataattgaaaaatgattgttttccttatctgtaagacaggtaaatggtattaatcctcaggtggttgtgaggattaagtgatacatgtaaaaaaaagaaagctttggatagtacctattataagaaactcagtgttgctgcaatgtatgtattataatggatttgaaatttgccctaaccaagagtcacagacagaaaaaaggaagttaatgtatctcttgatcactatcaagatgtggtattgaaccttcaagat

SEQ ID NO: 6563 - DNA, 1036 bp, Homo sapiens
gggtttgtcaaagtttaaatgtgtcatgccagactcagaagcagccaaaaacactgctgatctttttttctcttctagagatcctctatgtggaccaagcctgcctgatctacacacacacacacatatgcacacgcacacgttcaaacttattcaaatcctttatatcatttcttatgtgaactgcttaattttgagggaggttttaaaaatattttatcatgattatggatttataaaatttttattttgtcagttttttgctttttgtatgttgaagtcatgctgtcagatgctttaaggcacataattgttatataatttaattgacaaaacaatctctagccatagttctctcaggccttgttaatgttattcattttaatttgcttaatagtagtattgttatcccattttcactttgttagtttttatcagaaatatattttttcatttcttaattttcagtactttagttacatctgttataaacagcattattttagttttaacaagaagatttatagatttctcatgacttatattttcagttttgtggctcaggttttccttttgttggagttctatgagatttttttcttcatctcctctattcattgctattatcaactaagatgattttgattgggagagcctcaactcaggctggtttaaaaaatagggaaatttcagcacttactctaggcagggataataaaataaaaacaatagggtcggtggctcatgcctgtaataccagcacttcgggaggccgagtcgggtgggtcacttgaggtcaggagttcaaaaccagcctggccaacatggtgaaaccccatccctactaaaaatacaaaaattagtccaggcacggtggcggtaatcccagcactttgggaggccgaagtgggtggatcatctgaggtcaggagttcaagatcaacctggccaacatggtgaaatcctgtctctactaaaaataaaaaaattaactgggcgtggtggtgggcacctatagtcccagctatttgggaag

SEQ ID NO: 6564 - DNA, 1058 bp, Homo sapiens
agggctccaccgaaagggcatgcagggaaaacttttaaacggtgcatgcggaagcaaggcaaagaaaacattgattgactagaatggagcagtagccttaaagttcctagttagagattagttggcagtttctgattggtaaaactaaagttacagtttccttggataggaccattcacactgaattgggtttggtttgcttacataggaactcagggccctagagctgcttcagtctaatagcctcccaattaattattttaacaatgttataggtgatatccaacttacagattttaatccaacttacagatttttaatttaatgtgtaatcaatatttgaaaattcaatgtgtaatcacatatttggaacttgaaatgacaaaacaactcatatttttaaagagttatattatttagaggacaagctaagtagctgtaacaaaaagattcaaagtaaagtgttttcattaagatagaagtttcctttttctctaatgtaacaaatcagcagtcggggctgataggagagttttgccatctccaatatgtggtttccatccgtaagtccaatggcaaagctgtagttttccatttgctagcaaaagggaagtggggaagaaagaaccaaaggattttaggttgatcttttaggggagaagaccaggaaactgcatatcatatcatttccaccaaatgaatgtggaagaagtgtctaggttctactattagagttgggagaaaagactgtaatgagcaactaatagtttctgccacaagcacctagagtatttaactgcaaattttaaaatgcaaggtttttttttttaaatttatctttggctcctcaacagagcacctcttagatgcttaataaaaattattttaattaaatgtaaaggtaaacgcagactaaaaagtgatgtttatgtgcatgttattcactcaacacatgaattaaaacatgcctaaattggatttaatttcactacgagtagtaaaaactataaagagttacaaagtttgtcaaggtcaatccattgagtatcaggaaaagg

SEQ ID NO: 6565 - DNA, 1076 bp, Homo sapiens
tgtttttctgaaaacacctggtagggaaaacaggattctcttattaaaaatctttgtaggatgtatccattctagaaagcaagaaacaagaacatctataattgttcacatcagaagtggttaagagtaaggagaaaaatttggttttaaatgtcattcattatccctccacttaactttttcatttttgtattccagtcaagaaaagtatgttttaggcacttgtaatactaatatattggaaaaacaatgttaagtcattgccttgtggggatacgcctacagataggtcagactaaatgttgttccttttgacttaggagctgaagttgccctcctataaaggccagtcccctcagttaagtctcagacggtattttgctgacttgattgccattgtgagcaatcgcttcacactctgcccttctgcccgccatcttgctgtctatttactggacctgtttatggaccgctatgacatctctatccagcagctgcatttagttgcgctttcctgcctgcttctagcaagtaagtatgaatctgatttacatgactggaaatttctgatgtttatataataaaataaatttatgtagaactcagtgaaatatcatcaaatcccattcattccagttcactagtatcaagaagcttatgttaaaagtgcttctcagtgtaataattcttaaccagacattgaaaaatggctttggagcctgttaaaaacatgtgcctaagccgtacattctcggccactccagatctactaagacaaaatctacataatgggtactgggtattttttaactttttgaaaaagttccaaaggtgattttgatttacctttccaattgagaaccattgtcttaaagcagtggttctaaaccaggagcagttttgtcccacagggaacacttggcaacgtgtacagacgttttggttgtcacatctggtgataaagtgggagatgcttttttagcatctagtacatagaggcctgggatgctgctaaacatccggtagtgtacaggacagtttcccataacaaaattctctgtcccaaaacatcaatg

SEQ ID NO: 6566 - DNA, 1189 bp, Homo sapiens
gccaacaaatctatggtattataaggaaagctttggaaatgtagtggaaaatattgtacccatgtaaaaaaacatgttttttctaccctcaaaacacagatgtctcctactctttgtgttggataggtcctgggatctttgaaatgctaagattcttggataccacagtatcataaaattcctctaaatgcagtaagtatacacataagtatgaccgtaaattaggaataagattatttatgtaactgctgaaatagctgacatagactataccaccttacagtattgctttaattatcataataaccgtgttcttccctgaacttcaccagcaaatggatttctgttcagggccatttttttacaaaggcatgaatttttattttgtcagaaaataatgtacattgagtagagagcagtagagctgagttgaggtaccacgttatcgtttatgtcattaagtaactttttcctatataatatttgtttgacttcctaccacgagattcacatgggtactgtgttattcctgaagagataaagtaattctgaatgctaagaattttcctaaaggttgagcatcccaaatctaaaagcctgaaatctaaaatactccaaaatctgaaactttttgagtgctgacatgaagctcaaaggcaatcatcactggaacattttggattttggatattcagccagtaagtaatgcaaatattccaaaatccacaaaaatctgaaatctgaaacacttctggttccaagcttttttgttttgttttgttttgtttttttgagacggagtctcactctgccacccaggctggagtgcagtggcgcgatctcggctcactacaacctctgcctcccaggtgcaagcaattcttctgcctcagcctcccgagtagctgggactataggcgcatgccaccatggctggctaattttttttttatttttagtggagacgaggcttcgccatgttggccaggctggtctagaactcctgaccttgagtgatctgtctgctttggcctcccaaagtgctgggattacaggggtgagccactgctcccggcctacttccaagcattttggttaaggaatattcagtttgtactatttgacccagactactcagaaaaagtaatgtaatgaagaatgaaagctgtagttgtagtgaagtaaatag

SEQ ID NO: 6567 - DNA, 1108 bp, Homo sapiens
ctttatcttaaaactccttgaaagagttgtctgcactgcatcactacttcctctcttcccattttgccttacatccaagcttgtcagcctttctcctctaaaactccactgaaactgttctaatccatggtaccagtgatcttcacattaagtctagttagtcatcttcttacttgacagagttgttcaatcccttatccagtaaacattttcttcattttgctttgaggataccacattcttgatttaccttaactcttattggtcatttcttttctgtctcacttgctggttctttttaatctctttctgttggatgtgttatagaatcttgaggctcaggccttggactgctctttttgtttattccccctggtgatttcatcctgctccaagtacttgaaagtacatatgtacatatacacacaccgataactccccaaatttcatcatccacctagccctctgtattctatatccagccacacagtccacatttcctcttggatgtcaaatagacatctcagatattacatgcctaaaatggaacttttgataaactttcctattactttaacaatcttttatatctcggtgaatagcaactcagttctttccaatgctgtcagaacttctagagttatccttgacatgtctctttctttcagagaaagcatatcaggatatcttgtaggtgctagcttcaaaatatattcaatctgaccatgcctcattgtctcagccaaaccaccatcaactcttacttggataattgtactgtgtagtctttgtctttactcttaatccctcctgaatactctgttcttagcatagcagcccaagtgatagaagtaattcgactcatggtaattctctgcccacaatgctccagtagcttcctctctgattcagaataaaaccaaagcctttacagtttctatcagggcctgtttctgtccccttgttacttctctgacctcatcttctagctttccctctaatgctttctgttgtggtcatactgattttcttgctgttccccaaatgtgttaggcacattgcacactcagggtcatgtcactaacttttgttttcttggattgttggc

SEQ ID NO: 6568 - DNA, 1613 bp, Homo sapiens
cctgccttcttttcttttttttcttttcttttctcttaacaaagcagtgagttaaaacctgactgttggattgtagagccttcaattagtgtctagttcattctcctagaaagacaagtgctctgcttggctagtcattctgaaatcatctgtaagccccatcttagtttaagaatagccatcagataattcttctcagccttttctcctggtttcctgacagttccagttactttttcagcttttcttcttttagggccctaaaaacccttcatgaggccttcatcttgtgttaccttttctttgtaatactaaagttttatgacaaacatcccattctggattcacattttactgtattagtcatggcatgtaaaacaattcaataattggtacccttctgattaatttattatagatctcttaatatgtaattcaacttttaatgattccctcagtaaaggatttctaaaacagtaaagtttgtaggtatttagattaattgaagtttaaagctgagacctttggatagacattatggatgaggagcttaatgtgatttatactatgttttgtttagcttatctgattttgtctattcatacatatatatatatataaagcacaaaattaaaaacatgtaatttttctaataatacagtttgatatattaatgactgaaccttcagtattcagattcctgtctcaacaatatattgttatgtcccatacgtggtaatcacatagagtaatagtggtagctgtgatttatatggcactttaaaggatatttttacatatattttctcattttatcttcacaacaaccttgtgaaagacataggggaagtactaatttttccccccattttacagatgaaggaactgagacacagaggttgagacttgtctaaagtaacatgaccagtaagtgcttgaattaatgcaggtaggtagtgatgggtatgttctaatctgccaagggcttttccttgctgtcatctggcttgagttctgaggatataaattcatatagccaaaatggtagggaaccagaaaggtaatgagtagatggactttaggactacactagggaaatggtgctgctgttctttttaatttcttcctttttgttctttttgtttggtttctaacttgttagtaatgataagcagataccgtctttggttgtttccgttagatgaatgaagcttttgttttaattgtagattatccctgaggaactaaggaaatagaaaatctggagagaagtctgttgggattctcacagggaatagctattagatcaactaagcaaatgaaaaagttaatagtatatggataaaccacatgtgtgtaattggaacttcttaggattctaagatttttaaaatcttgtttaaaaactgtattatcaccttaatataaaaatcttagcgcttgagcgtacttacccaactgtggttttctttagatgaggaaactgaggtccagagaagttgaagttttcccaaggtcacacagcagagctggaactagagcttgcatttcctgacttccagattagtgttatttttacttcaaactattacttcttggtaagctgttcttaa

SEQ ID NO: 6569 - DNA, 1028 bp, Homo sapiens
aaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctt

SEQ ID NO: 6570 - DNA, 3360 bp, Homo sapiens
ggaactctacaaaaatgacacagattcttttttttttttttttgagacggagtctcgctctgtcgcctaggctggagtgcagtggcaccatttcagctcactgcaagttccgcctcctgggttcaagccattctcctgcctcagcctccgagtagctgggactacaggtgcccgccaccacgctcggctaattttttgtctttttagtagagacggggtttcaccgtgttagccaggatggtcttgatctgctgacctcgtgatctgcccgccttggcctcccaaagtgctgggattacaggcatgagccactgcgtccctctatgtatgcccaggctggagtgcagtggcgtgatcttggctcactgcaacctccacctcccaggtttaagaaattctgtgcctcagcctcccaaatagctgggattacaggctcgtgccaccacgcccagctaatttttttgtatttttagtagagatgagggttcagcatcttggccaggctggtcttgaactcctgacctcgtgatccaccacctcggcctcccaaagtgctgggattacaggcgtgagccaccgtgcccggccgacagattcttttttaaaccacctttacagggacaatattatcatccacaagagtattatcttctaagcaagctcatttggaggttatgccttccattgctgttacagacctatttttggaatacctttaggattgacagattatcatccttggaagttggagttggtatttggaaagagtcaaaaagtatttgctgtgaaatgtggcaattaaaggtatatgttaaataatgggattggctttcttccctggcttgcagtctagctcggaaagctcagtagaggggcttgatttgtttcgatgtgcctctgaacctctctcttaattcatatttcccgtaagtctgtccatctgttgtgtggaatctcagtttgtgatattggatagatgcaaataagcaaagctgttacttttcatagtttcaaatgaaaaactcaacatcactactgtataaattattttctagtctatctgtgtttatttttaaattccttttactattctatacacttgcacattgctctgggggtaaaaatccaatataaaccattagctcattttattgaccattcttgtattcagcaagtatcccaagtacagtggtccataccttgaattttttttcactttttaagtgagatataatttacataccataacaacttagtgggtttcagttatttcaaatacaaggttgtacatatatcatcactgtctaattccagaacattttatttttattttttctcagcagtggggtcctgccatgttgcccaggctggtcttgaactcctgggctcaagtgatcctcctgcctcagtctcccaaagtcctgggattacaggtgtgcgccaccacacccaccctcaaaacatttttatttcctaaaaaagaaaccccacatccataggcagttccacattccgttcttcctatgatccagctcttggcagctactataatttgttttctgtttctgtggatttgtctattctggacatagcatgtaattggagtcatacaatatatggctttttgtgcctggcttctttcacttagcataatgtttttaagattcattcatgttgtagcattatcagcactttgtttcttttatggctaaataacactgcattgtgtggacataccacattttgtttatccgttaatcagttgatggatatttgggttgtttccacttcggggctattatggatgatgcttctctgaatatttgtgtacaagtttttgtgtggacatttgtttttagttcacttgagtatgtacctaggatggaattactgggtcatgtggtaactgttttaatttcgtaggaactgccaaattgtttcctaaagtggctacggtattttacattcccatcagtactgtatgacagttccgtttatccacatccactccaacacttgttgttatctgttttgattatataatagctattttagtgggtatgaagtcgtatttcaaaaaaacaagaaataaatacaaaaaaataagacaagttatatttcattgtggttttgatttgcattttcctaacagtgtgttaagcatcttttcatgtgcttgttggccatttgcatacctttggagatacatttattcagatcccttgcccatttttaaaattgggttattatttattgttgaattgtaagaattgtgtatatattctggatatacttacagtgtatgctttgcagatattttttctcatactccccatttaagaacaaatacagatcaatacatgaccagatacactgtaacaaaagctaaactgcaggataccttatgaagagaataaggagcgtagtaatagaacgaaatagaattctcaagaaaagccaggtgcggtgtctcacacctgtaatcccagtactatgggattacaactccatttgcaagagtttggatagagaaggacacctttgctctatattgccctgtcacaaatgttttgaatgaatctgttccatttctgagtttagtgagaatttgggtagtgagaggaatctcactagcagtatttttgaaatttaagattacattttttttgtttgcattttataaaaacccagacatctgacaagttatacaatatattttttcttgctttttttttttgagacgaagtctggctctgttgcccaggttggactgcagtggcgtgatcatggcttattgcaacctctgtcttccaggttcaagtaattctcctgcctcagcctccctagttgctggtattacaggcgggtggcaccatacccagctaatttttttgtagttttaggaaagacagggtttcacccttttggccaggctggtctcaaactcctgacgttccgcctctcttggcctcccagagtgctgggattacaggtgtgagccaccacccctggtttatattttgtttcctggtgctaagttaaatatactgtttttaaagtgtttgtttgaatttcgttgattcttggtttctctgatttttgaattggttaggtttggtctgttacaaagtgtcaggtataatgatgtcttaaggatgaaactaagtatcttatggggtagatggccgaatttaagaatcttttgcttaatggattgtgagggtcaagttaggaaagctgtgtagtaatgagtggcatcttctaatgatttttggtcttctttttattcctttgtttcatgttttaatctactttttgataaagagagttgtagattcttttagcatatcacttaatcat

SEQ ID NO: 6571 - DNA, 1145 bp, Homo sapiens
acagatgtactagaattggtgatgcgaatctaagattttctgacttcagagtgtaattgcattcatatgattgtaatcatttaaatggtgtctttaattttctccctaagttattcccccattattttggggaaaaattatatgtgtgttttatcatacctttcctactgaatatcttgttttagccctcccaggatcctttctctcctcctcttatggcagtagcatcttgattttcttttagggagtcaccttttctgccattcttgagttccatatgatttggatgaggctgacttacccctgggactgatgtctggccattggtcacagtgagtgagtggttcagggatccttctgagatttggttggtggagttcttgggaaagagatttcttttctctagggtagctaagctaatagcctaaagtgggaagcagctaccatggggggagagcttgcctgtgagtgatgctatatgcatttgtgtgagacatacagaatgatggatgagaattatttctgtgtacttggatccagctgtgcatgctctaaaaaaacttactcgagccgataattaccttttttgctcaagcccatttaagttgggtttttattacctggaaccaaaagttttgactgacgctgtttttttttgttttttgtttgtttgtttgtttgtttttgagatggagtttcgctcttgttgcccaggctggagtgcaatgacgcgatcttggctcattgcaacctctgcctcccagattcaagcaattctcctgcctcagcctccctagtaactgggattacaggcgcccaccaccatacttggctaatgttttatatttttagtagagacggggtttcaccatgttggccaggctggtctccgactcctgaatttaggtaatccacctgcctcggcctcccaaagtgctgggattacaggcatgagccacagtgcctggcctgtctaatgcttttgttttgttttgagacggagtctcactccattgcccaggctggagtgcaatggtgcgatcttgcctcaccgcaacctctgccttccgggttcaagcgattctcctgcctcagcctcccgagtagctgggattacaggcatgcaccaccatgcccggctaatt

SEQ ID NO: 6572 - DNA, 1069 bp, Homo sapiens
tttgggaggccaaggcgggaaggcgggaggatgacttgagcccaggagttcaagactagcctggataacatagcaaaacctcatctctattttatatgtatagatatatatttaatctacttaatatgtaaaaatcatacaatatgtttatgtataaatatatataaattttagaatattttgtctgttttttcaagatagcctactggaattttaacaacgatgatgttgaatatattaatttttttttctttttttgagttggagtctctctcttgttgctcaggctagagtacaatggcatgatcttggctcactgcaacctccgcctcccgggttcaggcggttctcctgcctcagcctcccgagtagctgggattacaggcatgcaccaccgtgcctggctaattttgtatttttagtagagacggagtttctccatgtttgtcaggctggtctcgaactcccgacctcaggtgatccacccgcctcggcctcccaaagtgctgggattacaggcgtgagccaccgcaccgggccgaatatatcaatttaatggggatggatgtcctaataatattgagttttccagtatgccataaggagtgattacttttttcttttcttttcttttcttttttttttttttgagatggagtcttgcactgttgttcaggctggagtgcagtggcatgatctcagctcattgcaacctccgccttccaggttcaagtgattctcctgcctcagcttcccgagtagctgggattacaggcgcatgccaccacccccggctaattttttgtatttttagtagagacggggtttcactgtgttagccaggctggtctcaaactcctgaactcgtgatgcacctgcctcggcctccgaaagtgctgggattacaggcgtgagccactcttcctggtcggagtggttactttttaaaagtcatcaaattcttaagataaaggactgaaattacagtgtagttttaggtcactgtcagaaaaacctagtctaacctttcgtatcagatcagattcccccagcagtattatactattct

SEQ ID NO: 6573 - DNA, 1052 bp, Homo sapiens
aagcttattccaagccatctccacacagagtttgtggctaatgagtacttccgtagctttaaaaatcatagttattttcacaatataaaaaacagtaagactgttagtgctggtagaagagtcgtagaaattatatctcatggtgctcttaggcaagattttatgagaccttctgaaatgtaatggttatctaagttggagactatatattaatactgcatctttttgttttgttttgtgttttttttgcgacagactctcacctcactctgtcgcccaggctggagtgcagtgcgcgacgttggcgcactgcaacctctgcttcctgggttcaagcttttctcatgcctcagcctcctgagtgtgctaggattacaggcgtgcgccaccatgcccagctaatctttgtgtatttagtagaggcggggtttcgccatattggccaggctggtgttgaactcctagcctcaagtaatctgcccacctcggcctcccaaagtgctgggattacaggtgtgagccaccgtgcccggccgatactgtatctttatgattctgtttgcatgtctggcatgttacaagaagtattggtttgggatttgtggattaagggtgtttcatatattcccctatttaatgttgcttcagttgcttcactgttgatactgaaaatccttaaggatctggctggtcttttgcattcaggtattggttttgctctatttggtttaaactgatattgccccaaaaggcagtgtagctttttagtacacactcctctttaataatgtcagtgacctttagagctgtcagtttgaaataatgtaactttgcaaagtgttttatatcattggttttccctggagggcatagtgagactacaaacgtgatgataatggtggccttctagcattgagaaaatatattttaaggccatcttgtttaggttatctatattccttgttttttgttttgttttgttttgttttgggaagagtctcactctgtcatccaggctggagtgcagtagtgcagtcttggctcactgcaac

SEQ ID NO: 6574 - DNA, 1033 bp, Homo sapiens
tcctcctctgttgatttctccatactacagtggtacatttattatagttgatgaacctacgatgacacgtcattatcatccaaagtccataatttatattaggtttcactattggtgttgtatattctatgggttttgacacgtgttgaccattgtagtgatgtacagaatagtttaactgcttaaaaatcctctgtgctctgcctgtttatccctcctcttgcctaactctggcaaccactggtctttctactgtctccatagttttgtcttttccagaattttccatagttggaatcctatagtatgtagccttttcagcttggcttctttcacttagtaatacacttctttaatgcgtattactccatgtctctttatggcttgatagttcatttctttttagcagtgtctagatgtatcgtttatccattcacttactaccaggcatcttagttgcttcaagttttgacagttataaataaagccactataaaatttgtgttcaggtttttcttttgttgttgttgttgagacagaatctcatgttgttgttcaggctggagtgcagtggcacgatcttggctcgctgcaaccctcacctcctgggttcaagcaattctgcctcagcctcctgagtagctgggattacaggcgcgtgccaccacccccagctaatttttgtatttttagtagagatggggtttcaccatgttggtcacactggtcttgaactccaacctcaggtgatctgcctgcctcggcctcccaaagtgctgggattacaggcatgagccactgccccagcctgtgtgcaggtttttatgtggacatgttttcattttatttgagtaattaccaagaagtgcaattgctgtatcatatgataagagtatgtttaattttgtaagaaactaacagtcttccaaagtggttgtacaatttcgcatttctgagagttctgttgccccatgttttcaccagcatttggtgttgtccgtgttctggattttggccatctgatagttgcatg

SEQ ID NO: 6575 - DNA, 1028 bp, Homo sapiens
tcacaaggtcaggagttctagaccagcctggccaatatggcgaaacccggtctctactaaaaatacaaaaactaactgggcatggtggtgggcatctgtagtcccagctactcgggaggctgaggcaggagaattgcttgaaccctggaggtggaggttgcagtaagccaagatcgcgccactacactccagcctgggtgacagagcaagactctgtttcaaaaaaaaaaaaaaaagaaattgtccaaggttatagagcttttaaaagagaatcagatatttgaacccaggtgacctggcttcgtaattcatattcttaaccactacatctcttacttcctagagttgtagtactccttctattacactacaacagtgaatgtaaaattcagttggatacataaaatgtgcattcatgttgaaaatgaaggaaaaataaagtgaaagatactgggaatcatttgggaggaaagataacagctggaagggacttttgaactatggccttgaagaccacgtaggatcaagactattgatatttgagagaattttatttatttattttttgtaatggagtctcgctctgtcacccaggctggagtgcggtggcatgatctcagctcactgcaacctccgcctcctgggtccacaccattctcctgtgtcagcctcccgagcagctgggactacaggcacatgccaccacgcccagctaaaatttgcatttttagtagaggtgggatttcaccatgtctcaatttcttgaccacgtgatccgaccaccttggcctcccaaagtgctgggattataggcatgagccaccgcatccggcctgagagtacattttagaaggagcaaggtgaagagagggatcaagacaaagaaaatcaaggcctacttgagaagcagattgttattgaaaggcattgaaaaggagtgttgaaaaggttcacttttggaagaatttgaaagccagactaagcagtttgaattttattatgcaggcagtagctaatcattgaacctt

SEQ ID NO: 6576 - DNA, 1025 bp, Homo sapiens
attgtcagtggaaagctatcaaatgtttttaaaacctagaaaggatgatgtttagcagcagcatgaagggtggattctggtggtagagatggtggtgtgggagaatactaagataaattaaaaattaagagatgttattaataggtggtgtgatgaaatgaaaagagcctgggctttagaatcacaggaatggttttaaatctagatattggcctttgcagtttggaacgaattagctgctttgattttcagggttgtttgttttgttttgttttacacattctgggtagtaatagtgcttgttttacagtattcctttgaatattttgttatgggcatgaagcacctgctatagtgcttgcctgataccaaataagggtgcagttaatgataactgtcattattatcaacatgagtgacatttattataattgttaagataagagatagtgaaaacctgaatttagggatggaaaagagagaacagattgggaggaatctttctgaagtaaaatgaataggactcaatgaccggaatacttggtgatttatggaaagaatagaattgtgactaaccgaggtctctatttaacctgaataacttggggggaaggtgttcgtgatgccattttcttagtaatgaatacagaatatagacgaaatctatgattgagatgaaggaaaggagtaaaatgattttgatttggtgggcatttttaggtatttaggagattttggtgataatatgaagtaggaaattagaaatttggtcttagggcaagagataaaggattggagagttataagtatctgcatagtagtgggaaagcatgttaattttgattccttgactagaattataaatatcttaacggcagggcatatttttaaacataacccctgtatccccacactgctgagctctatgtaaacacttgattaattcttattaaatgtgagatttaaaaaataatattcttgatggctttgtgaatagaaaaggtaatgcatagttattttgattt

SEQ ID NO: 6577 - DNA, 1081 bp, Homo sapiens
gtaaaagagaaagcctatatcatgtgaattgtcagatttacagtatttctttagttgtgttagacttaaagtgtttatattggaactctttgcagtcacttggagcatcttgtccgagaaggactagagtctggaaattaagtattttttttgttttgttttttggaaatgtattatatccgttggactgaggcttgcattttaaggctggcttaagattctaaaatagaaagaactatctggagaatatggtaatagccaataggtggcagcatagagcatggtactggatcttgagtttgagattggcatggtgagataatctaggtagtatttggaaaagcacttagaaatattgacctgatatttgggaagcagcagctatgcatacttttagctagttggattttcagtaaatactaactctgtagaatggataaagcaaatacattatttatatttacctttaaaaacacgtaggtgaaaaatacgaagtagcctctttgggaagtagaacagggattcacctagagattagtaaaaatttttgaactgcacttcaggatcgcgcagaagttagagaatgtaattgtaagggaaaggcaactaacatgttctgagcatctactatgtgccagttatttttacatgttcccttttttttttttttttttttttgagacagggtcttgctctgttgcccaggctggggtgcagtggtgtcatcttggctcactgcagcctctacctcctgggttcaagcgattctcatgccttagcctcctgagtagctggaactacaggcgtgcaccaacacgcccagctaagttttgtatttttagtagagacagggttttaccgtgttggccaggctggtcttgaacccctgacctcaagtgatccactcgcctcagcctcccagagtgctgggattacagcgtgagccaccacgccctgccactcctatttaatcttcaaaacaatcctataaagttgattaaaggcatcctagttttataaataaagaaaaggaaagggtcagagatgttcagttatgggcaaaattacatagctgggattt

SEQ ID NO: 6578 - DNA, 1947 bp, Homo sapiens
gcccagctaatttttttgtatttttagtagaggcggggtttcaccatgttggtcaggatggtctcaaactcctgacttcaggcaatccacccgcctcggcctcccaaagtgtgataacaggtgtgagccactgcacccggccttctttaacctttctttaagcttcaaatttttaaattaattttagccttataaagcaattgcaaaaattgtaaaaggaattcccgtatattctttaaccagattctccaaatgttagcatgttatgtaaccacagtacaattataagttcaggaaattaacaatgatacaatagtataatctgcaaacctttgcgaatttgccagttatcccactagtgtcctttatctggtccaagatccagtccaggattacagtctgactgatgttgtatcattcttcgtgcatcatgtcagaaagcacgtggtgatgtttactttgatcacttagttaaggtgctgtctgcctcttttctgtaagatcttcctttcttcctttcttccttccttccttccttccttccttccttccttcctttccttctttttcctttttgtagttaatggctacattgttgggggaggtactttgaggttttgtaaatatcttcttttttttaattatactagtttttcatgcactaattttagcatccattgatgaacattgcctgaaaaaaaattactgtggtgttgaccaaatgattttctatttccataatttcttctacatttatgagttggaattctactgtaaggaagaacttctcttttctccctatgttgttgttttaatatatcagtacgaattcatggattcttatttcattctgtggattataattcattacagtccttgtttacttagcagttcaaattatcctaggccatttagggccctttggagttggctgttgtgtcctttttgacatctttcttttttttaaagcactttttttttttcactttttggcattaaaagatgttccagtcttaacatgtactttccctgtcccggccctggatttctccaaaaaactctagttccttttaatcagagaactgtgtaagaattcaaggtgtcggtactaggtgtatgtactcttggtactagagtgtcattgctttgaaacatgtatgtttactaaaatacatgtgtagctatgttattttatatatcagtgaaaaaccatccactgagattttttgattacagatatgttgatagtatgaagagctaatccagtagtagtgagagggtcggggagagatgggaaggatgagaaattacttttagtagttaattcctaaaaacggactgcttcagtgatcagtctgttcttgtgtatggctgggatagagatggctgtttgtaaagtacagataacatggatgattcactaaggatgatgggagagtaggatgttataccaaaatataaaattagtttatgcacttaggtttaagactaaagtaagtttagtatttgattggcatattaggagagtgtttcaagaagttagaacttgaggttgggtgcagtggctcacacctgtaatcccagcactttggaaggcctcaggcaggcagatcacttggggccaggagtttgagaccagcctggccaacatggcaaaaccccatctctactgaaaatacaaaaattttagctgactgtggtggcccatgcctgtaattccagctacttgagaggcacgagaatcgtttgaacctaggagctggaggttgcagtgagccgagatcatgcctgggcgacacacacagactgtctggaaaaaaaaaaaaaagaagttagaacttgatctgtgtttttgaagaatatataagtctggatgagcagagatgaaagggcacatcctggttggaacagggcatttatttttggaagtaaccagtgatatggttg

SEQ ID NO: 6579 - DNA, 1054 bp, Homo sapiens
agacgtttggtatagattatttaggattaaaactgcttgatatgaatcagtgctcagtaagagattccatgaaatatcaaagagtttattttttgtctcccagttcgtagagttgtttgcaaaaaacacaggcaaggagaaatcattaattggtgactgctctgttcagttttatgtggtcagagtcaatgaatagactaatcatttggcaggtttattaaatgtgtggttctgtgtttggccagagaagataacagagaagtaaaagacctggtcccctcttggcttgtggaatattggggaaactatgagtggcaaaagcaattagacttgtaatctataaggagttttaaatcatccatgctgtgcatccagaaccagaattctcatatatgcagggaacattaaaagtaaaatcccatgctcattcccatatgtagtattttagagatagtagctaatacaagaaaatataagtactgtagcagtttgagaggtgcagtagatgacactggagttgcttaatctagaagttagaactcaaactgaactttaaaaggatctgtgtgtgttttagagtggttggtttggtaattgtttttaggatgtagtacagaaggatttacagcgagaaaattatgggagggtcttataataattcacaaaatgaaactgttctagagtcatggctgtgaagatgcataaggaagagatgtgcgtagagaatctggaataaagagttgtcgaagcttagtgattacgtaaatatataaataagggagaggaaagtgatactgacgttaggcttccatcccagatggcttggcatgaaattaaaagtcaattagaagtcaagaagagagaagggaaagttttggtgcagtggccagttttatgaggagagaatggagatagctcaaagcattttgaggtgagagtgaacatttaattggaagtgtccagtagacagggttgtgggaaatgagttgaaataaaaggtctggggtgaagatatattggagagggtttctgaaaacatgattggattatttga

SEQ ID NO: 6580 - DNA, 1029 bp, Homo sapiens
tagtgggtgtgtgtagtggtatctcattttggttttaatttttatttccctgatactggtgaggttgagcatcctgtccatctatatattttatgtgatgtgtttgtttgaatcttttaccaattttagaaaacattattataagttataataattctttatatattttgtataaaccctttggtcaggtatgttatacaaatattttctctgaggcttgtctttttctttgcgtcatttgaaaagcagttttttttttatctcaatgaagtttatcaatctttttctcttaaaatttatgttttttaatgtcctgttcaaaaaaatctttgcctataccaaatgcaaaagaaaatctcatgttttcttctaaaagtttagtagtaactgttatattttgatctctgatccatttctatttaatttttctatatggtgtgaggtaggagttgaggttttatattccaaaagaaaatccatttgttctagcaccatttgttgaaaagactgtcttttgccacattgaattaccttgacatctttgtttggtcatttgaccatatacatgttggtatatttctggaccctacagacatacctgagagataatgtggattgggttccagaccatcataataaagcgaatgtcacaataaagcaagtcacattatttttttggtttcccagtgcatataaaagttatgtttatattgtagtctgttaagtgtgcaatagcattatatataaagaaacaatgtatataacctaagaaatgctttgttgttgaaaattgctaacaattatgtgagccttcagtaaattggaatctttttgctggtgaaaggtcttgtcttgatgttgactgctgccaactgatcaagttggtggttgctgaaagttggggtggctgtggcaatttcttgaaagaagacaacaatgaagtttgctgcatggattaacttcttttcaggaaagatttctctgtagcatgtgaggctgtttgcattttacccgtagtagaacttcttt

SEQ ID NO: 6581 - DNA, 1771 bp, Homo sapiens
attcagtaaaccataatataaacacatgtgttgtcatccaggctttgttgttctgtttatagagtacaggcaatgtagagttagcataattcttaagggccctcgaatttggggaatcgtaaatgagcactggcttcaactttggtcaccactgcattagactctaacaatctcatcaacctgttcttgaagctttgaagccaggcattgacttgtcctctctcactatgaaagtccttgctgacatcttccagtatgaggcctttttgtctacattgaaaatctgttgttttgtgtagccaccttcatcagtgatcttagagtgatcttctgtataacttggtgcagcttctgtatcagcacttgccacttcaccttgcacttttgttgttacagagatgacttcttttccttaaacctcataagccaacctcggctagcttccagcttttcttctgcagcttcctcacctctcagccttcatagaattgaagagagttagagccttgctctggattaggctttggcttaagagaatgttgtggctggtttgatcttctatccagaccactcagactttctccatataagcaataaagctgttttactttgtcatttttgtgttcactggagtagcacatctaattttccttaagaactttttcctttacatccacaagttggctaactgacattagagacctatgttttgacctgtcagctttcagcatgccttcctcactaagctcaatcatttaaatcaaaagctcaagcttttgatttaaagtgagagacatgcaactcttcctttcacttgaacactagaggtcattgtaaagtatattaactggcctaatttctatattgtgtctcagggaataggaggtcgaaggagagggagaaagacaagggaacaggtgttcagtggatcagaacacacctaacatttatcaatttagttcaccatcttatacaggtgcagtgtgtgggacctcaaaataattcactacagtaacataaaaaatcactaattaggaatcaccactgtgaatagtaaccattaaaaagattgaaatattgcaaatattacaaaaatgtgacaccaagtggtgtcaccatatgctcttgggaaaatggcaccactagacttggtcgacacagggttgccccaaacctttaatttgtgaaagacacggtatctgccaagtgcaataaagtgaggtgtgcctgtgttgtatgccattgatctatatgtctgtccttacaccagtaccacagtgtctttattatatctttaaatgtagaaatctagtagtatgagtcttccagttttttagtttttcaaacttgttttgctaatctaggtctttgatctttctttataaagtttataaagattataatcaccttaccaattcttgaaaaaacctttgaggattttgattaggattgtattgaaacttcgattaatttggaaagaattgccacgtcagtagtggtatttcagtttacatagtttatctcacctgtattagtttttactttctctcagcagtgtttttatactgtcatttcccttcaacccgaataacttcctaaagcatttctagtggctttgagagagagctactttaaattgtggagaaaagcgtagagtaaactgctgtgctttgaatgggtcctctccaaaattcaggtgttgccaatgtgatagtattaagaggtggggccttttaagaggtgattaggccataaggactccttcctcctt

SEQ ID NO: 6582 - DNA, 1125 bp, Homo sapiens
acactgcaagtgggaatacaaattggtataacttttccttagaaaaaagtttgtgaatatgtttcaagaaaggaagaaattgtttattttggttgatggtttctcttatagtaatctatcccaaggaaataatgagaatgtggaacaaattcattaaaatgcacagttatagtaacaaaataaaaaactggtctaattgcaaattatggtacatttattaagataagtgtttttgaagaatatgtaacaatgtaagaaagaaaatcctaatattaattgaggataagtaaaatgatcttcagtgtgagtctcatttaatttttttaagttaatatgtctgcgtatgtgttttttaggggaatatatcaaatgattggcagttcatagctaagattgttgagaatactagttgtttttactttctctttatagctttgtgtacaaggtagcttttttcaggatcttccagagaatgagaagaacaagcattatttataaaagcataaaccttgtaggatttctgtgcaatatatttgctttaagaaaaatgaaactatagatgattgtggcttataaatttttattgataaatggtgaaacctttatttatatagaggaataaaagacaaaagaacacaagtccctggttaagttaatataaagttagtagcttaaatggaattggtttcaatttacagatggaaagactctttttgagatggagtctcgctctgttgcccaggctggagtggagtggcacgatctgggctcactcaacctccgtctcctgggtccaagcaattctcctgcctcagcctcctgagtagctgggattacaggtgcatgccaccacgcctgcctaatttttgtatttttagtagagatgggatttcaccgtgttgatcaggctggttttgaactcctgacctcgtgatacacccgcctcagtttcccaaagtgctaggattacaggcatgagtcaccgtgcctggccgaaagactcttaatagattaaaacacaaataaaaagatacacttggatttttcaatattgatttctcttatgtagttcatgaaataattcactttgaaaatacttctgactcaacaatttacagctgtcta

SEQ ID NO: 6583 - DNA, 1040 bp, Homo sapiens
gttaacatgagagtatttcctaagtgaagggttttgggatttctgtatcaggtaagtgattcttgcccataagatattctagttgttatccctttatttaatttcataatattcaattattatatgggggaagatgtttagaattattttaataaaaattttatttttaaaaatagacaactcaaaagcttagaaaacataagtcaaaggggagatactatttttaagataactgcattttaagaaaaataaaatgaaattttatgtttacttgaaagctgtcttttttagtacattgtcccactttaaaagtaaataaatctttatttacagacagtccctgggtctccgaccccaatattcccctagtggcccgtgagatcatgcagcgaatgatccaacaatttgctgctgaatatacctcaaaaaatagctctactcaggaccccagccagcccaatagcacaaagaaccaaagcctgccgaaagcatctccagtcaccacctctcccacggctgcaactactcagaaccctgtgctcagcaaacttctcatggctgaccaagactcacctctggaccttactgtcagaaagtctcagtcagaacctagcgaacaaggtatggtttgatgtcaaggtctcctctatcttatcagaatactttactttggggagaaaaaaaaaagcattggcaagtagagcatcagcagcaataatagcataaaaactaatgtgattcttaaattatttcttactatgcagtgatggagaagtacagctaaagttgttacagccttatctgtcagcagttcatagtcatgattgatgtaccactcaggaaagtcaggtggttaacagttgtcactaatctttcagttacttgatatttatataagcattttatattttccatagtatttttatgttttttaaaactcctatgaaaaagtaagttttcttattaactaaaaattttctaggactagcacctgtctgagaaatatgcctctacttgcaggtataagttatatactctgc

SEQ ID NO: 6584 - DNA, 1031 bp, Homo sapiens
tttcattaaagatctcctcactctaaatattgcatcagaagtttcaggtttatattaggagaatgacaacatagaataatatttaaagtattaatggaggttaacataaaatgataccacttaatctaatttaacttgttataactaatgttacacttaagagatcaatacattgtattgacagcatgctcttaaaaagaggaatttgaactacatgatagcattatagtgtgtagacttcaaatgaagtaaaaaaattttaaattatatttccttaatgaatgtgttttcagccaaaaaccacaatatttttagtggtagatttaaaatatgttgcctgtttgattagacaaattgtctatttgacttgcgtttaaataatagtgtctttggttggaaaagttgtaagcagtagtacatttgcttcttagatgtataattgggttagatgtctaataggataattggttctataagcttataattatatttttagaagtactagtgactgtaaaggacaaaactctttcttatgagtgtggggtttttttatttacaaactctgttgcctgtttatttctaacagccggaaataaaatgtcctcagatacaagttgtaagtagcttctactctggggtgatttttaacacaactagatagcacgacccctctactggccaactgaaaattaaagacattgtgtattatcttgttctgttaattttggacagagtggtagctttaaaagacttcttttccaggtatttcaacaaggagaaaaacgtctttgagggaaaagaaagtcttctaattttatatattaataacatgaatttgtgatttggtctagttgtagtaaaaaatggttgtacttccaggctctcatcagtatcaagacagtttcattcttctttctttaaactttcttcaccaatttttattgtcttcttaattgaaaaattcttgcattcataaaattcagcaattgaattttgaatctctgcaaaatttttttaaaggattgaatata

SEQ ID NO: 6585 - DNA, 1050 bp, Homo sapiens
agtgagatactggaggaagcaatctcagtggttatgagtggaaaaatgagtgtttccaaagctcagagtatttatgggattccccacagtacactggagtacaaagtaaaggagaggctgggcactttgaaaaaccctccaaagaaaaagatgaaattaatgaggtcggaggggccagatgtttctgtaaagattgaattagatccccagggagaggcagcacaaagtgcaaatgaatcaaaaaacgagtaggaatactgtagagtgccaattactgtacaaactgggtgagcactactgcatcattgttcagctatcattgcttgcacgtaatttcatttactgtgacacttgcttctttgcagattttgcattgacttgtgtgtacagagatgaaatgtgcattctgaatgttgcatattttaaatttttcatgtgcagtatggctcggaatatgtttggccttttgcatgtttctctacaaaagagaattgagttacctcacagagaacagatacatggaagtggactccttgcctgtagagcctgcatgcttttttgtttttttttgttgttgttgttttttcttaagttatatttgtttttactttttaaaaaagaagaggaaacaaagcccccttttagaaactacgtctgtcatactgggagctttatcactgcaaattggaaagccatcttatacaaaattattcacatttttcatctacgattcaactaatcgaaggattaaactaaagaaaaaactaagaagaacaatgaacctttgactttgagaaatttggttattcactgacataattattgggtcatttatagttacattttataattttcttctcactattaaatttatttaaattagcaagctattagtgctcacccagaggggaaggtggtggaaaatgtgcacacactaccttcagaaatgcttcagttaattactttgaacactacctttgctgtaatttcatttgagattttctaagggtagaatttggtctcaccaacaagtgaggatatagccttatc

SEQ ID NO: 6586 - DNA, 1032 bp, Homo sapiens
tttttgcaagaataagcaaagcccatggaatttaatttttcattgtgatcagattaaaattactatttgtgcaaaacaaattccacaccacatgtactgtatattctaatctgctgagaaaggtggtcaggcccttctaaatgcttaaccaaaaacaaacattattggagtttcagtgtaaaataaaattaaaattggagggttggttagattgatttcagatggatactaacagtttgaggggaggtccagatatttccaaggcataaattcttgcctggaaactttggagcaattaattaaattaggttaagttttccctcagcaacctgtgtgttcaaaggttaggcacaccattgctgttactaaaatacatgcactgctcattcttgacatagcttgggtgtgggttcctcttgttttggttattttgtgtagcagtttaatcagtggataactgagcctgtttcctcttagctttctagacttcttaacagaaaaaacagtttgggttcaatagcattttatgattctacaatattttgtcacctagctggaagttgcaataaaaattccttatgaaatatatggttttcatctgtaattgaaggaaatcatagaaagtttgctgaaagcaaagggctaagcttatgaaggaatgcctcctttgttacacactcaagaatttgtcagcacacaattaattgcagccatagtacctttttgcgtaatgtttgggatattcagtagcccaggattgctacaaaaaggtcctttgagaaaattaatttgtgcttgcttttatcccctctcagaaagacatcactaaaggcccattaaaaatctggccctaaaagttcaacttttgtagagtttattgttcagagaggtttaatcctatgtggtagtctatataagtgatgtatgagttgagttatgtaaattttgtcattgtagtgtacatggagtgatcattttactaacataaatattttctatgtgtgtttcagtggatgacaatcgagcagcaga

SEQ ID NO: 6587 - DNA, 1086 bp, Homo sapiens
gtagatattctagtttggggatgtcctcacaatgtgtaatagagattggtctattagcatgcttaatttctgctaatcagagttttgcatggcccaaacaacagttgaccatttttatggtatgggaaagtgtagttcacaactgtctttgtcacgaaagccgtttttcctcacattttccagtaggcagataacattacttaaattattaatatataacactcttggaactattgataggaaataatgtatttaaaataattttttgcattttcagagaccttgatgttatagggtagataagctatggcactataaaatcaaaaacactaattctgtggaaggatatctagttggtatttttatctttagctttctcatttctgagacagcatagtcatccagcttgatggtaatgtagtatattactttgttcagtgggcttataagtgactctgaattatgtttgtgatgagctatacactttttttctgttccccaaataccatgaaggacaaggtcactctttcaggaaaaataatttatatttgtgtataatactttttaatattaagtttgttgttctgaagtttagatgttgcttgataaacctttgctgcagcagatcatgaatatgagtaaggctttgtgtgataataggggtccttatgtgaagttaattactgttcagttctggtgagcaagctcaacaagtgtgaagtgtgtattagctttatttggtacacttttactttacaatatcgaagtgcttttagaactctggttatcttatataaaccattacctcaaccaattggcatttcttttccccaacatttaccttagctataatatgagctatgtgggatcagatggtaaaactataaaaggcacaatgagaagtttagttcccaagttttggagagaactctaaattagactaaaaacaactacctgttaacaccaatatcataactaccttctgtcgttaggcagtacatagcaacctttgagctgctagtgagctatctgttctccccctacccccaagtaagcacacagtgccaggcctggttctaagccttt

SEQ ID NO: 6588 - DNA, 1024 bp, Homo sapiens
tgtggaggaggctgtgaatgaggtagacaacgaaaacacccagcagaaagatgatgagagtgatgccccatgcagctctcttgggttgtcgagtagtggaagtggtgatgctgctagggcaccaaaatcggtgccaaggcctaaaagattgacctcttcaacctacaacctaagacacgctcattctctgggctccttggatgcttcaaaagtgacttcagaaaaggaagctgcacaagtaaaccccataatgccaaaggaaaatggagcttcagagagtggagaccccctagatgaggacgatgttgacaccgtggtagatgaacagccaaagtttatggaatggtgtgctgaggaggagaaccaagagctcatcgccaacttcaatgcccagtacatgaaagttcagaagggctggatccagttggagaaagaaggacagccaacaccaagagcaaggaacaaatcagataaactgaaagagatttggaaaagcaagaaaaggtcacggaaatgtaggagttcattggagagtcagaagtgttctcctgttcagatgctctttatgacaaactttaaattatctaatgtttgtaaatggttcttagagacaactgaaacccggtctctagtcattgtgaagaagctcaatactcgccttccaggagacgttccccctgtcaagcatcctcttcagaaatacgctccttccagcctatatcccagttcactacaggctgagcgcttgaaaaagcacttgaagaaatttcctggagctacccctgctaagaataattggaaaatgcagaagctctgggccaaatttcgagagaatcctgatcaagtggagccagaagatggcagtgatgtcagccccggccctaattctgaagacagcatagaggaagtcaaggaagatagaaacagtcatcctccagcaaacctgcccactccagccagtacccggattcttagaaaatattccaatattcgaggaaagctcagagcccagcaacgtttaatc

SEQ ID NO: 6589 - DNA, 1443 bp, Homo sapiens
tcctttgctccatccttcagaggggcagttgtgtagttatgctgccgggtgagcacagacacacatactttctcccctagctgggaccatcccacacggggtgctcaatatgcatgcctcatgaaagcatagactgtccatttaaaaaaaaatcaggtactcatggtattacaatatgccaggggttggacaaatggattttttacccttttttaaagggttatgtaaaaaaaaaaaaaaaaaaaaaaagcaactatatgtggcccgcatagcctgaaatatttacttcctgacccttttgtggaaaagctctactgatccttatagtagtcattaaagatcaaattgtgtagacaggcacaacttttttttttcatatgctccaacatttttttcatacagtccagcaattcttttagattttagagtgtcttgcctgttcatctcagtacacagctgctgttacagattattcctgaataatgcttttgcgttaagaaaaattatccccctttgccagttgtctacttgttaataagttgtgggccatgtgatcatatctattagggtatgtagtgaaaactaaaagtgcagtctttaaaagtacagtcttcatttttatgaatcagagtgaacttgactgtggtagacattccattaacagcagttcagcacaaacaaattactcatgaacttaaagccaagaatagtgcctctccctgaaagtatgcgatgtgttggttttacccctagaacccttcatttctcttttgtatcatatacttgaaggtttctcactcttcaagctctggtcgtgatatgagaacatagatgcctggtgtttgcctgtttgactttcgagtgcagaccacacattctcttaaaaataccagcatgtctgtggcatcttgtcaggacaccggcagctttagacagaacaagttcagggctctccagcccagcccgagtcactgctcgttctgaggagccatccttggcaccttgccctccctcctcctgcctctgcttatgccgccagcccccttccaggaggcatattctctgggacagtcccccacttccccagtgtggccctgaacacaaatttgtcacattggaagcatttttctctcaaaactcttttcctctagtatttagttgttgggtttaaatgctattcaatttatccacttttttttaaaccccagttttctgtgatctgcacctcatagttgtcttgtagctaaagctgaggtatttgggagctaatttttgggaaagagactataccaacaagatttgcataattttttatatttataccacaggtagggattatttttagagtcactatagcttaaggttattgatttcactagtgtggtttctgcattctaaatagttctcggagactgtgttagtaactggtttcaaatacatata

SEQ ID NO: 6590 - DNA, 1306 bp, Homo sapiens
tttctcccagcgtgtccagttcagcagatttctaaagctgttaagcagcctctctttttgaccgtcctaaactttgtgaaaataaataccccacacccagataaccattaatagaagtaatgtagttttttaggcttttggaatatgtcttctcttttgtatttatgatggtgtttggaatttttcactagtgtatttttagactgaagtgggtgcattaggataaaactttcccttgctgagcctgaaggcaagcaagagggaagaaattgacctgtattgtatcattggggaggcgactacttcttgtggtggtagggggtggggggaatggggcattgtagattatgtgggggtacaatagaattctggcctgaggctccccaagtcttattaccttgtatgaaaaatccccatattagcctcacttaatctcaatagaagcctgctgtttaccctcagggaacaagtagttttcaaaattgagctcctccaaggtcattggccaatgctgtgtgcaggcattggtcatctttgtaaactcatggcattatttcctcatatgcattatgatactaagaaattcaaccccaacctgtatgaaaagcacagcccagggccctaattgaggctagcatgaatgcctttgaggggccagggggccataggaggcccatgcaatttaactgaagctcaggtgccacgttggatttttattcttattaggccgcaacctttctgaatgagtttagggcaggggctgctgatccggctgtggattcagggagctctaaaatgaatctctaccgttcctttaaaggtctttctggttcctcccagtgttgtcattgctgaggtcgatctcgtagttgttcagttgtgctctttttgctgtcttgtgagtcttagccagtgatccagctgcccaaggacagggcctccagagggcctagcgccctcctggtaccaagcgtgtgctcctggcctgtgtgacagtgtctttcccgaagcagtgaaatgagaaattctgcaagtggccacccggaagatcagtctgtagctcttgggcctggatttctactatgttagtgagtgtaggaatatactgtgtctttaatggatgaaaattcaatgtatgctgtgaatttgttggtttgaaacattgaaatttttcattagacaatgtttacatacctcacctgaagaacctttgagagtgtatatataaaattttaaaatatattaagttgctttaaaacaatatgtatagctataaaagttggagttattttaactttgaatatgt

SEQ ID NO: 6591 - DNA, 1109 bp, Homo sapiens
gccactcaggaaggtacccgaggacttctcggtgagaaccagctccgcctcttcttccatgggcgtctccggggcttcgcttttgcccaagcgcaaggaccctgactgcagctcattatgtaacttcacagcatcgactgtcaggtcactccttcctgagagccagaggcacaagataaggtccaagcctccttttggtcaagagaacagaacaacccctgggaaacaaaccagcccaggccaaatctccaacccgagaggctgaattctgaacacagccagtctcataaaaccactgtatgcctaaaaacttgaaaaaccaaggagaaagggaatcctccatgtaaaagtttctgcttccctgtagcagcggcataaacgccactgggaatcggctgggagctacattcagagggcctgcaaaataaatgaaggtgaacgcgctctgtaaagagctacccaaggtccaagccatctgtctcaactctgacacccgcggtaccttacacaagacatttccctactgcggacctcagtttctgtatctgctaaattggaaggactgcccttcagagagggctccagatccgacatcctaagagacgaaaggtccaatgcctggccccgcactctcccagaggccccagactcatctggacccaggtctgcctggaaccccgcccccggctgcgctcgggtctcaacccagctacctgacggccggctgaagaagcggctgcgggcggcctgacggtggcggcagatggcggggttgctgtcgctgctgtggcctttcttccagcgcttcaacttagctgagacaccagaaggcaactttcccgagcgacccatgttgactaagccgtggcgaggaatgagcttaaatgaccggcttccagggacgtagaaacacgctcagaacccacgtggataccctgtagccttcacttcctcttcttctggcgtcacttccggattcgtgtgcattactatggtaaaacagtcaacatccggttttacacctcctcctggcttcggatggggaggagctccaaggagatccgttgctagggaggaagttaggttgctaagggttctatggggttctt

SEQ ID NO: 6592 - DNA, 1037 bp, Homo sapiens
ggtaatttttttttctggtgaaagtctttaatctgcagaactgatgaaactgtcatcgaaggaatctgttagcgcatctgtgtcttctgttctggtcattgcccaggcagccgatctcttcccatggctgttgcatgaggtagaaactgcatagaggagatggaggcactggcagaggtgccatagaagcagtgaactgggaagtctggttgggtatcttggggctaaggcagcagctgcagagaaggttcttaaatgtctaattagactggggcagtggagtccatcagagaggtcaggacccgaggccttcatgaatcaacatggaggtcccctcccattgactccttcctgtgttctgctcagaatacctggagttgtcttggctaccatttccttggggtggggctgggaatggaattggagacaaagcattttctgtcatgcaaggggtagctggctgtcctgacaggagacagggaatctcctgctaccaggttgagttggctagcctgtgacatcagcccagagggagtaggaagaagagtatcttttgccaagacttaaatagcaccaggaaatacctcggtacaggatccacattctgtgtactcattcttccattggctgttctttggtgaggaataatcatctgaaggtaggttgatgcactagggcagtcaggaagccctggcaatctctgctacagtggccatgcccagagacacagtggacagctttgtccatgttggccacactccacccaaaagtctgtctacacagacaactcctaagactgctttgatttggagtggcctttctcacccctttcctgtggcctgttgctttaggtgtgcatcaccttggatttgctatgcaaccatgtggtgtaatttaagtacaatttctgcaggctcagaaccatcagttttactcccttaatctggttggaacattggcactggtcagtccgtagaaaagtgaagtaaccttcctacttctcacagttggtgactggcctagctgggtcttagtct

SEQ ID NO: 6593 - DNA, 1049 bp, Homo sapiens
ctcggccgtctgggagtctataaaagatggggtgcggggtgagagtcacccttgggattgttgggatccttcccagctttgggagtgagatcgctcgctggtgatcctccaggcccgcgcaacgctttctcactttcatggtacaccccgcctgccctggcatttcgccccgggaagaggtctgtcggtcatttttctgggtcttacactcacttccttctttgagggtgttgcaaggacccgctgggaataatatcgtagacttgagagctcaaacttgtctggattccagatggacccatctcctactctgtgtcaaagcccagatcctgagaggttgaacaccttgtccaaagtcacacagctagttaggagctcacctggggctagaactcagcctcctctcccaccccattgccacatatccccttatgtaagaggagccacaggcagagttgttaatgaagtggaaactctagttggagtttcctgtctcccttgacaccgaaggtgtgttgcttgggttgcggaaactgggaaggaagatgggggaaccaggggaagcagggaaggatgtctgcatggtggacaggatgacttgtggaggcagaaatgtgtttttatgggaaggatgcagtaaaacttattgaaattctcttgtctgaaggtaactctggccattcttctggctgaggagagatgactctcaaaaccaagggctggcttgctttcattcattcatttgttcaacaaatatgtgttcaggccccataattgattttgcagcattttttgctgttgacaactctctcctacgagacattcccccccttcctttcttggcatcagactgtcttggttttcctttctgaacacccctttccaccatcaccttctagcttgggggcacgctggtgcttaagtttgacattctgttttttctctcattacactctctcccagagaaatcttgttcagtcccacaactctttgtccattgggaatacccctatgcttaaacttcagctcttctctcttgaaccccagaa

SEQ ID NO: 6594 - DNA, 1050 bp, Homo sapiens
ctttttctaaatcaagctgggagggccaccctcaggcaggcaggagcagcagcctccagactaaccagatcctggagctctgtgttctgggtccctgatctccctgaagccccagctacggagtttggtccagatttcccccagcagcagctgggcagcagtgtgtgcctggccccctttggagtgggtcacacacccacctggccaggctctggcatggaggctggcactagaatgggcttcagggatagcatgcacctgttttgtgctgctgttgtcaagtagctggccttgggcttcttggaactacagatgtttgcgtcattggactgattgtcctttgactttttctttgccatactgactttctgtggccatatggttagctttggatacagagaggtgtgaggtggtcccacagtgcctgccacaacatcaagtttctatagatgggagcccttccgtaaacctcagaaggtggcaagagcatgtctgacagtgattggaattgagctctgcaagacatagacaagatcacctcttcaactccagagtgttgtggcagggcaccagagctggaaaagcctgaaaggtcatgtccagctgcccacgcaatgtggggtcgttccacttagcacccttgccaggcattcagccagactttctttgggcgaggctagcttttgaacgcactgaatgcgttggcctgtctctctgtagagtgagtgcctgtgccctgtctcattgcccacaccatggccttgtgagagcagctccctccgatcagtgtgaacttggctgagcccaagtgtgcttcctttgtgtctctcactcactggttctgcctgagaagtttgtttcctttaggtaaagttttcctgttatagctcttggggtttgaattgggtgacttgtcttacagagtggtgaagatcggagacagggtgtgtaacttgcccaggtcatctcaaatttgtggccaggcaggaaacacaaccccagagatgcttgatcttgtcattttgctgctcagacacattctgcctcctt

SEQ ID NO: 6595 - DNA, 1083 bp, Homo sapiens
cagtacataggccacagagaaggacagaccataggtatgttacttggtgatttagggattccagtctctaaaatttcctggccactatcctttctcataggggaagtccaaacacagatgccctgacaaaactttttgacgtactcatactgcttccagtgaagaaaatgtgatttagaacaaagggcactttctaaatgcttgcggtgggttagactggcccacagacttactgtagttggaattgtcatctttggctctcctccaaatgtatttactttattaaacaaatacttacatagcatttactatattcctttaagtgctttacaaataataactcacttaatctttataaccacccttggaggtaggtactgttattatccccgcaggtgacaacacaagcccatggtataacaaatttttccaaggtctcacacctagtaagtggtagaggcaggattgggccaaggcgggttggctgtggagttcatgttctcaccactatcctttgctccctcagagtcagtcatcagaatttccatattctggacaggtgcggtggctcacgcctgtactctcagcactttgggaggccgaggcaggcgcatcactggaggtcaggagttcgagaccagcctggtcaacatggtgaaaccccatctctactaaaaatacaaaaattagccgagcactgtggcaggcacttgtaatcccagctactcgggaggctgaagcaggagaattgcttgagcctgggaggtggaggttgcagtgagccgagatcgtaccactgcactccagcctgggcgacagagtgagactccgtctcaaaaacaaaacaaaagaaaagaatttctaaattctcttctcagctactatattggttagtattgaatttgactatatgtgacagatattttaaaataatgatgacttgaaaaaaggttcatttacacctcatgtaaaagaagtctataggctagctgctcaggcatgctcagggctggcatgacatttcactttattggagacatagggttcttcctgccagctgatcagccatctttaggatatggc

SEQ ID NO: 6596 - DNA, 1031 bp, Homo sapiens
ttttttccttttttctttttttttttttactttttgagacggagttttgctctgtcatccaggctggaatgcagtggcatgatcatggctcactgcagcctcaacctcctggactcaagtgatccttctgcctcagcctcctgagtagctgggaccacaggcacatgcaccataccctgctaattaaaacaatttttttgtagagatagggtctcattgtcttgcccaggctggccttgaattcctgggctctagcaatcctcctgcttcagcctcccaaagtgctgggactacaggtgtgagccagtgtgggtgtcctaataaagttctttgtatcagtttccctgatctgggatccaattcaggattatacatcatgtttaatttttttatgtctctttagtcttctttaatctggagcagttcctcagtccttgtttcttgtgaccttgacatttttgaatagtacaagcttattattttgtagaatctccctaatttttggattgtttggttccttgtgatcagatttagagtgtgacaagtgatgtgtcatgttcagtacatccgtatcaggaggcacctgatgtcaggaaatactgactttgatcacttggttaaggcatccatactgtaaattatcattttactcttcattagtagtaatttgaggggagatactttgagactatgtaaatatcttgttcctcatcaaacatttatccactgctttaaaaatccattgatgggtcttgccttaatcagtttattactatgatggttgcaaagatgatcttctaattattctatcgacatttttttagctggctttctactataaggaagctctttcttactattatcagtatgaactcatagatttatattttatttgatgagttagaatctattactatcattatttattttgatctcaaattgtcctagatttggccagtaggagctcttttgagttggctcttgtttgcattggtccctgtcatttttgaatgcttcctttatggtacaac

SEQ ID NO: 6597 - DNA, 1025 bp, Homo sapiens
ctttaagcacatggtgagtgtgtttaaagagattgaccatccctagccaactgtacctgcaaggccccaggctccacttcccagggcttctgtcctgcccactcaccaaagcccctgtgtctgtagcttgatccagctggaggccttcctgagccgcctgtgctgcacatgtgaagccgcctaccgcgtgctgcactgggagaaccccgtcgtgtcctcacagtgagtgacccctcctctcccgccaccaccctataggaatttgcagcttgagcccgagcaaagccagctgccttgagaggacctctgcccctcttacctcaggggaagagctcgcctcctgggctcttgtgtgtatatctgcacatatgcttgcgggctctaatgtactgcttttgtttagatgcttgcttttatgtgtggtaaaaataataatagaaaaataactcaccatataatccaccatgcagccgaatctcttgtttgttttgcctgctagaatttgtcacatgcatctactttacggatgtatagtttcatagtgtatgttcaatttttcttttgttttccacttatcattatattaaagatgattttctttgttgctatatagcttttggaattatttataataccagattaatatagatggcaaatataatttgtgaaaccattctgttacagatttagtcaatttcccttttcattactaaccccatggtaaacatttttatggatttagctttaatgttttagaaaatttttcttggagtaaattcaaggatgaaactaccatatcaaacagaatgggtgtttttgaggctctttaatatgaataatagtgataactaatgtttgttgtgttcacctggtgccaggcactgctcaacactccctctgtattatctcactcttatagtaactctattaggtaggcgctacttcagtccccatcttacacgggaagggagctgtgcccagagaaccaagagacttctcagaatgagaagtggcagagctggatt

SEQ ID NO: 6598 - DNA, 2389 bp, Homo sapiens
ctacacacagagtcatagagacacatgcaataggcagagagagaggagggtcagtcagagacagagaagtcaaaaacagagagggacagtcacctaggcagagttagaaagcagggtaatcagagatgtagacagacgggcagagttagaaatgagggacagacagatacagggagggagacagaaagagtgaatgtcatgagtaagatggagagcttattggatttttgtctgttatttgagaagaacatgtaaatatttatagttggctaggaaagggaaaataaacagatattaatagtaaatcaagtaacatgaaatttttattacactaacatttttccttaaatactaagtttattttgcatattcagcatgcaaatatcaagtcaatttatgtattacctgttaactacttacgtgacctctcagtgtagtttaaacacatttttaaaaaaattaagattaatattaattttttcctcaaaaaatctaatatataacttactatagaaaacatggcaaatacaggaaatttaaaaggagaacagaaaacactcataatctcacaatctaaacataacataatgaggcccacatttttcatgttttttttttcccagtcttctttttctaggcatttactaaagcccatctactttcctgaaggacccaaaagctgtttataagtccaaaatgatgctgtaactatttgtggcagagttaactttataatcctattttggcacttaggtactttcataaactagtgtgtacccattttattctcttcctagattgtaaacttttaactacagactatatgttattcatctttgtgtcttaggaatctaggaaagtatcttacatatcataggtattcagggtatatatgagatgaattgttaagcctcctaagtagaaactgtcttatttaaacaggtctgccaaattgcacattggattggaccttccttaaagttgagaaaaacttgattttaggggtggtgtgtatgtgtgtaatgtaaagctaccaaactgggaaagggcactttttttctggttaccttttgttgtgtttgtagcaagccattccaaaacataatggtgtaaaacaaccattttattgtgctatggatctgttggaattcagacaggacagtttctgcacagatggcttgcttaagccttagctgggaagattcaaaagctggtggtgactttatggctggtacttagaacctggaggcttcttcactcacatggctggtgattgatgttgattgtccctcagaacacctacctacccagataggctaatttgagcttctttgcagcatggtggtggctgttttctaagagtgaacatctagagagaaccaggtggaaactgcattactttttgtgaccaagccttagaagttctgtagtatcacaagcttgccagattcaaggagagagtgacagttacatgggatctgcttctcacaggagtgtcagagtcactgtaagaaaaacattgtgggggtgggaggtagcaagttaaaaaatgagttaataaaacagtatcactttttaaatgtcaatgaataaatgttctattgaaagtaagggtttttccctactgctgatggtgttattttgttaaaaaatttgtactaaacttgtaaaaacttttaaacctaaagcaattttaaattattttcttggcttttaagctctgaacaagatcttattatttctttttaactgaatttgcaagttggtcaatttctatacttgggtcttgcctcaaccccatttactaaaacaagtcttgttttataaacgatatgcatgttcactgcagacagtttagaaaatcaggaaataaacaaaatcaactcatgatctcacctctgagatgtaatcagttccaggttcatttctttctttttttctctctctctttcttttctttttttgtacctgtaatcccaacactttgggaggctgaggcgagtggatcacttaaggccaggagttcgagaccagcccggccaatgtggggaaatcctgtctctactaaaaatacaaaaattagctgggcatggtggcatgtgtctgtagtcccagctactagagtggctgaggcatgagaatcacatgagcccaggaggtggaggttgcaatgagtggagattgcatcactgcactccagtctgggcgacagagtgagactctgtctcaaaaaaaaaaaagtaggccgggtacggtggctcatacctgtaatctcaacactttgggaggctgaggcgggcagataacttgaggtcaggaatttgagactagcctggccaacatggcaaaaccctgtctccactaaaaatacaaaaattagccaggtctg

SEQ ID NO: 6599 - DNA, 1100 bp, Homo sapiens
gagactggggttcaaattctggctttgtccttgccaaactgaaaactagggcaagttataggatacctctgggcttccatgtgtcagctgtcagatttccaaagtattgacacaacaatcttatgaaagttaaccctctgcttagaacattattcatacgcaaaagaagtcctagtctggtctatctttgagattcttctggttctgctactgaatgatctctaagttgaggagtgcaaaatacagcagtatttatgtcaggttatttaggcctaatggaggagaaggatcttgaatgaaatgaaagagtaacaaattgactggaggggacagaagaaaactctggagggaatggtgtgaagttgggagcaagaatgagtacagtatgtgaactgagtgagacaaacaagtgatcttaacagtactccacaaatagaatgatttttactgatgagtagtaaggagataggatttgttaagtttatatgtgtgtggggataatgaagaagaattaagggacaatattgaaggctaggctgaaaaacttaaatttgatccaataggtgacaggacttctgttgagagtcatataatgaaaacagtgtttgactaaggctgccttggcaactttgtatgtttgataagctcaagtagagggaattgctgaagagtacagtatttcaattgtactgtggaataatgtggaaacagaagtaggaataatgtaaaaatagaaaacatgatatctcttgtggaagaagaagagtaagatatggggttagaaatcggagtcagaataccgcaaaattttgagcctgacatatgaagtgtactgtgtcattgatagtggcattgggaaaggatctcagataggtcttggagaaaggtaacgagttcagtttctaatatattcagttttaggcattaggttatttaagtggtagttttaaaagtctggtgctttaaaaattgattaatctaaatgaatgctgccccttttaaagtaatgtttttggggacatgcatttattctagcaaataaatgttctttggaatttgtcttttgaaactgcttttagaacctgtagagccacataaga

SEQ ID NO: 6600 - DNA, 1061 bp, Homo sapiens
agattctattattttccaaagacactttagggtctaagagagctactagcttcagctttttcacatacattgcaatcatcagaaggagaaagagaaggacacatctcacttcctttaaggatacttcctggaagttatattacaggttgagtatcccttatcaatatgcttagatccagagaacggtttcacattgttttcacattttggaatgtttgcattactctgtggatatcatgcaggcctttttgatactttcaaccatatcgttatactacagagcagagaataagcaaaaaaaaaaaaaaaaaaaaaggaagaaagagcatagtgagtaatagtaaggcagtacatcttagccccatgtgaggcattgtggggagcctcccattggtgtatccagcgtgtacacgtgtcattttattaccctttgtgggcatgcttgtatggaggaatctggtgtgtgcagatatatattgcagctgatggcagctgggagggtctttctttccttggggacactgaataaactatgtgttgggtacctgcattgtgactgcaacctgtcacatgagatcaggtttggaattttttacttgtggcatcatgttgacactcagaacattttagattttgtagcattatagattttggattagggagttccgtgtatactacttttgctcatattccattggtcaaacttagccacatagccacaccttgctgctggagaggctgggaaatgtagactttattttgaatggtcagtgcctggccgttcaaataaagagcaggaacagtgagaataatcccagtgtagctagatgaagaatacagggtagataacagttaattgtctttaggacagtttaattcattattgattattcttgatagagtttttataattactgaactatgagtacaaattcactcttgtcaaattgcatcaacaggatgttgtttttaggatgtaatctcttcatgaatccttgcttaattaggattatcagtttctcataaagaaaaaaatatccgtatatatacgtatgtatgtg

SEQ ID NO: 6601 - DNA, 1083 bp, Homo sapiens
aaatctgtgctgtgtaataatagggtagctactagccacatgaatagagatgtgttacaagtgtaaaatgtacattggatttgaaaacttactacaaaataaatatgagatatctcactgatattttaataatagtttatgttgattatgtgttgaaatattttaagtgtattagataaaatatattaataaaattaatttcactttaatgtggctactagaaaatattaaattacatatgtggctccattatatttctattagaatgtgctgatataaaaaccgtgttcaaaagttacttggattaattttccttctctaacattctttcccttctccctggggttatgttactcatttgaaatacagtgtacttcatttatttctgtttgtattctgtctttttcacttgatcctaattgatcttatttattcttcagtatgtgaaacatcaacatgtttccaaaagtcagaactctacaaaaatgtttatactcagggcactgtcacccattccttctgtccttcacactctaacctgacctctgtaggttaccaatctcatgattccaccagttatccttcatgtgtttttcccccctcaggattgaggagatagatgcacattttctaatttgtctttcattcttacacaaaaggtagcatactatagatactcttttgtactcttatgctgtttctaatattttgaatttacaaaaagtgctgcaactttgtccatatgtattttggtatgttggaggtgtatttttgggtaaattttcaaaatggaatggttgggccaaaagttaaaagcatatgtagttttcttaaatattgctaaatccctttctgcagaggttgtacgaatttgaattcccatcagcagggtatgagagggttagtttccccacaacctcatcatcagagtgtgttggcatactttttaatttttgctaacttgataggtaagaaatagtatctcaatatagttttaatgtttgtttctcttgttattagtgaagttgaacatcttttcatatgtttaagggtcatttttatatctttttgtgtgaaatatat

SEQ ID NO: 6602 - DNA, 1019 bp, Homo sapiens
tttagacctttatgtagtccagttttagagttttttgttttatctgaattttggattaaatttagaggctttccttggacccatggtaaataactcacctgtgttttcttctaatacttctgtagttttagttgttaatttggatccttgatccatttggaggtacggtttctttaaaaatgaataaaaagacgaattttgccccagtgttctttgatatgctacctttatcatatatgaaatttccatttggtttacttctggactttctatttctgtgccattatcacacactttcaattatagaggcttaatagtatatcaagggctagcttttaaaatttttagtgttttcctgactattcttgcatgtctgtttttctgttgaactttagtatcagcttttctgtctcaatgaaaaagcttgcaggtgtttttattggggttatgttaaatttataaattaacatggaagactgactttttaatgctgttgttttgtgctgagatttctgtccaagaacaaagaatatctttccatttgttcagatctacttttgtgtctttcaggaatgttttaaagttttcttcgtatttaactcctcgataaattctccttttttttttcagctcaataatatgccttgtagatctttcttttgtatgtctgcatgattttctacagtgtggatgtaccataatttatttaacctggctgatattggtggacattaaagttatttaaaatttttcactattgtaaacagttctggaataagtaaatatccttgtagaagtctagttacttccttatgataaatttatcaaaggagaattgcctcatcaaaggtcttttgacacataaaagtttctgaaacatattgttaacagctttccatattaataaaatgtatacctccactaacactgtgtttgagccctattctgttgacattcagcaaaacagaaccttattgctcttttttaatatttgccagtttgatagcaaaacaaaatat

SEQ ID NO: 6603 - DNA, 1093 bp, Homo sapiens
tactttgattgcactatggtctgagagacagtttgttgtgatttctgttctttttgatttgctgaggagtgctttacttccaaccacgtggtcagttttggaatacgtgccatgtggtgctgagaagaatgtatattccgttgattgatttggggtggaaagttctgtagatgtctattaggtctgcttggtgcagggctgagttcaagtcctggatatccttgttaaccttctgtctcgttgatctgtctgatattgacagtgggatgttaaagtctcccattattgtgtgggagtcttgtaggtctctaagtacttgctttatgaatctgggtgctcctgtattgagttcatagatatttaggatagttagctcttcttgttgaattgatccctttaccattatgtaatggccttctttgtctcttttgatctttgttggtttaaagtctgttttatgagactaggattgcaacccttgcttttttttgctttccatttgcttggtagatcttcctcaatccctttattttaagcctatgtgtgtctccgcatgtgagttgggtctcctgaatacagcacactgatgggtcttgactctttatccaatttgccagtctgtgtcttttaattggagcatttagcccatttacatttaaggttaatattgttatgtgtgaatttgatcctgtcgttatgatgttagctggttattttgcctgttagttgatgcagtttcttcctagcattgatgtttttgctgtggctggtaccggttgttcctttccatgtttggtgcttcctttaggagctcttgtaaggcaggcctggtggtgacaaaatctctcagcatttgcttgtctgtaaaggattttatttctccttcacttatgaagctggatatgaaattctgggttgaaaattcttttctttaagaatgttgaatattggaccccactctcttctggcttgtagattttctgccaagagatctgttagtctgatgggcttccctttgtgggtaatccgacctttctcttgactgcccttaacattttttccttcatttcaatcttggtgaatctgacaatta

SEQ ID NO: 6604 - DNA, 1029 bp, Homo sapiens
accatgaccaagtggaatttatctctgggatgcaaggatggctcaacatatgaaaatcaataaatatagaatatatacaatattaacaactgaggacaaaaatcacatcatttcaactgattcagtaaaagtactgacaaaacataatacctttttatgataaaaacactcaacaacctaggaatagaaggaaattatctcaacataataaaggtaatatgtgaaaaactcacagctaacataatcattagtgaaaaatgaagtttttcctctaagatcaggaacaaggcaagaatgcccactcatcactttcttcaacattgtaatagaaatcctagctagagcagttagacgagaaaaagaaataaaaagcatccaaattggaaaggaggaagtaagattatccctaatcacagatgacttggttttacgtgtacaaaaccaaaaaaaataaaaaataaaaaaaactgtaagaactgttaaaccaattcagccaagttgcaggatacaaaatcaactctccaaaatcacttgtgtttctgtgcactaacaattaaggaaataaagaaaatctcatttacagtaacatcacaaagaataaaatgcataagagtaaacttaatcgaggggagaaggacatacattgaaaactataaaacattgctgaaagaaattaaagatacaaaaatatggaaagacataaattggtattattatgctgaaactaaagccagacaaatactactggttgagcatctctactccaaaaatccaaaattcagaatgcttcaatgagcatttcccttgagtatgacctttgagcactgtcagcacacaaaaagttttggattttggagcattttggatttaggattcttgtactagggctgctcaatctgtacaagaagaccaatattcctgataaatattgatgcaatactgttgtggattggaagacttaatattgttaaaatgtccatactgtccagtctacagagtcagaacaatctctgtcaaaatccttacagc

SEQ ID NO: 6605 - DNA, 1079 bp, Homo sapiens
gtgtgtgctaacttacattgttatactgtctctgtctccctatagtcttttgcaaaaatggtgtccatgttaagtggaaaacccaaaactgaaaggaaaaatttataatccagtcactaaaagcaaattatgtaacatacaaagagaggaaagcccttcatatcccaacccctcgaggcctcataaatagttggtagcccatcacctttcagttgaatagcaaatattgaacacttagagtttgataaactataaatccctaatagctagatatgtgttgttatcactgctatgttaaaggcactgtgctgcatgccatcttttgctctgaagttgttcatgttttatttggagagacagtatgtaactatgtgactagtcccacagcaatctgcagggaaattaatataaaacaaccttataacagatgtactaaaactgtatttcattgcctgataagtgacacagaatatgacttcaaaaggagattagagggataggacaggggaaaaagaacaaaaggggattagatcccccaatgctagactggttgatgcagtttcatgttggtgaggctatagaattaaacaagagattatagttcccacttttactatgctgttctgtttctaatttctgttttctattccattttaaaaaaatctatagactttatttttgagtagttttagatttatttaaaaaattgaacagagtacagagttcccttgtaccccctcacctgtcgttctaatttttttcacaatatcttttaaaagttccagctcattttaacagatttctaattcatattttataaagatgtctgaattgacatgttattgactgcctaagtggggatttattgactcactttccagatgctgtatattctaatgcagtcagttgggacattcagtgaagaatctgagtgaattatgtactctgtttttattgttcaatccattagtgaatgatgactagatctctggtccaaacagaaagagggaacattaagtagattccatcactcatagtttttgtttttgtaaccaggtgactcctaaaattaaaaatct

SEQ ID NO: 6606 - DNA, 1049 bp, Homo sapiens
ttcctaatacttcacgttcacaatccaactctttctaataatttgttgattcagccactgatattgatgcttttctattcagtgtcatccattttgccattgagaactttgatgacgcagcatttcttaaaagaatacataaaagaaccaaaaatctttgttgcagaattcttaagacacctttgtacttgtgtagagctgttctgatatttagaattttcctccacattactgaccatcctttctgccagttttggtactggtgcttctgatacacatgtgcaggaagcaataacaatatgttgattgtgatgcgtcctaatgtcagtgttgttaaaatgtgaaaaaaaggatatatcttagaattgatgaaatgtatatatccaactactgagtgttaggaaatagtaatataggaaaggaaagatcgccaaattggagtaaattgggaaagaagcatccagaggagtttaaagattgaagctggatcttgggagaagacagaacatgagcagaaaaagcattccaggttgtgagaacagcttgtgaaaaacagaatcagaatcaagtcctaagtttgtcactatcagaagtttagatgatttattttgaaattttgttttctttttataatttattctgaattttcttcatgattaaccagggcagttgaagtttattggtaaagggaaagaaaaaagtatcaatttttttcccccaattttagagtgccatttagaatcatttaaaaaatatatgttcttacctgagcagggtggctcacacctgtaatcccagcactttgtgaggccgaggcaggtggatcgcttgagtgcaggagtttgagaccaccctaggcaacatggcaaaacctcatctctacaaaaaatacaaaacttagccgggcgtagtggcatgtgcctgtggtcccagctactggggagggtgaggtggaaggatcgcttgagcccaggaggcagacgctgcagtgagccaagtcatatccctgcacttcagcctgggcaacagaatgagaccctgtctcaaca

SEQ ID NO: 6607 - DNA, 1054 bp, Homo sapiens
gattaaggtagagattgaagaatccaatggggctcttaaaatattggtgattttttttttccatcctagacaagtgaatttaattagccctttaacctgtctagtgagaaattataatacataccctctgaatatatgattgggccttcttacatataccattggcctcatgatagatctgatgcagaggcattcaaagaaaatagagatattgaaacgttagttcctatctgaaccacctagaatatggatctgcaaaattattctataaaggaccaaacagtaaatacaatattttaggctttgtggagcatcaggtctctgtcactacttaactctgctgttggagcaagaaagcagccatagacaatatacaaaccaaatgggcatggctctgcttcagtaaaataataaaattactttgtaaataaatataaaaacaggtggttggctggatttggtcatggagccatagtttgctgatacctgatctaaaataattactgccacgttgatctttagatctgtctcttttgcttgctttgaaaaaaaagcataacatctaggaaatactaagagctatccctagtttttcctttgcatcactctacttcatgtcttctgcttccttttattcctctttgcagctcgtgatgcgttgggtattaaacacaccatggtgaagattcgtcccttgtcacaggccacaagagcagccaaggccaaagctagagcttatgctggtgagtctataatctctgggtttttttcttgctgatggtggtattattgttctttccagaagttttatagcatccagacatctaaagacatatcacttttatttttagtgttaaaagaaatatgtttttaagaaaaaataaataaaagggaaatgaccatgttggaaatatggcatctgagcagccacttggagtgtgtgagaactaactgcaggcaatgcagcaatcagtttctgatgacatccctacctagtttacctctgtgtttagctgcctgatagagtcactgtaagatactttgttaatgcaga

SEQ ID NO: 6608 - DNA, 1077 bp, Homo sapiens
tgtatgtgactacagtagattttgtgattatttttcatagatctagaataaattttgaaagtctttaatttacatcctctctctgctttttttaaaacatgacaccaaactggcccttttacaatcttcaacgctttacattctcttatgtaaagtcttgactgcaccgtgattgcaggcaactcatttaatatagtcatttctgttgattgatttattatattggagaatgaaagttttcagggccagccaatgtgaatgttttaggtcaatcattttgtgctgaattttctattttttcttaattccttgcccttgtgtctactgttgggctttctctttattcttttaattgttggaggtcaagttagtaggagctttgtttcatgcagtttatcagctattatctgctttcctttctctttaataaagggacatgtttctttgtctttctgtttatacaatttttttcatatttttttcccttgtagatattttcagatgtcaggatagtagaaagtgtgctggtgaagaattaaggatctgggtcccagattcagttctttcactggctgtgtaaccttaggcaagtcatttcagctctctgagcttctgtttcctcatctttaaaataaagaaattattatttcctatcctgacctacatttctctattctattcatgttcttgtatttctaaatttacacctcacattttcactatttctttgtgcttctcaatttgtcttcctactcttactagttttttcatatggcttaccattagaatctatttacttttattagaaagtgttaggaaatgtttcaggccgggcacagtggctcacgcctgtcatcccagcactttgggaggccgaggtgggcagattacctgagctcaggagttcaagaccattctggctagcatggcgaaactctgtctctactacatatacaaaaaaattagccaggcatggtggcatgtgcctgttactcaagagctactcaggagactgaggcatgagaattgcttgaacctgggaggcggaggttgcagtaagccaagatcacaccactg

SEQ ID NO: 6609 - DNA, 1043 bp, Homo sapiens
atatgaaagagaaaggaaaaataatggacttgaaaatcctgacatggcttgaggtgacaggaaagattctagaacagattggaaactgagtttacaatcaaacagccttaagtgcaaacagggatgtagaagatgtagttattgggtgaagccgatggtctgaccagttctagaagtctgccttgtaagatgtcaaaggaaatgcatctctgttccatccatagccttttgcacaccacacacatacaagtcacacgctggagtgtgggagcagagggtacatttacagtgttccagctccctgagcctatagatggctgattccacagtggctcggagttacctgtgtggcagttgtgcagccagacccggtgcccatcatacttgcagcggcactgcagcatattgttggagaaatctgactctgccacttcatagtgggggttcacaatcacctagagtgaaagaggggacaactgaaaatgggtgatttggtttctgaatgagttgactgtggctgtgataatccttacatgtgtttctatttgcttcattaattcttaacaattacccaggaggtaggtactgatgttcccattttacagatagggactgagaagtcccaactgagaaactgatttatccagtgttcactgaatcaatactcaaacacaggttcattggacccagcttgactgttacttccctaacaggacagctcctttaagtgacaggcctgtcggaaaccctgtatgggaaattcttcccttcatttgccctcagggaaagttgtggaacatctggaggaaatcaggctctgtggggaatcccccagccgccttacctggaagatataattcccggggcccacatctgtgatatccacccactggcaatcaatgtcatgccggtaggtgtcccagcagcctacagtcactccctgttctccaaagttggcacatgcgtagcgccgctgcagtcctgtaaggaaggggacagacaggttttgaggcaggacgaagcactctgctaggtcttttatt

SEQ ID NO: 6610 - DNA, 1049 bp, Homo sapiens
caaggcctgaactggggggagaggcggggcaccgggtctgtgagcagcctaggagctgacctgctgggaagagggtccctgtaagcctgggaccaaattgctaccattgtttccaatccagttataatgacagctctgttcatgctacagggaaaggtgcttattatctcaggcgagaccaagtcccaaagtcattgcccattcctttccactttctccacccgtggctatgttctgaagaagaaaaaacaattctgcctttgtcacaggcattgtctctccctctctctggtctggaagctcctgataggaaagaatgttcattgtcacttttttagtggcagtctgttcatgctgttctttgagggccttgccttactactgaaggaatcagcgagcttttcctgcagagccagcaccctggatgggatgtctattttgggcccccaggttcctgggagtccccactttacctggcttctgaagacaaggcctatgatccaacataggaaaagtgtcaaataccattctaacagaacaactctgctggcggtgacgcctctatgggatgttgctgtgggaaacagaccccacgggcaccattgacatagtgaaggcgagagcgatggaggggcaggtggatgccgctgtcctcactgcctcctgcaggcaaggccagcaaggagagcgcacacccctcccaggaaaacttgcctgtggccagggaagggccaaactgctccctggaccctgctttttgttcctaaccctctagtgccaatgcatgggcaggctctaacctgtggcactggtgccaaacccagctatcgcgtccagtctttggacgaaagtcagtccggcccagattgtagatctgtgtggagaagcgcaataggcggcggtatccgtagggccagtccatgtgatccgcagacttggagaggcagttctcctcgtgggcacaatacagctggctgagcgggcggtcctccaagtaggccgtctcctgcactagctgggcgttcatcaccaggtctggtgcacctggg

SEQ ID NO: 6611 - DNA, 1075 bp, Homo sapiens
tggggctgcaggggaggcagtcaagcctgagctcaggcagcaggaggtgaggtgggggctggccacaaaggcagacactggctgccaagaggagactccagttgggtggagtgagggcttcagattcttccatgtagggctgatggggcacaagttaggattcaggcttaaagcagtgggaatgagaggaatcttctcatttccctgcttacaactttatagggacttcctgcacacttacaataagtgcaaactccttccgtggctattaagactgcatggtggagctcttggccatctgacctcacccctccagcttccccatccttattaggctctatgcacattgctgatcttacctctgagcctccgaacattctggtccttttgccctgatgggtttcctctcaagtgtgatggtgttttctagaggaatttcctcagacagactttggaccccgctctgagattgacaccctccccctctaccccaacaattattttccgtctcagccccttgctgctttcttgcagggttctcaccaatattcataatgttttgcccccactgctcccaatagagtatgcactccatgaggtcgggaacatatcagtcttgtttacctgtgtatccaagtacctgccacttggttggtacctgattgtatttgggatgggaggatgtggggaaactgcaagccttcaggaaaatctctttggacactttctgaaacattttcttttacaccaacagtgatgggaaagtagggaaaatccacatcacctctggttttgttgtccaggtctgaaaaagatgatggggtggggaagaggaggtaagttctctgtcttgctgaaaaaggtaaaataaataaatacaataacaattgacaggttatccttcttcaaggctttgcttcaaatgccacctcctccaggaaggccttcctgatcaccacctgcattaggcagttgggcgtgatgtctccctcctctgaatttgtgctccccctttgatgtgtcttctgtggtgcttatcacacactgcctggattgtgctggttgtgtgtgcatg

SEQ ID NO: 6612 - DNA, 1050 bp, Homo sapiens
aggtacatctattaatatttattacaacaatttcttttcacatgtaaagcactgtgctaagagttaggggtatgagataaaatctctgttcccaaagagcctaaagcatagtggatgaatagcacttccctttgcaaagctagaaggcaagctggacactcacctttcccatgacttccagtgaccttgaatttacaagtcatgtctcagtatataagtacaggatatgggtaagacagaccttggtacataaagcattaaaatgaaagtgctatactagaaatgcaaaaatgcaatgggaacatggaggatacaataactatgactaggtggcattttttttttttttttttgagatggagtctcactttgtcgcccaggctggagtgcagtggtgtgatctcgcctcccaggttcaagcgattctcctgcctcagcctcccaagtagctgggactacaggcatgtgccaccatgcccggctaaatttttgtattttagtagagacgaggtttcaccgtgttgcccggggtggtctcgaactcctgagctcaggcaatccgccaacctcggcctcccaaagtgctaggattacaggtgtgagccattgcacccagtcatattttgcttttataaattttttactgaagtttatgtttctataatttatacagaaaaaaatttaaatatagaatagtagaaaaaagaagtatgaaaatcatatgaggataatcatcccactatcctgaaatagtaactcaatattttgtcatattaaaaatatattgcacataataacaatcttaatgaaattcttaaaaagaaaacaaaaggaaaagcccattgtcctgccatcaagcacaaatcaaatgtcccattctaatcttaagagtgattttcttatagggtggtatttttgctatagtttcctcagggttgagtgctataatttgggaagactaattttaaaaatggagccgtagagatttatcatacttcttaaatttactactctattattggattgcttttaggagacactgagttctgt

SEQ ID NO: 6613 - DNA, 1025 bp, Homo sapiens
aattatgaagggaagagtgttccagctgaggcaggagtttgagctgaaaaagaaaggcagagagggagccgacactgtgtctgaacgctgggaaagccattatcataatgctgcttttcttccagcaaaatggggagctaggcagccgaagatatttgtcaaacataattttgtttccttcaaatgctaaaactgtatattttaaccatttttgatggtgatatttctaaaatgttttatacccattcctgcctttcttaacaaaggattctaaatataacttaatcttttcttgatgacgcaggatcatgatcatgagagtgtagttattttatgctgtattccctattttttacatttttttctgtcctctggctgacagctgttagttctctttgaatctgcctccagcaaatccctgccccaccgttctccacaaaatcactcttcctgtgtatatctcacttacagtttctgtttcactgataaactaagtgaataccatgttgagaatcatgtgcctgatatgtagtatacttcaatcaatacttgttggttaaatgattagttaggttttgactgtaagcctagggtagggagtcaatggagagacctgggacagttctttctgggaccatattcaaaacagtgggaagtcagacctccagataatgggttgttactctgctatttttacagtgttgcttagcaagccaaaccaccaactggcttagattctggtgacgaacaactattttttcatgccctagtgatgttggttaccatggtgctctggatgacacagttggcttttttataattgccttttagtggctcaagaatttattttgtgataaaggtgttgattatttctgataaaatagagcaggataattactataaagtacagccttttttttaagctagagaaagggacagttttgtttttccaaatcaaggcggttgctgcaggattggtagaataacatttttgtgtttctcttcctgatttggtagggaatgat

SEQ ID NO: 6614 - DNA, 1035 bp, Homo sapiens
tcatgaccactgcttgctcaggtattctagtttccatttgtttattgggaaagtaatgggatatggtagaaaaagcacaggggttcaagtcttgactccccctttgactcttgttaatcagcctggacaagccatttaacttccttggctttagttccttcctctgcaaaatgggtgtatgaatcacttttcattcagttagtgcttaaaaaaaaagtgacaaaaaattgaattgtaaaaagcagtaatattgtcaagtgttagggatctagggtggtagatttcagtatgaaaagacaagtttattttgctttttatacttgttccctacccttccatttaattgcctggtttttacagggttaattggtgctgggggtggatagaagagggaagattcccataagaagtgtgttttctgagttgcctctgaaacccactgcatgcttctgtccttagataatgacgtgcggaaggttggaagtctggctggatcttctgtctttcgtatgtatctctcaaaccccttcctcgtcctccccatcgtagtcctgcctcagcccgctctggggacctggaccgagcactttgagcctgggctggggctaagacaaatgctggcagcccctttgtaatgttctgccaggaacactgcttcctgccaggtacccacagaccatgggagcttaggttctgtgtgtctggaatgttttctgctgcttctctgctcacatggttggggggatgcaggggttgtgagggaaggcactgcttattgccaccttccagtgaatgcaggcaggtgatttgtgtgcttgggcagaggctcagcccttccttctgtgcaataacaattcacccatggcctttactcaaacactgtcatatgctattattgtgtctgtggggtttgtcctcagtaagaagtgactgcaagatttggggatgtaagttccacctttgtgcaatacgttgcttatctgcctctctttcttggttctccacctctcagctagtggagaggtatctgccagc

SEQ ID NO: 6615 - DNA, 1031 bp, Homo sapiens
gtgttgtatgtgtattaggtaggcagagggacaaggactggaatctaagtcttagatcctgctctccacctactgcctgggaccttgctgtacctctgaatatagacattttatgccccctagagggctgtgatttatttgcattttgaaagcagtgctaattacgaatctggtgctcgcactagattgaggctaggggtctctgcaccaaatattgccatcattatccatagggagtctctttctatttgagccttagtttgaaataagaacacagtggttcacagattacctccaggttgtggtgtggttaaccaacttggcaggtgctttcatttaaaaatgaaacttctgatcaggggtttcccctgaaagtacacagccccactgcaattagcattccctttccccatattcactccttctttcttctcctggtggtggagataattttgaattccccataacagtcctttcaaatccacaaaagcacagagacagagactttggaaccaacggttctttttcagtgctcggttatctattcataatgtgcactgagatcaataatgacagttttctgcttgaatatacagggaatctctaaaaataatatttctactttgcaaaatgtggtaagtggaaatattccttcgggttggctcttgtgtgatgaacatttgggaaccattaaagctccgtgtaaagtgaatgagttcatctgggatcctaacttgggcttagagttcacatcgtagttttgacagacagctggctttggtgttcggttgtctgatgctaaatattgccccagtataatgaattttaataattctagttggtactcttacaggtctatgtaattaagcttcctcatccattttggagaacagagatggcccacggcacaatcacagtcagaccaaagtaggccattccccctcatccctcactgatggtacaaaagatgtaggcaggcaacccctgaaccctcctttttcctcaaatcctcatagggaaaatgggagctt

SEQ ID NO: 6616 - DNA, 1035 bp, Homo sapiens
tgcatttttgttacatagatatattacatagtggtgaagtctgagcttttagtgtggccatcacccaaatagtatacattgtactcattaagtaatttctatccctcaccctctcctgcccttctgggtcttcaatgtgtattatttccctatgtccacttgtacatattatttagctcccacttacaagggaaataatgcagtctttgactttctgtgttatttcacttaagataatggcctctatttccatccatgttgctgcaaaagacatgatttcattctttttgtggctgaataatatttcattgtgtatacacacatacacacacacacatatacaaaatcacattttctttatccagtcatccattgatggacacttgggttgattctgtatctttgctattgtgaatagtgctgcaagaaacatacacgtacaggtatcttttttacataatttcttttcctttgggtagatacccagttgtgggatttctggcttgaatggtagttatatttttaagaactcatcagtttgttttcaaggaatgaggcccagaagtgaaatgtacctttttctgcccaactcttctgctttttacaattaattaccttggtgcttcatgttgttctctacattaccatcactgtccctgtccccgtcagttcttagtcactctggagaagggtctggtccttcatcacacagtggatgggtagggccctgggcatctgacttcaggaccccttgtttcacatgcccttattaaacaaacagtcttgctgctccatgtggcctcttcctcaagttactgggtcaaggcctgaggcttcttgatgccctttgattctagttgcacactattttactctatccagccacatttctggagtgtcttgctccccacccttacttcttggggaagtcagcttccccagaatgactttaggtttgtgatgatttaagagctttagtgactttaagagctttagtttgatgatttaagagctttaatgactttagctttgtga

SEQ ID NO: 6617 - DNA, 1103 bp, Homo sapiens
gaccagacaaggtcttcagagaaggtggtgcctcagctgagaactagtgactgaggagcagacagccattagctgaggcgggaggaggtggggtggggaagggaaatggcattcatcgaggtggggaaagcctgcttagttaaggatgcccagggaggccagtggctaaagcaaagcaagagaggggaaaggaggtcccaagatcagatcagataggaaagcaggggccaggtcacagcaaggaatttggattttattcagacaaaacaggaagctgatttgtgttttaaaaatgtgattctggcagctgaggtgaaaacagattataagattctaagtggggagactgtggtccaggtgaggctgaggtagctgggatttgagtggagacagagataggaccgatgggctcattatgtcagatggatcgcaaggctgcatgtggggctgagggagcggcaggagtcaaggacaatcctggggtttctggtttcaggaactgcatataagtggatgacacttactgagaagggggaagactggaagtggactccttaattccataatcagatcaaggcagtgatgattatggttctaatgagaaaatgattcaacctattattttactctttctgctacatggtttgccagacaacagcttggcagctaaatagatcatcaaccttccatgactcattctaaatagaggctaatcaaatattttgctttatctcaagagacaggattaaattcccaaggttctaccctgaaagagcagaatctataaagaatctgatttttcatttgaggcccctgagctaaatctgtgttaagagaagctgacagcctcctcatccccttttttggaagaagcagaaggattgggggagctttgcagtctatcacttggggtggttccacggttgagatgatgtttggagtcaccttcggtatcctgttttctgttgttcctggagagggcagctcacataaaaccaagtgacatggtcttaattgaacttttccaagaagtatttctttaaaatgtgaaaagaacctggctaagcattcaggagatctttgacagaaggcctgcagatgat

SEQ ID NO: 6618 - DNA, 1031 bp, Homo sapiens
aaagcagctcagctccttccccgggctctgatgggaagggtgaggcccatcaccaccacccagtgttaccatcgcctgaaagtcttatgggacctcagtaaacaacacctgtctctccctccttccctgtctccctccctcccccttcttcctccccacccatccctccttgtcttttctccatctctcaccatctgcagtaaaccggtccccttctcgctgcagtgggttgaatcgctctgagtctccaaaccgagagcgcagtgactttgggggcagcaacacccagctgtacagcagcagcaacaacctctacatgcctgactactcagtccacatcctcagcgatgtgcagtttgtgaaggtaactcccccaggaaggttatcctctccctcccagtgggcagtgttggctggctgagcgggacaagaagactacccccattcctaggagggatgtgtgcaccattcccctgtgttccaatacagtgctgggtggtaactgctactggctgtataaaggctgttttcagtaagctttaggacggttcattatttgtcactcttttaacatctcctgacccccttttttcatgtggggaaatgaggcacaaagcaatagattagcttgcctgacacaaattgctgccagaaccatttcctttgcatcccctaccattggcatcagtttgattttattcattggtttttctaagataagatttttctaagataagtttgcaggtgattaataaacaaagtgatgtgtagaagaaaccatgctatacatctgcctgtctgttggttaaaaagaagaaaccatgctatacttttacatgtgataatataattttataccttaaagtctaaaacacaacttgacctgtgtgttaactgaaaatcttttgtagtcactagtaagaccccttgaaaattactaagctatttgaagagaaccatgtgcaattgcccaggagagaggtagcaaaaggctcatggcctcataattaaagaggaggggagctatttcc

SEQ ID NO: 6619 - DNA, 1043 bp, Homo sapiens
gcttcccaaagtactgggattacaggcatgagccaccacgcctggccaataaaaaagttttaaaactcttcttagagaagaaaagcttcctaaatcttttcaagaacctaacataacattgctgctaaaagacaacaaaagggaaaaaagtagaatgagagacctagatcgtaccttgatactaacttcccaagtaaacattaatgaacaatattaatccagcagtacattaaaattacccccttgattgagagtcatcccatgaatggattataagagatataaaaccaatcatgctgctagatagagaaaacccaaatgatcatcacaacaggtaagaaaagcttggctattcctgagataaatgcttagtaaaacaggaaacagtggatacttcctgaaaatgactgaaaaaaattcatttaacccataagtcagcttaaaaacagtgaatcgtttagtagaaatcccatttaagccaacaacaaggtaatgttaccaattatcggcactattatgcaccaatgttctgtttgtatttataggtgtgagcatctgtgaaagaatactatctgaaatgtgaaacataagcaaagttgacattcaaggggatgcagaactaaacatagctgtacattacagagaggggcaaaggcagtgcactggggtgaaaatgctcagtgtgtgtcagatttggtgtgctaactactctgttatttacagtgatccttactgagcactcatcccttgctattactttaaaagttttgcccccacattgtggtttacctgaattctttatgcaaattgctaccaagatgatataacacaaatgtgcatttattttttatggatttgtcatccagctaagttgaatgtcagtttcatacatgacttcacattgcagatacctaagccactctagagtgctaatacttcctaagcaaatgagcaagacctcccttgaacatggttttaacttctggaaacacgatagatgcatagataccagtggaaacattcccaggcataatttttcattt

SEQ ID NO: 6620 - DNA, 1045 bp, Homo sapiens
ttgaccctgggtaatcagatagggttattgtatgaacagacctaatgctcctgcacgttctggatagaagtcaatctactgaaatagcaggatgtagttttaaaaaatgtgtgtaactcatatagtcttagccctgataagtgcttctaaattcttattcactgcctttattctgctgtgttagtgttgctctctgtcatacgtgggtcaggtcagaactagctcaaatacagtatgtgtattatgactttaaggagtggtgtcagacaagatgggtaaagaatgtctttcatgggactgcagttggctaaatggctgtgtataagtagtgaaattgaagccttgtatgctcgtcgtcattctatcacagtatgatttgagtttccctaaccggtaaacagcaagaaaaaatgatctgttattttttactaaagttacttgatgctctttagcaagctgacagaataattctaattttagcaaatacaaaaccatggtaatcctagcacatttggattctgtttaaccctgaaaactcttttggcagcaaatcttcaatgccaatttagataaatcccactaggaataagcactgaaagacgttgagtctagttcccagctctgccatgtgaagttgggcaaattacagtctctgagcttttatttcatctgttaaatggagataatacctcctagatttattaaaagggtcaatttagaaaatatgtattaaaatggtttgaaagccatttaagtacctaatgaatatttctatcactgtagcccaaaaagattcctgcctagaagactttatgtctcttctcctcatttggtatcattctattgcctgagattgttaattaacttttatgtatactcaatattttctcccaacttggttgctagttccttgagaactgaaaccatcaattgcacttcttggtatcctccacaataaggtatctaggtactcaaatatttgttggttgattaaaaacataaaccacaagacataattaactctttttaaaattgtggtaaaaaa

SEQ ID NO: 6621 - DNA, 1070 bp, Homo sapiens
cacttctctggtgagtcctagcattctctactagacaatctctttaaaatatatctacttactcttctggttcctctccatgaaggaggcacatactacctgtgtctagtcagccatcttctcattgtagttttaatttgcattgctctaatgactaatgattttgaacatcttttgaacagattgcttatttgccatctgtatatcttatttggtgaagtgcacaaatctttcgtctatttacacctgggttgtttgctttctcattatttaattttgagaattcttttcatattctagatacaagccctttatcagatatgtgatttgcaaatattttctcccacagaaggataacccactgtgtggcttatcttttcattctcttagtagtgtgttttgaagaggagtagatcttagttgcctttttcttttcttttttttttttttgaggtagggtctcactctgtcacccaggctggagtgcagtggcacattcatagctcactgcagccttgaactcccgggctcacatgatcctctcacctcagcctcctgagtaactcggatgagaggtccatgccaccatgcctggcatatatttttatttttaaactttttttaaagatagagtctgactgtgttgctcaggctggccgtgaactcctcccacctcagcctcccaaagagctgagattacaggcatgagccatcatgcctggcctagttcttagtttcaatggagaccaatttattaaggttttcttttggtgtgtgagtgtgtatcttgcttttgctgttgaatctaagaaatttcaaggctaccaagattttcttctctattttcttttataagttttatcgttttagctcttacatccaggactatgatctatttcaagttagtttttataagtgatgttagattttttttgtcactgtcagtttttactcattaatatttctctgcgttcttatcatgtgtgtacataaagagcttccttttgtttttccaggtacaacagcaggttcttttctgattccgcaaagtcctgcatggggtggaggca

SEQ ID NO: 6622 - DNA, 1031 bp, Homo sapiens
atgatgaggtttcccaatggtaacagaatcaaggggcactcaggaggggcatgggtctgggggcagggccaccagttggaaggcttcattagaagatcttggagaggattttaggcagttgaattaagcacccctagtgactcattggatggaaagggagaaagaaagttagaaggaagatattctaggatgactcccatacaggttcctgctctggtgaatcacagggtattttgtcaagatggagaatatggatggaggaggtttgggtggatatgatgagagtggagagataatgagtttatttgggacaatggggtgcctgaaagacaggtgaagagagatgggtaaacttggaagggagagtgtagaccacatgacactcctccaaattcctttagagggtagggtgggatggagtgtggagggaaggagaatccacaaggggaaatgaagcaaagcaaacaactagcacctaatatgggacctgttgggctgattttgctcagggctgggcatcaagcacatctggagaaaaattgcaaatgtaattgtaaggcaagcctttaaagagcagttaaaaacctgttttgaaacataggtttctataacttgttgcaacatgttgagttacagcaaatgaaatagagaaatactctcagtgctttttaatttgccctgctgactggaaacctcggaactcagccctatgagctgttaaccagataagcattgctggtttttgtaaagaattatgcttgacaaatgcttgagggcatatggatttattgaaggaagtattgtccaaaccagactgacaaagaaagttttacaaagaaaatataatgaaaaaatgttgggattaaaatgtaggtcttttctgttttatgatgtagttatgaaatgtaaattagaggatgtttcaatgaacttttgaattataagttaatatagttcataaaccataggaattaagtactattttaaaaataggaattatacttccactcaaaaacacctattttgtggaa

SEQ ID NO: 6623 - DNA, 1056 bp, Homo sapiens
cagccctccagaacaggtaagaatgctgcatgtgccatatcctgtcatttgtgtgccaacaccaaggttgacatgttcttacagtagtaaataaagcaggaatcaagaggcatttacgggactgaggctagtcagaagtcaatgtggcagattaacatccaagatggagtcacttttgtctatatttaccatttctggtctgcttcattcctttgtgtagatccatatttccatctggatccatatttccatatttgcttttacctcaagaacattctctagcatttctagtagagcaagtatgcggtgataaattctttcaacttttatatgactgaaaaagtccctattttgctttccttttgaaagaaatgttcattgggtatagaactctaggttgatcattttttttcctttcattactttaaagatgatgcttcactgtcttttggcttgcattctttctgagatgtctgctgtccttttaatctttgttctctctgtatagaatgtatctttttcctctgaatacttttagaattttctgtttatcactggttttaagcaatttgattgtgatgtgctttgatgttgttttctacatgattttatttgtttttttttttttttgagactatctcgcgcatctcccaggttggagtgcaatggtgcaatcatagcccgctgcagcctcaatctcctgggctcaagctatcttcctgcctcagcctcccgagtaactgggactacaggcatatgccatcatacctggctaatttttttgatttttagtagaagtgaggtctcgcagtgttgctcaagctggtctcaaactgctgagctcaacctatcctcctgcctcggcctcccaaagtgctgggattactggcatgggtcaccgtgccctgcttacctgattcttgtgcttgtgatttgttgattcttggatctatggatttgtagttttaatcaaatttggaaacattttgtccattacttcttcagatttttgttgttgttgttctcccctgcttttcctctggggactccagtaac

SEQ ID NO: 6624 - DNA, 1135 bp, Homo sapiens
gtttcttaaacagaggaggtgtgtgtgtgggtatggtattggggtgagtatgtgtgacagtgaatcagacctctttagggaaggtggatgtgagggatgccaaggcttttgagacttttctcttgggcttttggtcctctttagagattggctagtgtggcatcggcaaaacaggagggtccagcaatgcaaataattggccatgatggctaaggccatggctacaaattatatatgacaaaaaaaaaagaaactatatatgaaaaaatgcatgaaaggtctggtgatccattcattttaggagcctaaatagaggaaggcttctagttggttgaaagtgtaagaaacctgattaggtcataagaggtcagagttccaggaaaaggtaatatggctactgcccagaggggaaaactgttctttagttactagtttgtatgcacaatgagaaaaatggagactttccactgcataaatgccatttaggcctatcttcctctttagtgatcaaaggtcagctgacattttagccaaagcacacatggagacttcgaaaggaagagaaagaaaagttgagttgcaccaaaactggagctgtaaagttccttattttggcaggaatcagagaggataacaagatactttatttggaaagcaattaaaactttctaagaaagagaccagttgattttgaatagagctgtacaaagacacggaggagttaacagaccaacagctccattttgtgagctctaggaccaaaccaatcaatactatttgatacatcttttgggcagagaaacatgagaaactctgtgacaatatcaaggtagtatagataaggtacatgttcttgagaaacttatggtctaaacaggtagagcaagcaaatatgaaagaaatcttaggggctcatactgaaatataaacagggaatattgacgtccacattttagaacagaaggaagaggccttttcaaatcattctgggtactaccagtcagcattgttgggtagaggctttttaagaactgagaagccatgtccaaggagacaggagaggggaaggagtaggtagagaagcagatggatgttaaagagaaaaggaaggctgtattagaacagtggttctcaa

SEQ ID NO: 6625 - DNA, 1050 bp, Homo sapiens
ccagcgtgggtgacagagtgagactctgtctcaaaaaaaaacaaaaattgttttaacataaacaaaactagaatagtgtaatcaactcctgtgtacctgtcaccctgctttcctactaacatttatcagctcctggcccatcttgtttttatctgttttcccatccacaatccccctcttacttcaactgggttgttttgaagctaatcccaaacatcctataattacatttgtagatattttaatatgctctctgaagatagggactcttaaaaaaaagaaaaagaaaaacacagccacagtatcattattgcctttgtggtaaacacaagataagtaggctgacttagaaataacccacttagaggtgaggaaggtgaagcgggaggaggtaggtcttttaataacttgtgggaatacggagtggcttattgcaaaggaaagtattagaattcttttctctttttttaaaatttaattatttttgtcacacagatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcaggtaaagtaagactgaccaatctggtatcttgagctcagaggatatcagttgatgcctcagaatcggtttctttctttttttttttaaccagcttagaataggtcttaagtgaccttcctctctaccccctcacaaaaacaaactcctttacttccatgtgagccactgttactaccaggcatgctcgaacagaaagaaggttgagcattactggtctggagtctcagctttgctgtttcagaaatccagctttatttgtttactcacaacaaaccagtctttaggactgagctcttactaatcacttccaagatactgacaagctaaaatgtcattcttgggttaccctggaaaacacatctgactaaagaacaggggtaggatgtctagagc

SEQ ID NO: 6626 - DNA, 1060 bp, Homo sapiens
caacatgcccatctaatttttgtattttttttgtagagatggggttttgccatgttgcccaggctagtcttgaattcctggctcaagtgatctgcccacctaggcctcccaaagtgctgggattacagccatgagccactgtgcccggccccttttttaactttgtattggggatactgtcagaacaaaaagaagtggtttatacctgtgtatacgccaaagccagcagagtcactgctgccatcttggtccttctaggaaggggaattctccgagagaggaagtagagcactgtaatggcagtgactgaagtgattccctgcagggaagaaagagtctatcacattagatagaagtgccaggtttctaactcaccttacatgtatctcctctagaaccactcagcaaccatgaagtactttcctgtaccagtcacagagaacctccctgcagtcccagcctgatcactcctccacaggctgtctcttccaccatcctcttctgcttgccacttaaacgtcggtatcacccaggctccacctaagattctgtatgtactttatacaccctcactcccagtgatctcatccaccttccaatgtgggtgtccccctcatttttaattctttgcatccttatccctaaccatatctctaatcctatattcttaaagcagggctgaccccagcacatgagggttattattttcctgggctgtgagtggagaaagtgctggtgctgccagctggtgctaaaaaagacctaaagtctcattttcattcctatctcttcagaacaagggtccaggactggcaataatggtctccttcctcttccacggtatcagggagaatgttttctatcatatttctacatttatttcacttcatttccttttcagtgctgtccacaatgacaatttcaaccaggctttacttatgctaaaatactgtgcgcaggtggggactcagcccacaccaggtaacatgcctcagcccagcccccgttggacagctgagccctctggccccctctctctggacgtgctgctctcatctca

SEQ ID NO: 6627 - DNA, 1048 bp, Homo sapiens
tattcctttgtgtagatcccgtatttctgtctggtttcattttcattctgcctgaagtactttctttaactttttttgttaaaaagtatgctagtgattcattccttcagcttttatatgtctaaaatagctttttccttcatttttgaaaggtatttttgctgggtatagaattctaggttgacaggttttttttttctttgaagatgtttttccattgtcgtcttgcttgtattgtttctgacaaaaagctatcatccatatctttgtttttctctatgtaatatgtctcttttttctacctacttttaagatttttttattattggttttgaacaattttcttatggtgtacctgagtatagttttttcatgtttcttggacctgtgcatttatacttctcatcacatttggaaaattttcagcttgcagcttgttctccactccctcctttagagacttaagctattcttacattagactacttgaaattgtcccaaaagtcactgatgaacttctctatttaaaagaaaatctcctttctgtgttttcattttgcatagttgctattgttttgtccttgagcttactgaccttttcttctgcactatctaatctgctattagtctctcctggtatgttttcatctcatacattgtagtcttcatctgtagaaatttgagtctttttatgtctctgatgtctcttaacttttttgaacatgtggaataaagttatgatagctgttataatgaccttgtctgcgaattctaacatctatatcagttctgggtttgtttcatttgatttatcatctaataatatatcttattttcctgccttgtaattttttattggatgcaagacattgtgaattttactttattggttactagacatttttgaattcctacaaatgttccaaaacagtttggtccttttgggtcttgcttttaagatttgctgggcaagtctggagcagtggttaatacagagctaattattccttactactgagtcaggattcttctgtgaactctaccctgt

SEQ ID NO: 6628 - DNA, 1013 bp, Homo sapiens
tgtaagatttttaaccccttgacaccttattgagacaaatttcttccttttacccctccctattagattctgtgaaggtggatctagggagtagtgcttaatatgaattattttcttcttcagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaaggtgagaaatcattgaacatgatgaagatataaaggtggggtgggagggagaggggaggacatgtctggcaagtaagacagggaagatggtggacatatggtaatcaacacaacttcatattatttttatagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacaggtatgtaagaaggattgggacaagatagaacttgggccatgggtggaatggtaaatcaatatctaattcctgaactgctcagtatccagtgaactagatttggaagcaaactacccagagattcaaactctgctttctgggttctgtgtctctttgaggaaacatagaaattgaaactctatgcctgggccaaactggtgacttatcctgctcatctgatgtctgacacacaatcaaaggacactctttagaagggtacaactgaaagtctgagtgagtaacccttgtggaagaaacaccagtggcacaacggtccctcttttagggatgccatgttcctattgactctagtcacacatgtcatcccatctaccccaaatccattaaaaccacttcctcgacagcttcat

SEQ ID NO: 6629 - DNA, 1022 bp, Homo sapiens
tgaccaaacagctccttgagcacacggtcctgactctgcacagtgtgcacaatgattttcaccatctctgtgctgtcactgtaggagtgatctataaaagacatcagtcagtggatataacctttcttctgtaacatatcagcctccaaacaaaaaattcctcaaaaatccctgaaactctgaaactaattttaattaataaacatctccatttaaattaaaaattgggttaagataaaagatataaagattacctataaataaaatctagttatatataaaaaataaagtttgcaggtgtataatgtatatataaatttatcagtaagagaccttagttgcctgtgcttgagaacaatagtcttggctatctttaacccatactaacccaagccctagacacaaatgcagcctctggccaagggaacaatttttcttggatgattaaccacatatttagaaacagtaggacaattcatcaaactttcattacctaaaggaaggaggcccttgaactaggttgcttggaatttcatgtttatccgtctgtttacaacccagaaaaactttgaaaaaagctcattgaaaccaactagtaaagggacctgtagacatcctgaaagttccatttgagggcagtatgacatcttaaagccaactggcagcagccagataccctcaaatgggatggctgttggtcacaatgggttctacagtttaaaatgtgacctcgattttaaaaaaaaatcattaattgttatatttcagaaaatggctaaaggagttgaaagttgcttatgcatcatgctggtatattctttggacaataattaagcctaaatgcaataataataatatttgctactctctgcttataattttcccatttaatcctcacagcagtcatgtgagaagactacttttgttacccccattttaccaaaaaggaaatgatgagcatcaaaggaggtttaaaaaacgttgtgtcctttgttatctatcactccaaatacttcccccat

SEQ ID NO: 6630 - DNA, 1385 bp, Homo sapiens
cggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatgtgagtttcccagcctggccccgtaccgccgggtcgcaggcgcgggctgggcttccaggggacgggttggtggcagaagagaggggagagctccgcggaggacttggtcatctttttcgagttgtgctgccttccgtgagttgggaatgtggattgtaatttggggacttgagtctccaactttagtttcttaagctttaaagaaaaatccggtcgtgctggtgcttttatgaattatgcgggttttcctttgtcttcgtggggatgtgagtgctttacttctccttcctactgccgcctcccgataggtttcgcgcccctcgtccccctcgccctccgcccctaatgtatctgtacagtttcagggaacttttctccgttgcgtctcggatacaccctaccctcagtgaactacggcgctgcggaagggtccgtactgtccacccttcccccagcgtgattagagagcggagtggccccagctgcctccacgtgtctcttctcctgactctcctcttcctcccccttccagatctctagctcctataccaccaccaccacca

SEQ ID NO: 6631 - DNA, 1008 bp, Homo sapiens
tcatactacacctggccctctgctgttattttaataacaccctggcttatgggttctgagctctgcaggagtagtttgtggcccttaaaaccttagagaaggcctagatagaggtgaaaggagatagctaggccctgggagaatgcctttaagatgaagaatgagtggtaagagcactattctctctcctgcctttctgactccttagttcctgggattctttagcttatctttttttcctgggttgagaggttggggggtgatatttttcaagtggtaaaatctaagggatgtggttatccctagagttcatggtaaagccagttctcacccaaagcctgacgaagacagtttctagcatccagagagtgtctctggcatcctttcccagatggaactcacactgattggtgactcccccactgtcttctcctggcaggggtattctactattttgtcagtgccctgggcataacagcaggagctcatcgtctgtggagccaccgctcttacaaagctcggctgcccctacggctctttctgatcattgccaacacaatggcattccaggtaagaagttgtctctgctcagctgtttgtcctccacactattaatgatccggggacagaaaggagggatcagcaccagagaggagccacacctgacagccatttcactttcctctctcctgtagtcacctcaagttccagttcagtccttaagtccataaagcatgaagagacttctgagtcttggaaaagggaactggaagataattggaaaatactcctgatgtgtaggaatatttttgatcctaaggtccctgtgttgtcacacaatctggccgttgtggctcttcatcataaggggctttggcacataagccagagactgaccttagattcctgggcagacactggacaataaattcactatttaaggtaaatatcttagggaggcagagctgggaggatcactggagcccaggagtttgaagctgcagtgag

SEQ ID NO: 6632 - DNA, 1672 bp, Homo sapiens
atacaaaaaattagccaggcgtggtggcgggcacctgtagtcccagctacgtgggaggctgaggcaggagaatggtgtgaacctgggaggcagagcttgcagtgagctgagatcgcgccactgcactccagcctgggcaacagcaagactccatctcaaaaaaaaaaaaaaaaaagtttatagcaaagacagaatgaagggaaatggggaaagggaatgcatcatagtcattaagctgtagcaatgggcaaatgatagcatgtggcgtttggcttagcttggagcaagaggaagaaaggaaaccaacttagtggtggcaatatcccaagaacttgccacatttgcatgatcatctctgccatagcagcttataccttgaaggcttccaaagttgtcctgtggagcaaaaggaaggaagagagatattggtacattctttaagggatggaaaaagtcatgaagaagcccagaggtcgtttgaaaatgcagtcatgatcacgagttgcatgcctggccttgttattgggttgtatgagctcttttgcaaggcaccagaatggtgcaccctgcagctgcagcttatctactgattgagaccctaggacacaaggctgcctgcctcatgttccccatgcctagggattaggtaccccatgaggatcttttccaacattccttgcttaaagaattgcaatgttctcacttcttgaaactctctgagctctgtatgatttacctccgttccacccaccatataactttcaagaaacagcagttctattgctatggtcctgggactttaagttgcttttttctacttaagcttcagtggcaagttgggagaagaagggaggcaactccatgactcctttggagcccagattcctgggtattttgtgaggttgggctgagcgccttgggctcttgatacctgtccattgggattctcctaatagggtgtctatcctcaagccttacattcctcttctctctctccccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtgagtgaagccctgatggaggtggggatatggccctggcacctggtcattagggaccccattttttctcctgagactttcaaaatataagctgagaaatttgctgggtttgcatgttcacaatcttaatttaaaatcccaatttttaacatcccacgggcccgtagccatagactattgctccatttctttctctctgactatcttaattaaacccattacattcaagagatgtttattgtcctaggacagtcatagattcaaagatgattatagcctagttgcctaggtttgtttgtttgtttttgtgtttgtgtttcaacagtctttctctcttgcccaggctggagtgcagtggcacaatcatggctcactgcagccttgacttcccaggctcaagcaatccttctacctcaacctcctgagtatctgggactacaggcacacaccgccatgcctggctaa

SEQ ID NO: 6633 - DNA, 1995 bp, Homo sapiens
gaggtacaaaggggagggagattgctcaatgggcaacaccaaggaagtgatatgaaataaatagtgttggaatccaccaacggatagaaatttttacaactatgtgtggggagagacagtgcaaacagaagaaacagaatgagctaaaacacgaagcatgttccagcaatagagtccttttgcttgaagtatagggtatgggaagaagtaagactggagagactaatgccattcttgtcgagtcctaaaagcagacttaggacttaattcaataagcaataggaagccattacatcttttgaactgcaatgtggcatagttacggacgtgctttaggaaggctgcttttagaacaagtgtaagaaaccactgagccaaagtgagaggtagggacataagttaggtaatgaggacccctgctagcgaagcagtggcagaaatggagaaaagagttgggtgcagggaatgtcagtgatgtaaaagtcaaagacttgactgctgaaggaatgtagggaatcagtgcccttggaatgtcaatggcctggtctacattgagaatgaagactgagaaagggcttcctgagggacagagagctgcaggtgatcaaggacactcaatgggtctctgagggaaaagaagaccaaagaattagggagtagctagcagaaaatggaggcatgacactaaacacagactgaaaaagagtgctgattagaaagagaaaggagcccaaaggcagatgggaaaaccagccaaggatggagagacgtctgttcattagtttgtagtttggacctcacctatcttaccaatgtggtattatgctctagtaaaaagtcagcgatggccgggcatggtggctcatgcccgtaatcccagcactttgggaggctgaggcgggaggattgctggaaagttcaggcattcgagaccagcctgggcaacatagtgagacctcatctctacaaaaaattaaaaactaaatgggcacgatggttcatgcctgtggtcccagctactcaggaggctggggtgggaggatctcttggcccaggagttcaaggctgtggtgaactaaggtcacgccactgcactccagccttggcaacagagtgagaccctgtcaaaaaaaacaaacaaaaataaataaaacaatgaacttagagtcagacaagcaattcaacatggaagaaagacagcccatcccctcccaattagtgtggaagatccatgtaggtgtggagtccccctccattgacctggtgtctggtctgtcaatgtaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtaagtcagctgtccaagtaagactacatccagtggtctgctgattaggggattaggctaggagccagaaaaactagataaatctgttttttatggctactttgtatctcagtttttccactataaaattagggggcagtatactggaaaacgcttttgagagtcaggcaacatgttttatgtaaaaatgaaaggataagaaacaaaacacaaaaaaacactgattttgattccaggttctaaaacaatttccaaatgccatgtatgctccgggcccggcggctcatgcctgtaatcccagcactttgggaggctgaggcgggcaggtcacctgaggtcaggagtttgagaccagtctggccaacacggtgaaaccctgtttctattaaaaagcaaaacaaacaaacaaaaaagaaaaccaaatgccatacatgatgagcaccttagagttttcctttctttcatcaactctgggctg

SEQ ID NO: 6634 - DNA, 4881 bp, Homo sapiens
aaactgtcagttctcctcccacaaggctcccagacagccacgggtgaccagggtctccaatcactccttaagatgcctttgactggctgggcgcagtgactcatgactgtaatcctagcactttgggtggtcaacgtgggagggttgcttgcaacatggcaagaccccgtctctacaaaaaaagtaaaataataaaagtaaagatgcctctgaggggatctgtttggttcatattaaaagagactgaattcatccattcaacaatagcgagtttctcccaggtgtgaggtaccctgctagctaactggtgtgcacaaatcaagaaaacctcaatgcaccgtcactccataacttctcgcttttgtttcaggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttgggttaaaagatggttgtagcatttaaaatggaaaattttctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgattgcactgggtctgggagtttcttttggctgtgattcaaagtcttgggatttgtctctggctcatatctatgtctgtacctttaagagtataaaagaagtagaagttacaatggttgactcataccccattaacctgccctgctgtcctaaaggtaactttaggttaaactctgggacgcaggaagccaggagtctgctgccattaaatcaaacacattaacaccagctggcaacttggccctggggaagtgccagggttctcgggtgtgtcacgtggtcggtcacatagacctaagataaagacactgggagaggaaaagaccagcaggagaagcgctccctgggaaagcagttttttgctcttgcccaggctggagtgcaatggtgtgatctgggctcactgcaaattctgcctct

SEQ ID NO: 6635 - DNA, 1052 bp, Homo sapiens
acccagttactaaagtcagcaaagaagatgcggtaatcaccgcctgatctccacatggtgaacacaacactctcactaacacctccttgaccagtcagtcttcagcactgggggtggacaggcaggttttctgtgtttaccagaatcgcacaggctaagcacaaacatggaaccagagttccaggtgaggaaacctcactcgcagaagcccaggctgcaccccaccaggtgatgcagtgcgcctaggctgtgggtgctaggagccaagtgctagggactcgtcatgagtgggaatccccacgttcctgtcactgctgtcaaacagaaggtaaacagtcttacgaatgtaattccttaggaagacttgtacaaacttttattaggatatctatttatttaatactgaactttggcctactttgtgataagactataaacaaattgaggaaatcactatttctcacttctgtatttctcaaaaaataattttgttacagagttcaatatactgtgtactactgatcttctattgtgaaagcaaagcatttcatcaaaacaaagtattttaaattatgagtgaaaattgtgtatgttaattttgcagctgtaatattaatcaaactttgtgtaattctaatcacaaaatgatgtgccttaaatgcccctccagctgtgggttggcagtgtccagacagggaccctgaaatcctgaatgactgctagaccaattctattaaaaacatttcaaggcaaaaaaaaaaaaaaaagaggtggctggagctgaaggcgtagtcaaggttaatgctcctttttcttcatctgacctctcccaatcagttagcgtttaggctgtttttcatcaaatataaaaacccagcccagttcatggcccatttggcaacaacccttagatgctttaccgccctagacccagaggggccagaaggccgtcttattctcaatatgcattttattacccaacccgctccggacattagaaaaagctccaaaaattagattccagccctcaaaccccacaacaggacttaatt

SEQ ID NO: 6636 - DNA, 1135 bp, Homo sapiens
ctccttggcaaccgatcatgcaccccttaccatcccattaaaacctaatcacccttaccccactcaatgccaatatcccatcccacagcacactttaaaaggatcccacagcacactttaaaaggattaaagcctgttatcactcgcctgctatagcatggccttctaaagcctataaactctccttacaattcccccattttacctgtccaaaaaccagacaagtcttacaggttagttcaggatctgtgccttatcaacaaaattgtcttgcctatgcaccccatagtgccaaacccatataccctcctatcctcaatacctccctcccacaacccattattctgttctaaataaacctagctgaccccataaatcctaaatcctttccccactcccctttccattccttaaaaaacagccctaaaagctgctcccacactagctctccctaactcatcccaactttttcattacacacagccaaagtgcagggctgtgtggtcggaattcttacacaagagccagaagcatgccctgtagcctttctgtccaaacaacttgaccttactgttttagcctagccctcatgtctgtgtgtggtggctgctgctgctttgatacttttagaggccctcaaaatcacattatgctcaactcactctctacagttctcataacttccaaaatctattttcttcctcatacctgacgcatatactttccactccctggctccttcagctatactcaactcttttttgagacagagtctcactccgtctcccaggctggcatgcagtggcacaatcttggctcactgcaacctccgcttcccaggttccagcgattctcctgcctcagcctctggagtagctgggattacaggtgtgtgccccacacccggctaattttttgtatttttagtagagatggggtttcaccatgttaaccaagctggtcttgaactcctgacctaaagtgatctgcccatctcggcctcccaaagtgctgggattacaggcatgagccaccacacccagcctatactcactctttgctgagtctcccacaattaccattgttcctggcctggacttcaatccggcctcccacattattcctgataccacac

SEQ ID NO: 6637 - DNA, 1095 bp, Homo sapiens
ctaaaaatatggaaattaggcaggtagggtggcacgcacctgtaatcccagttacttgggaggctgaggcaggagaatcacttgaacccaggaggcagaggttgcagtgagccaagattgcgccactgcactccagcctgggcgacggagtgagactctgtctcagaaattaaaaaataaataaataaaatgataactgtatttgacttactacctcatagggcagctatgaagtaaaaagaggtcgtataaatgaaagacataataaagcactattgaaatgtaagtgatcatcactgctattatttttatgtatatgttgtctgtccaacctgttcaaagatccttgggtttttccttttgttctactgccacagccccttcctcatactagacacatagcagatcctcagtaaatatttatttgtgaactgatagatgcactcagtcttgcctgtgttgtcagaagtaaaaagagaagtatttacattttggtagtcactccctagccacttcctgctctcaactccttaagcctaaaaaactaataaaaataaaaataaaaataaaaaaacaacttgttaagtttgtagtcagccaagactcatagcctttttcacttgaactgttaagctaagtcttccttatcctatgttggtgaaattaatattttgaacataagcatgggactttaaatgtatccctggttggccaggtgcagttcatcacgcctgtgattgcagccctttgggaggccaaggcaggtagatcatgaggtcaggagatcgagaccatcctggctaacacagtgaaaccctgtctctactaaaaatacaaaaaattagccgggcagggtggcatgcgcctgtagtcccagctactcgggaggctgagataggagaatggcttgaacccaggaggcggaggttgcagtgagctgagattgcgccactgcactccagcctgggcgacagagcaagactccatctcaataaatatatatattatatatatatatatatatatatatatatatatttccctggtaaatttcatttatttgttaattctaactttggaacctattgagagctt

SEQ ID NO: 6638 - DNA, 1055 bp, Homo sapiens
ctacagccagctagttctgtagcttgagggatgagggaatgattaaacttgagctatgaatctctgggttcccatcttcttcctcataaagagttagttgcctagaagggtcaggcaggtgaatggaaggagtaatatcgtctgtgtgaaatcagtgatgaggctgaaggcataagccttgttcaaagtgagaagccaaggccggcgggggtggctcatgcctgtaatcccagcactttgggaggccgaggtgggaggattgcttgagtccaggagttcaagaccagcctgggaaacgtggtgagagctagtctctgcaaaattaaaaactaaaacaaaaaaccatggtgagaggtcattacttgactctgcttgcttcagttttggagtgcagttctagggttgggagatattccgattttcaagagaagttcaaaatcaggatttttatttaaaatcttttgactttaaatggagcaactaaatcagatttaaagaaaaaaagttgcagggggccaaacaaaaatgtttgtcactggatttagctctgaaaatgcctgtttgtagccattgtccttaagtattgtgatgactgaggatagttcaacctgaaaagttgtatagtttgttgtgattctgcagtaaagaaggttaggattctctagcttagggaagatcagattaaatttgtttttcctatcacaacagcaacacaagacacacaagacagtgattcttcctctctgcttttattcctgcttatgaggacagcctcttatgtaggtccgagacagtattcagtcccacactataacactgcctctggggaattgctttcgctcagtacttcacggtgaattaccctctcgcatttggtgtccaaccctgggtttctctctagtctcttgcttcactcactcctgttcctgactccttatcagcagtctgtggctaagtgaatggatttgaaatatctttttttcttcttcttaacacttagcagttgtcataatgatgggatttttgaccagaagagtttccaagatatgaactgt

SEQ ID NO: 6639 - DNA, 1021 bp, Homo sapiens
ctttaggatccctctctctggtcatccctgatcatcttagggccgtctcccttttctgatttttgacagctctgtttattttgcccatggctagtcctcttgttttgtgtctgctgtgtgttcttgcccttccattgtcagttctgtacatcctggttcagcttgtctcactgtggtagccccttctgcttgtcttcagccatcttggtttaatcctcataggtcatggatgaatggagccttgctgagcactttgagggcatttctgttgggcacaacctcagaaacgggaagtcttgaggcctgggggcgtgtggtcagtgaggcctccagaggtgggttaggggtgggcacctacaagggccagttgaggggagaggtgcagggattgctgaggagactttgtgagaatgatgtcaggcccgggaagctggtgtggaagaactgagctgtcagaaggagataccaatatcccctttgcagggtggtgatgggcatcaaacatgacgtggaacatgtccccttcatggagggtttccatctaaatgcatctgtgtgccttagggatcagtagttcaggggtggtggacttttttgagtgtctcctaatttctctgaggtgtctttggctctgtgtcaccaaatgtgcctgacctctgcatcccagtggttgctgaaagggaaacagtatattgcgtagtcagatgtcaggagtagagatcttaatgagaaaggccctggcagctggagagatgagaggacctagtggtcagcttatacccagactatctctccactcctccaagagtttgagtcccatagctgatgaaagaatttacatatgggctcccccctgctttcccactgaaaatctattctcatattttgggaaggagcatatgtcctttaactttcaatggtaaacaatctaggatagtgtttaaaggcatggattttggagtcacatatagttggtttgaatttctagcttcactacttaccagctgggtttgaccttggt

SEQ ID NO: 6640 - DNA, 1035 bp, Homo sapiens
caccacaggcaccgacccaaactggagagagcagagcatcaaagaaggtttcagtgtgagacaatgcctgggctgaggttagaagaatgagtaggggttacacaggccacaaaaagtcaggaggggagacagagagaaaagggagtttctggcaggaagaccagtatgtactaaaacccagaggtaaagatggcacaggagaggtggataggtctgctgggctaaagaatttgagtcgttgtattaaggggatggggagcccataaaggattttaggacaatatatgacataattaagatttgcattgtggaataatcctggcactgccacttacttactagctgtgttgctaacaacttacttaacctctctgtgccttgatcgcctcatctatgaaatgggaataataatagtgcctgcctcttagggttgttgcaagaatgaagtgagattgtataggtcaggctggcatgtgaaaatgcccttagtgaagattcgttactgttattcactgtaacagactggactggggctagaggagaccactggaaggcagagtttgaagcctactgctgggtactgcagagaaaatgaaggccacagctaaggcagaagcagcacatgaggccagttgaaaagctctcaagagggaaaactcacaagacttagctattgcttagatgaaaggggtgatgaaaagatggcattcacaatgacccccgggtttccggtttgggtggctgcctctgggaatacacaaatagatttggggcagggagatttggtgagttcattgtagatgagttgagattgagattcttgaggaacttccagcaggagatgcagatattccgagctgacctctgaggtctgaatggaaaaaagaagtgccagtgtggtcaagggagccctgggcctggatgaggtcaccagggtgagtgtgtgggaaggagggggtgtgggctgcggatggagctgtgacaacacagtcattaagggggcatgtgagtgaaatagaagagtccctagagaag

SEQ ID NO: 6641 - DNA, 1050 bp, Homo sapiens
agatgtggatgctgcccaagagggaagtgcccaaggcaggaagagggagcagaagaggctggtctcccagaagctggctgatttgagcagaggtaggggaggccagagaggcaaagttcacagctggacagcagcagggaccagtgtgagcagtgtggatgtagcttctgaaaagggttgccaactcagaagctcggcctcctggcccacatctgagatggtcagcaaagtggccttttagcagatagaggtgtggaccctgggaaacctcctcctcctactcagggcatcctgaggacctccaggaactgcctctttcctgtagttaacaacccccttccaatgcaactgcatttccctccataaaacaaacagcttagcccttggccagcccccgggggaggagagggcaataaagactgagaaatgtttctcaaggaggctgggagtctcctagtcttgtctgtcagctcaaagcccctgattagctagaggaatttagggcacagacatcatagttcctctccttgaaaggagagggctaagacaacttcagacgtgtggcaagtcagagatccctttactgtggaggccaaagcaagccagagggctgttcctcagtgctcacatgccctagacccttcctttaggctgtgagggtcccaagaaaagaggctagcctccttcaaacatccctgagtctgctggccacatccccaaggacctccagcccccaacctcagctctgatttaattatgggggcatttccatagcaatgagacattgacagatatgcggctgctctcggcctgcagcctagggagtcattggatcaggcctctttcccttcctcctttatccagtccactgatagaggtaaaggatatggaaaagaagaggccctaatccactgtcgggatcagagtcaggccatatttgaccagaataaaagctgtgccacctcaatctcaggtcccaatcccatgtccttgtctgtgcctaccggccaccctgtgctgctgggctgcccttcccaggagggtgccatg

SEQ ID NO: 6642 - DNA, 1086 bp, Homo sapiens
gcagtggacattttgtgtgcatatgaacttagagaacctacctcttgaaagttacattcatggttattttacaggtttcttgtatgttttacccaaaatcattttttctctttctggtgtattaatcaaaaaggagtctgaggtccaatattttagggaagagatacagtgttacatttagtaaaatgcatttagaattatcttgtgtgcaacaaatgagctgcttctgggtcccttcccatctctcctcaatcaataacaagatcaataacaaggtatcatccttcttccctttgcagaacctccaacatttactctggtggagttaatttgcctagtataatttatgtaaacaaatgcatatattcttccatagcccgtcactcatattcatctcataagcacttagcttttataccagcatctcaaacaagcgtgatggacttggtaaaccagtaaagatgtgcattgctcttctaatgtgaccagtaaagtgtacaagaagcttaaccttcaagaaacttggattgttggaattttcactgagcattccaacctcatagtggatgaatgtttagggaaatcaatagtctatagcttattctctttcagtaaaatgatacattttagcaaaatttaccagaaagttaattttttgttcagcatatcataacatccccttttttgcagctgacaactctacagtgaacaaatcagaatacgaattctggtaatggattcctatttcactttagcattattgccaatgtcagaacttgattagttaagccagataatgaaatccagtctttacggtacagaaattcttaaaaattaatttggtttttgttattcttgttaactttcttccttttctccttgtgtttttcccaagcaatgtgttatttttgtaactatcttaaggattctttgataaaaaattaagaatttgaaactagttgtgacaactcattctaatttctgctgttacttagattaacatcttaatgtataaagagggtagcataagtttggtatttttcttttctgcccttgtccagcaaactcctcttcaactgattccct

SEQ ID NO: 6643 - DNA, 1043 bp, Homo sapiens
gtacaccagtcatactgcattgggacacagcgtgatttttttttttttaatgagaaattaacatttatctgccttcaagtgtttatcctatacgtgttttaaggtactatacatttaaatgtagaagtgttacatttctgcaaccaggtagtcctaggtctaaaagaatttccagaagtacctatggcatccttaacttggtacaaatatgcagttgtttgttttagggagtggcatctttaattctgttaaggtggtaaacttttcatagctttggaatgaaaatgagcatttgtcattagctttaaatttcttggacaccagtatttatccagttgataagtaactctttttctgcattccatatatggtgactaatctcagccttaatacttagaattttaaacctttcattagggtgttctagacactgaataaactttactaaagttggaaagtatatttttcactaatctaacaaaaattaaattttagcaggctctaagcagaataaattccctgaaaaaagaaaaaggaactctgtggactcagatctgaaaagcacaagagaatctatgataccaaaagcaagagagtccttccttgagaagcgtcctgatggaccacatcagaaagaaaaatttataaaacatattgcactgaagacacctggtgatgtgttgcgcttagaagatatatccaaggaaccgagtgatgaaactgatggctcttctgcaggcttggcaccttcaaattctggcaattctggccaccattctaccaggaatagtgaccaaatccaagtggcaggtaccaaggagactaagatgcagaaaccccacttacctttatctcaggaaaagtctgcaattaaaaaagctagcaaccttcagaaaaataaaaccgctagctccacgacaaaggagaaggagacaaaactacctttactttcccgtgttccaagtgctggttcctctctagtaccattaaatgctaaaaattgtgctcttccagtttctaaaaaagataaagagcgttcctca

SEQ ID NO: 6644 - DNA, 1035 bp, Homo sapiens
atcacctgagcccaaggaggtcaaggctgtagtgagctgtgattgagccactgcactccaatctgggtgacagaataagaccccgtctcaaaaaaaaaaaaagtggggggccaggcgcagtggctcacgcctgtaatcccagcactttgggaggccgaggcaggtggatcatgaggtcaggagatcgagaccatgctggctaacatggtgaaaccccatctctactaaaaaataaaaaaaaaaattagctgggtgtcgtggcgggcgcttgtagtcccagctcctggggaggctgaggcaggagaatggcgtgaacccggaagtcggaggtggcagtgagccgagattgcgccactgcactctagcctgggcaacagagcaagactccatctcaaaaaaaaaaaaaagggaataagatgggttctcttgttcatagactggatcaaaagatccaggtttttatagtatactgcactaactaataatataaattcctttctgtttattacaactagtatctgatagctgaaattctagatcgaaagcatgggtagaattttttgtgtttttttaatggaaaatacatataaaatttaccattttaaccatttttacatgtacagttcagtggcattaagtaaatttatatgttgtgcaaccattatcaccatctagctacagaactttttcatctttccaaactgaaactccataccctttaaacaataactccccattttcctcttcctcccaccctcagcaactacccttctactttgtctctatgaaattgactgtgttttagttatctcatgtaagtggtattatatttgtccttttacgactgtttatttcattcagggcagtgtcttcagagttcattcatatagtagcatgtgtcagaatttccgttctttataaagctgattattccattgtattatgtatataacacattttctttagtcatctgtcagtggacctttggattgcttccactttttggctactgtgaataatgctgctatgaacatg

SEQ ID NO: 6645 - DNA, 1067 bp, Homo sapiens
atgtgccaccatgcccagctaatttttgtatttttagtagaggcggggtttctccacgttggccaggctggtcttgaacctctaacctcaggtgattcacctcccttggcctctgaaagtgttgggattacaggtgtgagccaccgtgcccgaccacttaaaatccctttttaagcaattcagggttttacataaagggaaaatggatattgttaagtgtaaagaaagctataataaaaggacaaaatgaaagagtacacactggaaaaaaatagcctaagaaagaacaactatattatttagctttgttcaatgtctcctctttcttttgataggtatcagtcctacatcgctatcttgtgcagatgaagccttctgatttgttaaagaaaatggtcttgaagaaaaaggctgaacaaccagatggcattattgatgacagtcttcatttagaacttgaaaagcaggtatccagtgctagaaggtctcaaagagtacatagaagcataactgttatcagcttactaaccatagactgatatgtaggcatttctggatttggacactagacacattctagcaaacataattttaaagcgaataatatttttaatttatcactgtcatgaaattcttccataaatttgagagttgaaaatttaggtaaaaggatgattgttggtaatttgctcccaagagtattttttgtagccctttattagggcagtcgtgaggtcatgaatcatggtaaaaagaatgcacttgagttagaaatgagaaagcctagtttagatgcttcgcttttacttactgaccagctgggttaacttgaccgtatcctttatccttcctgggcaattttcctaatgtgtaaattggaatgacatctatgctagctaattcataggtgttaattttattcatttctctaacaggcatattacctgacctacattcttcttcatttagtcggtgaagttagttgttctcattctttttcttctggacaacgggtaggtagtgtttagtgttgttgctgctgtttttaaataggtgttactgatgat

SEQ ID NO: 6646 - DNA, 1053 bp, Homo sapiens
atgttcttacatggtttttatattttatacattttttttttcgagacggagtcttgctctgtcacccaggctagagtgcactagcacaatcttggctcactgcaacctctgcctcccaggttcaagcgattctcctgcctcagcctcccaagtagctgggatcacaggcgcctgccaccacatccacacccagctaatttttgtatttttagtagagatggggtttcaccatgttgatcatgttgctctcgaactcctgaccttgtgatccgcccacctcggcctcccaaagtgctgggattacaggcctgatccaccatgccggctataaattactttttatgattaaaaaagtcagtgactgggcatggtggctcatgcctgtaatcccagcactttgggaggctgagtcaggaggatcacttgagcccaggagttcaagagcagcctgggcaatgccatctctgtttaaaaaaaaaaaaaatttagtgattattgtaaaacttatataaagtaaaacctgaaagactcctacaatccagtgccctcctgtaaatttcttcacaatttactaatatattacatataatatactaacaattattttaacaaaaatgtaatcatagtatcatttgcaacttcctttttttcctctttaaaaaaaaatttttttttctttttgagacagtcttgctctgtcacccaggctgaagtgcagtggcacgatctcagctcactgcaacctccgtctcttgggttcaagtgattctcctgcctcagcctcccgagtagctgggactagaggcatgtgccatgatgctggccaatttttgtatttttggtagagacggggtttcatcatgttggccaggctggtctcgaactcctgacctcaagtgatccacccgcctcagcctcccaaagtgctggtattacaggcgtgagccactgtgcccggcctcctctttaagacattagcacttggctgggcgcagtggctcacaactgtaatactagcactttggtaggccgaggcatgcagatcgcttgagc

SEQ ID NO: 6647 - DNA, 1071 bp, Homo sapiens
taagtctttgagaaatcttatatttatgttttgttgtttttgtatttgtttctaaccttaatagattttcttttaatgctggtcatgtactgatgtggtattaaaacagaaaataatttaatagcaaaactatactaatcagcttaacattatttaatctgcttaactaagcccctccatgtgtgcagtggtgagaaaaacatcctgcacttattttttactgttttttgttgtttgactactgaatgtgaaatttgaatctgattaccataaattttcagagaagtcaatataaagattttattacttgtcttatcaaagcccattgtctgatgattagtagttttataaggattaattcataatatgattaaattttgctttaccctcttttttctccttcccttttttaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaaacaaacagttgagaa

SEQ ID NO: 6648 - DNA, 1048 bp, Homo sapiens
ggctgaggcaggagaatctcttgaacccgggaggcggaggttgcagtgagctgagatcatgcactgcactccaacctagcggcagagcaagactccgtctcaaaaaaaataaaattaaaaaaataaataaacatcttggggaaacatcactttaggaatatttatctggccccaggcactggatggatgaaaatagggtgagtctggaggcaggaaaagcagtgaggaggctgggggcatcatttgggtcagaggaaggggcctgagcaggcttatggagacgggggacagatggtagtggcttgtaccaggtgagggagcaggaggagacacaaagaggcctgtatggatttaaaccctgggtaacaggcaagaggaggaatcattaacgtggcaaaggagtcaagaggctggcagctgagggcatttgacaggcagagaagaccagtgtggctggagtagggtgagtgagaccagaggaatgggcagagtcccatcacacagggctaggagcatgtgggactctatattcaggtcactgatgagccgatacagtggtgtgatccacttgactttttttcagacatggtctcactctgttgcccaggctggagtgcagtggttcactgcagcctcgacctcctgggctcaaacaattctcttgcctaagcctcccaagtagctaggactacaggtgcatgccaccacatagagatgaggtcttgctatattgtccaggctggtcttggactcctgggctccagtgatcctcccacctcagcctcccaaagtgctgggattacaggtgtgagccaccacacctggctaggtttacatttttagaatatcccttggaaagtggttggagagtagcaaaagtgtgttgtttggtaaaatatctctggaaggaaacttcagacaatagtaacagcagtcttcttggcaggcaacctgggagacagggataaatgggagactccctgtttataacatacccctttgtactttctaagttttatactatgtacatgtattcattgactgaata

SEQ ID NO: 6649 - DNA, 1050 bp, Homo sapiens
cgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacaggtaaccctttgagaaatcactacttagagtaaaggggcagaagatcaggtgacaaaagcaagtgggtttgggccatgacaatgttgaaaagaaggttggccctttccccccagttttaaagccctgacctatgtcttggtttcaagggtaggacttcctcctcacccaggtctgttccaccccactgcagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggtgagactcccagattccagccaccttgctttcccagacatatcccagcactcaggaacctttggttccttttccagctccagtaggaactcccccatctccttaggtttggagtttttcaaagaatgagagggcagggctggacacactggctcacgcctgtaatcccagcactttgggaggctgaggtgggaggatcacttgagcccagggatttgagaccaacctgggcaatatagggagaccacccctctctataaaaaaatttttaaaaattaggctgggcatggtgatggcatatgcctgtggtcccagctactcaagaagctaaagtaagaggatcgcttgagcctagtaggttggggctgcagtgagctgtgatcacaccactgcactccagcctgggctacagagcaagaccttgtctcaaataatagtaataat

SEQ ID NO: 6650 - DNA, 1102 bp, Homo sapiens
aagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcctttgtttctgtgctttttct

SEQ ID NO: 6651 - DNA, 1068 bp, Homo sapiens
cttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccgaggggtccctactgggccctcccactcagacagtggccggtcctcctccagcaagagcacaggctccctagggggccgtgtggctggggggcttttgggcagtggtactcgggcctcccctgacagcagctcctgtggggagcgctcaccaccacccccgcctccacctccttcggatgaggccctgctgcactgtgtcctggaaggaaagctccgagaccgggaggcagagcttcagcagctgcgggacagtctggacgagaatgaggctaccatgtgccaggtgtggtcagaggcaatgatggggaaggggcatggcaggacatcccaaggccctgggatgcaagcggcatttccattttggcagggaacgggggttgggtagttgtagttgtgacccccctgccctccccaccagttgtctggtttaatgtgtggagtagccaggtgtggtggctcacatctgtaatcccagcactttgggaggccgaggtgggcggattgcttgagctcgggagtttgagaccaacctgggtaacatggggaaaccccatttctactaaaaataaattagctaagtgtggtggcatgtacctgtagtcccagctacttgggaggctgaggtgggcggatcactggagcccaggaggaggaggttacaatggactgacattccaccattgcactccagcctgggcgacagagcaagactctatctcaaaacaaaaaacaaaacttgtggggtggaaaggagtcagagtgcatggattc

SEQ ID NO: 6652 - DNA, 1053 bp, Homo sapiens
gacgacttcgcacagctgctgcaggagcgcgaacagctggagcggcgctgcgccaccttggagcgggagcagcgggagctcgggccgaggcttgaggagaccaagtgggaggtgggccagaccaggaggggcagggagcagggtcacacagggagaaaccctggaaaaaggggcccagccccaccctccctcagcctgccacccccagaggtcctcccctttctcacctccgtgagatgaggttcccctctgtccctttctgggaggggggtctccttgttggccttgtctagtggcacgtagccacgcttccagccagtagtaagaatgtggtgcttgtggtgtggaggcactattctaagcatgttacatggaacagatcatttcatccttataacaacactgagggggctaccattagtctccccattttagagatgagtaaactgaggcccataaaggctgaagccccaaatctgaacccaggcagtctggctccaatatctgagctcttaactaggtcactgtagtacctctccagcaggcacctgggcactgccctccattgtccccactcctgcagcacttgccaggacccagtccccagtccccagtccccagggcttggtggtacttgcagtgtcttgtgatgctttgaagacaccagctttgaagcaaaaagttctaggtctgctttccacttaagccccatcttaactgtatgaccttggacatgtcactagacttgctttagtgtctccatctgtaaaatggggataaagatggactcttctctcccaaatgcccagcatgatgtgcagggcctgtccccccaggagaacctgtctcaccatccttccccacttcctcccacccccaggtgtgccagaaatcaggcgagatctccctgctgaagcagcagctgaaagagtctcaggcagagctggtgcagaagggcagcgagctggtggctctgcgggtggcgctgcgggaggcccgtgctacgctgcgggtcagtgagggccgtgcgcggggtctacaggaggccgcccg

SEQ ID NO: 6653 - DNA, 1096 bp, Homo sapiens
ggtcagaggcttggctactcggtgactgcagccaagcagggaatcttccaggtggtgatttcaagaatctgcatggcgattcctgccatgggtaaggcgggagtggctgggtggggcataggagactctgagagaagcaggtgcagttctcagggactttggaggactctggggagagagggaggagctttgaggggggtcacccttcacagttcctgactttaactccactactaatgttctccttcttggccctgctctccccacagccatcccaccactgatcatggacactctggagaagaaagacttcctgaaggtaggcgactgtacctctcttgtcctggaatgggcgatggctgggagaagtgaccaggccccaactctctctccagcctcgcctgattctctaagacttgccagcccttctcctgacccctgcaccgcctcctccaccttcgttcattcagcaagaatgaactgggctggggtgaaggaactctgcaggggcaggaggagaggacaaaggaaggaaaccaacttcatcagtgttactccagtggcttctgacacacagaaggggactgtcatagtcatgcttgatctcatgctcattcttttaccccctagtgcctccatactgagaggtacacacgggtgaacacgcacacacagacatgaacaggacacgaaagcaaagcacaggaacaagctctggctcattcacagaatcatttattcacaaatgtattgagtgccatgcaccaggcatgttttagggctgaggagatggcactgaacacaatggttatggcccctgtcctcatgaagtttatagtctgatgcagaaaccaataaacaaggaggcacccaataaatacattcttagaaagtgtaatatgtgctttgtaggaaagcaatgggggtagtgtaattgagattcatgggggagagctgtttagataggatgatcagagaaggggtctttaatgccgcaaaggatgaggagagagccaaataacgcagagaagagtgtttggggtacagaaaacagtcagtgcaagggcactgcagtaggaggggcttgcacatttga

SEQ ID NO: 6654 - DNA, 1601 bp, Homo sapiens
ggtgttttgttagagtcagagacctctccttgggtgattccattcgtcagccccacaagtccccgtctctggcctttttcagggtctccggcagctctctgacagttccccttctgtctcaggtcgacacttattccaaggaccagggattactcacaactatccgccagagtttgctccgccctttctttttcctgtttaaaatccgcgggctcttagtgttctcggttcctagatttcctgttctgattctcgcgacagttgcgaggcctcgcgtgaagttcccttctagtccctatttcgaatttgagaccgggagagagtgtctgcccttgcccacctcctcagaacccctctggccagggatggcgcctacgtggctcgggagcccctgaatgaatgggcttggcccaacttaggggcgcattccgacgggagagtcctggctgtattccgaggctccagtgcgcatgcggagtcgatcccgcgcaggcgggcggggacggcagccgggtcttgtgggcggagcctgactaagtgccgcccccttgccggctgcagattgctatttctgccccccaccctcgcccatccccccgcgagctggactgcgccaaggcttctgtgagccgcttggggccggccggggcggggcctgcccgacccgggtttggctggcgggcccctaggaatgctctcctccccgcccccggcccaaagtgccacggtggcggtggtggcggccgcgaggccgagtgtctccggccctgccagcctcgcaaccgtaacctgtaatcccgacccgagggacgcccgccggggaggcgccagcccgcctctccctgcggccgctggtcggctccgacctcgaatcacccggctcacccgcgggtcgcagcacctgccggatgtggggaggaagaaggaggccagatgagggaaggcggatgtaggcgcccagtctgtccgcgccttggtggggcagctgggtgggcaagcctgcggtcgctcccgggaaccagccctgggctgcggggagacgaaggtggttggtcctgccctccaggagcgccccgacatcgacgtaaaatgacttggcaccagagctcctgccgcctcccccttatgcagctgccctcgccgacgccagggactgtaaaatcagatgggacagggcctagccgttcagccaacactttgagcttcccagccaaactcctacccccactccccgcctccggtcctcacccccttcctctctcccagcctcggtgtctggttacggctcctctgctcgcattgtgactttgggccaggctgggggaaatgacccgggagggtcccatgcggctacataaaattggcagccttagaactagtgggaaggcgggtgcgcgaagtcgaggggcggagagagggggccggaggagctgctttctgaatccaagttcgtgggctctctcagaagtcctcaggacggagcagaggtggccggcgggcccggctgactgcgcctctgctttctttccataaccttttctttcggactcgaatcacggctgctgcgaagggtctagttccggacactaggtgagcactct

SEQ ID NO: 6655 - DNA, 1049 bp, Homo sapiens
ggttcttaaccagaggtcccccaagggctctttgaatgggcttcaggggctctgtaaatctcagaaatttatatgtgtacccaggtgggcacatttttctgggagcaatattatataacacccaggattctcaaagcgggtggggatccagaaaaggtaaaggctggaatcaggccactgtagggaagggaggcaagccactggggaagggggatggaagcggcctcctcccaggcctggggagcagggaggcagctgcttcaaaattcaggctgggctccaagcctgctcctggacctgccctgctttttctggccacacccagctcttaggacctcagctggcaggaagacgtggggcaccatctgagggcaggacactcctttggtcccctccctgattctccccttccctacttcttttgtgagctgaattccttcagagcactgtgacaaggtgaccataccacatgcaccagcctcctccaggcactgtaatcctgcttggaaggagcggggagtgcttgccctttggaagtactgggggacatagacagaccactgagtgacagagacaggaagggaggagaagagacaagttcccagagatgctcaagtcctgggtgcccactctctgcagcctctagaacagccttctcttttggttccaagcttttgctcccctcatccaagggttgggatgatttgtgtcccttcctttcctggcacctcctgctctgtctctagtgctcaactcatttcctgggggaaaccttctctgccctgttcagctcctctgcgctccttagcacattcccctggatgtcactgtcatattgccaagaatgtgttgctttgtctgtctgtcctgcctctctctctccatctgttgtgaacttgggaaggaaggacctgaatcacctctccatgcccctatgccagcccagcatacaccaaggggtccaagcatttgttgagtaaataaactaaataaataaacaagggacaaaaatggagccagacagggaacttagcctgtgcctcagagag

SEQ ID NO: 6656 - DNA, 1055 bp, Homo sapiens
tccaggagacaggaggtagagactgccagtcttctaaatcctagatttggaagtccaagaatgtcactgtgggtcaaagccagtcaaggccaactacagagggaggagaaataatgtctacctattgataggaagggtggcgtgcataaacaaggaagggggaattgctgggggccaccttttgagacttgctaccgtaggtgctatgctagttggatgttaaggctaaaaataaaaatggtatcggccaagtttgtgggtcataatgctaggaatgtttaggaggcatctctttttttgaggttaacttcggaaggcactaacatgatctcctgcgtgacttcccttaatgatgtcactgttgacataatactgggtgaattaatgtgattaagtaaacttgcttacttacttcaggaaacagaggtatctaaacagattacattttaaaataaattgtcagatgtttcactgtaatggaattttctttacatcagtgaaattgattaccaggtagtgggatgaacatctgaaactagttcttagtttaagttgtctgagtttttgtgtatactttacctattcccagtttaaattggctttcaaacagtttgttttctgggtactcttataggtgttggggtatgaaattagtggtaattctttttgcctattttctttttttttgtctgagataccctgagtctcgctctgttgcccagactggagtgcagtggcacaatttcggttcactgcaacctccgcctcctgggttcaaatgattctcctgcctcagcctcctaagtagctggaattacaggcgtgtaccaccttgcctggctaattttgttgtatttttttttttttgagatggagttttggtcttgttgcccaggctggagtgcaatggtgcaaactcagttcactgcaacctctgcttctgaggttcaagtgattctccttcctcagcctcccctgtagctgggattacaggcatgcaccaccacacccagctaattttgtatttttggtagagacagggcttttccatgttg

SEQ ID NO: 6657 - DNA, 2719 bp, Homo sapiens
gatgaatagatagattttgacagatatctctctgaggtaggcagtcaagcggtggccagagtggaagaattactgtccagatttacatataggtttcctgattatttaaattaccgatgaagtgcagtaagactctactgttgtcacagtatcatttcagttagctattggcgtttagaatcacaaaataccagcatcttacagtgataggtatttattctcttgaaattgtgggtttgctgggtagtggatgatctaaacttggcttactcaaagtcaaaagcccaaagtcaagcagggcagggagtaacttgcacaatactatagtgacagtaatctactgcagtgatctagtacagttgatttagagaagaatggtaagatgcttattatgacaactattgtgctttcttctttctgctctctattgttgacactctcctgatagcactttttcattttggttgctgaataatacctgttgattggatactcctagaatcataatgtaatacagcagatttcttctcttcatgttatgtagaaaaaaagcataaagaaataatcagaatcttgactattccacagtgatgccctgaaaagttcagcaatatcatggtgctattcttctatctttgggactgataagcttgatgtcactggaatggcatttgtaacagaatttgaactgtaacagagtttacatcaaggtcatacataataacccaacaactcctttgttaacagttttaacagctttccatctcttcgctgcacctaaacttaaggttgcaaagatcaggtgctgatatatttagatgtctggaaaactttcatgctttcactgaaaagtcatagagacagatatccaggaattatagcatgtggataaatatttttgtagcacagattcataaatccttgtatgcaggaagtactacaccaaactgttaatgtggttatttgtgagttgctgaattatgggtaatatttcaaaatatttaatggtattctgaaaatatactagtaaatacacagaaaagcattatttaggtgatatttcttttaattcttttttttttttttttgtatccccggagcgagtgcaccgttcctggaggtactgcaataccaggtcgatgcatggagtggacggagcaagctcctattccatctccctgctccaaaaatctatttaatatattgtcctcagatagaggacatatcagatactaaactgatgagaacagatactacacttgatcttagccaaaaggccgagaagtgattttaattctttttctttttttctttttaaaatttttttatttttattttttttttaagatggagtttcgctcttggtgcccaggctggaatacaatggcgcgatctcggctcaccgcaacctccacctcccgggttcaagtgattctcctgccttagcttcctgagtagctgggattacaggcatgcaccaccacacccagctaattttgcagttttagtagagatggggtttctccatgttggccaggctggtcttgaactccggatctcaggtgatctgcccgcctcagccttccaaagtgctgggattactggcgtgagccaccgcgcttggccctttttttttttaattttttgagacagtctcactcactctgtcacccaggctgggtgatatttcttttctttaattctttttctttttaaaaattttttatttttatttttattttttttgagacgaagtttcgctcttgttgcacaggctggagtgcagtggtgcagtctcagctcactgcaacctctgccttccgggttcaagcaattctcctgcctcagcttcctgagtagctgggactacaggtgtgcatcaccacactcagctaatttttgtgatttttattagagacagggtttcaccatgttggccaggctggtcttatactcctgaacttaagtgatccacctgtcttggcctcccaaagtgctgggattataggcatgagccaccatgcctagacttctttcaattcttttatgttttacggattttctacagtgaatatatatcataatcggaaaaagtaaaatttagtatattgagtatatgcatttataaaacaaaatgatcatggactacattgtagcaagtgtactggccagtgggctgacagtggctgcttaaacgactccttactctgagctccagttttcttaaccagaaaatcagctattgttaattttacctacttagggtctctctctatttttcctttcagttcatgttaatttctaaattgccatgtataagtaaggggttgtcaatttacaccataaaacccctttatgtatccaaggttttcataggaaatttaggactgtatgatcctaaattgtgctggagtaccacattttctgttaagtagtacttggcaataaagtataggaaaaaaaaatcagtgggttgacaaagagaggtcatgatagtgtacctgtaatgtaatttgataaaaaatgtgagcctgaactgattgcaaagcattgttacatataggggaagacattatgggggcagaggggggtgaagatacaaagttgaataaaacttctctagagcttcacaatctaataagataggcatttataaatatctcttaaggcgcactttgttaagtgctaaaatagtggcacaaagagctatagaatttaa

SEQ ID NO: 6658 - DNA, 1081 bp, Homo sapiens
ggttgctgagagtagggtagaacaaatgaagaaaaagagtaaaatatagctggcatcagtcatgttaagggcaattagagggttatcaaagcagtaggtaggtaagggaaaatgagtgtttggtgggtgaagatattgggatggtccctaactataataaggagactttgaatttaagatatattcgtataaataaagatgggcagggccgggcgcggtggttcacgcctgtaatcccagcactttgggaggccgaggtgggcggatcacgaggtcaggagatcgagaccatcctggctaacatgatgaaactcagtctttactaaaaaatacaaaaaattagccaggcatggtggtgggcgcctgtagtcccagctactcgggaggctgaggcaggagaatggcatgaaccagggaggtggagtttgcaatgagccgagatcgtgccactgcacttcagcctgggtgacagagcaagactccatctccaaaacaaaacaaacaagacagaaaaaaaaaaaaaagatggtcaaagtgatagaatatatgagacttggaaggtggaaagctgggtgatgattagatggagattatatattattctgtacttttttgtatatttaaaagtatccatgataagaggttaagaaaagtttatctgctgggccaaatggtatttccagttctagatcccggaggaatcgccacactgacttccacaatggttgaactagtttacagtcccaccaacagtgtaaaagtgttcctatttctccacatcctctccagcacttgttgtttcctgactttttaatgattgccattctgactggtgtgagatggtatctcatagtggttttgatttgcatttctctgatggccagtgatgatgagcattttttcatgtgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcat

SEQ ID NO: 6659 - DNA, 1062 bp, Homo sapiens
gtttttcctagtactatgaacagattgtgtatcatcttcatttattttaaagatgctgtggctggtccctcagctcataatcaccatcagccatggcatctttacatagaggaaaaggatgtaattcagtacaattaaataaggtaaatgtaaaggtgctttgtaggtcatagggtaaggtggtggtggtggtggtgctttcacaacaacattctaacacaaagcaattcatacagactcccaaagtttattgaataggcattccactctcattccattttactctttaaatatatatttattcatgcctgctgtatgcaaatttttgattccaatttttttaatggacatacagtaaaatggatttttcttaatgtacacagttttaggaattctaatatgtgtagtagattcatgtaaaccacaatcaggataagaacaattgtatcactcccccgcaaaaaactcttatactcttcctccacctctaaccccctcttcctcacttcattttatgtttttgagaatgtcatataaatggaaccgtgcaatatgaaatcttctgttactgacctcttccgttcagcataatgcctttgagctagattaatccatgtttttgcatgtatcaggagttcacgtcttactattgttgattagtattttattgtgtagtgtaccagactgtttattcactcctgaaggacatttgggttgtttctggttttggtgattataaataaagctgctataaataaacacttgtgtatagattttgtgtgaacattttcatttctctaaatacccatgagggagaattgcgtgataaatgtaggtttaacctttttagaaattgctattttccagagtgattgtaccagttggcattcccacaagcaatgggtgagagttctagttgatctacatccgtgtcagcatttgggattatcagtatttttaattttagccattctaataggtgtatagggatatcctattgtggtttcaatttgtatttccctaatgcattcctcgattcttgatgcttttattgatggagga

SEQ ID NO: 6660 - DNA, 1034 bp, Homo sapiens
gctaatttttgtatttttagtggagatggggtttcaccatgttggccaggctggtctcgaactcccaacctcaagtgatccgcccacttcggcctcccaaagtgctagaattgaaccactgtgcccagccccagttataacttgtttccatgggaaaacatccgctttgaagcagtattcagtaatatattgaaatgagaaataggcggtcaagcagtgattcaggtttagtgttcagtgtaattaagaaaaggtgacttaagttgaagaacattgatgtatctgtttttaaattgcacctaattataatgacaacttacaagatctctttccttccttctctcttggaatgttgactataaatttcacataatttaaaaacaatttaaaagctagtcaaattaattgagaagaatcctgctttatcaaattttgcctgtaatcatatccagacatggcattttgaaaatcagaaaggattgcttccacttatatcagagtttgaaagtagaaactcttttcatgtaggtatgggtcacctttgattatatggtagtcttctgaatatggtcctcttacctgacacatatgcacctcatcaataaactacatacaattcttaggtttatatgtggtcatgttacaaaggatttcttaagtactcttaaatgtgttctactaatgtcttgtggaaaaatataatcttttgaaagcattcgtgttaaaaagaattagacgtgatttatctcatttagacctgttctttttcaatgtgtctttaaaatgtaggtacagtatataagaattcatactaaaggatcaactgagactttgatttaaatatgttataaattatagtatggaggcctgcataatatactacatatttttttttcctaagaagcttatttaaatggttctgttaagtgtaggaatgttctgatgattatctttttaattaaaatgagaaatctttgtttaaagtggcactcgtttttttatggcctgttacagtctctgtaacaatcatttct

SEQ ID NO: 6661 - DNA, 1107 bp, Homo sapiens
ggtagagacggggtttcaccgtgttagccaggagggtctcaatctcctgaccttatgatccgccctcctcggcctcccaaagtgctgggattacaggtgtgagccaccgcgcccagccaatcctagctatattacagtctttgcctttaaagttaatttcaccgtctgtgccatcttggtattggcatctgttgataccagttgaagttttcccctttttagtataccaagtaatttttgcgttatatccttggcttttttaatattatgcaactcagttttgtttaaattgtattgaaaatgttgatatttttgtcaggcattcaacccagttggcttcagtctacaagttgagatttctgtaggattgtggtttcaatgtctgttacattttgaaagcctttgcagttctattgagatatattccatgcgtgtgccacttgatggccattgtggaatctggatgatagtccatcttgtagttcagttctcaaagtctatgcctggccgagtgcagtggctcacgcctgtaatcccagcactttgggaggccgaggtgggcggatcacgaggtcaggagatcgagaccatcctggctaatatggtgaaactccatctctactaaaaatacaaaaaattagccgggcgtggtggcgggtgcctgtagtcccagctactcaggaggctgaggcaggagaatgggatgaacccaggagacagagcttgcagtgagcctagatggtgccactgcactccagcctgggtaacagagctagaatccatcttaaaaaaaaaaaaaaaaaaaaagtctatgccttactgttttgggttatatccacccatgtgcagcttgggggtgaacataggagttcattaaccactttatggggccattttcttgagttcctccctctgtacaatctccccagtactatctggttccctggggccgcctttttcagtcctccagccagaaagctaggactttatttaatcctgcatctgttactgcatatggggctacgcaatgggaggctagaggaaaaaaaaaaagcaatgaggttttgtctcacccttttaggatcacaactcctctgatcagagagg

SEQ ID NO: 6662 - DNA, 1028 bp, Homo sapiens
gtattttgtggggaggtattttgagactatttaagtatcctcctccttatcaaacttacagtttatattttgtttcattttattttatttcattttagagatagggtcttgttctttcactcagggtggagtgcagtggcgtgatcctcattgtaactcctgggctcaagtgatcttcctgctcagtctcccaagtagctggaactacagatgcgtgtcaccatggcttctttttttcctgttaattctttttgtagaggcaggatctcaaaatgttgctctgactggtctctaattcttggcctcaggcaatctgctgggttacaggtgtgacccaccacacttgtccccagtttattttttatgtcattaatggagtcatagatttcaactttattcagtggcttattttattagttatctattattacataacaaattacctcaaattgagtggcttataataacacatacatttaggctgggcacagtggctcacaccagtaatcccagcactttgagaggccgaggcaggtgggtcatttgaggccaggagttcaagaccagcctggccaatatggtgaaactccatctctactaaaaatacaaaaaattagctgggtgtggtggcgggtgcctgtagtcccagctactcaggaggctgaggcaggagaatcgcttgaacctgagaggcggaggttgcagtgagccaatattgtgccactgcactccagcctgggtgacagagcaagactctgtctcaaaaaaaaacaaaaacacagacatttatatttttttgggggggtgatttacaagtgagttgtatttaaactttaaatggcgaatagttattacaatattaaatttttcaaaaatatatagaaaaatgaatacttaatacttattttcaataaatttttatgagctccagtatttcagagtgccacctcccaaaatgacagcatgatataccttggcaatagtttagacctcttctagaattttctcacatctgctttttttttgcc

SEQ ID NO: 6663 - DNA, 1042 bp, Homo sapiens
tttagaaggttttaataccaacagctttctaggtgtcgtcttcttcctcttcctctcccctccccccctcccctccctcccttcctcctcctcctcctcctcctttttcttcttcttctctctctctcctttctctctcttttctctctcctttttctctgtctctcctttctctctctctgtgtccctgtctctctttgttgttgttttcccttctgtttgggttgtttcttcccctcgccttataccccccaccccccacagaccccaatccatctggaaagatgaagaggcagctgctatggtaactgtgcattttggttaatgaatagcagactaacaagatacataaaacatacgcaaactgtgcagagtttgttgctgtcaaagccgtagggatacaatactttttcttttccttctaaaaaaaaaaaaaactctcttaactgtggtgttttgttttctaatttaccattcctaatattgtaatgtttctgtgaactcctcctctttctgcttagtctgcacagtattacaccctgtggtgagtttatgggagctgagttgaggtgcatagaggaaaataattgatcaactggattaagaagtagatttcctttagactgatacatagaagaatagggacaaaatgtttttgactaaatgtttggttttttgaacgataacttctttttttacctcctttccttttggccactactgccccttttgggattctctctggggttaaagccagtaagtagtgtgtttcttaaagatgtttctatcataaaggtcagctgcaactggaatattgcgttcagccaagccttaaaaattcctgtaatctgtgccatcctgtctcatactgtcccatctcatagttgtcctctctctgcagtgctctatgcccaggtctctgtggctgggctgctccagcctggcggacagcatgccttcgctgcgatgcctgtataacccagggactggcgcactcacagctttccaggtactttctctgtctctgtgggttatttgcggg

SEQ ID NO: 6664 - DNA, 1065 bp, Homo sapiens
gtactcacctgtcccagctatctggaaggccaaggtgggaggtcaaggctgcagtgagccatgattgcgacactgcattctagcctgggtgacagagtgagaccctgtttcaattaaaaaaaatagatagatagatagatagatagatagatagatagatagatagatttatatggccctagaatactttagctatcaagtgtaaccagtaattttaggaaaatcttgagctaagtgaaacgtgatattttaacattagctagggttccatgtcaaaggttgaaattgtattgaattcaggagagatgttgtattttattccttaagaatgcttacaagtctactgaattttaccatgtacaaagtgaaatgttaaaatggaacaatacaggaaaattaggcattattcattatatatatggaaaacttaattttacatttgagattttagaggaatatggattatcgaattgaatatacattaacattcaaattctattacaaaacaataccataaggaaaattatcctgtgacagaaatgcttctcattctgtagctgataccctctctattgtatatgaataatttctgtgtagcacaatttctgtataataaatgtagttattttttatgtatatgttaacatttgacttgtatttatcccagctacacccttcaccttaggggtttgcagggaatgacaaatcaaacatgtttttgtttgtttgtgcagaaatgttttgttctcctaataaaatgaattattgtttattatggaatatgtacattatttggtaaatatataaacaagagtatcacccatatgccttccactttaagataattattgctagattaacatgttagtgtcctttgatctgaaatgacttatccatccatgtgtgcctgtgcgtgcacacacacacacgcccaaataatggtttcatttttaagtattttattacatttaattaaattatgagatatacagttaaaacatttaatattcattgtagaaaatagaagtagaaagaaggaaggattttaaatgtcctcccagagat

SEQ ID NO: 6665 - DNA, 1017 bp, Homo sapiens
tcttgcttttactttgttggttctactagaaagttttttcttggccgggcgtggtggctcatgcctataatcccagcactgtgggaggctgaggcgggcggattgcctgagctcacgaatttgagaccagcctgggtagcatggtgaaacccagtcactactaaaaatccaaaaaattagccaggcgtggtagtacatgcctgtgatcccagctgcttgggaggctaaggcacgcgaatcgcttgaacctgggaggcggagatagcagtcagccgagatcacacccactgcactgcagcctgggtgacagagtgagactgtctcaaaaaaaaaaaaaaaaaaaaagtgtaataagtcagaatacaatgtagacacgtcttgttttgaacacaatttaaataatgtaatttaattactgcctaagattgcatatacttctttgatttgaatgatggaaaaatttctaggaacttagcctgggtttgtttcctcatcttttctttgaagccagaaaagcatagaaaagcatatgtaagcactttgacaaatgacataatgtagcggcatatcagagtggcacaggtattttaaacctagctccagttcctgaagatggtgaacatctgcttagaggtactgtagagctccacaatgcactaattgaattactcttttctggagttgcgactgcactaattgaattagaatctctctctctctctctctctgtctctgtgtgtatgtgtgtgtgtgtgtgtgtgtgtaaatgagataattccaaccttaacgggagagactatgagagacatgactgatggtgtgtactgtgctgctatctaatggcagcctatggaactactacgtggtctccagggaagagaaaatacagcgtgacctcagtctaaccccatccagtttagttcagaaggtcccaggatgtaattttgtaattctaaattgaaaaggaaagaatgtgataaatttctgtattaaaaattaagatatattttattaggc

SEQ ID NO: 6666 - DNA, 1068 bp, Homo sapiens
aagagtggaaacagagggaatgatgaagggagcaccacagctgcacaatgccaggctcagtttctgaaaaggaaagcaaaaaaatctgtgttttatgttactttttttcttgctgtgtacaggcattatctttccattctagagctggttgcaggcttaagaaatactgcctactttccaaagtaatgccacaaatatggttgatatattaataatctatagactgtaattctatcaggagtcatttgattttgattaccagcatactttctttggcattgtactctgggttttaagcttgatttttctaaaaatcaggtaaccagaggaattacattttttaaagttctgccttgtcagcctcctctctcctcatcactccaatttagagttttccttgcaagtaacatgagagttttctggtttggagcatttctgtcactttgagttatttaaaagaggagcaaaatccaggcagccagctatgtcatatttaaattatattcctttcctgattctgtttattagaaatttgctgttttgtttttctattacctgtgctattgacttctcagtgttgggctgtgttatttcaatttatgtaattgagaactgaatatcaatcaagtaaggtgtttataggaggaagaaggagaaaatctaggcattaactgagactaaaggttgattcatccattcaaagctcagatatactaaaattgtaaccttgttaatcaaatggtattaggctatagaagacataaatgagcaaaattttctgagccaaatcagcttctgtttcctagaccttttttggaaggctttaattttgggaaagtatatgaagccatcatgatttgcagcgtgttagtctttacatattagacttagtggcttactgtaaaagcaagtaatatgttataggctatgtaaatgaattcaaatatcttctaaagatacacaaaatatttttttcttgatactaataattaggcatttatttgaagtactaatatgcaaaagctggttaccaggtacccacctgggtacagaattggtaggaaagag

SEQ ID NO: 6667 - DNA, 1032 bp, Homo sapiens
gcttgtataaatatcttgttcaggctgaactgagagaagtagtgtattcagaaaacttactatctcttttcggctgggtgtggtgcctcacacctgtaatcccagcactttgggaggcctaggtgggcggatcacttgaggtcaggagttcaaggccagcctggccaacaggatgaaactttgtctctactaaaaatacaaaaattaggtggatgtggtggctgcacctgttgtcccagctactcaggaagctgaggtggggagactcacttgaacctgggaggcagaggttgcagtaggccaagattgcgccactgtactccagcctgggtgaaggagcaagactctgtctcaaaaaaaaaaaaaaactctcttttctgggttacctagtcagtaattccatgtaacttaaatagtcacctgccttattaacatagtatacagatctttcaaggatctaagttgacttcttggctccatattacattgttctgtatataaaatgactgagataatattagacaactggttcagggtggtgacttactttagtaattgttttagaagttgttttggaatacagattttatcctgttgtctgtgtcacaatttgtagtgtaagcatgcactggcagtcctttcataccaacacatttgtttttcccacttaaacttggttattaattttgtcaattaaaaatgtgtcccttggcctggttcggctcacacttgtaatcccagtactttgggaggctgaggtgggaggaacacctgaggtcaggagttcaagaccagcctggccaatgtgctgaaacccagtttctactaaaactacaaaaaaattagctgggtgtggtggcaggcgcctataagcccagctgctcaggaggctgaggcaggagaattgcttgaacccaggaggcggaggttgcagtgagccaagatcgcgcctctgcactccagcctgggtgacagagtaagactccatctcaaaaaaaaaaaaagtctcttaaggcttcaggtctgtctgat

SEQ ID NO: 6668 - DNA, 1014 bp, Homo sapiens
ctaaaaccttaaagcttttaagattttaaattattaattttaaagtcagcatgtagaaaagtcagagaataataatattacctgtgtacctgtcactcagaatgatagcatttctttgcattaaaaattcaattgtttaagaaaagtttgacctattcttggggttatagaatatcttgcttgcccaaataatattgtgaaaaatgttttttaaaattcgagggccaggcacagtggctcaagtctgtaatcccagcactttgggaggccaaggcaggtggatcacctgaggtcaaggagttcaagaccagcctggccaacatggcaaaaccccgcctccactaaaaatacaaaaaattagccaggcatggtggcacacgcctgtagtcccagctactcaggaggctgaggcagaattgcctgaacctgcggggcagaggttgcagtgagtggagtacactgcactccagcctgggcaacagagtgagactgcgtctcaaaaaaaaaaaaagaggtgtatgcttaaacgccaatatgatgggttttaagtaagaacatgtgaagaatgaatctctatttttaaatttatgtacgcaattttattttaacttacagtagaactggattatagactcaaagtttaagagccagactgagcttcagataatcccatccactcactcatgttacacatgaactcccatgccagcagatacttcccccaggttgtatggctaattagtgatttagactgggcctaaatctctttagcatcgtgttgcctcacttttgctttcaggctacattaaaacatttatgtcaactataagaaaactttttgatgaatggtttgtttccagagcatcaaagttcagtatgtattccttaaatggaaaatagaaataaactacagtgtttgatacatagaaaaattccatgggaaagagttattagtactcttgagcctcgtatttatagtgctccatatgaacttaaaccactcccaggtaaaat

SEQ ID NO: 6669 - DNA, 1027 bp, Homo sapiens
aactatgtagattacaatcctttttagttaaaactcatcacaacttatgcccttactatgtgccaggtactctttctgaatacctttatatgtattattttaatcttaacattagcccttctagctaagtattgtaactatcaccattttatagatgaggaatttgaagcccagagaagttaattaatttactgaagatcacactccaggtaaatagtagagctgggatagaatcagtgtcaaattatgattttttaatgatattctattacataaactccttcagaaagacatttaagcttgcttcagtgtggcactttgagtctcagtgcatatgtaaacctcttttggttatagaaatgcatttatccatctatgcaaagcagtcctggtcttctacatttagtcatagtcattgacttggagcttcattgtcattgaaaagaggaagaggaccagaatttcattttagaaaaactgttcagcttatataataactgcattttgaaatctgaactttactaacttgtgtgaatctgagcaagttattttgatcacctgtgctgaaaaaacagatgctgcatctaaactaagcttttcctggataaattaagaaaacaattaccaaagtattccagagagaaatgtcttcagtcccttgatgttcccagggttattaaagttttacctgaagataaccaagacttccagaaattacaagtcatttacttcattcactgcagctaagagaagcttgtgctgctgcctcatagaattatttcttgctgcatttaacatgcattaacaagcatttgaaaagagttgaatttcttctagaaagttgagttggcttcttgagatcctatccaaaaaactttgtattttcctaatcccagttttagataaagccttctcaaaggcttttttcaggagcaagttttaccaagttgttgaggcctttttatagaacacagaaattgaaggattagagcacaaagaagagcagggtagttttttccttctttat

SEQ ID NO: 6670 - DNA, 1029 bp, Homo sapiens
aagttgggcagaagactctcagtttcaactttcagcatcacagaaattttattctggtaatcttaacataatttgacatctaggtgaacaacctccacctgaggaagttacacagaaagaacaaccagattccagacaattaaactttattactccgcctgaaacattaagtagtggttttaaaaaatagttttttatctcctctccctcttgatgtttattgtgtgggagaggatgtttgtccaacaagcatattgctcctcttagagcaggtgagcttggtaatgctgggtcccttttgcatttggttatattcattctcccccttcccacctatttctcacttcatctctcctgtagccatctccctccatctcttccccagctcatcatctctccccatccctatctttcccctagacctgcttatccctcttccttcatccttatcccatctctcaccaaccccactgcctagtatccactgtcctttccccaatcctcggtcacttttgtcattcctcttcctcttctaccctcttctctagccctagcccttcctctccttgcgttcctccttctgctttcccattttcccccttccatttcccttttctttctctcctcactttctctccctttgactctctttcttttctcctctttcctcccctcctttcagctcccctcatcacaataacctataattctctgtcctccaggatcagatcttgacttctctaacagcaaagattaattttgcttgctctgatcaatttgatattatgaacaaagaattctctagatggcacagatacactccccctcccccatattcttcaaatatttgactaataaattttaaaaaaattttgttttctttttgagatgaagtcttactctgtcacccaggctggagtgcagtggtacaatctcagctcactgcaacttctgcctcccgtgttcaagcaatcctcctgcctcagcctcccaagtagctgggattacaggcgtgcaccactgcacctg

SEQ ID NO: 6671 - DNA, 1093 bp, Homo sapiens
atactgctttgcaaaaaataatggaaagctgatcagccctcctgtttaaaacattctgttatctgggcagaagttggtatcctgtggctgggcacagtgcgttcacgcctgcaatcccagcactttcggaggccaaggtgggcagatcactcgaggccaggagtttgagaccagcctggccaacgtggcgaaaccccaactctactaaaaatacaaaatttagccgagtatggtggcgtgcacctgtaatcccagctactgtagaggctgaggcaggagaatcgcatgaaccctaggtttctttcagaaaatttcttgcctttatcttatgcctctggtgttttgtcacctttgtaatcaaaaattatttttaagcccaagtggaataagaactctagccatcagaaaaagtgaaaatgaaattaagtataaatcattgtttcttcttaagacttctgtttttcaagattttctgacttaattccgaattccccaaagcatcatatagttagcagtctaagagacttcactaatttttttgttgttctcttaacagtactatttcattagaacttctgaaagatatctttctttaaatacttttctctcagagtatgtctctagaatgtcactataggaaagctacgtagtaatagttcacaaataaaggtgacatattaaatattctcattgacagaaaaaattataataggcatgtgtgtgcttagtgatgtccttccaaattaattttatcagttgtttatcttggatcataaagaggaaaacagttaaaagtagagaacacttttaaaagataaatattcatgggccagctttcctttgaattttcatgaaaaagtagttggctctctttctttttttctatctttgaaatttattaacacataataaatacaatgacctataaatattataccaaatgcctcagatttttatcattctggctattaggaagactgtttaaatttttctctcaaattgaattaaaggaacaaaaaaactaggcaatttttaggctgtgtaacaaagaatattgttggccgggtggggtggctcacgcctgtaatcccaa

SEQ ID NO: 6672 - DNA, 1049 bp, Homo sapiens
atttcttgtcttccttgttggatttatgtgtgtatgtataagacagggtcttcctctgtcacccaggctatagtgaagtggcactacatgttgctgatgtatatcaatatttcatttcttttgaaaatttgctgagtagtattctattgtatggttatacccattcactgattgtttctcgtttttggctattaacaaagtttctataaacatttatgtagaagtcttgggatgaatgtatgctttttgcttttatttctctgaggtaaatacctaggagcagatgactaggtcatatggtaagtgtatgtttaaaatttttagaaactgccaaactgtttttcaaagtggtttacccttttacattatagtatatagcagtgtatgagagttccagttactccacattcttgccagtactgagcacagtctgtaatttagtcattctcattgtggtttaattcgtgtatctctaatgattaataatgtcaagcatctattctttgccatctgtatatctcctttggtgaagtgtgttcaaatcttttcccattttttaattgagtggttattgagttttgagattcttttatatattataagttacaaatgcattatcagatgtaattcacaagtattttctccacgttcataaaatttgtttctttgttttcttaaaagtgtctttcaaaaagcggttcttaattttaagtctactgcattgactttttctattatggcctatgttacttgctgttgtatctcagaaaaacctttgactaatccagagtcacaaggatttttccctgtgttttcttctctaagttttataattttcagtttgtattttggtctatgatccattttgagttaatctttgcatatggtacaaggtgtagatcaaagggttgggcttttttacacatgaatatccagttgttccagcaccatttattcaaaagactgtcctttcgaaatgcttttgcagctttgtcaaaaatgaattgaccatatatgtgtgagtcttctttgggaatctgttctgttcc

SEQ ID NO: 6673 - DNA, 1044 bp, Homo sapiens
gccacctcagcctcccaaagtgctgggattacaggcgtgaaccaccgcgcccggcctagggtttttcatagtgacccattatcaggggattaggcagttcccttctgttcctagattgctgagagttttaatgaggaacacatgttggattttgtgaaatgctttatctacatccattgagataatcatatggtttttcacttttattctgttaattggtatattacattgaattttttttagctttaaatcctttgcattgctggtataaacaccacttgttcatgaggtataattctttttatgtgttgttggattcaccttgctaatatctttttaaggatttttgtgtgtgtgtgtatctgtgtttgtaagggatattggtttgttgctttattttctgtgtctctggttgactgtcatgataatgttggccttataaaattttgaagtgttccctcatctattttctaagagtttgcatatgtgatattatgcttctttaaatgcttgatagaattcactagtgaagcatctagacctggaattttctttgtggaaagttttaattacaacttcagtttctttaataaatacagcactcttcagatttaatatttcttttgaagtccactttaatacttttgtcttccaagcagtttggccgttttatctaaattatgaaatttattgaaataaagttatcatattcccttattatccttttaatgcctgttaggagcatagtcctgtttccttttttggtttcattgattttttttttttatttttctagcttcttaaggtagaaactaagatcattgactttgaacctttttttaaatataatcagttgaagctataaatgttattagaagtaattctaatcactactttagccacatcccaaaaaatgtcaattaagtcaagttggtttataatattcaggtcttctgtatccttagtgatttttctattcgtccttaccaattattgagagaggaatttttatgtctcccactatagttttgaatttgtctattt

SEQ ID NO: 6674 - DNA, 1473 bp, Homo sapiens
tgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccg

SEQ ID NO: 6675 - DNA, 1150 bp, Homo sapiens
gatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccag

SEQ ID NO: 6676 - DNA, 1181 bp, Homo sapiens
tggatcacgaggtcaggagatcgagaccatcctggctaacatggtgaaaccccatctctactaaaaatacaaaaaaattagccgggcgtgatggcgggtgcctgtagtcccagctacttgggaggctgaggcaggagaatagcgtgaacccaggaggttgagcttgcagtgagctgagattgcgccactgccctccagcctaggcgacagggcaagactctgtctttaaaaaaaacaaacaacaaaaaaaaacaaccatggattacagtgagatgtgaagagggacagtcagggaagggttatatagaaactaatcccctaagctgaggcttgagaaactctatcaggtggtagatttagggaacagggcattctaggaagacagagcatcttgaatgaactgaagaaacaaaaccaactgggtatgttttggggaattgtgagaggcttggtttggctggagtgtagtagctgatcagggcagtgggcagaggtaaagcgagagataaaactggagtggtaaatagaaggtcagattattgggacctcgaatgccatattaagctctttggactttatcctgtgcattgaagaaactttgccagattggtttttgggtgctccatctagcaggaatgtagaagacaggtggactctgaagctgcaagtggggagacgatagatgatgactgcatgagtgcaggaaagatgcagcctagaagtcaggcagtactcgggggaaggggcggatctgagaatggagagcttagactctaggacctggctactaggtttgggtagtgagaggatgagggcttcaggaagaccctagctggctggatttctcttgctggtccccaagttggggaacatggggaaggggcagttgaagcagtgggaaaagttgggctgcttaccttgcttggtgtactttgtgagatgaggtgggggtctctggaggctatatacacggtatttggaagcgtagaatcggatctcatcctgctatctccatcctccctccccaccacagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgc

SEQ ID NO: 6677 - DNA, 1023 bp, Homo sapiens
gtttggggggctgatgacaccctcttttgtcaggtacagctcttatcgttcacatgaccattaccaaaggcaaagagtgctacaaaaggagcgtgcaatagtgagtagaggaacagatcatgggaggatggggcttaccccctgagccttgagctcagagagctgcctgcagctgtagccctggctaatggtgtgttgattttttttcatttccaaacataggaagaaagaagggtggtcttcattggaaagatacctggccgcatgactcgatcagagctgaaacagaggttctccgtttttggagagattgaggagtgcaccatccacttccgtgtccaagggtaagcttgggccccaggctcaggatgttctttctatcccattcatctaccttggtgtttctttgtcttgcctccttgctctggtgtgctgagcaatatggggcaccttcatttctgcagtcagagggttggccactgggaatgagaagaaccacctctgtaccttgggatgctgtgtctcctctatggcatgggcccatatagccactccagcccctgcctcactctcctcctactagggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttggtgagtggagggagggcctaaagctttggaatgcttcatcccctccccagaagggttcctaaccctttgtgagtggggctaggcagacttaccttagtttgacatacaaagaacccaagggggctgggcatggtggctcacgcctgtaatcccagcactttgggaggctgaggcaggcaaatcacgaggtcaggagttcgagaccagcctggccaacatgatgaaaccccatctctaccaaaaatagaaaaaattagctagaggtggtggcacgcacctgtaatccca

SEQ ID NO: 6678 - DNA, 1050 bp, Homo sapiens
cgttatgcgcccgcgcggcgcaatgacgtaacacaggcccgcccactgcccctgttgggttcctgagtcgtgctgcgtcgacaacggtagtgacgcgtattgcctggaggatggcggacgccggcattcgccgcgtggttcccagcgacctgtatcccctcgtgctcggcttcctgcgcgataaccaactctcagaggtggccaataagttcgccaaagcgacaggagctgtgagttccgggcttggggcggggaccgggctgagatgaccacaaggcttcaggccctgacgtgcttaggtttccaggtggggaagtctgggggtccgccagtccagtgtctgcaaggcctttacgccgacccctcggcagtgaccagagaaagcctgcggcctcggtcgcttaccttcctccatgtctgagtagatatcgctgagtcttgttgcttttttcttgtgacctgtgcagcggcggcagcgtgggagcctcgtggccccaagccacatggctggcagagtgcagcggggaggtagagtcttgttccactgaggacgttggttcttcggcatcttctggggggcttttcgttgggtgaggcaaaccgtgatttgaccttagcctcagtcacatttactgggattcaaaagcaagtgaaatttctttagaatgaagtctgggattttcgtttgtaaagaagaaaatgaatgaaagtagaagcagagttttgttttgagttacactgagaattgagagtcatcaacagccctaccaagtaggcatagtagtgggcttggagctttggctaattgaatcaaacaaacctaggtttgggaccaggctctgccactttttagatacgtgacccgggcagtttatttaacctttctgagtctttctacagggatgtcatcatccactttataggatttttgtgagtttcagtaagatgatgtgtaagagtagcaatctcagtgctggtacagaggaatcttgtaaaagtgaaagctgtaccatagttatggcaatttaggatgctccaaacacatgtaag

SEQ ID NO: 6679 - DNA, 2129 bp, Homo sapiens
agagaagaaacccccaactaaggcagtagtctctaaagcaaccactaaaccacctccagcaaagaaagcagcagagagctcttcagacagctcaggtaaggcatatggaggccctcagttcagtgagatgctctcaggcagctgctaagggctcccctgaatccaatttggggagctgttgattccatcccttctgtgtctagactctgacagctctgaggatgatgaagctccttctaagccagctggtaccaccaagaattcttcaaataagccagctgtcaccaccaagtcacctgcagtgaagccagctgcagcccccaagcaacctgtgggcggtggccagaagcttctgacgagaaaggctgacagcagctccagtgaggaagagagcagctccagtgaggaggagaagacaaagaagatggtggccaccactaagcccaaggcgactgccaaagcagctctatctctgcctgccaagcaggctcctcagggtagtagggacagcagctctgattcagacagctccagcagtgaggaggaggaagagaagacatctaagtctgcagttaagaagaagccacagaaggtagcaggaggtgcagccccttccaagccagcctctgcaaagaaaggaaaggctgagagcagcaacagttcttcttctgatgactccagtgaggaagaggaagagaagctcaagggcaagggctctccaagaccacaagcccccaaggccaatggcacctctgcactgactgcccagaatggaaaagcagctaagaacagtgaggaggaggaagaagaaaagaaaaaggcggcagtggtagtttccaaatcaggtctgtacccaatgaacatgccctctgggttttgtccccccaaatcaggatgggatatactctttgagagtagggtagtgagaggaggcccaccactgggcttccagttgtggaaactgggaggaagaacaggaaactggttacctttttttttttttattagagtctcactgtgtcacccagaccagggtgcaatggcatgatcacggcttgtgcagccttaacctcatggactcaggtgatctttccaccccagcctcctgagtagccgggactacaagcatgcaccaccatgtctggctcatttttttaactttttatagagacagaatctcactatattgcccaggctgatctgaatttcctgggctcaagcgatcctcctaccttggactcccaaaatgctggggttacagttgtgagccactgtactcggcctgagtctggctttttgttttgtaggttcattaaagaagcggaagcagaatgaggctgccaaggaggcagagactcctcaggccaagaagataaagcttcagacccctaacacatttccaaaaaggaagaaagtaagttgtctcactttcttctcaggagccagctctttaaaagtagaaaaatctaggatcatcttgacagctctgcctggcgtgacctggtacatgtgcccatgtgtatcactcaggagaactgttacatgaccactctgtctttaatttcctacttcattcttctgtagggagaaaaaagggcatcatccccattccgaagggtcagggaggaggaaattgaggtggattcacgagttgcggacaactcctttgatgccaaggtgagagagagatctgtgccattcttgggagggaggatgggtagtgtcagagaggacaattcttggttcaggttggtgggaatcttctctgggttcaggtttccttgagcagggagtagaaagaataaagtgacagggctccagcatggtcctcctctgtgttaatctccctctctacttaccagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacaga

SEQ ID NO: 6680 - DNA, 1648 bp, Homo sapiens
tttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaaggcattctggtggtagaaaagtgtgccccaagccttcatggacgagttataggtcttaagattagtctcctcttgtttggattccatacttgctaaataacctgataataacctggttttccatgtaactgcctctaggaagaaaatgtactgttcatgctgacacagatatttcagtctgcatggtaaaagttctaaatcttactacaaaataataaactggctggtttataatgtgtcttgggagttttattattgtgagtctaaacccctcccaccccctactcaaaccagaacaactttggtgccagttataggactggggtccagacctgtgatttcactgcagaggctttttggcagcagcttgtctcacggtgccttttccaggctatattctagcctacgcatagtccaaattgggggttggcaaaatggcctatgggtcaaatccagccc

SEQ ID NO: 6681 - DNA, 1045 bp, Homo sapiens
atagctcggcctgctggctgcgctcgcgcttccgccatttggcgcgccggttcttgaaccacacctgcgggcacgggagaaaggcggtcagggcccggggccgggtcccagcggctgaagggcgggccaccccgacggggcttccagccggggccctgcggtcaataaacgagatgaggtggctagagacggggtgggagggaaggagcgcacggagtccggggtcggagaacagaaggcgcgggcggctggaccgagtcatcggcgccagggtctggcgggacagtaggatggggttgaggaggggtggtgaggggaaggagagacggtgtcagggccgaagaagcgcgcggtccgagtagtagggagcagtgggagcagaggctggaggttggcgggcaagagaccgcgtggggctgcggccgggagccagggtccggggtccggggtccgagggagggggcaggtggggtggaaccgctggcctccgggtcgcaggctgagcgcggagggcccgcgcgggtgcgagtcgcgggtctggagagcatacccgcacgcgggcctcggtgaggttggtccacacggcgatctcctcgcgcgtgctcatgtcggggtagcggttcctctggaaggtcgcctctagctcctgtagctgctggctggtgaagtgcgtgcgctgccgccgctgcttctttttcagcgaaccgtcctctggggagccgccgggcagcgaagccgaggccttttctgagtctgggggccagggtgggggcaggtcacagagcgcccaagccagcgcatattctccggctcggggacctcctaagccactcgctggctcccaccggggctgcccagccggggtcccacccgcactggggatgaagctgttatgtcctgcacccccggaagggggcgcgcttaccgctgtgctcctggcccttgcagccgtgctctgggagctgggggtgcggagtgccagcgtctgacagcgacagggcagggctccgggcctctgcctcgctgagcaggccgaactccatgg

SEQ ID NO: 6682 - DNA, 1050 bp, Homo sapiens
ccagtgactgctccactcatggacagcctctaccaagcctgctccaggccataggcaggagcttcattagaccaccttcctactcatacttcctttcccaaacttagcctcacattgcccaggagcctcccagggtccttctccaagtttcccccgcagggtccccttttctgcctgctctcccaggacccctctgctgcgaggaagggaaatgggcaatactggggctcaagactctgggtgccttttggttggaggagaacagaaggaggctagggacagagggaaggggtagagagctgagtgggaggggcctctctgcctctctcaccccttccccattaacaggggcttaatgcaggctgcacaggatggcattaatgtggtggattagcctagattgagatgtgtgtcacttggctgctctggatttattaggagcctttctcagggaggtgcagatgggcagcagcctgtatttgcacatggtaatgcccccttcaacagctcagagatcacagctgtgcccccactccccaccccacctctcaagccaggttgggagtggaaccgaggtcaaggcaggaggttgagaaagagtccctgctctttccacaggcagaggggtctagatcttggaccttttattgggtgtgaagagacagggctggagggaacccaggacaggagaaaagtcaggccagaactggaggtgtgctcagcttacttccccttccaggtcgggtcaggtcagggggtttggagctggaaaactttggccaacaatgctctgatggaagggagatgtccctgagaaggaactatggtagccttggctgggaagatgagggaggaagggttagaactgagagttggaaaaaggggtgctctgaagtctccccttacttcataccccttacttcatacccaagatgcccttgaaatgcaaatcatccccctgacttttccagaggccatggaagcaacatggagctgggaaaaaacccagagaggggtttacctgtgggaaaagcagtcccacccttgcca

SEQ ID NO: 6683 - DNA, 1002 bp, Homo sapiens
cggggatcagagaaatgactccacagtcttcctgctcttccttgcttccttccttcagcaagtattaggtgttaagagggatcccaagaacagtaaggcagagaccctatcttgtaggagtctgcagtgtagggaggcaaacagagcacaggatggaaagatggaccgcatgggtctgactcccagactgtgggagatcagagagagggaagcccatggaaggtggtaccgagtgttgggagctcagagaatataggcacgtgactgaattgggagttcaagaggaagagaaggggtatggcattctaaataatcagcagtgttgggaataagctggcaggctgggagggcagtggtgagcctaggttagtcagagtctcagtgtaggccacgggagatctgcagagagaaacgagtcaaaccgagggggcctccaatgggggacaaggggcagtggttcagatttgacaaagtctaggctacagtatgtccagctttttcatcaaaaaccgctaagattcacactgagcaacagccctgaataaagaaaaaaaccctaagaccagtcaaaaacaacatctactagaaaacagaagcatgacctgaaacagctgccactagtatgaaattgttttgaggtcaccagctttatgttaaaaatgcaaacaaatttttcgttctattccatactttagtcatggattataaaatattttaatataaaaataaagctttttttaatataaaaccccccaatcttcaagtgatatcaccacaccaggaagatgggccctgtttagactgtgtgtcatgcctcctccactcccgtactgccctcctcccccgcccaccccactatgagaagcaatgcaccaagcagtaggggtcactggaggcttgtatccaggggtgtgacaaaaaacagcatctttgtgacctttatttgaccatggtgagcataaagggttgggcagggaagaaataggaaaggagaaactatta

SEQ ID NO: 6684 - DNA, 1002 bp, Homo sapiens; identical to SEQ ID NO: 6683

SEQ ID NO: 6685 - DNA, 1022 bp, Homo sapiens
gcgctccggctaggacgcttaggcagagccaagtgggcgagagtagagtggtcccggtagccacgggtaaaagggatcggctggcagcgaagtgggttgggccgctaccccgaggaaagtggatcggcgccaggtgggaaggcgcacggggccgccgggtctcagcgctcagacttctctgccactcaagtttcgccgattttctccacttgtcgctgtccgtctctcctcccttttgtctctgttccaatcctcccacgtctcgcctttctttcctcttctttctcctcagccgcttcgctcctgctgtttaccattctccttcctctgccactttaaaagactcatttctctttctctctgctcctctttcctcatatctttcctcttcttcatttcccccttcttctccaaggaaggtgacttcgtggagacagcagggtttggaatgatacaaaccaaagtagtattccaacgctgccacgaactgcaccatcactgagtgaacttggacgagtaactatcatctccctccccgcgcaaaacaattaagaggaggttcctgctggatctcagggcttgggctgggcactccaaaggcattgcctttcagtctgtacccttgtcttgcttaggctgtgctctccctccttcagcagggctggtttcccgctggtggtaccaggttaagtcctgtgggcaaggtgtggccttggtgcctgctggttaggaatttgcaagggacaggacagatgaccaaggaacatcctggcagactgtgacttcggccctctctgacttaggcctcaatttccaggaaacaggctccttctcttctcccagttaggctatgttgcttgggtgctccgaagagcctaagcccaggccaaacactgtggctcatgcctgtaatcccagcactttgggaggccgaggcgggcggatcacaaggtcaggagattgagaccaccctggctaacacggtgaaaccccatctctactaaaaaatacaaaaaattagc

SEQ ID NO: 6686 - DNA, 1047 bp, Homo sapiens
aggaagaagaatggcgtgaacccaggaggcagagcttgcagtgagctgagatcgcgccactgcactccagactgggcgacagagcaagactctgtctcaaaaaaaaaaaaaaaaaagagcctaagcccagtcacacaatatgcccctaaggcaaatctgagcagtcatgtcttgactgttcagtgactcccattgcccttaggataaaggtcaagctccctagcctggcatacaagaccttcaggacctgaccttgtcttcatctccaatttcctagtagtgtcctgcacacctctggcccttcctgtgaaagtaacccatctttatattgtcaattcctactcctccaatgttccactcaagtcttattttctctgggaagccttttctgaactctcagtttagccccttgctctcatgaccctcagtgtataccttctattacaccacccaccatattgaagggatcagcttatgtgttgtctgctatgataataaaatttaggagggtaaggaccatgtctgttattcccaggcataatgtagaatctcaataaatgtcacactgaaatctatgaggaagatgttctgcctggtaagatgatgattagtggttaggagggactagggaattgtcatctctctcctccccatctctattgcacaatcacatgcttttagaatgatgaatttctggaggtatgtagaagtagatattggcgagcagaaatttttggcccacttagaggattttccaatcggctttccaggacctctcaatctgagacaggcccaggacaccaactctcagttttcaaatgaagaggaaaatggctttgaggtaatgtggaaagaggtgctatgatggtatatcctctttccctgactctctttgggtgatagaggctagatcctcagctggacccaccgaccagaagcccaatgtgcaggtgtaggaagttactgaggggttcttcacgtctgatatctgatgggtgctttacactagagcatcgtggccaggtgtggtggctcacacctgtaatc

SEQ ID NO: 6687 - DNA, 1260 bp, Homo sapiens
aagtgctgggattttaggaatgaaccaccatgctcaacccattcctttatttagaagagccaactgctcctttttcagcagattgttactgttttagagtgcaggcacagaatgaccactctttctatttttcaggagaaactggaaatttagatcattgtgttttctaattgttggaaactagttaaaagtatttttaagcctttttcaggccaaagaaaatatgtctgtggactggattctgcccaatggttactggatgatgaccctcaataaacaaaatgggcaggccttatgagacttaatcactgcagttctctatacataatcacatagactttttttctttgtcctactctgccagctgtcacctttgtaccttgggtgccctgagtggctaaaagatggagtgagatagagaaggtttgttttatttttcatctccaagctggcagaagggacagctttggacatattagtagcttaccttgtaaacggtttttgagatactctcagaatctccacagggggaggagatggcatgctagagctgaggtaccctggtcacccgattatcaggtctgggaggattttccagtgatgcattgtcagggcaccagcttttttcccagtttaaccttcttttacttccaccctttaagtaaatttcttgagctcagtaagttgtttcctagtttagtaactttggttattctcaataaagcacagaactatgatgtgttcctaggccagctctggaaatgttaaaagctctgcatctttagtgtttctctggctttttttttttttttctctgatggagtcttgctctgttgcccaggctggagtgcagtggtgtgatcttggctcactgcaacctccgcctcctgggttcaagcaattctcctgccttagcctcccaagtagctgggactacaggtgcacgccaccacacccagctaatttttgtatttttaatagagatgtggtttcaccatattggccaggctggtcttgaactcttgacttcgtgatccgcccacctcggcctcccaaagtgctgggattataggtgtgagccaatgcgcccagccttctctggcttttaaaggtattgagtgaacataaaccttagaagggcctattgctggtcctttagctccctactaccatctaccttttcagaaagtccatcagtttttcttggtttgcccagctctgtattagacacaaaggcatcatgaaaaagaaaaacaaaat

SEQ ID NO: 6688 - DNA, 1081 bp, Homo sapiens
gtgatcctcctgcatcggcctcctaaaatgctggattataggcgtgagcacctggccttttaagtattatcagatttaaagtgttttgctatttcaggaatgtaaagtggtatatcattataatcttattttgtaattttcctgattattaatgaagctaataatcttttcatatatttatttgctgtttatgtttcctattctgtgaaacacctattcatctctgttgccaattttggggaggggttatatgtctagttcttatagttttgtagcagttattgtatactctggatattactcctttatattagttatatgtgcctcaaatattttcttctggtttgtgccttatcttttccctcttttttatgttgtcttttgaacaggcatttttaattttaacatggttgaattcaccaattttttaaagaggttttgctttttgtttcttgtttaggtacttctcccttatgctgagtttataaaaatactctcctgtagccaggtgctgtggcacacacctgttgtcccagctacccaagaggctgttgtggaaggattgcttgagcctaggagtttgagtccagcctgggcaacatggcaagaccctatctctaaaaaaaaatcaaaaagaaaatattctcatatattagcttctaagagatttcaagttttgcttttcatatttaaataacctgagatatatttttggtattccattaaataagaatacaatttattgtttctttttctcctgcttttgttggatatagacagagttgccaagtgatacagtgactcctctttggatcctgttgaggtaactgggatgccacaaagcactaggggaatgttctagacccagctttaaatggacagtggtttcaagggtacatgttactcagagtctctgggccagtggcttatctggctaagggtgttagttggtatttatttagttgttccctctcttatttatttttttctattaatttttcatttgtgtgggtacataatgaatgtatttctcttgttatttctgacacaagataaatcttaagttcgtttctactatact

SEQ ID NO: 6689 - DNA, 1047 bp, Homo sapiens
ctgtagtatgttttgtgttttttttttttttttttttttttgagatggagtctcactctgtcgcccaggctagagtgcagtggcgtgatctctgctcactgcaagctcaacctcccgggttcacaccattctcctgcctcagcttcccgagtagctgggactacaggcacccaccaccacgcccagctaattatttgtattttttaatagagacggggtttcaccgtgttagccaggatggtctcgatctcctgacctcatgatccacccgcctcggcctcccaaagtgctggaattacaggcatgagccaccatgcccgggctgtagtatgtatgttttaagctaagtattattataaaagtccaaaagcttaaaaaaatttaaaagttataaggtaaattatggtaagctaaggttaattaatgaagaaagaaaaatctttttaaaaataaatttaatgtagcctaagcatagtgtttataaagtttgcagcagcatacagcaatgtcctaggccttcacattcactcactattcactcactgacttatccagagcaacttccagtcctgcagggtccattcattctaagtacccagcacagggttgccattttcttttttttctttttctttttttttttttgagacagagtcttgctctgtcgcccaggctggagtgcagtggcgcaatcttggctcactgcaaccttcgcctcctgggttcaagccattctcctgcctcagcctcctgagtagatgggactacaggcgcctgtcaccacgcccggctaattttttgtatttttagtagagatggggtttcaccgtgttagccaggatggtctcgatttcctgaccatctgcccacctcggcctcccaaagtgctgggattacaggcgtgagtcaccatgcccggcccattttgtatcttttatgcagtatttttactgtactttttctgtgtttagatatacaaatccttaccattgtgttaaaattgcttacagtgtatagtattcaatacagtaacaggctgtacaggtt

SEQ ID NO: 6690 - DNA, 1003 bp, Homo sapiens
acaagtccaattgatctgtttactttccagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatagtgagaggcatttctttctttgatgaacccagtgttctatgcttatcccttctctactctctgagtcgtttttcctgtccccatatcacttcccctgggatgctcccaattctgtttctgggctttggcagtttaaatcacaggccagtcaggcagattagtagaactcatagccttctccctttttcctcctccccactttggttttttacagaattattatttctttatggcaagagaagagaacagagattaaagaatataggatttctgtctctgaaagctccaggtcccaccatccctcatccccaatatctgcctccactctaattagtcctctctagctcccccttgaaatttgaggttgcagaagatcagggaaagtgactgggtaatctcttcattaaattagagaatctaatgcttggctgggacagggactacttattttggcttgggtttgtcctgctcagggctggcgccctgtgcaggaaccatgcaggtcttctgggcttgggatttgatctatcctgcagctctgcttggcttcataccctataagtcttcacgtatcttcttctctcttaccagctgagagaactgccagcgatgggaaagctgtaggcatggcctcagacatcccaggcctgcatctgccaggtggagggcggctgccaccagaacatgggaaatcaggatgcagtgatctggaggaagctgttgactctgggggtgggtactgggtgtccatgaccctaagctcctcacctggagggcctggtg

SEQ ID NO: 6691 - DNA, 1027 bp, Homo sapiens
actgtgctccagcctgggagacagaccaagaccctgtctcaaataatataattaatatatttctatttgaaaaaaaaaaaaaagaccagagcagtatcctaaattgggtcctagccaaactgtcttcactggcctaaggagactggtgggaaagaaaactagacaggaagctgtgtgcccacacagctccccgcttccccgctccctgccctaaccccactccaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggtaagccctttcccagggagactcaggctggcagataaacagttacaccccaggagttgggacaggaaaacaaaacacaggttactgtgttcagcagattaaacagccctggctcctgccatcacttccagagcttccagtgcccgctggctagtacccataagttaaatagcatgagggcaaataagcaatgcagacggctgtgaagccaggcttcctactgtcctgaggactgatttgtcctgaggactgtttcccagtttctgtttctgagctgtcccgaggactgttttcccagaattctgggaaaatagaattctgtgagcagactttatatcactaaatcgatacatcactaaatcccagaaactgggaaaacagtcctcaggacagtggaaagcctggcttcatagccttctgcattgcttatttgtccttgccaccactccctagagtggtgctacagctgccactagatgccatcaggaacccagattagcctgccaccttatttggtcaacagagaaactgttccggccatcctttggccctctggtgacagaaattaaactatgc

SEQ ID NO: 6692 - DNA, 1025 bp, Homo sapiens
tgtccccccaaaagcccccggggtttatcagccgtggcctccctcctggcagaaaatcccaaggttgctccagaccgggggaggggagcgggaggcggacttggccccagactgccagcctcctcccggccgtgaaagaccctcctgttccctgccctggagggaggagggggcttaacccccaccggggcttcccggattctcctagacctctgcccgctgaaaagcagcgggagcccgtagactgtcgagggcctcccgcccctcccgtcgcgagggcggggccagtggcgtcatttccaggcccgccccctccggccccgcctccccttggtattttcgggactttcctaagctgctctaactttcctgccccttccccggccaagcccaactccggatctcgctctccaccggatctcacccgccacacccggacaggcggctggaggaggtcggaccctcccccaaatctgggcccccatctcccgcccacccccatttagatctgaccccctcccccacgccactcctcccaactttaggcgggcgtctaaaattctgggaagcagaacctggccggagccactagacagagccgggcctagcccagagacatggagagttgctacaacccagtgagtcatgccgcctgcccctgacccggccggctgcccctcgtgtctgtccacctgtctgcccgagccccctctgctgccttacacctgtatgctcgcagatgctctcagcctgccagtctgtccatctgtctgcaactctgcctccaaaaggagctttctcttgggtctgaggaggaggggggagtgaccactgaagacttggagatgggaggtggggctgtggggggtgctgagagtcggatgccacccccagtctgtctccaaaccagggtctggatggtattattgaatatgatgatttcaaattgaactcctccattgtggaacccaaggagccagccccagaaacaggtcagcaagttcactaacctcccctagtcctaa

SEQ ID NO: 6693 - DNA, 1024 bp, Homo sapiens
tctttattcagggttttggggagatttctggggagctaggactcctgggctgggctcctatcttggggatccatatcttggggactccctttagctcagaaagccccttggtttgcatagagatgcccttctcagtgtgcgtgttctggctctttccccagcccctcacccctccagccccacatcaggccccaccaggaacacatctgggcaggaagcgacagatggatccctgccatggccctgagccccctcccctcttaacctactccaattcctgttggaatttatggaactcctgtccatttccttagctgtgggcccccattttcagctccaagctcagaccctccctggaataggagttctcttggtatcacaagttccttatgtgacccatcctgggcctcaacttactcatcctgggaacgggagacgattcacagaagaaagcatgcaagagcagcgtccaggctgaaagaactttggccacctggcactgagaactgaattccataggctgtgagctctagcaatgccctgtggactcagttctggtgcccggcagtgctacaacatcaatgccaaggccgtggggcagctgatggtttgggctcccaacttcccagccaggtgcttctgcaggcccacatcttgcccactggccaaacctttaaataactttgactcgggctactcttatgctcaaagacgtcaggggctctcccaaatctctttaccctgccagaaagtcttctatagtacggcctccacttagctttcacgcctgatcttccatcgcatcctgctcataacctgccactagtgaacccctgctgctccggctccacacttctcatgctggtccttcctcagtgctcctggggacacctcttgcctgtcactgtctgttggaatcctggacattcttcaaagcctctctcagatgcctcttcttttttcctttttatttattttttttgggatggagtctcattctgtggcccaggctggagtgcagtgg

SEQ ID NO: 6694 - DNA, 1044 bp, Homo sapiens
gcgggggtaggtgccgtacgcgcgccgcagctcccggcgcacgaagtccggtagctgcagaggggggccccgcgcgcgctccacgcggccccagcgcagctcggtttgcaggctcccgccctccggccacggcgcccagctctcggccaccgccgcgggcgcctgcagcgacagtcccgagatgccggcggcggcgcagggccggcgcagggtcgtggcgtaggccggagggcaggcccaccagggcggcgcggcctcgggtggcgcggcggggccgtagaagcggtggtattcccgtggggccgcccactcgcccgcatgcaggctcccgggccggctgcggaagctgtgggcctggactgggggtagcagcagaggggcggccaggtaggtgcaggtgagcagctgcggcggcggcggccagacgccctgtttgggcggcggccagctgtacacatacatggtcggccccccaggcggctgctgttcttactgggggctcctgcggatccagacctgcggcggaggaagggatatgtagacagactttctacttaaccgcctcctgtccctgtgggccggttccccgggacgccggttcatggctttgggggaattcatcccaaatcgaacattcagctccccgcctagcctcttgtcccaaggtcgggcagagcctcaggctcccagcagacaataaggagccttttcaagccctccgccgggatgctcttcccagtgactccccactcacttgtctccttcagccttggggagccggcgggatccagagcggggctcctctccgcactttgtagctgcgttgctccgctccatgccctgcctcagccactcctcctggttaccaggcaaaaggaaacaccttgagctggccaggagctaccagcgtctgtctacacctgggtgagccgtactggtcgtagtggccccaccctacaaggatgcccttcctacagtattactgatggctgtctaatccggttagctcccagtcactacaccccagcctcccagcgcctgcag

SEQ ID NO: 6695 - DNA, 1050 bp, Homo sapiens
tctgactgctctgctcttcctattctgccccccttgcttttcctctgaagtgccaggcattcttctacctcagggcctttgcacttactctccctatgcctgcaaagttctgcctgcagatagcttcataccttacctcacttccttagaccctttcgcaaataacttctctcagttaggccttccctgacctccttatttaaaaaggaaatcctgcaccctcctcccacaaagcagtatccccctttcctgcctaattcttctttttaaaaagttatatatatttgtatagtcagggtctcactatgttacccaggctggtctcggactcctggactcaagcgatccttctgtcttgcctcctaaagtgctgagattacagacatgagccaccgcacccagcctaatttttctttttcttttcttttcttttttttttttttgagatgaagtctagctctgttgcccaggctggagtgcagtggtgcaatctcggctcactgtaacctccgcctcctgggatcaagcgattctcctgcctcaccctcccaagtagctgggactacaggcacgtgccaccacacctggctaatttttatattttttgtagagacggggtttcaccatgttggccaggctggtctcaaactcctcaagtgatctgcctgcctcagcctcccaaagttctgggattacaggcgtgagccaccgtgcccagcctatttcttctttaaaacacttatcacttctgcgatgtctattatgctttaagaaatttttttttaaattaccatctagcttattttacttacttacttatttgtcttgtttattgtctgtcccccctccttcccactagaacataagctccctgaagataaggatggaaatgtgctttatccattaatgtttctccagtacatcagtaaatatttgttgaacaaatgaataaaatggaggaagctcttgctttggggtttttccgactgttggaaaaatattctcaccactggagacggagaattctcctggcccagcaccaagcccgag

SEQ ID NO: 6696 - DNA, 1101 bp, Homo sapiens
aattacatttgcaaagtcccttttgccatttaaggtagcatatcacaagttccagggattcaaatgtgggcattagggaacatttattcaggctaccacagtggtgctcttcttcaagctaggtaaagatggaaagatcaggtttggtaagatactgagtttggatttgtgtagactgaactagaagtatctaggtctggttctttgcttgggtatagatttgggaatcctcaacagaggtgtggtggctgaagccatttcatgaggttgctgaaggagaccgtgtggtgaggaggggcggagactgagtcctggagaaagtggaactctgggccaggcgcggtggctcacgcctgtaatcccagcactttgggaggctgaggcgggtggatcactaggtcaggagatcgagaccaccctggctaacacagtgaaaccccgtctctactaaaaatacaaaaaataagccggtgtggtggcaggtgcctatagtcccagctacttgggaggcggaggcaggagaatggcgtgaacccgggaagcggagcttgtggtgagccaagatcgtgccactgcactctggcctgggctacagagcgagactctgtctcaaaaaaaaagaaagtggaactctgactttgtccctctttccccacctaggaagtcccctaggggacaggcggaggccacgcaaggggaaatgttcacgttctgctttcctagtgaagaggtttccaatgacggcctcccttcgccagactgtcgttcatcctctgcgtaggtgtaaggggcagagcagtggctagtcctggggcatcatggggcttgggccagcactgaaggtcttagagcagattgacaggaaacggtacaaataggaaaggcagctggcattccaagcatgtgctggagtttgggtgagtggtccttggacttgcttggcattgccctgggatacagagagattgtagagaagctgcaggcagcctctgtaaagccctagagcaacaggaggtctgcggtttaggtttctctatagtctctgggtccagctgggcctaaggctgggcttgtccctatgcctgttggagacatgcatgg

SEQ ID NO: 6697 - DNA, 1030 bp, Homo sapiens
ttctgtctctatgaatgtgactactctgggtacttcatataagtggaatcatatgacatttgtccctttgtgcctggcttatttcacttagcataatgtcttcagggttcatccatgttgtagcagatgtcagaattttcttcctttttaaaggctaatattccattatatgtgtataccaatttggcttgtccatccatctattgactgactcttgggttgcttctaccttttgactattgctaataatgctactctgaacatcagtatacaaatttctattcaagaccctgctttcagttcttttggatatatacctggaagtagaattgctggatcatgtggcaattctatgtttaatttttgaggaaccgccatactgttttccatagcagctgtatcatcttacatttccaccagcaatgtgtaagggtcctaatttcatgaccattgtgaaaggagtttatttttatgctatagtgaataataggtgaacagaaaacattagaggctatagagtggggttctgatgtaaagttcctgttcctctttaccagtaagaggtggaaagagaacccctcacctctcaaagattagtccctctgctttcagaaccattgtttttagtgacttgtaatgtcctaccacataatgtgccagaactcatataataccgctacttgtagaacagttagattgtttctagattttttattcttataaatactactgaatatacttatgcaagaggcttttttttttccaaatgtaagattattcccttaggtaaattagcagaactggaaactgctactgtaagtaatcactgacactaagatctactgtgttccaggtgctgttctaagtgttttctatattatatgttaactcattttagtagctaccatatggaaactacaattatcttcgtttttgaaaaaagacttttttagagccgttttaggttctcagcaaaattgagcagaaagtacagagagctaccacacaccctctgcttaccacacgcatg

SEQ ID NO: 6698 - DNA, 1035 bp, Homo sapiens
tctcttttttggagacagagtctcactctgtcacccaagctggagtgcagtggtgtgatctcggcttactgcagcctccacctcctaggttcatactgttctcatgcctcagattcctgagtagctgggattacaggcgtgcaccaccacacccggctaatttttgtatttttagtagagatgaggtttcgccatgttggccacgctggtctccaactcttggggtcaagtgatccacccgccttggcctcccaaagtactggggttacaagcatgagccgtcgcacccaacctcaagctctcgtttcctggtttcgctaagctgcctattgccccagtcagctaactaaagccaaatggagctgcctggttatattcatatcatttttctccctcacactctttttaattttcctgacattttctttgcctcaacctgattcatcctcttttctggttgctgtggatctgtgaaatattttcacttttatcagttagtaatactgaccaactgtaagacaaaacaactcttgatttctctgcactttcctaagattttagattaatagttgaaagattgtgttcctactgcactgaagaaaaacaggtcagtccctcagaaatgagtttgtgccctaaaatttaagtgatttagccaatatataaatctgggtatttttagggaaaacttaaaccctgagagcagaggttggcaagtacagcctgcaggccaaatcctgataatcacctgtttttataagtaaaattatattggaacatagccatacccatcatggattacctgggcttcttttgtgccacagcagtggagttgactagttgtaacaagaatgatatggccctcaaagcctgaaatattttatctctggccgttcactgcaaaagtcggccgacaactgacttagagaatgttttccacttctgaataacaactcaggtggagaggtagccatctctgtgagatttcagaggtcccgagaaatgagttgccttagctgggtcctgtgctctgtg

SEQ ID NO: 6699 - DNA, 1049 bp, Homo sapiens
ctgacagaactggcaagcaggaacaatttaggtttttggaaatatccacaaactctttgcttccatccggagtgaatgcttctcttccttcacaggggctaccctaagaggctgggaagcctcccagcctgggctagtgagatcccagcccagattccaggcctggatctggggccttgaacaatgaggatccttgtatctctcccacagagaacaccttctgcagtggggaccatgtgtcctggcacagccctttggataacagtgagtcaagaattcagcacatgctgctgacagaggacccacagatgcagcccgtgcagacaccctttggggtagttaccttcctccaggtgaggcacaggttggacgctggctcaagccttcctgtgggaagggtcctgggaggacaaggaggcttgaggagggggagtgaagggagtgggaggtttcctttggcctcgtcctgatttctgtttcctctgatggtttgtcaggtagattcagatggtctgatttaacctgctgagatgggagaggggagaaagggaagggggcatttggttgggagagaatggctgtagctgagagggagtaatggggtggcgggtattctttgaacagtgaagacccagtctcaggaacaggactttccagcgggaagccagctctgggtcgtccttgctctttgccagaagctgtgggaacctgcccagctttgaccagtgcttgtttttggtcacgaagtctatgtgaaggttccactgattcccttgatatttacacaaaggcctatcccctaataaggaagggaggagtttctctgcaggctgctatgacctattggtggtggttccaagcctgataggtctcaaagtctcttgtttacattccccatgataccagactgggtaggaatggctccctgaacctcccctacttccagagacatggcctgaggacacatcttgagttgctcaggccttggttttctcctttgtagctaagagctagacttggtgtcatccagacacagcaagggcaagggt

SEQ ID NO: 6700 - DNA, 1022 bp, Homo sapiens
tagacacagggtctccttctgtcacccaggctggaatgtggtggcaagatcatagctcactgcagcctcgagctcctggcctcaagtgatcctcctaccttggcctcccaaaatgctgggactacaggcatgagccaccacacctggcctgtatttctctaaactgttgctcagatgctgggaacctgcaccagtattctagggccacctcctccctcagccagtgacttaccacctgaggctgggaactcttaggaagctctctgagttgtgtgccctcccagagagggacagggcacatgcaggtgtgcacacttatgttagaggggaaaagttcctgactatgggagaagcactttgtagttgaggcacctctaaaaagcgaactcaccatcactgctgagtttctcagtcttctagaatcacaccagcagcttttaagacctttaaaaaattttttttgccttaatttcatggagaattaagattctgtaccatgaattcctctgctgtaacattcacatttgcaacacctccccaacatacacacacacacatatacatagatttctctctactcttaggagtgtctctgcacttgtctgtttggcctttgattggggtgactttgctccctctaattcccatcttgaataccttgtaacctggccagggagtcatcctttagagaaaattgtgttttgttttgctcagcttgtgaggtccatgaagattaattagaggaagaaaatatcttgtttgcatccaacttaccagtgaattggggtgaaggaaggtgagtttccatctggggaaacagctgggctgtggctggtgccgctcgcacgaagggcagtgttgggtaaccctgcttcaaggggtctctcctgtcagcgcagtggccagcctggagccctctctgtcacgttggcttccctcacactcccacgctggggaagtacagttgcttgcactggaaagaaagcccagaaagaaacagcccttctcttagggccccagcc

SEQ ID NO: 6701 - DNA, 1046 bp, Homo sapiens
actttccccagtattgggaagctgctgctattaataaagatggaagggctgggggaggaggccgggaaaagtgcagaggcaggagaaaggagggctgtccagttctgtcctgggattggcagtggaaaatgagaggaggggaaaggagatgtggctgaaaggaacaggggaggggcagcaacctgggcgatgggcggatgcctgcccgcacccacagtgctgctgtagctggtctgagttctagggatgtctttaattggggtgggggagaaaacgtcattatacctgacttggtgtaggaggatagctttaggtgtctgtgtttttgaatgtctttgagactgtgtgcttcgccctccaatgcacctgtctcctgtctctacagttcagggcacaggcaggggtgggtgggtggcatgtgcatgcagagtattccctggggtgccccccagcaggcccctcatttccagactcgtggattggatggaagcaggcactgaactttgtcggcaactccgcagggtgtgtgtgtgcgtgtgtgcgtgtgtgtgcgtgcgcgtgcatgcgcgtgctttcttgtgcctggtgtgggcaggctcagaagtagtgggttgcatcagggccagatgtgcaattctgtgcgttcagcagctgtgccctgcagtggcagcctgagcctcatccttctccaggttccccctccccaggcccctgattctttctggtgccccaggccactggggttggaaacccttcagtagcccagtgtcactcaagtatgagtttgacttattgaatgtggaggaataggggccctgcctgccctcccaggagggagaggagggggtgaaccataggaacctaaatggaagaaccctctgcactctctgtaggccaaacagggggagtgggtggagcgctcttccttggccccttttctcttcccggagggagtctgccttaaagggcctttgctggtgttgtgggcgagggccacagaattccccaggatacaggggcagaagcacagagacctggcacctgcc

SEQ ID NO: 6702 - DNA, 1021 bp, Homo sapiens
tctgtcggagggcaagaagcagcctgggggctggccctgagccctgaggtgagctgaaagcacaggtgaaaggcgttttggggatcggcccggtttttgttttgacacagggtgtcgctctgtcgcccgggccggagtgcggtggcgcgatctcggctcactgcagcctttgcctcacaggcttaagcgattctcccgcctcagactctcgagtagctgggattgcaggcgggcgccaccacgcctggataattttttgtattttgtttttgtagagacggagtttcgccatgttgcccaggctgggctcgaactcctggggtcaagccatccgcccgcctaggcctcccaaagtgctgagactacaggtgttccaaagtggtgagccactgtgcccagcctctggccggttttgctaagctgctttggacaggaccgcgtaccatctgtagtcctggaggaggcaaaaatgagcctgcatttttagccaaggaagagcaagtgggacactggggtgggttgggaagtgctacctcccatccctttcccgatgcagaggactataagaagagtttacacaaacgtgctaggccctgttctagacgctggagacacagcagtggacaaaatcagcccgtatggaaattacatccttcctaatgaaatacatttcataccaaatttcattttcacaacccctagaaattggtaattgcggccaggcgcagtggctcatgcctataatcccagcactttgagaggtggaaggggaggaaggcttgagcccaggagttggagaccagcccgggcaacacagtaggaccctgcctctacaaaaaaaaattttttttaattagccaggttccgtggcgcacttgtagtcctagctactcgggaggttgaggctggaggattgcttgagcccaggagctattatcacatcactgtactccagcctgggtgaaagagcaagaccctgcctcaaaaaaaaaaaaaaaaatgaaaacaaaaatcaacatct

SEQ ID NO: 6703 - DNA, 1102 bp, Homo sapiens
agagaggaaagactagcttttgagtattgtgtttggaaaggacctgagacaggaagaggcctattgcatttaagaaaatcccggccgggcttggtggctcacgcctgtaatcccaacacttggggaggccgacgcgggtaatgggtcacgaggtcaggagatcgagaccatcctggctaacacggtgaaaccgcgtctctactaaaaatacaaacaattagctgggtgtggtggcacgcacctgtaatcccagctactcaggaggctgaggcaggagaattgcttgaacccaggaggtggacgttgcagtgagccgagatcgcaccactgcactccagtctgggtgacagagcaagactccctctcaaaaaaaaaaaaaaaaaaaaaaaaaacccatggcaggaccggggctggtagctcactcctgtaatcccagcactttgggaggctgaggcaggtagatcccttgagctcaggagttgagaccagcctagcaacatagggagaccctgtctctacaaaaaatacaaaaactagccgggcatgttggcacatgcctgtggtcccagctacttgagaggctaaggtcagaggatcgtttgagcctgggaggtggaggctggagtagtgagccatgatcataccactgtactcccacctgggcaacagagcaagaccctgtctcaaaaaaaaaaaaaaatcccatggtatttgaaacttaacatgcagaaatcaagcttactattaatattttctccctcaaagccaatttttctgtgctctccctgttagcacctatcgcccaagtcagaaaccctaggtatcactctggatatttgtcatgtgtcaacttggctaagctaagcaagactcccgggattccctctctggtatattccagttatagtggctacccaggagcacacacacaccatcttccagctcttcagacaaacagtaatctaggtgctgctgtgaggggattttgcagacctaattaaattcctcaattgtttggctttaagttaatcaaaagggagattatcctgggtggcctgacctaatcaggtggaagccctttaaaggagggctagaacacccc

SEQ ID NO: 6704 - DNA, 1044 bp, Homo sapiens
taattagccctcaggaagttcctctacttgaaaaaatgttactcccaacagtacccttaatcccatgagaatcaaaagtgctcttccaatcccagcattctcagtcttacttgaacaggtctagtagtggcgttttaaccataacctttcttccaccctgcaaaacttggtctttcattttctttgacacacacatccatttccaacctttgcttagtggataaagtgaaagattaacttacgacgtttgccctcaatttttagtgaagagagaattttggggaaaatcctactcttatctgagattgcataaatgttcagagaaacgtggaaaaatgaagagaccctgccagcatatcttctcctcttccagctcttcggggatgcaagctgttggtccctatcctgtgtttggctgactatgcctacccttccggtacagtactgggggtttcagggcaggtgagcaaggctgctgagggagaaatggaacatagaatttagagactgaggctgggtgcagtggctcacgcttgtaatcccagtgctttgggtggccaaggtggaaggatcacttgagcccaggagtttgagaccagcctgggcaagatggtcaaaccctgtctctacaaaaatacaaaaattagctgggtggtgtggctcatgcctgttgtcccagctacttcggaagctgaggtgggaggatcacttgagactgggaggcagaggctgcagtgagctgagatcatcgcaccattgcactccagcctgggtgacagagtgaaacttttgtctcaaaaaaaaaaaaaaaaaaaagaatttggagactgaaagacactggagagataacgatactgtgaacagatgttcagttagagagtctgtgctgctcaaaatataggagatttggggttgagcagactcaactgtgtgactgttccgaggcttaaccgtaagcttatacattgtgactccacaaacgagatggtagactttgattacatgggcctcttatcacagaaatggctggcctgggaggggtct

SEQ ID NO: 6705 - DNA, 1059 bp, Homo sapiens
taactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcggagctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgctactgctctttcttgctgcactttgttccctcttcttcttcctcagtcttcaggaaattgcacctcaagatcctaaaccacaagcacttttctccacacagagactgagaggttgtcacacagtcattgaggatagggccctgggccaaagagaaaccacagggccaagggcagctggacagtgctgctgggtccacactctgttctgaggagtcctcccctctctctgtcagggtgtgttcctgatgtttggaatactttggaaagtcccacaaacaggctaaaatcagatcccgagaaagcagagacaagttttgtcagataccctgttgctaaaacatggcttttttttgagacacagtctcactctgccgcccaggctggagtgcagtggcgcgatcttgtctcacgcagcctctgcctcccaggttcaagtgattctcctgcctcagcctcctgagtagctgggattaca

SEQ ID NO: 6706 - DNA, 1051 bp, Homo sapiens
ctcatggcttccccacaccccccactgtttctcttattccattttttttttctttttttttttttgagacagggtcttgctttgtcgcccaggctggagtacagtggtgagatcttggctcactgcaactttcgcctcctgggttcaagcaattctcccacctcagcctcccaagtagctgggattacaagcgcagccaccatgcccagctaacttgtatttttcggtagagatgcggtttcaccatgttgcccaggctggtcttaaactcctgacctcaagtgatccacccaccttggcctcccgaagtgctgagattacgggcatgagccaccgcacctggccttctcttatttcatttctaaatagctgtattcctctgtccttttcagccccattctaactcttgcatctttactactttcaaacaaccccaaatctcaaatctgcctttaaagaattacgagtcatgttctctcactggacttgtggagccaaagtttttttgcagacttctcttagcacttaatgaatacactgtgccaacagcccagcagttaggaagcacttgatttctcaggcagtggcctttgaaacagatgtcgggtccatgccagaactgccatagtgccaatgaaatgaattttcaacatgaacaaatagaaaattatccttcattacattttgagtgtttgtggttgtatagggtggaggagtgggagaggagagagggtagtagtgtaacagctgcagagagaagattacaggaagtttgggaattttgattattaccattttatttttgtcttccagctgctaggtcaggcagctcgaaacatggtactccaggaagatgccatcttgcactcagaagatgtaagaaacaacttttttttttaatgatttgggtttatgtatatggtttgtgtggccacagggaagtggaaatgttctatttctctctctcttttttatgcagagtttaaggaagatggcaataataacaacacatcttcaataccagtgagtatgccccctccagcaactattt

SEQ ID NO: 6707 - DNA, 1051 bp, Homo sapiens
tttactaaaaatacaaaaaaaaattagccgggcgtggtggcaggcacctgtagtcccagctactcaggaggctggggcaggagaatggcgtgaacccgggaggtggagcttgcagtgagccgagattgcaccactacactccagcctggggatagagcgagactccctctcaaaaaacaaaaaaacaaacacaaacaaaaaccccacacaggtaaaaacattcatcttgtaattttctattatcaggtttcaaaagatcacttctttcttgaaacatacattgtatgtcttttggtgaacaagattgttgttgtcttcctggtgctgacagtttggtgggggagatagacatgaagcaaatcatcacacgaataaactcatctgcatgtgctgtgggggagaagtacttagtgccctgagaatattggcaggtgggacgggagggaagaaagtagcttttgggtgacttgagatctgacagataagtaggcgtcaactagaggaaatttgggtgtggaaaagagactattgcagggagacatgataaggtgggaggtaacattgtacactcaaggagctgaaagatgattagtgtggctggaacacaaataatttgtgtgtgtgcatgttgaggggtaggttgggtggtacaagatgctattggcgaagtcagcagaagcaagcagggactccagcaggcagaccttgcaggccacactaagggttccaggatttcttctaagagcaacaatatgtccttgaagtattgggggtacatgagcatgacattattagagttgcattttcaaaaggtcttctgtgtggaaaatcttttgatgaggagagagaaaagatgtggagagacagagactggcatttggaggcctttgcagaagtctggtaagaaatgatgacagctgggtggttgggatggggagaggatgattgatttgaagatgccaaaaaggacaaggctttaccaacccccctttcaatgatagagagagagaggcaaaatatagatattatcttcataaccggggcccgaaaa

SEQ ID NO: 6708 - DNA, 1026 bp, Homo sapiens
ggcatgagacaccgtgcctggcctgtatttttcaatagtcatatttaataaaatttttaaaggcataattcaattaataaatgtaagatgatgagggacctgatacagtttcacctttcatgtttcctatgacatctcttcagaagcgtttgttgagccactgtatgcagtgcacaatgctgctaggcatttgtggacaatgcaaagatgatgacatcttggcctcctgggtgatccaggaatttacagcaatgcaatccaggtccaggaatttacaatccaggaattttcggggagaaagacattgccagtaatttttggataagctggttcttctggatagataaaaggacattgttaagaaccacttgctggctggaggtggggacttcaaggggacttcattttttgagaaggaccttaaaaggtggtaagattgggatctcttcaaggaaaactacaaaccactgctcaatgaaataaaagaggacacaaatagaagaacattccatgctcatggataggaagaatcaatatcgtgaaaatggcgatactgcccaaggtaatttatagattcgatgccatccccatcaagctaccaatgactttcttcacagaattgaaaaaactactttaaagttcatatggaaccaaaaaagggcccgtgttgccaagacagtcctaagcaaaaagaacaaagctggaggcgtcacactacctgacttcaaactatgctacaaggctacagtaaccaaaacagcatggtactggtgccaaaacagaggtatagaccaatggaacagaacagaggcctcagaaataacaccacacatctacaaccatctgatctttgacaaacctgacaaaagcaagaaatggggaagggattccctatttaataaatggtgctgggaaaactggctagccatatgtagaaagctgaaactggatcccttacaccttatacaaaaattaattcaaggtggattaaagacttaaatgttagacctaaaaccataaaaaccc

SEQ ID NO: 6709 - DNA, 1086 bp, Homo sapiens
cactccagcctgggcaacagagcgagactccgtctcaaaaaaataataataaataaaaaagatgataagatttcagctggtggagataggactaggagaggccatttctccttgaggggatgggaaagcaaaggtgaagatgagagaacaatgggagtggggctggaaacgtaaattggtttagaagggaaagtttttgagtgctaggataagtgatttgaactctatgcactaggtaattacattttcattaacatttatcaagaatctattaagctaagtcactgtttttaatgttaagaaatcaaagaattgtttttatagttgtccgacttttcaccaaagacagcacctttcataacctttatctcaggattccttccacgtccaaggtcctgacttttgtccttggaattaagccctaataggagagaaccatctttttaagacattgactgatttctctgtttaattttgatgcagtttaacaccatctaatataatctgccattttgagctatgttaggctggtagatcgcttacctgggcattacttgtttgcttctctggaatccttaaaaggatcacaatatagaatatagtactaaagggcagttgctgtgggagagttggaagtgctgagttgtgggatatttcagaagctctactttttcttttttctttgagatggagttttgctcttgtcgcccaggctggagtgcagtggcacgatcttggctcactgcaacctccgcctcctgggttcaagcgattttcctgcctcagcatcctgagtagctgggattacaggcatgtgccaccacacccggctaattttgtatttttagtagagacggggtttctccatgttggtcaggctgatctcgaactcccgacctcaggtgatccgcccgccttagcctcccaaagtgctgggattacaggtgtgagccactgcgcccggcctgagccactgcacctggcctgttttttctaactgtgttgaataatttgggattcctctctacccttagtttcaaaaagcaatattgtgcagaaagcaaatgaagtcaagtgaatatgatt

SEQ ID NO: 6710 - DNA, 1054 bp, Homo sapiens
ggggatctatgttgggcaaatcaagttaatctgcttaaacttcagtttcctcacctagaaaatgaaggtcataattgcagcctcactagggtatctgtgatctaggagggatttttgatagtggtaaacagtagattcctgccttactaatgtgtaggtcagtttatcatctacctagcaccatcacttttttcaaaaaaggtcttttcaaccaagaatatgtcatacatatctgtattttctgactagattgcaggttcttggtccttgtcttacttgttttcgtaactggcttatagaacttgatactcagcacatgttaattgaatgactagatgatgcatggtctcctttgagcctaccatagcatttggatttaccatcattatgtttacttatgtgcgttgagaaacttatgtgatataaggtttgctttaaactatgaggtcttaaatatttcccatggtcagagtagattattgatctagtttggctagacatgttccctaacttccttaggattgctgttagacttcctgaagctgaatttttgtgggaagaagattaagacttttgtgacttaggagaggtaagttttccctagttgtatactagcaggggctaacttacctgatttcaccctttaattggtcaaaagttttggattgcagcaacttctgtataactttttccaaagagaattctattatctgataattttggaatgttttttgttttgtctgttgccttttgcttatagtggattgtttcctcctattgtttgtgattgtggcttgtgagtaggttttttgttgtttctctctcccaagaagagctttacctgtggaatcctgtatggctttggttgaggatgtattctttgttgttaatttcttgacttaaaggtttcaggacgaccaaggtagtaaaaatttaagcttcaaacctacgtaaggtgtaggtctgtcattaaaaattttcagggtatacttttccttccttccttcccagagcctcagcagaggcaggtaagtgtccttagcagctcacctgg

SEQ ID NO: 6711 - DNA, 1045 bp, Homo sapiens
catgacttgcactgaactagatacacaccatatttatggctttatgtcagtgttcaagtgtttttgttttttttttctgtttcttgatggctctgattaagttagagttaacaaactctcttctgatgccacattagtgggcatttattttctggcttgtaaaagcaggattagtcccttagactgaagccacacttgtgtttttcttactcataatgcaaataatgacttcaggcagtggtgtgggtgttcagcgaatgcatacttctatttgcagagcagttttacctgtatctacagcagggaagcccctctgggctttatttagtaggtgacagaggaaattagaatggcctggctaagcacatcaatatgcataattgacaggctattcaatactgttaaagataagtactttccattctttaactatcaaatgcagctcaaatgtattctagattgtattattttctgagtattttgttacagatccttcacgtatatatgcgaacttaaagtaaacaaatctaaggaactagaaaaacacaggcttgtctctgggcaaggtctttaaaattatcaatgtgattataatgaatgaataacatatagcccttcgaagggataaggtaaacaccaagattggaaaggcagacataaaactttattcacaggtgacacgatcttctatatagaaaatgctgaggaatcgactacaaaactattaggtttaggccggcagggtgactcacgcctgtaatcccagctctttgggaggcaaagccagttggattgcttgagaaccaggagtttgagaccactctggccaacatggtgaaaccctgtctctactaaaagacaaacaaaaaaacctattagcattaataaatgagttcagcagggttgcagggtacaagagcaatattaaaaaatcacttatttctttttgtttgttttttgagacagggtcttattctgttgcccaggctagagtgcagtggcgcaatccgggctcactacagcctctgcttcctgggttcaagtg

SEQ ID NO: 6712 - DNA, 1226 bp, Homo sapiens
taattttcagtgtaagaagcctaattcacaggaataatttctcctagagtaaggccctttccagccaaatctgtcggtgctattgagctggtatttcaagtatgtccatctgcatttaaacgagttgctccaagacaatctgattatacggtagttactttggtgagaatagcgcctcagtggaatggaaacttcattttgagtctaatattagaccttgctttggaaaattccttttaaatgatcacaagctgggaatagcaaaagaatttaactttcgacagacagcattcaccaagaatttttaactgcttatgttgggtccttgggaaagcagatgtgagaaacctaccggaccaagtggatgagatgagaattgacttgacctgatgcagtgtttatatccattgctgataagtttccctcctcgtctcctctgctcaaaatgttttcattctttgagcgtgagcatgctagggatgaagattgtaggatgcctaattgtctaacaatctaaacttctaggcttgtagacacagctgcctagaagggggtctgaggcagagcagaagctgacttagactgccaagttaagaaagggccaacagatctgcaggaccagagccattgtctgcgtaagtgctgggagcttgatcagatgcagccctcagaatatttttaatgtggctggttgtatctgggtgaacttacccaacttaaagtgttaactaaactttatttaaagctcttgcaccccaccccccgccaccgccaccaagaaaacactctgtcattaaacaaaaattatacaaaaattagctgattaggaagtttccagataatgcctactttggcttcatttatggatatgttttagatactttgcatgctttggattgggaaaaccaatattgttgtttgagagatgctgttactattttaaaagatctttgagattgaaatgcatctttttaactttttattttatttttttatagaaatgagttcttactatgttgcccaggctggtcccaaactcctggcctcaagcgatcctcctgccttggcctcccaagatgctgggattacaggcgtgagccattgtgccctgcctgaggtgcatcttctaatcactttgtacatttaataatatagtggggttttttccctctaagttggtaataagttgatggtgccttagaatttaggaaaaacattaataaaat

SEQ ID NO: 6713 - DNA, 1050 bp, Homo sapiens
cattcggagtatccagtcaaattgccccagacattggctgctcagtcactaataacaacacacagtgccgctgggctaagccggcatttcctaggtaagaccaaaggtctcattcaggcctctcaattggctcttgaaaacaaggatggctttataggtcctcctctgctatgctaagcctgggaggaaggtcggagcaggcatggatagtcactttcaagtggaaaacatccggcctgagtgtggcgaggcgtgtgcaggtgggtcttcaggattcagtggatatcctgcattccccagtaatcggtgtgtatgatacacgttcttttccatcactactttgtcttctgttccttcttaccctcatcactcacatgagaccagtccctgaagaacttacggtggagcttcagggaccctctgtgatccattcctaaaccacatctttttggaatcccttttctctccacttttagtctctattttacattccaaagaggatcgtgctctgaaaatttagcctcttgactggtccatttatagtctccactgaatttatttaaccgtggcatttgcagtcttttacttacacttgttctgtggatggagacatttcagggaagaactgctgacagaattggctttcagacactgcctgacctaactaccgctcccatctccccaggtatcgcccaactacctgaaagtagaatgaggtgtatcttagcccagtgaaatgctgtcttcgaaccctgcttgctttcattagaagcagggcagaaagtggcagcagagctagggaaagaaatcatggtagcacattcactcccagcctcctgccttggtttgtttttcctgttttactcacttggtctagatgagcccttagctcaaatcaggaaatgctccaaggaaaatggaggcaatttttcctgctgtcaagatgagatttgcctaaaactcccccctgcatcctcagagtgcgcacacatccgctcatttctaagctttatcgtgatgcacccggggtttctatttcacaaaaattgt

SEQ ID NO: 6714 - DNA, 1025 bp, Homo sapiens
tgctaagtgctatttgaatgattctgcatttactcataaatgacttatttttgaaacactattaaatgcattagcaaaggagctatgtggaaactttattggcttatttaagggaagagaggaagtctgtggatcttgagttggaaatttgatcgtagtactaacttatccaactgcttctcttttcttctctgcctacccctcccttataatacaaaaattcctttttagacataatagaaccctggttcatcttcattgagattctgagttatgatgacaatatctgtgtataaaatagcttaagttactagtacaacctgtaattacttcatattctaaatcctgtttcctgatattttcatggatcctgaacaaaccccctcatgaaagaaacagtgaaagaaatgtggatgtaatcactggcctgctcagatgtgtcaagatgggtgtttacttcacaccgttctcatgtatacatggaaatctctgagcctgtgtaatgtcagtaatgccaactaaagagtcttagatgcttcaattctaaggggcatcctgtgacctcaaatctaaaggaagctctggtacaattacagttggtttgtgcctcttatcacaaaaaaagacattgtctttttaaacatttcaatgtagcctggtgtttttcctattctgccatcaagaatgaatagtaaatggaaaagttacataagagactgacacacatcctattctggttttacgagctgttgttctgaccttaatacaatgtcaatagtaaataaggtggcataacagtagagaaaatgtataacagtaaagctatagctacagaagttgtcaaattgtggcattatgatttgaaaatatcgggacatttcacaaaaaaatagtagatactaaatttcatctgctgtttactagggtaaaaagttcaaattagtgacaatagtggaaatatttttattttgaaaataaagcttattcttatttgtttaaaatattattagcacatattcacttta

SEQ ID NO: 6715 - DNA, 1034 bp, Homo sapiens
tgctggctagcattctgcttcttgaagaaaccacattttgcagattagcagtctgtcagatgctgatctgtaaccacgaggagataatgttaaggactttatgtcactcatttactcggaaaagaatttctcatttgaagcctcagaactagatttctggatttagtattataaaactaagtaacaatactaatggaaatcactagtctgtttatgcctatttgccatttgaaaaaaaacaagcactgaacagcctgaaatttaccaattctgttttctattttcactccattgtccactgttggtaacaacaaattcagcaatataacacttttagcagttgtctatgcaaataaaaccaaagaaaccaaattcagaaatagtatagattagtcccttcattttgtggagagtgcatagtttgattaaaaacaactttcttgctctgtcccaggtccaaagacctaatcttagattggctttcaagatctttttaagcttgttttgtcctggggttagcctgactcatctgtgtaggtcacttaaccataaaaaggctaaaaaagactgtgtgctcagataaggaccacaaatgaaaaacctggggtatagaaagtatatacatgagggcaacttaataaattaggaaactagagcacccgacaggtctaattaagggagaaagaggcctcgaaaaaagggaaaagaaaaacacatacccgcagaggaagtcaaaatgcaaagggccaaatcctgatacatatcatgtgcaaagaacgtcgctaaagtaatttggggtgaaagaggaattgtaaataggcttggcaggtattttttatataaaacatagttggccggatgcagtggctcacatctgtaatcccagcactttgggaggccaaggtgggcagatcacaaggtcaggagttcgagaccagcctcgtcaatatggtgaaaccctatctctacaaaaaatacaaaaattaacagggcgcggtggtgcatgcctgtagtcccagctactcaggaggctg

SEQ ID NO: 6716 - DNA, 1048 bp, Homo sapiens
tgagacctagtctcttcaaaaaaatgcaaaaattagctgggtgtggtagctcactcctgtaatcccagctatttgggaggctgaggctggagaatcgcttgaacctgggagatagaggttgcagtgagctgagattgcatctctgcactctagcctagatgacaagagtgagaccctgtctcaaaaaaaaaaaaaaaaaaaaagaaaatgtgtggaggcatttttggttgtcataatgactgggcggaggagcaggaatactaaatgttctaatatgtgcacctaggtagtcccactttacaaagaattatcctgcccaaaatgttaatagcacccttattgagaagcactggactaggttgtggtggaggtgaagagaagtagacaaagtcatgagacacttgatagattggctagggaggtgagggagatggagatatcattgaaatctccagttttctggccgttctagctggataggggagccaattcctgacacagaaaaccctagaagaggacttgatttgtcagccttggaataattttgagttctgatttgaatatgcctttgactcatttaagaaatgtcaagttgataggtagatgatatatgagagctcagaacagaggtagggactagaactattaattggagttgtgtgcaatattgatggatatggatgaggttgactaggggagagtatgaaataagtcagtcagtgggctaggcccaaggagctccaaatttaatggccaagtagaagagatacacaggaagaaaaccaggggagggctgagttatagaagccaagggaaaggagtatttaagaaggaggcaggctgggtgtggtagctcatgcctgtaatcccagcactttgggaggctgaggtgggcagatcacctgaggtcaggagtttgagaccagcctggccaacataacaaaaccctgtctctactaaaaatacaaaaattagccgggcgtggtggcagacacttgtaatcccagctgcttgggaggccgaggcaggagaatcacttgaatctggg

SEQ ID NO: 6717 - DNA, 1063 bp, Homo sapiens
tcctgagtagctgggattacaggcgtgcgccaccatgcccagctaattttttgtatttttagtaaagacggtgtttcaccatgttggtcaggctggtctcgaactcctgacctcgtgatctgcatgcctcggcctcccaaagtgctagaagtgtaagcgtgagcccccatgcctggcaagacctcagcttaaaaaaaaaaaaaaattgtaccagatgaactcttaggactgtgagtctcatttttcttcccctcagttaactagtaagtggggggcccactcagaactaactttttatgtggatgtttctgtatttattttgtatagatttttggcgtttcacagctatctactaattgtcatcttttgctttcaataactttataaaaggctctgggctacagaccactatcagcctttaagaatatttgccggccatcttgctgatgtgaattgtaccagattccatccaaattctaattatgttgctacgggctctgcagacagaactgtgcggctctgggacgtcctgaatggtaactgtgtaaggatcttcactggacacaaggtattttacactcttactattccagcatccaaggttgctttcaaaataaaaatattttttaaacaagtgacacataaattttaaagataccattcttactacaaaactttaaaattttgtcttattttcctagacatactttgatcttttctatgaacttttttctagggaccaattcattccttgacattttctcccaatgggagattcctggctacaggagcaacagatggcagagtgcttctttgggatattggacatggtttgatggttggagaattaaaaggccacactgatacagtctgttcacttaggtttagtagagatggtgaaattttggcatcaggtaaatgactattaatggctttacgataaatgctatgttaagaggaaacagtgttgacgactgcaatactaagtccttatgttttaggttttacttccctttagctatgattccagagtgtcatcctacatcaatcacttctcaggtta

SEQ ID NO: 6718 - DNA, 1073 bp, Homo sapiens
tagagatgtgcacctgtacatgttcatattccatttctcctggctgtgcttgggaagggttttctttcttgccagcatgcctgtggtagccctgaattttaggcaacctctgccctagtttatttaattctgtgttttctccttgtcctaggtctattattgaagctcagtaccttagatatcatgacatcgaacctggggcagtggtaaaggtaagacctcaagcatataattaggtactgcctcaccatcaggcgttctttagttcacgcacaggtgactgtcagcccgttagtcctcatgttaacacattgaatgtcatgttccttgcttctgcctgctgactagaatttctttctctttctttgggtaactcatagttaatttcaaggtaagatcttactagcaccacccagctacacaaaggcagtagatcataaatcctgagatttgggatttgatggtggttagtagacctgatcaaaagttagtcctgtgattattgatctacctgggatattagtgagaagccagttccaggtacctgtcctgtccgaccatttggctctaatcgagcagctccctttatatgtagagtttattccttaggagaccttgacatagtcccttcctttggggaatgtattttaaggcacacagaaagcacatgctcacacagaaagatgtgaaggctcccataaataaagctgacagaataatccagctcagtgtggggtgtgtgcttcacccatgtgccatctggaataacaggcacagttagcccaggaagttggctgtgaaggggaggtatgacatgccttgttgtaagaggtgggggaaaggccattcttgagacattgtggcagcttatctttggattctctagggcacagtgctaaccataaagtcatatgggatgctggtgaaggtgggcgagcagatgaggggcctggtacctcccatgcacctggctgacatcctgatgaagaatccggagaagaagtaccacatcggggatgaggtcaagtgccgggtgagcctcctgaagggtctcttggggttttggctagatg

SEQ ID NO: 6719 - DNA, 1034 bp, Homo sapiens
atagcaggttcttggggaatggccccgtggcttttgggtttaagaggttgcagagaccagctcagtggctctcatgataacagataacttgatgacagcctgtgtccctcccctaggttttgctttgtgaccctgaagccaagaagctgatgatgaccctgaaaaaaaccctgattgagtccaaactacctgtcattacctgctatgccgatgccaagcctggtctgcagacacatggcttcatcatcagggtcaaggactatggctgcattgtgaagttctacaacaatgtgcagggactggtgcccaagcatgagctcagtactgagtatatccctgacccggagagagttttttacactggccaggtaacccttcccctagacaggtcccctttacccttggtgaccccacaaacacaaatatgaaggagcagtaagtagtggggctgcctttaggaggctgaggaagagagcacatggggcagtgggtgtgagccggctaaatggaggagacggggaacagaacagagagaaagcctcagcggggttcagcagaagctggcaagctgatggatctcaggcacgcatggaagaggtcagtctttacttgtaataaacctgtgcctctcatatcggaaattgttttgaggtcactgtcaccacatgggggcagtgctgtaaaactagtaagtcttggtatcactaggaaaagcatttttttattcctttaaacgactttaaacagatagataataattgtacatatttatggggtacaatatgatatttcttttttcttttcctttttttttttgagacagagtttcctctgtcacccaggctggagtgcaatggcgtgatctcagctcactgcaacctccacctcccaggctcaagtgattctcgtgcttcagccacccaagtagctgggactacaggcatgtgccggcatacccggctaatttttgtatttttagtagagatgggattttgccatgttggccaggctggtctcgaactccctggcttcaa

SEQ ID NO: 6720 - DNA, 1049 bp, Homo sapiens
ggctatcaccagcctcctcctcctgaatcagtgcctggaggagctgcagggcgtgcgcagccttatgagcaaccgaggtggggcacctgtggggcaggggaggtgggccaggggtgggagtatgtgttgtaaattacacctgttgttaggtgagttgttgggcttcccagaacataagaaaaaaaaatttggggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaattagccgggcgcggtggcgggcgcctgtagtcccagctactcgggaggctgaggcaggagaatggcgtgaacccgggaagcggagcttgcagtgagccgagattgcgtcactgcagcccgcagtccggcctgggtgacagagtgagactccgtctcaaaaaaaaaaaaaaaaaaagaaaaaaaaaattgggttaactttttttttaatggaagtatgacctgcataaagtgcacaattttattattattattattattattattattattattattattattgagaccaagttgcactctgtcgcctgggatggagtgtggtggtgcgatcttggccactgcaacttccaccccccaggttcaagcgattctccttcctcagcctccggagtagctaggattacaggcatctgccaccatgtctggctaatttttgtatttttagagaagacagggtttcgccatgttggccaggctggtctcgaactcctgacctcaagtgatccacccgccctggcctcccaaagtgctgggattacaggcgtgagccactgcgcccggccaaagtgcacagttattatgtgtgcagctcaataaatgtttatattacacccctttaagataaaggtcattacgagcatcctagatgtcctcttctccccactgccagtccagagtcaaaatttcccttagttctgtggctttatatttgcatttgctgt

SEQ ID NO: 6721 - DNA, 1048 bp, Homo sapiens
gaaagagaggctaggtgccttgcacacaataagctctcagtaatgactctattcattgcttgggttgaagagtgattaattgggggtgggggagctgcaggacagattcaggaaccacagtgtctctaagctgagagagctgttagaggttgcaaggctgtgcatcagaattatctcaataacttgtaaaattcagatttactagatctaggatagggtcttgcaatttaaattcaaagcaaagcaaaaaccaagccaaggtaattcagaggcagccccatgagtttagtgtacaggagaggaaagctaggtccagggagtgaaggctagtctgttccagctcagaccagccttgagttccctagccttgggaccccagagggtttcctcagccacaccctgcccagtggggccatgagtgagtgaccatgctgtgtaaggaaagcagggatggtggcttttctctcttctagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatggaggctctgggggtgggctggcttcgag

SEQ ID NO: 6722 - DNA, 1005 bp, Homo sapiens
aattcaaagtctggccaataatttgcatattaatttcagtagctaactgtggggtcttcagtaagtcaattatcctctaaataaagacctcagtttccttatttttagaatgaaagaattggagtatatagactgtaaggaaaattgttttcaggatctgatatgacaatcctaaaagatcaggccaggcacggtggctcacgcctgtaattccagcacttttgggaggctgaggtgggtggatcacctgagatcaggagttcaagactagcctggccaacatggtgaaaccccgtctactgaaaaaacaaaaattagccgggcacagtgcctgtagtcccagctactcgggaagctgaggcaggagaatcacttgaactcaggaggcagaggttgcagtgagctgagattgtgccattgcactctagcctgggcaagagagtgagactccgtttcaaaaaaaaaaaaaaaatcaggtgaggctgggtgtagtggctgaaccctgtaatcccagcactttgggacgatgagggaggtggaaaacctgagcccaggagttcaagacctgcctgggcaacatggtgagaccccatctctacaaaaaaaaaaataaataaataaaaataaaaattagctgggcatggtggcatacacctatagtcccagctacttgggaggctgagctgggaggattgcttgagcccaggagattgaggctacagtgagccatgattgcgccactgcattccagcttgggtgacagagtgagaccttgtcccagaaaaaaaaaaaattcagatgagcctgctccttactaataactgcaaaggttgggaatggaaaccttcagcctgacacatctgtcttcagtggtggtgtgacagtggaacagggtgcttttgtgagcttggtttggtggagagtagggagaaatcctgacctacagattactgtgttacagagatgaagagaaatgattcagcttatttgtttctccaggtatct

SEQ ID NO: 6723 - DNA, 1103 bp, Homo sapiens
agagacggggtttcaccatgtttgccagggtggtctttcctgacctcaggtgatccgcctgccttggcctcccaaagtgttgggattagaggcatgagccactgcccctcaccccctgctggatttctcttgtttttaacagaaaaaaaagaatgacataagattatgaattgaattgcatttctagaaagctattttatctattaaaccagttgaaactaaactcttggctgtgtgctggatgaaagtagtttttatatgacaactgatggctgtgtgccttttaaaaaatagtaaaatatataatctttgtattaaaaagtatggaaacatatacatttagcagataataaagtgaattattattaacaactgtcagtgtcaaggaattctgctaacatccgagaatccctcttgcctcctttctgtatctaatatcttctctctccctaaaggaaaccactatcctatctttaagttattcatttatttgcttttcttaatcatttactatctaggattatatccctaaatgttataaatttagttttgtatgcacttgaactttatatgaatggaatcatattgaacatattcttttgtgtcttgcctctttcaaagtcagtattgtgtttgtgaggttcatctttatcacatagagctgtagttctttttcgttgtagcattgtattctattatatgatgatatcaccaattatttactattgtacaattaatggatatattggttgcttccagtttttggctcttacacaaaacggtagttgcacatatacatgagtttcactaagagttaatccaggaatggaattgctaggttatagggtagtgtatctttaattttaccagatgatgccaaactaattatacaagtttacattcccaccagcagttgaagaatttccttgccctgccaggcgcggtggctcatgcctgtattcccagcactttgggaggccgaggcgggcggatcacgaagtcaggagatcgagaccatcctggctaacacggtgaaaccccgtctctactaaaaatacaaaaaattagccgggcgtggtggcaggagcctgtagtcccagcta

SEQ ID NO: 6724 - DNA, 1029 bp, Homo sapiens
ggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactat

SEQ ID NO: 6725 - DNA, 1097 bp, Homo sapiens
ttcgagaccaacctggcaaacatggtaaaaccccgtctctactaaaaatacagaaaaattagctaggcaggatgtcacatgcctgtaattccagctactcaggcggctgaggcatgagaatcatttgaatctgggaggcggaggttgtagtgagcagagattgtgccactgcactccagcctgggcgacagagggagatcctgtctcaaaaagaaaaaacaaacaaaaacagaaaagaaaaaaaaaaagaccaggcccagtggttcatgcctgtaataccagtattttgggaggccgaagcaggaggattgcttgagcgcagaagtttaagaccagcctaggcaacatagtgatagccctatctctccaaataaataaataaataaataaataaataaaaagataagttggtcatggtggcatgcactgtagtcccagctacttgggaggctgaagcaggaggatagtttgagcccaggaggccgaggctgcagtgaactgtgattgtgcaactgcactccagcctgggtgacagagtgagaccctgtctctaataaataaaatagaaaaaaaatttccatgttagaaaaaaagaactcatttttttgagaattttcataacatattttagtgcatttgactttttcagtattgtgaaggttatagtacattactaaatttaaatactagttatgttctcttaggaaacatctttactataaggtattaatatgggtgatggaaaagttatcatcttgagctatattgttttacagagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggtaagtgtaaactactgtttttaattactaaagctttttttttaaaaaaattgttttaagactatctaaggatttaggaatactaataatacttgagagttaaatagcacctattcattctttcattcggtcttctcaaca

SEQ ID NO: 6726 - DNA, 1121 bp, Homo sapiens
agttattctatggcaattgaccccttttatagcagcgatgaccacaatttactaagcagctattacgtgtttggagctccatagattctgaatgctcccaccaactatgctacataggaacctgtggctcagagagatgagtgagactcaagattacacatttagttagtaggcagagttggattcaatcatgggttcacctgcccctgaagtctgcatttatttttattttttttttgtagagatggggtcttgctatgttgcccaagctggtcttgaactcctggtctcaagcaatattcccaccctggccacccgaagtgctgggattacaagtgtgagccactgcgtctggcctaaagtctacgtcttctgcacagtttttctctctgctctgccgccgcatccacgcatgtttgtataataatagctaacttatattaagccactcctctgtgcctggcattgtacatccttataaaacctgtattatttaatccttattgtagagacaggaaagatgagtctcagaaagttaagattttttgcccaacatctcacaagtttcaaatgaacttgaattcaggtagttaattgtctgaaaataactcttctttccagcagacttgtaaatttcaaagtaaattggacatttagtttaaattttgcatttttctggaaaaagagaggaaaaataggaaatccttcataatttccaaaagttttagaataaataatatgggaagaggctacattgttatggatatcctgggccacttagtgaaaatggctgaatgttattatttggtgcgtttaatctacaaattcagacttcattttcaagcttcaaatattttcgagatatctgtggagtatagctttatgactaaattttgtgtcccaagatgcttcctttactcttgatgctgaaataactacactaggttaaatacagaaagggtttgtaggtcaacattcaggaaaatagcacactgaacatgtggttttaaataatgttttaatgaagaagaatgagaaggttattttgcaagacagaggggattgtcacattacgcttacctagaattctaaggcaagaatattaatggagactcataaat

SEQ ID NO: 6727 - DNA, 1045 bp, Homo sapiens
gaaatcagaaaaattttcttccctagctctttgcagttggggccaagttttgtgacctaggctcttcctgtcagacacacacatagagttcaaatcagaaacgagcaaggtaaggaaacaggcttggtgggatatctgcttaagatattcagctctccactggttttcctggtgagagcagcggcagagcttctgggtttcagcagtgtgggttacaagataaaattccagagtagaaatggcatcagtgccagtggtgttagcagttatctcagactctactttctggcagcctcacaaactgaagcatctggtgctcagcttggactggcagcagtgagtgcttcccattaggccatttctcagcatgaatttgggatgttctgtcttaattccaagcctgtttgttccgcctcccaataattctatgagccactcagtctcctttaaagaaagttgtgttggccgggcgtggtggctcaagcctgtaatcccagcactttgggaggctgaggcagatggatcacctgaggtcaggagttttcagaccagcctggccaatatggtgaatccccatctctactaaaaatacaaaaattagcctggcgtggtggcgcacgcccataatctcagctactaaggaggcggagacaggagaattgcttgagcccgggcagtggaggttgcagtgagctgagatcgtgccactgcattccagcctgggtgatagagcatgactccatttcaaaaaagaaagaaagttgtttcttaaacgtgccagggtagcttctgttatttgtaatttataaaatcctgaccaagccagcattttaggccacaaaactgttcctaagaccagtccattacctctgtgagcgcaggaacttgatgcacccttggtgtttctagaacaccttgacaccaggactgtaagggttctaccatatttttatgtgagggggccgatacagttagccataaactgataaactaagaaattattctctgtctaggtgccatccttggtaggaagctttattagaag

SEQ ID NO: 6728 - DNA, 1049 bp, Homo sapiens
gaagagagaaagataaacctgtttgctttctgaaacaacaagtagtaaaacaggttgtttagggtaaagtcccttgaactagataattgattttaaatacatttgcctataataataccttatatttacatagtgctttgaaaagttcaaagcatttttacatttattatctcatttgaacttcactacaaccctatgaagtaggtacagcacgtattataatccaccgccaccaccacttaaaagacagctatactgaggcacaagcatgtcgagaaacttgtttaaggtcatataaccagttggtgttacatctagaactggaacaccagaactctgaaactgaagcctgtgttttcttggcagaaagtgcctctgctactgcttgatctacccagagttcctgttgagatttgtggctacaatttaattggagaatacaaatcaggcacgtctaaagagctctacagaaaagagattgtttcttttagatcatgactgtgttaggaaagggaggtagagaatggagtcagttgttttggacaatgcaaattaaaaacaaacaaaaacactttgtagtcagtttctggatatgttgggagcaattcattcattaaatcgtgtattcattttttaaagtatccgttaagtgcctttatataagagactgtgctgagcactttgggaagaggtaaagaaatgcattcaatttgcggggaggggatgtgggggaatgctttgaattatacaaataatcaccattttattcattgttcaatactacctggtagatgaaataaaaagccctccttgcagagaagcaaggaaaacaaaaacagatgaaggaaactgggcaactaatttcttttaattctctccctgtaggaggcattaaaaaaaaaaattgaggccgggtgcggtggctcacgcctgtaatcccagcactttgggaggccgagacaggcggatcacaaggtcaggagatcgagaccatcctggctaacactgtgaaaccctgtctctactaaaaatacataaaattagctggg

SEQ ID NO: 6729 - DNA, 1049 bp, Homo sapiens
tattttcctttgcttaaatggagcagattaactttatggaaggaggaccaggataaaataaaggcagctacatttaactcttcatctttctgaagagttcagtctgtgataacacttaaggtgcccagaagtgctggcatgttggtaatagtttttaaagaagaaacgggtgtatctattttgaatgttaaacataatttgaaggagttcttgagatagttggttatgagacattcaatgtattgctacattttacatatatgatatcaggaaatgtttggtgaacatttgacatagttgatcatatgacacttgggaaatattttgcatgatagaaggatagtattttcgtaatgtaagtttcaagcattgactgaaagggagaaaattacacactttgctgtctcacccctttcttcaatattatgctggcatgaatgtgaattctgcctaattatgtttaaagtgtagatctggcctttgtaaaaccagaatgtcttttgagaccaagagaacataacatcagcaacagcccaactcctacacacaatcctaaaacctagatacagggtggtgcccaacttctgaggttttgaggcttcctgaagtaggcctatcatgtctgagtgcttttgtcacatgtaagcctacaggtggttagctggttaatctctcccatttcaaagcagttggttagcagtactgggtggcatgtatgcatgtcatcagagtataagaagtgtttgagggaagaaatcacataaaagcatagaaacctggctctgaacaaactgtgtagcgtgttggggaacagtcacatcagaactttagcttaaccgagttgttatatgtaaagtgcttagaatggggtttgtattcagtgctttttgtgtttatcattatcagtatgtaaagtgacatatctttttgaaggctgttaggtcatgctacccagcatgtgaagactcagcaaatatttgtaatagccaatatttatttgcctaacctctgtgccaggcactaagagttttatatgatttaatttactt

SEQ ID NO: 6730 - DNA, 2343 bp, Homo sapiens
gcacccaccaccatgctcggctaattttttatattttagtggagacagggttttaccatgttagcccggatggtctcgatctcctgacctcgtgatccgtccgcctcggcctcccaaagttctgggattacaggtgtgagccactgcgcctggcagaatgtttgattttttttttaagtggacatcaaatttattttcagttaaaaatgctgaaagtaatacatttttacttcatctgtcatagtgaatgttgataatgataaaatcttatttctctaagcactttgccatagctaaataccttagtaaaacatgcgatagacaagggtccggtcactagccacagaaaggctgtcactgttatagcagaatgtaatagggaaggaacattttatgcctcaataagaacagtgtatttgcttgagatagtaataacctctgagaagctgattaattggtaatcacttaagttagatgattttatattgtttgatgtcttataatctaaacgtccctgtgctcttttagagtgtctgccttgaccagtcagcatttcaggagggattgtgactgtcagttaagtgctttgaagagagaacccctgctttgtgtcacacctgaatgtaacaggacatacttcttggggctgtttaatttgggctcaaagggaagagtgccatctactgaatggccagcatcaagttgagcagctcctgttttccttacagaactcagccagttcctggagaaaccaggcccagcttcatttggaggatttgacaggatcttagtaccaagtggaattgttgcctgcttaattttaattatgcttcccagcaggaggcctaaacacatgatgaagaactaattcagtacttgttggaatgcatgggaaaagagaaacctgaagaagttgttgagccttatgttaaaaacagccgagtagtggtgaaattaaattaagtggtaaagaaaattattttaatgagagcagtctttcaatagcaggtctggttggttattgatggctcctgcagacaataatgatgttaaaatctgcttgggcttagaatcagcaaacaaatcatttgcctaactggaggtaagggttttaagaatacttgaatacttcgattgtttttttctcctgccctttttgtctcattttgtaaggcaatgattcctacttgagtgaattcactgtttcaaagtagattttgttgttgttttggtgtatggtagtggtttcctggtttttgtttgttttttctttccctattttccaaaaacttactgtggtagcagccatgggtagaactggaggtagtagaactagttacaggtcagtggaggtttaaggtatctggaataggcttgtcaaagccagacaagaaggaactttgaaaatatgaattgaaaggaagctttgaaattgttgctataaaaatacacttgattgttacatatttatatatattatatgtaattacttaattagtaatcatttttgttagcctttaaaacctgccaaggatcattttaagcacttcacataaattatccaaagtttagtgaagtaacttgcccaagatcgtaccgttaacaaagggcagagccaagatttgaggtcagggctaatacccttaagcactatgctatatactgctgatttatttatgtttatttttgttggtgactgcacagaagagttgaaccaagattagaatgatatttctgccttggctggaaaatactgatgctggggttcttggtttctgttgttgtttttaaggaagtggtaacatgggtaaatacgattgagaattcactagaatcaggacgtatacatgagatgaacttccaaatgttttctatttgattttgtctatgttaacttttgttccttctgctatatttaaaaccacaagaaaagtttactgaaacatgaagtgaattgtttcaccctggggcgtgtgcttaaaatatacccttcatgggaagagttactgaagaggttttggctgggtttattttttgtaggggagtggggatttgttttttgtatgtataatatatacatatttagtttgcttccttctaaatatttttatgtggtagtacttttcaatatggcaataatcatgtccacagtacaataaaattaaaccatgtgccatcctgaggtcctaggggaaaccaagtttttgtgcataccaagtacgttctgtatactgaataagtaccataccttacgtgtatgtactaaaacttcattgaatccatgtattttttaaattaagagatatttaatacctgactactattatgagtaatggtcttgtt

SEQ ID NO: 6731 - DNA, 1068 bp, Homo sapiens
ccagcacaatgcttacttcctgggtgataggatcaattgtaccccaaacctcagcatcacacaatatacccgtgtaataagcctgcagaggtacaccctgaatctaaaataaaagttgaaattataaacagaacttttgtgcaatggaataacaaaagaattgaaggcattgggctttgcaatatcaggtattgcatgttgtcattacaggaagtcattgtgccatcttggtttccccttaataacatatggtggtttatcttgaaacttcaaaagtaaacatagcgtaagcacctataataaattattgccaaaaaaaatcacatgcagaattatttttgctatgtgaatttagtggagaatccaatccagtaagactttttgcacatttgaatggtgaaacaagatgatttggctcctctagtagctttgttgcatgcacagttgaccatttttgtttgtagctccttgtaataagatatttaacacagggctttatattgggacatagtgattttataaatgggtgggagaaaacactgaatttgacagaactaacttctagattatttcaatgtaaaattttcatgcttaaaatttttaagtgttagatgtttaaaataacttactcaaaagtaattcttagtaaaatgaaaatcagtgaaaagcactcagttttttaaaagcaagaatgattttattggtttcaaagttaaacttactatttgaatcaaatttttataaaatccatttattttttaaatacttgaaattttgagtaagaaatataaggacatggaacaaaataaggcacaaaagcgtatacagtgaaaagtaagttgtcacccccaaaccactcaagtttcctcctcttttcttttttttttttttggagacagagtctcactccatcacccaggcaggagtgcattgggttcaagtgggttcttgtgcctcagcctcctgaatagctggagttacaggcgtgcgccaccatgcctggctaatttttttgtatttttaatagcgtcggggttttgccatgttggccaggctgctcttaaactc

SEQ ID NO: 6732 - DNA, 1045 bp, Homo sapiens
gaaaggaatgtatttaaatgagaaacagttccacccctccaatgaaaaggaatagttttaggtcatttgagtgaaatagattatagaacttatgaccccagttttcttgttttttttttttttttgaaacggagtttcactcttgttgcccaggctagagtgcagtggcgtgatctcggctcactgcaacctcagcctcccggttcaagcaattctcctgcctcagcctcctgagtagctgggattacaggcacgtgccaccacgcctggctaattttgtatttttagtagagatggggtgtctccatgttggtcaggctggtcttgaactcccgacctcaggtgatccgcccacctcggcctcccaaagtgctgggattacagacgtgagccaccacacccggctgattgtacttttaagtcagttttaataggacccaggtacaaggtcaaggtacttgagaatttttggatttaatgttttacattggtttaaactggttggagtctggctgtgtttcctggtgacaatattcatattaaaaatcttataggtcagtttttataaaaactatgtaatatttcttttaagttaatgattgattttttttttttttaacttctggtgcctttgcctgagattttggtttgtagagaataatatgtcagttaagcagaaatttcagtgacctgaaagtttgggttcttcattttaatgagggccaaatgattaagaataccattggatttcagtaatgtattcgaagtagtatcttctggctgggtcccaaaatcatcagatgctaactataccttttctagtcttctgtacttagaatcaatatttagaatgaagatcctaatatcttgcataattcttaaacagtaaagataaatatgttcatgaaagtatatgaaaccaaaaattggaaagatggcttttaagatgggggaatgaggtagaagactacattagtttggcttattactgtaagaatttgtttgccatttctgatgagagtaataatgtgggttcctcccaaaa

SEQ ID NO: 6733 - DNA, 1047 bp, Homo sapiens
gcacaaatgaaagaaatgtaaattctagagaattatctgtgggaaaaagaaattgtttaatatatatcctcagaatatcttgggagtgtcttcagctggtaaggtaaaatgagtatgtttaaaatccagctcaactaatgagaaccactatcccattagaaacaaacatattattactatactttaaaaagatttagctaagtgtaatatgaaatgtatcctttctcaagtgatatggtgtggctgtgtccccacccaaatcccatattgaattgtggctcccataattcccatgtgttgtgagagggtcccagtgggagatagttaaatcgtgggggcagtttccctcatcctgttcttgtggttgtccttaagtctcacgagatgtgatgattttataaggggtttcccctttcgcttgatcattctctcttgtctgccaccatgtaagacatgcctttccccttccaccatgattgtgaggcctcccctccccagccacgtggaactgtgagtccataaatctctttttctttatgaactatccagccttgggtatgtctttatcagcagcatgaaaatggactaatactgtaaattggcaccaggagtggggtgctgctgtaaagatgcccaaaaatgtggaagctcctttggaactgggtaacaggcagaggttggaaccatttggagggctcagaagaagacaggaaaatataggaaagtttggaacttcctagagacttgttgaatggctttgaccaaaatgctgacaatcatatggacaatgaaatttaggctgaggtggtcttagatggagattaggaacttggtgggaactggagtaaaggtgactcttctgtgttttagcaaagagactgccagcattttgcccctgccccagagatctgtggaactttgaacttgagaaagataacttagggtatctggcagaagaaatttctaaataacaaagcattcaagaggtgacttgggtgctgttaaaagcattcagttttgaaagggaaatagagcataaaggtttgg

SEQ ID NO: 6734 - DNA, 1050 bp, Homo sapiens
tttctattacactgagaattcagaaaattctcttaggacaagattggatagggcaagattgtgtaaccctgaaatgtgttagtcttgaacagatatttcgggatctgttctgattatctctccccagcagaaagattgtgattaagggaaaaaataattcttaattatttgttgtgggttagtggttacatgcaggtttttgttttcattttgcataatttagtttcgaacaatgtcttcattttttttaacgactagaaggcctaatttagattttaagtgttttgtgaatgtgttgttaatgtttcttatcactgaaaaatggcatcaggagctgaagatgggagaagctgttgaattcagacaacagaatgcattaatactgtaacactgctgttggccacagtgattgaacattgtgataatttatgctgcactatgtatttaaatccattatattgttgaggtggagaagcggagttaagtagtgtactgatttcagacctaaattttcttgaatttctttatttattatgcctccttgctaagtagttgatattacatggatcacttacattttgtataggagtatatatagagctcatataggagaacttagattacttcttataagaaattggatacgaaaatgctttggttttgtgagaaagaggatttaacagtgtctccagagagctaagctaaccaacagaaaaaatggcatcaagttataaattcttgctatagaaagaggggaggcttttctttcttttaaatcacttaattttttcagataaacttttaaatgcaagtttaacatatatatagaaaagtacagaaatcataacagtacagcttgatgaatatgaatatatatattcattatatatatatatatatatatatatatatatatatatatatatataaagtgaacaccgtgtgtaacctacctaagtcaagaactagaatgctagcaacaccctgctctgggttctcaggcatttctcctctctctgcaaggcagccataatcctgacataatttagt

SEQ ID NO: 6735 - DNA, 1069 bp, Homo sapiens
cttccaaagtgctgggattacaggtgtgagccaccatgcccagcccctacttgacatttttttacttactgttctgcacctacattatgaacaatgtgtgtgttatgactacatctaactgctttgttccaattgtacaatcacaaggagactcatgtttgccaagagtttatattaattcatattatatttttatttgtaaaacaaaatttgaaactgaaacaccctcttagctgtggcctccaattgacacatattttatcttttttaaatgactgcttagtcagacatcaacttccattaagtacagaacatttagtaccgcagtgggttgctgttactattttattttattttgttattgttgtgggggttttttcccttgactttaagttggattttaaactaaggctcagtcctaacttttactaaacaactatagatttattatttcctggactttatattgaggtttagaatttagttttattttaaagataacaagtcatttcaaaagaacaaaaacggggttcaggaatttaagaataatacggatcaatctgacaattccagcagtaggccagagaggtaggtaggtttccacatgtgtaggtttgatagccatggaagactttgtgcaaattttattgctacttttagaatatttactatttccactttggtattgagtattgtgatcatataatattttcatcccccctcccccaaataaagtcagtgatctaatggctggatatatctttaggaaatgatagtcctttgagccatctcatattttttggctaactccaccatgcctgttaagatctataaccatgagtaatttccttatttgtgagaagaacctttggtaatctgagacaaatttattaaacctcagtttttatactacaagactacagtaactaaaacagcctggtactggttcaaaaacagacacatagaccaatggaacaggttagagaacccagaaataaagccacacacatacaaccatctgatctttgacaaagtcaacaataacaagcaacggggaaaggattcccta

SEQ ID NO: 6736 - DNA, 1066 bp, Homo sapiens
aagcaacccagattgtaagataggcaagaatggcactagcagtgctggtgagctcagaattgaacataggggtatttttctcagtctgtgaacactttgggttaatttgataatgaacagctttacaaaatacatggtatgagcatatgtcagatactgtttaagtatattaacagttatacaatgttactacctctgttactttgagttttgagggttcttatattaatctaagtggattgggaatatagctttcatatgtatgactgtttttgtttaatagctcaggtattgtttgggggttttctttttgtaagtgtgttttgtatcctatcttacctgtgagcaaacttttaaaaattctttggtgaggaaagaacatggtatactataaaattcaggagggccctgaaaattgtggtattaatattttcctttgactgtgttgagattggatttgtcttatattggattaatgtttatgtatatattttggattttttgtgctttgttttgaaattatttcagacttacaaaagagttggcaaaaatagtgaaagaattcctgtttgtcctttacccagattccctaaatgataatatcttccataaccatgttgtaattatcagtttcaggaaattaacattgatgtaaatactattatcaaatttacagattctatttaaatttcaccaattgtctcactgatgtccttttcctggtctaggatctgatccaagattacatgttgcatttaattgtcacgtcttagtctcctttgtcttctttaatctggaacagttccttacagttccttagtctttgtttttctttttttttttttttgagatagagtctcgctctgtcacccaggctggagtgcagtggtgtgatctcggctcactgcaagctccacctcccaggttcacaccattctcctgcctcagcctcctgagtagctgggactacaggcgcctgccaccacgcctggctaatttttttgtatttttaatagagacagagtttcaccgtgttggccaggatggtctcgatctcctgacctca

SEQ ID NO: 6737 - DNA, 1032 bp, Homo sapiens
ttatgtccatactttatgaattcaaagtttatagcctcactccctcgacattgatagatatataaaataaaagggtgtgagattcagataaggcttttaaggcaccctgtctctaacttaaacattttgcttttcacctagtgatttttttaccatactttttggacctatgtttgaagagctgttcaaactataatgttctgggggcaaattaagttttcaagtaggattttgtttgagttgaagaattaaatggctttttaaaagtttataacattcaatgaggatgaatttcttatttaaagaaaataaatcttacctagtagattatgggtaggcctaattagacagcagggatttctcattcaagtaatagactgataagactgttttctagctaataacctatgaaatggatatttgctacgttaactgggtcaagattgagatcagattcttcactttctttatatctaggaaaatgaaaagaaactcttaacttagtattaattgagcactgaactacacactcagggagaatctagaaatgtgaaagacacagtttcagtcctcagataatatggtatagtagagcaggaaaatagttaaacaatcacagtcatacactaggtaccctaagtatagtatagggaaagttcacagtgaagtgtagaagagaagaaatacagagatccctcctaacttggatgattaggtgacttcaaggagaaggtagcatttgtaatgtgttgaataaaggaaagaattcattaggaagaagaacagtggaagtcaatacttccattggatgaagtagatcgagcagggctagagaagtgcaagttgtgatcagagaatgctgcaagaacctcataggctaaagcatgaggtagtaatggcagataaagcaaaaaaaattacatagcagcagactatggaaattttgcagtaccaagccattttgacctaagttaggagtcagtacattttctcatcattgcccattttgtttacacaattttttataaaagt

SEQ ID NO: 6738 - DNA, 1026 bp, Homo sapiens
cacatcctcctcctcccgagttcaagctattctcctgcctcagcctcctgagtagctgggattacaggcatgcaccaccacgctgggctaattttgtatttttagtaaagacgaggattctccatgttggtcaagctggtctccaactccccacctcaggtgatccacccgccttggcctcccaaagtgctgagattataggcgtgagccaccacgcctgaccagggactctgtcttagctaagcaaggagtgggtcacctttttttttacaatggtttcttggtgcttgagttgtatattaataagaggagttttatctgtgcctgtctagtgtagatattataatatctcattttctttgacatgaagaatgcctagtggttttcccccctaaaagcaagcatcttgctgcttcttgcagtgctttgattttattattttgtgttttatatttgtttttaaatagtacaggtaaaagctattcagaaaagggatggggtaaagattgattgtatcggaacaagttacttttgggccattcagtcttgcttgctcagtctttatttttgtgtattacaggcctttcgggaagacttggaatgccttattcaagaacagatgaagaaaggccacaacccaactggattactagcattacagcagattgcagattacatcatggccaattctttctcgggtttttcttcacctcctctcagtatgtcagttttggagagttttaaacattataattttacttccactttggaccactatacatctctagcagcatattctgctcgggttcagtccttaagtttataacatctaatacttagagtaacatagtgttagaccctcctaccttttcatatcaaccaggcatttactacactttgtacagattataagatgatataagacatgattctgggctgggacttgtggcatgtgtcagtagtcccagccacatgggaggctgaggtgggagaaatgcttgagcccaggagttcgagaccagccta

SEQ ID NO: 6739 - DNA, 1030 bp, Homo sapiens
agaattccgtggcttaaaatatgttaagaggtatggctctaatgtgttttccatcagggaggatcagagtcttggaaggtttctttttcagataggtggaaaagatacttcagctgtctgctggcacaagagtgtcatcttgtctttgttgttagtagcctgagcaagtattatagatatttgccaaattgaaattgtgcctttttgaaagtaaaatactcattacagtctttatagttttgtgtctctgtatattttaccattgattacaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggtaggttgcaaaattgaagtaaaacttggatttaatgtcttcagattcaagagcagatgcttccatttttgtagaacatgctccatactcttccagaagctgagtttggccctaggaaagcatttcattgttatttaaccacacctttgagaattaaacagaacttacaaatgtcgtgttttttttttaagattacaatatattgttattaactgtagtcaccatagtacaatatatctcttgaactttttcctcctaactgaaattttgtatcctttgatcaacatctccccacccccacctccttgtaaccactattctactctacttttatgagttcaacttttttttttttcttggaggcaggatcttgcttggagtgccgtgacacaatcagggctcacttgcagtctcaacctgctgggctcaaaccattcttccacctcagcctcctgtgtatctgggacataacgtgtgtgccaccgtgcctggctaatttatttttttttttttactttttgtagagatagggtttctccatgttgcccaggctggtcttgaattcctgggctcaa

SEQ ID NO: 6740 - DNA, 1043 bp, Homo sapiens
cagagcgagactccgtctcaaaaaataagaataacataaaatctgtcctaatattattttccacagggtgaaagtcaacaggtaatctctctgttccagccccccttcattctgatccaaatctaaattggttgctctcaggccagctgcacaggttcatctggaggattcctgtgctgctgatctatattgtattccgtttcctgtatcttgtgtcttctgctttcttgatttcctcctttactgtagaacgcaccctctaatagctttccgagaaaaggatacataggtggtaacagtctgaaatgcctttattctatcttcaaatgtgcatataatggatatagaatagtttagaaataattttcccctgaaataagaaaagcatcattctgttccctattttattgttgaagtaggaaggcattggaattcctgaacctttgtttaggattttttttttttttttttttttgcttttagaccctttctgcatccctgctgttctgaaattttatgattgtgtgctgatctctttttagtcttttttctaagtaattagtaacccttttcaatctccagagtcatatccttcagttctggaagttttttaaaagtgtttcttcaagagtgttttcttcccatttctttttctgtcagtatattatgttagtttggatgttgggcctctttgagcctctgatttttttcttttctctcctacttgccatctctttatctttgtatcctactttctgggagaatgttttctaacccttttaattttttattttgatgttaacttttttaatttattttattttatttattttttttgagatggagtctcgcactgttgcccaggctagagtgcagtggcgcgatcttggctcactgcaagctccgccttcctgggtgcacgccattctctgcctcagcctcccaagtagctgggactacaggcgcctgtcaccgtgcccgactaattttttttgtatttttagtagagacagggtttcaccgcgttagccaggatggtttca

SEQ ID NO: 6741 - DNA, 1040 bp, Homo sapiens
tctgtcttcattggaatcaaagtaatgccttattacattgctaaaacatttcagttttgtaaagtagagcaaaaatgttaagtatgtaaaataacccccaaaaaaccctcccctttcgtagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaactt

SEQ ID NO: 6742 - DNA, 1028 bp, Homo sapiens
cattttgatttagttatctggtaaagtctaggtatcctatagtggaagaatgaaagacaagcaggttccaatgaaggaccatgcttccaaaggcatcagccagtggatcgtttgtggggccaggcgggggttagatctattattgttggacaggggtattagagttttgaaagactacttgaaaaacataatcaaatgatacttggagtttgttccgaaagggtattctttcctctctcttcccacaacagtgtgcgcttcctattatagttgatatacctgtgctttaaaatagcacagctactagtagaggccattttataccaaaatcatttcccttcatgttctgtggtacatcagtttggcagtagaggttacagagtttgaaatcaaaaggagcattggttccttcagggaaaaatgataccaatctaccaaaataaaagccaaacagactctcattgttctttatcccacaaggggcttgccctttttgaaggtgtggttaattttgataggactcttctctctaacagggttagtggctgggaattaccttttcccctgggcaaaacccactttaaaatctcattttaaaacagaactcaaagtgtctttgaaaataaaagtactttgggaactcttcattgtgtaaccccatccctctcagcaaggggactccagttttctcacagggcacttcctgctgcagtacctaattctaactttgttttactataactcatgctaaaataggaaaggtttcagctttacagtttttattagctgttcatgtgtttttaaaaagtatgtgttaaataaaaataaagtaaatgtccaccaaggagctaaatttttaaaaatcagtttccattaagtctagttctataaatgtttcagtaccaggttttttctacttgctgtttgtctaatgttcatcataatattcagaagagcagccttaactttccccaaccttctttcccttcttttactagaggtgcaggaccatgcctttcatgaatcgt

SEQ ID NO: 6743 - DNA, 1131 bp, Homo sapiens
aggcgcctgtagtcctagctactcgggaggctgaggcaggagaatggcgtgaacccgggaggcggagcttgcagtgagccgagatcatgccactgcgctccagcctgggcaacagagtgaggttccgtctcaaaaaaaaaaaaaagaaaagaaatgatgttgtgcctttctcaatccattgtgtcaggaagatacacgatgtcgaagtttttactactggtgatgtgaatttttatatgtagattttaaagtacaacaccctttatttctctttccatctatcctagaatatttatctttgacagagttaaagaacagaagtcaaccaaaaaagaatggtttgaattttactgattgttcttcccaaagcttccaccacatcaggcttcatatcacattaaaagatcccagaggtgaacactggtgatttgaagtcttacatttggagaaaggagctcatgagctctttaggattctaaaacatgagacaagtgacagagtttttttgtttgtttgtttttaggactctgattttgttttttgtttttgacttttttaagtggaaattttcaaacatacttagaatagaataatgaactcctgtatacccaccattcagtttgaatagctgtcaacttgtttcatctgttcttcactacgctcaccctcaatattttttctggaatgctttaactcaaatcccagataacatcattttgcccctaaatactttagtatgtatcttgaataaataggatttttaaaaatgtaattataatgctattataataccccacaaaattaattcagataatcttttttaatatcatctaatacccagtctgtgatacattttctccagttgtctcaaaaatggcattttaccattggtatgtttaaatcaggatccaaaggccacattgcatttgtttgatgtgccttttaagatattaatctataataattttttctcttccccctacaccgttttggtagaaacaaaaactgatttctacataacatctcaaaaagacttctttggcagagaaaacatgaaggaatatataggtatagatctgtgtgttgtatatatgtacatatttttttaaacatcaagagactgagtcattt

SEQ ID NO: 6744 - DNA, 1044 bp, Homo sapiens
aagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctg

SEQ ID NO: 6745 - DNA, 1040 bp, Homo sapiens
cacagacctcatgaatcagatcctctgcacagatgattccatatttaccaagagatcaagccatcaaagtgttatctgtcaagacaatttgcttcatattgattttgctgtaaccacacttggagactagttcatttactgaattcaggttcggagactctcatgcaatatatggttctacaatcctcagcatgtaaattgaagcactgttgaacttaacaaagtttctgatgaagatctgacaaggcaaagaagctgccacacctttcggacccttgggctgccaccactgagacctctgatcctaatgatcaatgccaatttgggttctgcaggtacacagaagttgccagcttttcttgccattctagccattcatatctcagttctatacatctgtctatattcctagtgatagtgtttagcttcttcatagataagcttccttccttcctttcgaagcatcctttgggcaaacttttttctctggcacttgatcttcagctctgcaaaatgccttcacttttacttaaaggtttctggcacagcaggagccttctttttcttctcttcaacactctccctggttccacccagaaaactgaagattttaaaattataaactaaaaaaaattagtttttacaaaaacattatatgtaataagtaaaaacaacaaaatatcaaaagaaataaatgcttttgttttctcagatttttacatgcctttggctttcagttgaccgactaaccttaaagtaccacacactgtagcatggtcctgctgccacacagctcatggccagcacctgaactggtctatcccttgttcagtgagacaggttccctaatgcacttgaatgtaaaactgctataaaggtttctaaatgcctgctttcaattaggtactgctctcctcatgaactggtaacaaacagtttgtggactacagggttctatggagcacaatttgaatagtgctgacaagaagacctaagtggtgagtaagtgctggatcacctttctcttagtctaatgccct

SEQ ID NO: 6746 - DNA, 1019 bp, Homo sapiens
atgcatttctatagctaatgttcacctggatatctggcccagggctgataagttctgtgtggcttccttttctgggatgtacaaatgcagggatgaaggcaaattcagtgccctgggcaacaaaaggcaaggtcaggtaggtataaatttcaaagcacttaaacatgtctttcttccttttctgcagaaccataattaccactttgtcaaaaatgaaaaataaccaacaaatgtataagtcactatgtaattccaagggactgtatgatataccttagactagccaacagtctaacctttaaggtgtgtgaaatccaggtgaggagacaagacaaaagtatgaggaagcattcaaaagcactggtagtctaaagaacagcaaaggaagggctacacacaagccctcagcacaacaggctgtggatactttcatgcatgttaacagactccctgcccaagtgctatgccacctacctgattttctgcctccattccttctctgaggccaaggaaatcggcacagccaagcagaggtgcaatgacctctgagggcaacctccagtcattgggagatgagaactggtggacgagagcctctgtgtccctgtgctttggtgggacaattctgaagtatttatatggtttggctgtgtccccacccaaatctcatcttgaattgtagctcccataattcccatgtgttatgggagggacctggtgggagataattgaatcatggggggtggtttcccccatactgttctcacggtagtaagtctcacgagatctgatgattttacaaggggcttccccttttgcttggctgtcattctctcttgtctgccgccatgtaagacatgccttttgccttccaccatgattgtaaggactccccaaccatgtggaactgtgagtccattaaacttctttttctttataaattacccagtcttgggtatatctttgtcagcagcgtgaaaatggatgaatacaggtatgctattgacatttcctcagaa

SEQ ID NO: 6747 - DNA, 1050 bp, Homo sapiens
caaagttttctacatctggcattgatgcctccaagcttttggattgtggtgctctgggaactaacacccggaagtagtcagggagttatagcctcctttccatgttcacaattcaggagtacctgaatgtactcccaaggtagcttgaatctaccagaggtattaggagactgagcttttccattgattggcagccaaggcctgggttgagaaaggtgaatctggggccacatataaactgtgtttacctcagtacgtttttagtctttgtatacatctttttaatatatatttaaataaaaatgggttcatttttaaataaaaatgggttcatttttaaataaaaaatgggttcatcatataacttactggtaatctgttattctccttcaggataaatcttgaaatatctttattaaatattcagcatcctttaaaattgctatatagtgttccactctagcagtaattcttaaaaggaaattcttaaaatttcagttatttatagatggattgtggtttgaaatatttattcatttaatgataaattgtcatcttaaacttttatttagaaatagtttcaaatttacagaaaaatttccccaataagaactgttcagagactactcataaaccctttacctagattcacctgttgttaacattttccccacttgctgtatcatttccactttttacacacctttttccttaaagttatttacaccatggtcctttacctctgactttaatgtgtactttctaagaggagggatgttctctttcataatcacagtacaatttacaacttaagtaaatttaatacatagtaatctgtccattttccagttatgttgactgacccagaagtgttcttgatagcatttttccccctccagtacaggatctaatttaggagcaggtattgcatagttgtcatgcttctttagtctcctttaatctggatcatttccacagccttcctttgtcttttataacattgttatttttgagaattaagacataagtgatgttgtgtccctctcagga

SEQ ID NO: 6748 - DNA, 1414 bp, Homo sapiens
agatcacagctcactgcagccttgatctctcaagctcaagtgatcctcccacctcagcctcctatttttgttattttttgaagagatggaatctcagtatgttgcccaggctggttttgaactcctgggttcaaggagtcctcccacctgggcctcccaaagtgctgagtttacaggcatgagcaaccatgtccagccatcgtatgtttttgaccatagtaaacccttttgtaccagaattatggaatgattacacaagggagagttagaggaattgaatattgaaaggacagagtattactaaacattaagtgaaagagaattaatggtgtcacaattctgctattgtacttctaattgccttattttctgtttaatacttttgaataggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaagggtaagttaaaatgctaaaaatgaaagatgtgaatgttcaggtgagtagcaactgtagaagacagccctttctgtgactggtgtgtgttggaatttttttttaagctttgctacgttagcataatttgtactcaagtaacaacttggtactgtccctttgtttcttacattaaaaaagagtttcatgttacaggtgggttttctcatgaagtttttttcctgagaaaacatttatgctagacctaaattatgcaaaaaatttaaagcagtttgcatttttactttgtttacagaaacgtttattaaaagagaggcagaagctgcttgaaaaaatagaagaaaagcagaaagaactggcagaaacagaacccaaattcaacagtgtgaaagagaaagaagaacgaggaattgctaggtctgagaactttcaccaacactttaactttctacatcatattatgtaaaactaggttgtccgaggagctcaattatatagtagctgctttttacacttaattctttttgtatctttttgaaaaatggctttatgtttctgtgtgcagttgacattattggttgcaattaaacttggttattattctccttttcatcccatttgcttctattttgtgtagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataatgtaagaacttc

SEQ ID NO: 6749 - DNA, 1033 bp, Homo sapiens
ctcagcactttgggaggccgagacgggcggatcatgaggtcaggagatcgagaccatcctggctaacacggtgaaactccgtctctactaaaaatacaaaaaacaaaaaaaacaaactgaaattggatttttcaacagcatcattgaggtataattcacatacagtaaattgtacatatttagtgtacatcatttttcctagtcaggaaagtggcaaaaataaagtatataatttgatgagttttgacatacgtatacatctgtaaaacaccacacagttaagacaccacacaccacagttaagacaataaacacgtttattacccaaaagcgttttccatacccctttgtaattcctccctcaccttttgtccgcctcccccatccatctgcaaccactgatctgctttctatcagtgtagattagtttcatgaaattgaattttaaatttatttttatttccatagaaactggaccaggatcttaatgaagtcaaagctcgagtagaagaactggacagaaaatattacgaagtaaaaaataagaaagatgaactacaaagtgaaagaaagttagtatagactaaaatgtgcattaatgttttcagtaatgttcgttactagctgttatgtggtctttaagttacaagttaaccggtcaggcttgttttctgtattttgattctaaactgtatactgttaatgcatcctcatatgtgtttaaaattaaagacagtctactttttatttattagctacttgtggagagaagagaatgcagaacagcaagcacttgctgctaaaagagaagatcttgaaaagaagcaacaacttcttagagcagcaacaggaaaggtgggcaggttcttttcatcacctctgtttacactgagtcattgagttaatcgttatgtaataattttttacctttcaaggtgtaggtcatgggttccaagtgataaataggagtccaaattatcttctaaatatgaaatgatagagattaaatagttttattactacacatactatt

SEQ ID NO: 6750 - DNA, 1030 bp, Homo sapiens
tagcccttttatgtgagagatactatcgtaagttttgcatatattaactcatttagtcttcacaactttataaggaaggtatgtattgtctacgattttgtagataaagtaactattatctgaggaagttaagcaacttgtccacagtacacatctgataaatggtgaaacgagtgtttgaatttgggcagtctagcttcagaaccactaaactctttagcactattaggctctactattgaaaaccttgattacaagagcaaaattaccaggatattctagtggaatgagtcttctaactacttcagggaaaacgccaatcgttttgaaatataatggtgtttatggtttatttgtatttcataaagatgtaatttcataattctaagttcttagttaactgtgttgtgatctctctgttgacaaaatttcatttttaggatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtttgtaatactaattcttagctttaaacagataaattctaacaaatcatttaaaacatataatctggctgggcgcagtggctcatgcctgtaatcccagcactttgggaggctgaggcgggtggatcacctgaagtcaggagttcaagaccagcctggctaacgaggcgaaaccctgtctccattaaaaatacaaagattagctgggtgtggtggtgtgcacctgtagtcccagctactcaggaggctggggcaggagaattgcttgaacctgggaggcagtggttgcagtgagccgagatcacgccactgcactccagcttgggtgacagagcgagactctgtctcaaaaaacaaagagacatataatctgtataatatgtcagttgagctgtatgcatgtctgattaatatatcttacagtattttggagacattc

SEQ ID NO: 6751 - DNA, 1049 bp, Homo sapiens
acacaaagagcgtatggggaaatactgaggaaaaggaggatgttgacagtgtataccagctgtcttcctgtgtttgataatccagctagattgaattattccacacatggcaagaactcttcatacataaacccttaacatagtgccttaagcatagtaacagtaaacatttgttgaatgaaaagatatttaaaagtatgtaatattgttagatttcacctaacctcctttatggttttccaagaatttgttttgtataacttttagtaaaacagtatacatgttattctgagagtgaaatggggtgaaatgtttcaagcttctttatgattgaatgcattttgggtaatatagttcagcattgttttggtccataaatttgaggacataaatgttatttgggggtaaagaaaaggaagggatacatggtgttgtgtctaaaaagaattaagaacatacgatatatttacaacctggagataattttccttagccttgtatatggattaataatgaaattgatcagttgatgaaccaaatgcaacagatcgagacccagcaaaggaaatttaaagcatctagagatagcatattatcagaaatgaagatgctaaaagagaagaggcagcagtcagagaaaaccttcatgcctaaggttcgtaagtatatctttggttatagatcgattgttacagattaataatatggaaatatgaatcatacattatatgggttatccttgaattttatgtttcatttttgtttggacccatactttttttttttgaagacagagtctctttctgtctcacccaggctggagtgcagtggtgcgttctcagctcactgcagcctccacctcctgggttcaagcgattttcctgtctcagcctcctgagtagctgggactacagacatacgccaccacatccggctaattttgtgtttttagtagacatggggtttcaccatgttgtccaggcttgtctcaaactcctgacctcagatgatccacctgccttgccctcccgaagtgctgggattacaag

SEQ ID NO: 6752 - DNA, 1189 bp, Homo sapiens
gcctccacacccagctaatttttgtattttcagtatagacgggtttcaccatgttggccaggctcgtctcgaactcctgacctcgtgatccacccaccttggcctcccaaagtgctggggttacaggcgtgagccactgcgcccggcaactttttgttcttataatatgcctgaagatttttgtatagtttaatcatggaatatgatctgccccaccctgccccacctatactattacatcatatttttcttgttgctagagtcctaattaccaaattaataggcacctaatatttgagttgatatgtctatatatttagctcaatcaaatatagattgttttaaaattttcactataagtaatacagtggctaataccttactaataaatggataatgtcatatagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggtaagtagacagctgactggaaaaagaattcgttagtaattggctattgtgaaaagggcctttcttgctaactagggcaatatgaaagaaaagaactgagaaaatattaaaatgaggcttggacttttaatatacataggagtaaataagattttgtttttctaaaccaatctagctaggttaggattatacaagaaattttcatttccttaaaatttagttaattagcattacttattagttgtaagtattgctatgagtttgagcttgttagccttaccatatttatcttactgcctttacatatttaatgttttgatcaagcattttaattgatttttaaaactgcatagatgtaaactaccaacaccgattctaaaaaatgaaaagcatttaaagaaactgtttttgacagcatgcgttataaaaagggccagccacaaaaatttaacattatgaattgataagagaaaaatgaagaaagtatagggcttttttgaagaatataacatattaaacttcatttcagctcacatgagcacaagtactagagaggacagcaaatgagcaccattcctgtgtgtgaaatgtacatgcttatatagacaactttttcttaattc

SEQ ID NO: 6753 - DNA, 2071 bp, Homo sapiens
tccttggtggccatgacctattgcaagtggttatatcagaggctctgattgaaagcatgggctttggggacagaaagcttagtgtcttgtgggccttgggttggaattctgccacctagtgtgtgattttggacaagtcactatttctaagcctcagtttcttgtgtgaattaagcattatcatacttgttttatataattgctatcctgacacattctaagtactttgttaatattttttcagtggtggttagatgcttagaaattttctagtaattgtgtcttttttttcttccctttaatggatacttctaagtatttgtaattatatgatgtatttatatttttttgttttcttgaatgtttattcagacaatagccatagaaaatgttggcagtcataacatttgaaactaatggaatttgtattttttgttacaggaacttaatgagctgagagagacagaagggggtactgttctcacagccacaacatcagaacttgaagccatcaataaaagagtaaaagacactatggcacgatcagaaggtgaatttttatgtagtaaaattttgtttatatgcatgttttataaaattgtttactacagaatgaaatgtccaaataggcagaagcatatgctaatgattttttgttttccattataaacaatgtatagcaaatggaatttaggaagttgactataaatagtaacttttgttttactgaaatgtttatgacaattttgagaccataaatgattcattttgttgataaaatatgaaatacctgacgaaagtttctcatcacttagttgttagaaaataactatagtttataagcattaacattgaataatgaaaattatatatttgagtgactcatatatacttctaattttgtactgacttaacatggttcataaattttcacagaaaattttaaacacaaaacctaaaacctattttggtaggtttgatcataaaaatctatactcaacatataacactggctttataggtattatagcctaattttgtttccccccatcttagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacaggttggttttaaatttgaagtcttgttacaaattgctcagtatataaatttatttatatgaatacatattttctctttatagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcaatcatggaactgatgaatgtacttgaacttcggaaatatgaagctattcagttaactttcaaacaggtatgtttcgctttgtagttaaaacatacacacagaggacaaaagcttccagctcttttcagtttgtaaagattttaaagctgttttcctcattaccaggtgaatctaatacatgtgaacaaacctagcatataggtttacagtaacttgaatgttttacacagcccttagaaggatctagtctgttatccttgttcttaagattaaaaaataattggttgcttttaaatattttacttaagtgttatatataattctaagcaaaatttatatttcaatctgcttttgttttaaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactg

SEQ ID NO: 6754 - DNA, 1050 bp, Homo sapiens
atttttagcttccattaagaatcatccataccttttctgctcttgtttactgtaaagattatcagccatgtatagacacagataattaatattttataagatttttattttaaatatgcattctccaaattggctaatatagaggcattattgtatataaaacacgatttaggctatttaggaaacaagaaatataaataataccctaagaggagatttgggataagttaggaaatcagaataatttgagaacttaacaaatatatattttttccatactagcagaaataagaaaacattgacattctggtgaatgttttataaggatttatctcctccaacatttacaatgttttatttttaaaattattttgttttaatcgtgagctttaaagtcaaacctaatcctttatttataagaagttatttattaaccttgatgaacgtcagaaatttaagttttaggttgccagttttaaagcactcattagaatgaaaacagagccactcaattccgtgtgaaatgttgaagttagctgtcagatggaaccacgaagtataccactagccatggaggaaagaaaccaaacacgtgcacccctcttatgaagtgaatgtagaggtgattttcctaacttatttgatttgcagcaaaatattcctgggtaatgcgtggcatcaggttgcatatttaatttgagtatagatgacacttttttctgtattattttttaagcagtgaataaaaataattataaacaatagaaaaagttttggtttagcatttgatggctagtgttacctgcgtgtaaatgcttgtagttaatgaaaacatgaatccagctttgatctctttgatctatagtcttccgtatagcattagaacactggctgtctatattttcagagcaaagtgctcccctcactcggaatagaaaatgttgtaagtagcaactccgatttacagactctaattttacagacattctgcagaaggatctccgtgtaactgttagggagtcattcgcaggcaagttgtgtatgatgttc

SEQ ID NO: 6755 - DNA, 1055 bp, Homo sapiens
ccttgacctcccaaggtgctgggattacaggcatgagccaccatgcccggcctgttcttttttttttttaatggccatcctagtgggtgtatgaagtactatctcaatgtggttttgatttgtatttcagtaatgactaatgatattgagcttcttttcatgttggcttgttggccatttgtatatcttcttttgaggaatgtctactcaaatctatcatccattttaaaactgggttttttacattcttgttttggaatggtaagagtctttgaaaattctggagagtaggcccttatcaggtgtataatttgcaaatatgttctcctattttatgggtttgcttagcataatgattttgaggttcatctatgttgtttcttgtatcaaaactttgggccttttactttgctaagtagtattctgttttgtggatatagtgcaaactctttatccatctgttgatggacatttaggttgtttccaggttttggctattacaaatgaagctcgtatgaacattcctttgcaagtctttatctggacatatctttcagcttctcttgggtaaatttctaggccaatgatattttaaccttttaggatcacaaatattgtacataagaatcattgtttgggtgaaacgtcttcaaatttttattagtatgtcattgaatggagcatgttaatgtaaccctttaaggtgtttaaagaatatacactttttcatctttgttttcagaatcaatcactcattagtttttttttcttctgttgatgaatcttccttcaatagtttttcatttggcaagtaattatgaccatggaagtcgggacacaagatgaaaaagacaacaaaactgcagaacttcaaactgaaagaaaccctaaaaatcacctgagtcagctcttttattttacagaaaaggtgatgaggtccagaaaggagactggatttaccaaaggccagccgagtattagagcagttcggtggagcaggggaaacttacacacctgtgagggtaatttgacgtctcctagccatgatgcaacag

SEQ ID NO: 6756 - DNA, 1029 bp, Homo sapiens
ctgaaagggctagacagacatttatgttcagagaggccatataagaagaatataaatgcggaaagtcataaacttcagctctgctctgggctccactctcaagccactgtgtgaccagaggtagcacttagcttcttagagtccacatgggttaaagggggaccagggtatggggcttgttcaaacagtcaatgagatgacaggtgaacatgccttggtaggaaagcagtactgaatacatgtgtcctcatgtaagccagctttttgtctcatgctgtcatctccagccagaggccagattgtgtgcaggcaatttccaggctgaatttctgagagatttgatccaaataggataaatggtggaaatgaccactaggaacactccttaaaacctgcttgcatcaatgctttcaatgatacatttctgcatctcaaaaaaaagtttctaagccctaagctagcatctgcctatttcaagcaatttctgttcttttttttcttttcttttctttcctttcctcttcctcttcttcttcctcttcctcttcttcctcttcctcctcctcttcctcccgttccccttccccttcctcttcttcctcttcctcttccacttcttcttcttcttcctcttcttttttttttaattttttttttgacagggccttactctcacccagactagagtgcatactgatcctcccacctcaacctcccaaggagctggggctacaggtgtgcaccaccatgcctggctaattttttttgtatttttttgtagagtccggttttcaccatgttgctcagtctggtctcaaacttctgggctcaagcgatcattctgcctcagcctcctaatgtgctgggattataggtgtgagtgaccatgcttggcctcaagcaatttctaaaataacacaaatcaagacaacagcaacaccaagatactgctttattattgccttgacatttgcaataatgacagtttaactatagcagtaataatgacagtcgacttgtggcagctta

SEQ ID NO: 6757 - DNA, 1587 bp, Homo sapiens
gagtgccagagaaaccttttagaaaccctcttaaattccctctttgaaatctttttcatgtctgctctttgaggactgtgaagagaggggagggtagaggcagagttgatcccaactcttaagattctttggcctaatgtttcacttgaaggcagagactgacgaagttcttttttgaacttcttaggacagttccctgtggttacttttttagtataacaattaaaaaaaaaaaaaccaaaaaacctactgatcattttaagtcctggcccttgctttgttttgtttgaaaagtgacttttaaaatggtgacttttatggaaaacatatttacagtttgttaaagttgtgtcatttctctttgcatgtttacatgtatgtgtatttaacttagttgtcttgaacctcataaaggtgttgtggtttttaagcagaggaaaatcttccttcgttttttctggaatagcagcaaagccatgatggagaataagcagaagattaatttaaaatactggttactttggctaatccactgacggtgagcttgcttatggctggagaactatgaaagtgtttccagatagcctgagagggaagcactgggaaggagtgtggcaagtctgtatgcgtgtggcggggtaggggggacagggttgtcttttggggaataggaatgatatttaaacgaccagctcctccatgtattatttggattttctgttaaaagcaataaacttgaagtaagacgtgtttacaggccactacaatctatctgaaaagcctcttatggttttttgcctcccattcaaaaaccacttacgtgattgtatgtgcctttcaacaaaactttggattcaattacaacacttgtaggctcagaagattgctttcaaatctgaaaactttgcaccttcacttggttacagtactttttaaaaaatggagatacggtcttgctgtgttgctcagactggtgtccaaaccctgggctcaagcggtcctccagctttggcctcccaaagtgttgggattacaggcatgagccactgtatctggcctggttgtagtacatttcaagggactggctttcccagccaaactgacatttttgggtctgtccagttagtaaaaggtagggattggggtggcaagagttgtacattgacacagttcttaagcacacagtgactaaaaggtactctactggcttttggagaaggcttagaacttggtcaatcgacaaactcctgattaaaggttgctgaattaaaaataatatgccatttctttgaaaccattcgatttcaccctatttagttgttccagaaatgtttgctttggttttaaccatgacccaactttatttagtaagtctaataattcatctctttgaaaccttttagtttccaccttattttttttttgaagagtgatttttttagatggtgatttttgtgtgaaataatatttacagtttgttaaagtggtatcatctctctttgcacgtttacatgaatgtgtattcaatgcatgttgtcttgagttgagaatttttgtcttgatttttccttgcttcaacttgatttc

SEQ ID NO: 6758 - DNA, 1048 bp, Homo sapiens
tattgaaactggaggaatgaggtttacttgtgtttcagggattgaagtggtactagaggttgtgttggattgctaagttcagagagccatcagaaattgttatgagcttgagtcacataaaaatggaatatcctttactgtgggtggcatagctttttagggttggcttcctaaacattttggggagaatgaatctaccagcagagaagctttcctttggcagtctgagggtgtatcttcctgaggcaaggccagacttgaggatattctaatcctccttcctgcatttttatattgcaatttcttgccaaacttgctgcctgaagagagacgatatctctttaagggtgcattttagttcatttgtgtgtcaggtgggtgggaagtaatataaaactcatttatggctactcagtctgcaaacatattggaaggaagggctgggctttaatatctgtgtaggatggaagtcatttttgagttatagtcaattcttatgttctgtaaaatccattagaaaacctgtacccgtatcagttcacatattctgcacctggctctcctgttcatggggaattgcttacaacagggaactcttaaaaccaagactgctgtttttgccccactactttcaggttagagcaggattccagtgtcctgaagtttaaacacattctgagcatcctctgagaatcattcccaattccaagcccatttccagacgatgagcagacttgaattacataacctgtagctgcacatttttgtcgtgaccacgcaagctcaataatgtctcccaagtcttgtagatcactttgaagctcactggattaatggtgttgaatctgtttaatccaaataatttgaattgcatcaggaaacctgcatattaacaagctggtaataagtgcaggcgttaagattgatcactgcttaagtcttcaagatcacatacaaggtctggtgtttttgaggctgtcgatgtactatattttttagattctttcttgatttcattctgcactcttgacatttaaaataatttaaa

SEQ ID NO: 6759 - DNA, 1008 bp, Homo sapiens
actgactgcatttccttttgtcttctaaaacccagagggtgaaaccaggacatttccattgtactgaaatttggcataaaatctggtgccaattgtacatcccaggggctgaaatcaggatatgctgaaattcccagtgtcctcgctctgctggttcccacttcctgacggcgctgacagataagtgccctgcatctcacagagagagaaaaatagatatttggaagtggtatcttttattgcctataaagttaaacaatgcacgaaacaattataaccaaggcagagacgtttagacaacatgcataaaaggaaaaaaacagtggaagagaaactttgctctaagatgaaatgctaattctaactatcgctctcagaatttatggggcaacatcacttagtacttcttacacttgcgttcctgcacatttcaaactgttcatatggtagtttttcttctgtatgacattctgcaattgtagagtttttctttatattacttcattcacaaatttcaaaattcacaaagtgtctatcaattaggaagaacaacttcttgtacttttctgatttgcagtctccttggttgtgacaaacctatttgttcttgtccctgtatcgttgatataatccaacttggcttctttggaagcaacaaatgctattttttttgcttcaaatccaatattggtttttaaatttgtggatgcaagaggctataaagaggtttaaaatatatgtagcttgaaaatattaatgtttttaaaaaatctcagagtcactttagaattttaaaattttcaagtaaggctgcaatcagatagatacttgtagactgtcttaggctgttttctgttgcttttaacagaattcctaaaacaggataatttttaaagaaaccaaaatttatttattatagttatgggggctgagaagtccaaggtcaaggggctgcatctggtaagggccttcttgctggtgggaactctgtagaatcccgaggtggca

SEQ ID NO: 6760 - DNA, 1060 bp, Homo sapiens
tagccaggatagtctcgatctcctgacctcatgatccgcccacctcggcctcccaaagtgctgggattacaggcgtgagccaccgcgcccggcccttgtttcttatattagttatcacaggccctatgggcaaagacttcccctatacttcccagcattgctccagcatgccctgcacagttctgagcttatggcagatacccaggacacacaggaggtgggctgggaagggcaggggagcaccggaaaaagaggctgtgatggcggcccctggggaggccagaaggagagcaccaggagttgccctcgctggcaggagcctggcaggaaccctgcctgtccttgagggcccatcttccttgcaagagtgttgacaccctgtgaggagggtgcagaaactccagccacagggccacagacgttctggacagtgtcatgtgaggtggcattggagcttctcctcttacagcctgacagagtgtcccttggggtggcaggttcattgaagacagcgtggaactggatacagaaggtgtcattttgatggccattccttcagctttatgccatgctccatagacagcctagggtacccctctctgtcccacttttagttcctcagtgatacagattgctaaaggcaactcaattgcaaatagccccgcaccatgtgacactgcctccttgaaaagtacttcagatgctggcagaggatggtgacctttcagtggtatatgcctgctctcagcccagccagacagaccactgccacagaggtgggagaggcaagaagagcctttaacttaagggcacttggcaaagggctgtctcatttgctagggttctgttatatgtcacttggtgtgcaagcttccaagaactacttggcttcctgacagggaacatgatagaatgtcaggacctaagctaatgtaaaatatgctttggccagccaagtcatgcacaggcaatgcaagaagccattggtcgttcacacgtctgcgccatgttagacgggggctccactgatggacttaacctttccagacccacgtgatga

SEQ ID NO: 6761 - DNA, 1025 bp, Homo sapiens
accaaacaaacaaacaaacaaacaaatttgctgagtgagatggtacacacctgtagtcccagctagtctggaggctgaggcaggaagattacttgagcccaggagtttggggctgtaatgggctcggatggcgaccgtgcactgcagcccggggcgacacaatgaggccctgtctctaaaaaatacataaatgaagttgaaagcatgtgaagtttatgattggctttgtgatcggaaggatgtgtcatgctttcccctgggtgttgggaaccttctgaaagaactgctgtcggaattcagggtcttctgtgcctgtccacccactagccctcatgggcgtaatgcagagatctcagaagggagagctctggatccagactgcttatgttggaatcatcttccacccacttactcactgtgtgccctttggacagttatttaaccactctgcacctcagtttcttcatctgtaaaatggaaattatggtacataccacatatgattgttagaaggagtcaatgagttaacctttaagtacttaaaatggtatctggcaattagtgagcaccatgtaagtgtttgcttaataaatattaagagtttggggtttggggtgggttttttttcttgtttttttttttgtttttttttttggttggcttaatacctttctaactgaaatttttgttgagataattgtagattcagatgcacttgtaggaaataatttaggccaggtatggtggctcatgcctgcaataaagcctcactttgggaggccaaggcgggtggatcacctgaggtcaggagttcgagaccagcctggtcaacatggtgaaacaccatctctactaaaaatacaaaaaatgagccaggcatggtggcaggcacctgtaattccagctactcgggaggctgaggcaggacaatcgcttgaccccaggaggcggaggttgcagtgagctcagattgcgccattgcactctagcctggacaacaacggtgaaactctgtctcaaaaaaa

SEQ ID NO: 6762 - DNA, 1044 bp, Homo sapiens
acgtttttgggctagttgggaacagtaagaaatacttcattgtgaagactgataatattcagatgtattaatccctagaagatacatggcccaaaggatcatcacccaggaatgttattagaatgaagcttacccatctcctgtgaggacctggctaagcagatctgtgcctggagttacagtcatggcagtgctcctgattctgaagatgggctatgggaagaggactttgggacatgctaagcctcctgagtagacacttgagccttggcatagttgggattagggaatggtaggagaccctcttaagaaagaaaagagtgttccctgactcaagagcctcatgaacctgggtcttgcccatgctgggtagctagaaatgtaaccatatctgcagttcttggaggtcaatgaaaaggttgtgtaaaggagtattgtttggcagatgtctctagtaccattgctgcaacaaataaagctggcttagcactggcctgtctgaagctgtgctctgcagtggttgtagtcatactgagctgaccacctgaccatctaggctcctaggaactgctagaagggccagacaatgaggacccaagagcttccaacccaaggtactcctagaagatcccattacttgacagcagcaacttctgcttctagaacttgctgagagacctgctgatgagagcagctgctgtcagctgtcaggaggagctgctgccccaagagagcaggaacagcctctgggagctgtgggtggcccatgcccaacaggagtcaccagtaggagcagcagatagagtaccaggtgaggcagtccttcctggttgtcctcagccccttagaattgttgagaaggggcaacatggtccatcttccaagaagaatccttccctagtagttgacctggttggagacccagcagctcagggtggaggctccagctggcttgaattgtctcctggtcttcaagtcacttgttggaggggtggcccagggaaaaaggattgccttcccaaatgatgttgatgaaaataatat

SEQ ID NO: 6763 - DNA, 1812 bp, Homo sapiens
tccggcacctactgtaagtgtaccaggtttcttgaggcagtgcctggaaaccttgatcctggtctgcctgcatccccctcaggaacttgactgcttgggctctgactgcatgcctaccatgtgtcaggtcttcgaggaggagtcccagtcctcaaggagtttaaagttttgggtagagaaacgtgtggattgccaagttactgcaaagtggactgtgataaacactgtcactgagctctattaagcaagtgacaccactccatgaacttggatgatcatagctctttcccatctacacagcaggttaatcattctcaccctgtgtaattcacaagaatgactcgggagtaaatgagaccaagaatgtgccagagttgagtgtactagtggtgctaacattttggaatcagagatccctttcaaaggctgatgaaagctttggactttcacctcagaaaaattactctggagcgtgcgcttatatgactttgcaaacagtttcaatttcatggtttttatgaacatcctgaaacccatccatggacccttgtgggggacctgtaggtcaataacgcctgtttcggtgcttgttccctgaaggatgttttaaaagtcccagataaattcacattactattattaggaatcctatgtttctcagttacttctatgttaaaaatctttctcctaaacaattatttgctaaatatcccttataactaggtattatttagattgatgaactttaaggataaagcaaaagcaagacaatctgattggccagatttgtcttctgttttgtgtacatgtataacataaaatggaaaacaattgcagaggtgcaggctttaaaaaaatacagaaacagagcacatcaacctggattttaggtgtgacatcttgcttggttgtgtatttcaggggctgcagagctcacaaagctattgcggggaggcagcgttaaatctgttgctcttgtaaaaccaattgtatggcatatagctggggtggcgtgtgtataggaagctgagagcattggtcacgccagttctctgagacgggaggcaggattgacagccacagcttggcctctgtgctgggggtggaatctgctgcgtgtgcagcctccttcctgcccccctcccccgaccccatcctggcaggcagtggtgctgagcagatggaccccatccccatcttgggggcagatgtgctgctgactgccccatctgcccactcctgctttacctctccctctctctgggcacctgcctccttgctcccctgacgcagcccctctgccggcctctccctctcagtggaatgttctgtcccaggaggcattgcatcactgctgaccagcctcctgctcctgatgactggtttggctctgaccacgaaagggctcaggtttgggtttcagggctgctgtgggtgtctctgtcctaggtggcctgtctcagagttggagatggtaaggtcatgataccacccagcatctctacagcatcatattttctccgtactagagcactttctaaggtctcccctatcctctcatggcatgggttactgttccaagcatcagcaatgagtgaggccctctattcacttgcctgtcactctcagggtagcagatggaggcagtattactctgcacccaatgagagtttcactggtgcatagcttggtgattaaccccagttcctctacccactggatatgggatcatgatcaagtgatggccctctaagctactcagtgtctttgtctgtgaggtgggactaacacccgcttctttggtttttgagg

SEQ ID NO: 6764 - DNA, 1056 bp, Homo sapiens
ctcataaatctgccttagttacaattctgtcattttctacgtgtgctgccatctttaaaaaataatttttcagaagccttttatactgtaatttgtagaaattatcatttctccctcttgttatctaggctaattcaccttagaattttctgagagtgtgctaatgaaaatagacattcttatgttagaatggctcctaaaggcaaaagctgcatttttttgtccacttcagagtttaggcttcttcaggcattttccttagttgtatgctgagagtgttctcttcagcttaatttgcaaaatgtccttttttgtgttaagtttactgttgtagtaagattcgaggtataaagctggtcttttaaaatccttacccttgcatttggcattagatgcctctgaatctcacattcatggaccttcaggtccatcttctccatgtgcaccttcagcacctctagagctctttcttgtctcctcaatcttctcacctatgtttttctaaaaggactgtgcatctcaaacaatgccactttttatcttaataaccatacttctgatagtgacatttttccctcccctgctttttgccttttctcgagagtatttcttatacatagcatccttcaatattcccatgttgcagttctcgttggtttatctgtttcatggtcatctccacttttttctattcccctgtcccctcgcccctgctatttctatggagaggttggtattgattttctttctctgacgcgctgtcagtcatggttatttctcagttcctccatgctctttcctatgagaattattttttatgaaaatgggcatcccttctccagcttcctctcagattccttttaaggatttaggggaaatgtttcctttctccttcagatgatttcaattgcccaccaatcctgacttctgacaaaggcaaaaccaggtttccaagggcaaattcaattcactgctctgtctccagcagttagggttcattcttaggttctgaaatcattccctaaatttcttttatttctcaaactccggttttgc

SEQ ID NO: 6765 - DNA, 1052 bp, Homo sapiens
gtgtctgcagagctgcgctccatctgcaggttctaggggggaatcttttcttttcccagcattgcgatgctgcattccttgcattgcttgattcatggcccccttctccatcctcaaagacagcagccattgtagcatctccaaatctctctcctgtcacatcaccttctctgtgtcaaatccctctttggcctgtataacacttctgactgcacttagggcccacccaaatctacccatctaggttatgagatctaaattctgagatcctcaacttaatcacacctgcaaagtcttttttgccatatgaggtaacactcacagcttccagggactatgacctgaatatctttgggggtcattcatctttcctcatcagaattatagatttgtcattattttctttcagcgtattaaagatattattccactgtcttttggcttccatttttgatgttgagatattttttagtctaagtatgatcccttttaagataatctgtatatttttttctctaagcttttctcttggttttaatcactgtgatcactggtaactacgatgggtctaggtgtacattccttaacatttactttgcttgggattctctggtcttttgaccacttagtgtctttcaatagtcctggaaaattctcagcttttatcttttccatattacctcattcccatccccattgtcctcttttgggactccagtcaaatatatgttgggccttctgacttatcccctatagtctaaatccactcttctgtgctttccatatttttgcttttgatgctgtattttgaacaatttcctgtgatctaacctctggtccttaattctctcttctattgtttttaatcttttgccaaacacttcaataagattttcatttgtttttaaatttttcctttctagaagttctgtttgattcttttccaaatctactaagtcagtttttacagtttttggtgctctgcagatatttgcaagcttgtttactttttcatgtggttagcaaatataaacttactgagtttgcatctg

SEQ ID NO: 6766 - DNA, 1049 bp, Homo sapiens
tctacctcctgggcaagaattgggctatttgaagcagccactggctagtcccagcaggggcagagggaggggcaatggcagggaccggctctgtccatccagcatggatggagattcggctccagcaagattgccaggcgaaaacagagatgaggttgccaatgctggctcagtgtgctgaggattagaggaggctcagctgcagagtctgtaatcctggactagcctggatttgtcattggtttaatgatgaatctactactctctttgtacttacatagcccaagaaaaaacaatgacctagtaccaccctgaaaggtgtaagaaacaaagcaaaggcaatccaaatgttaaattggaggccacagagccaagcccacctccatggttgagcagttactctgcctccttcctttggtcttacctgactgtctgcaattagctcagtggtggtggggggcacaggggaaggctgtgagcttcaagccgtggcatgtaccaagaagctatcttgatgttgatgaccttggtccctctgatggacaagtttgagatcataaaatgagtacctgtgatgactgaacaatgtgctggcgtgttccatccccttttgcaaagaaccttcccagaacataagtgtgaaaacccacctgaatcgggtgctttggcttcatgtgtaaacgtggcagtgcttcacgaagatccctcccatgcacatgtgcattgcccttactcttagcacctggttctccaggagaggaaatcccttctcccttcttgggaaaggggctgtgttagacactttcatctgaggggttcattggaagacactataagctacatgggtcaatattagcccagctgaattccatcatcttttttttttttttttttttttttttttggagacagggtatctgttgtccaggctggagtacagtggcgtgatctcaggatctcagctcactgcaatctctgcctcctgggttcaagcaattctcctgcctcagcctctcaagtagctgggattacaggcactaaccaccacg

SEQ ID NO: 6767 - DNA, 1070 bp, Homo sapiens
aaaacctcccacacatctagtgtcagaagtggttcgtgttgtgagagtataggagacgctgaatttgtttgtgcctatattcagacaggaagacaattcatgttacttttggatgtgaaatgaggacaaggatgaaaatgtgtttggcacaaatgtaaacacgattcactctgtaggcaattgttaagcctgcctttttcacttaacattagagcatatagattttctcatgtcattaaagtggttttgtttttgtttttttgtaacagagactttggcaaattcaagataatgtttaccattggcaatcacggggaagggtgaggtggggggagcacgtaaccaagggagatttatcgtattggaatgctctctgtcttaagcttggtgctgtgtactcttttttgaatgtcctaaatgttacataataaagtagaaatttgaacaccaatagtaatggttacttaatattttattatgttggtgtatcataatttcctcagttcaaatcccatctcgctattgttggatatttgtaattttcaactttggactcttaaatagtatagtattaagcatctttgggtatcaaattttgtctgcatttgagctcattttctcagttttgatttatataattgaattccagggtcaaagaatatggctataataaatgcattttgttagactatcttttaacaaagctgtatgcgttgattatcattgacattgtgcctattctactctctctccaacacggagtgccattttaaaaaattgctattttgctaggcaaatatttgttttgaatggttttagtttatgtttctacttactagtgagattgaacgttctgtcatataatttttccattggagtttttttttttttttttaatgtgtatgtgtgagcacaggtttttgcagattcacttgtatgtgggaccagtgtgggaaggtcttgtttatgtgggaggggggaccacagataacaaagaacagccccttgcccccctcattgaaaaccagctgtgcatctagacctctgtcttcccacagtgccgccaagct

SEQ ID NO: 6768 - DNA, 1034 bp, Homo sapiens
ccccccaaaaaatgtattgcagatgcagtgaaatattttgaagcaataacaattataacaaataccatatattaaaccctttctgtgtgccagcagtaactcttatgaggtagatattattatgattttcattttacagatgagaaaactgaggcccagagagatgagatgacttactcagccccttctccccgccacctccccagcttgaaagtggcagagtggagattcaaatgtggccctgaccctttcagagcctgcaccatttaaacactgggctgtcctgcctcccatctctcatcctgtccaaaagcataataatgtccttgcagagtgtgagtcacactgcagcatgtcattcacctctgtttgggtcacaccatccaagtgcatccctgtgacccagataggacatgccctctgacctctagtcttgggaggggactagctgacacggggaggtgctcaaggattttgtctctcatgaaccttttctaaggctttgtaagtcactgtgagtctacctgccagattctcccaactggatatgaaataggtggggtcttcctgggggaaaggagaaggggtgggaggtgggaggtaggtggtgggggcaagggtccattgagaggggtagagggaatccaatttgtgagtctgggctcctgttcaagatgggcatgagatgtatggatgaggagctgatggagcaaaggctggatggggaggcaggaacagtgggaggagcctgggagggagagaggaagggtggagggatgtgtctgcaggggtggtccagcctctgggcgctctgtgctccctgcctgaccagtgtctctgtgctcatcctttgccttcccatggactcagttctactttggtcacttttctttccttctgacctaggactgggagctgcatgtgaaagggaagctgcacgctcagaaatgcctggtcttctctgaaaagtaagtgctgttcaggaggacaggctcatgcgtaggctcaacacatattcactgagcatttactgt

SEQ ID NO: 6769 - DNA, 1544 bp, Homo sapiens
tcttggctcactgcaacctccacctcctgggttcaagtgattctcctgcctcagcctccggagtagctgggattacaggcacctgccaccacgcctggctagtttttggtctttttttagtagagataaggttccaccatgttggccttgaactgttggggtcttgaactcctgacctcaggtgatccacctgcctcagcctcccaaagtgctaggattacaggtgtgagccaccgtgcccggccagtctgtttctttttattgttgaggagtattgcgttgcatatatggatacatcacattctgtttatttattcatctgttgacaaatatttgggttgttttcagttcggggcctttacagattgtatttgttaatagtcttcagttagctttgagattcattatctcattggtccccgaaggaagagtatggtatgaggttctgcatttgacaggtgaggaaactgaagtccagagacttacccaggatgacatagcaaacgcaggttagaactcaggatttctcagcctgggcaacatagggagaccctgtctctgcaaaaaaataaaataaaataaaactagccaggagttgtggtgtaaatctgcagtcccagctacttgggaggctgagggaggaggattgcttgaacctgggaggagatccaggctgcagtgagccattattgtgccactgcactccagcctgggcagcagagtgagtgagaccctgtctcagaaaaaaaggaaaagaaacaaaaaaaaaaactcaggatttccgatctcagatcactctgttctccaggttcttccagttcaggcagcaacacagtgtaggaaaggctacatttgtgcagaaactatgaacacagtctgtggaatctgattccctgagtttaaatcccctgtctactacctactggctggatgacaaagagcaacttatttaacctctgcttggatttcttcatctgtgaatcagccatagtaataggaggctactacgcagagttatttcgaggattaagtgaacaaatactggtaaggtcttagtggcttccagtgggaggtacttaataagggttgtctattattattattcactcatgaaatatttaagacctattatggctcctctcaccggggctgcataaccctttagcctgcaggactggtcactactggcatggagacttctagggaggtgagagacaattttttggctttgtcccatggaaagcatagagctgaaataagggatgtcaaggactgggctcccagatgggaggaaagggaggccagtcgcgttgctcggggactgggggtgggcatggctggggaagtacactgcactctgcacttgagatccaggccagttctgcatgaccctggccagcgcgagcctgccaaggcttgctctcagtagaaacaaacagcatcgcctgcaaagtgcaagctccctcctctatccatcccagctttactaggatgacagagttataattacccgtgccatgagctgttattagaagccaaatgca

SEQ ID NO: 6770 - DNA, 1049 bp, Homo sapiens
tcttggggtttctcctcccccaggcttctctccccctagtgctgcctggtagctgcctggtactgcctgaacttgcagagcaggggccagggaagaaagttgccaccaaactgtggagccgggttccccaggtggccttggggagaggttggggttcaagtgagaaagccaacatttaggcagttattaacagcttctgtgatgaaatatttaacacgtgtctccaaaccagtatttttgagcaacaggcaaaatgataggtgattcccctaaacatcacttacagcactattattcctatttcacagatgaggaaactaatctcagagagggtaaacagtgtgcctgaggtcacacagcataagtaaaagagttgggtttgcctctacattctattttctctccatgacactgtggcttccaaggtttttttttgtttgtttgctttttgttttttgtttgtttgtttgtttttttgacagtagaagtctttgttcaagtgaaatcggttccagaactgacagaagatagctctagctacactgctgggggctttggctaccagctcaatccctgcttcagggtctgtggtagctcctagggcatctgtaccccttctggggatcccaggacagggactcagaggactcaacagggggcttaataaaaaccccagggcttctttcctggtaccacccagctggttcatcctccagaggctgggacgggactgagagtgtggctctgatcaaagctctccttttttcccagctgcccctctcctatactgcgggggtctcggctccctgcagagcagcagcagagggaaaactattttgtaacaacgcaggaaggaggcagaccttgctgaatgcgcctctgccagcaccaacagccaggagccaggacctgtttgtgaggtggaggggagaactggcccccacagcccaagctggggccacttttccatcctttgcagagaggaagggaaggacactcaacctccctccgggcacctgggcctgagtgaggccctctcacttctgggg

SEQ ID NO: 6771 - DNA, 1029 bp, Homo sapiens
tcacgaaaaaaagaggacagagaattgtaattagggtatgactaaaatggcccccccaaaagaggcctacatataggttaattatgtggaagaaaatatttggattggagtgactctgggtgattttttccttccttttatttacttttttttctgtaaagaacataattctaaaataaacaaacaaaaacgagagaattcttcgagagtcccggtcacagcagctgcagagagaggtacagtgtgaagaaatgaaatccaacaagtgaaatatcagaaatgtcagaaatcaccttcattgttcttggaaggaggctgatagtaggagaacaggccagcggcaggccatggaatggctaagtgcttaccacaccgccgagtccatcccttacattcacaacaacctgtgaatgaagtgggtgtgagtctctttgtgactgttctgcaagtgaggaaactgaggcttggagaagctcagtaaccagccaaggtcaacagcaagtgaggggtggagctcgtggctcccatttctacctgatggctgccaggacacaggggcctgcctcccatgccatcctaaccctgcgtgtctatcccccatcgtttcccaggggtggagttcgtggttcccaggactggcttttattgcaagctgtgtgggctgttctacacgagcgaggagacagcaaagatgagccactgccgcagcgctgtccactacaggaacttacaggtaaaaatccactctccttgcccagcatgccaggggctccccagtctccataaccgagccaggtgtctggcgtccttggccttgcttgcctctgagtctagctcctacctgcaaggcctactccaggccacaggttacttgccattccccaagcacaccaggctgttttctgcttctgtgtctgtctccttccactacatggaaaacccctaatcttcccatagacttgattccatcaggctgctctcgacatggtggctacctcctgtgttgctcctagcacatgtctctacttt

SEQ ID NO: 6772 - DNA, 1099 bp, Homo sapiens
gactgtatgtgcagactttgataccaaaatgttatgaaaagtcgtgattcccgctgctctttctggtactggagggtgggtaccttcaggctgtggggtctctagcctgatattccattgaaagggtgtgggataaaggtgctgggggaaatgaggctctgccacagccatagagaggccctcgggcagttaagaagggagcctggagctgttttcatgagcagagatactctcctgaaagcacccttcatagcttagcccaggaaaaataaaacaaggaagacaggtcactctcccctaggcagttcctgttgtttctgttcctgaccttgggcaggcagactgagaagggactgtgtagggttttgttttgttttttttcattttcctttttatggcatgtgagagcatactgtacattctgtcctctgtactaatggaggaagggcagagagattagttcaaggctaacattttatatcaggtaactgaggcacacaaagggaacaaatgaagaacataaaatgatcagtgtaaacctgaaagcacgcagtcattggcaagggacaggctcatgggagctggtgagagagagcagttaaggcaagcaccaggggaaagcagaccaacttgaacagatgtgatgcggagaggttggaagaagcaagaaacctgaactcatcatcaggctattaaataaaatttataggaggctgttggtttggactgagctcctgcaataggcccaacagaccaaaacaaaagggagtcactcatgttgaagttctgtcttccaggaaatcaggagagagagagagagaaagaatagccaaatccccaaacaggccagttttaaccagcatgatgaagtgtccttggttttaacctttataaggaaagcagctttgagatgaccagtctggtttttgttctttgtgtctgctttcctcagcccttttctgtctataaagccaacctcctccgctcagctcatgggaacactcattctattttatagaatgacatgttgcccaattctagaatcaaaaataaaggccaactaagatcttcaaagtaaatttgttgtaattttatcttt

SEQ ID NO: 6773 - DNA, 1036 bp, Homo sapiens
tactaatgtgaaaggaaaaaatattaggactgcaaaaataaatgccgcttgaatattatctgtagtgcttgcttttgcattactgtagtagaatgcttttagctggttttaagctgctaattagccgttcgtagccgaagaatgaatacaagtaatcctagttaataaatggccaaagcttgactccccaaaatgccagagcaatttatgaggtatatttcaggaaatacatatgtatatatttcgtgggggagtggagggtctgtctcttagggaatgtcttggcagttgaatacttctgattgtatatttcgtgtaacacactggagaaaagaacagtgtttaatgtcagccttcattttcttctaacttgtatgtatagttttctcatcgaaaattcatttttgtaggttagtatgaaggaaatagcgtttggattttttgctttatattttcttgtttgggccaattaagggttgttaaataaattggaaaaaatcctactactttaaagagcgtaaaaacgtggaacatgtcttatctaaactcttaaaacgtgtttgttgctgtcaaatatgacttgagttcctgatcgggttatcattgcctaaagacacaggactattttttttattaagataactttgtttttatcttaataaaagagatgatagtcatttcctgacagttttgtctgacggaatgccttctgtataatagtttaaaataattatttttagtgtttggaaaacagcatttaaaagtttgaacagcagaagtctgttttaagaagcttctgttaacccttgaaaagaatcttcctgtgggatattaaaattttggattgaacttgtgcaaacagtactggatttggaaggtctggattctcatcctggctgttccactaagcagctgtctgtccttggacatatcacctaccctctctgaatctgtttagttgtgtgtaaggtggaatacctacccgaaggtttttctgtaaggtacattaaataatacatgtacaattctttttgaa

SEQ ID NO: 6774 - DNA, 2754 bp, Homo sapiens
aagaattgtaaagatttaaacacatgtatgctttttataggttggtgaaaatttttggtttcaacatgtcttaaaacatattaaagcccatgcacatagacctgacatgttataattatctttaggcatatagaaaatgatttgagtgattcagctctgatttgcgttaacaataatgaacaaaactgtggcccagtggtagctaattcagtagcctttctgacttaaagagctttcagggcaaagccaagtgcctccacttgatctccatggaatttgagtatgaaggacactctgctaggtgatggggatacaaagaaggacatacagtctagttgtggtttctcctttgaagcttatgacttagttggaagaaaaagactgctatataaaaagaaagtgatttccatgacgtgttgaatgaatagtatgtgagcaattagtgttcctgtacctagagttgtaagggaagttttaatgcagggagtaagacttgggctatatcctaaaggattttgataactgaaaataacagtgagggcgacattctactgggaactccagtatgttgatctctttcagaagaatcaattttatataggctggaagatttacaggatggtaagtaataggagaaaagtttagggagatgaattaggactttgagatgttggcttttcttgaaagcaaactttgtcttgaggcagtaaagcatcagcagttcagctcaacaatcatatgcgattatttgctaaatgcctttcattctcttttggattactaatagttcttaagtgtttatacctagttatgggacgtttggcaaatcatttaaacattctcagccttagtttccttatctgtcttcaatgttataataattaactgccaaacttgtgcataaataaatgatagagtgtctagcacagtgcctaatagtaggcattctataaatattagtttatctctcttctcaagatgctttgtcttttcttaatatctccaattagctcataaaagtctaagggttttatatttggtgttgctgttagcatagattttatgatctaaacgtgaaataacatgcttcttttggtaaaaacaaacaaatttggtttgtttttggtaagaaacaaacatgctttgttaaaattcagtgccttggtttactttccttgataatgtgaaaagtaatcttatttagttgtttattagattgaagtagatgaaattcccaatatgtgactgtaatttacctacaaaaatggtaatgtcatgtgattcaacctaatctaacttaccactatatctataaaacagtagatacttaaaatacttagaatttttttcttcatttttctctttaagatcctgataacttaagtgactctctcttttccggtgatgaagaaaatgctgggactgaggaaataaagaatgaaataaatggaaattggatttcagcatcctccattaacgaagctagaattaatgccaaggcaaaaaggcgactaaggaaaaactcatcccgggactctggcagaggcgattcggtcagcgacagtgggagtgacgcccttagaagtggattaactgtgccaaccagtccaaagggaaggttgctggataggcgatccagatctgggaaaggaaggggactaccaaagaaaggttggtatatatcatgtccaacaaatggaagataaacaagtggaaaaaaattgtctggttcttgtactacactttccttgttctaggaatgagagagattcaaaaagtgaaaatgtaaggctttacagtttgtatatatttttacttagtaataatgtgagaaccatctcactttttctttaggttgatgttttttcttgtttgagtagatttaattttcttgagcagaatgttaacgatttatttccagcaaaatatacactgatgtttttcactgttacgagttttacgtatattctctaagtttgaaaggagtcagaaatccatcatacttatttaatataattatgtccattactactactaataaatatacatttgattgataacgtctagatctgaattttaatgttttcctagatctcacggtgagttctctttagctctttattttgggttctgtagtagattggtctgtttcactgctgtttctctagtacccgaaatagtgactagtacactgtaggcaaatatttgttgaataagagttttctgacgatttcatcaccttctgaatggtgggaacttcaatttatagcctaggtttcttgtaaaatgtttttgtgatctgtcaaaaattagttttgttaaatgcctctgcaatcatgttttatatcaaaatgaaacctggttgtcagattctgttttggtctgatggcaaggatatacttggtacaaaataaaaacctccaaaaacagaaatgttggtgacattgtaaaggttctttaaaaaatagtgtagtacattagtccttaaaacatttcagtaagttgatgtagaaaagcaactttgaaaattggaattgttaagcttcttttggttgttttgtatttagaaaacagaattttcagggctgttaatgcttaaaagcagttagaattcttttctatatttataacatattgctagttgtatggtttaatgtgtactttaatatttaaagagtactgtatttgaccttaaaatatttgatggtggttactgtccttttttgttaaataatttttcccttgttgagtttt

SEQ ID NO: 6775 - DNA, 1069 bp, Homo sapiens
gatattagattccttttaaatattactgtttagaatggtaactatataatacattttgttttggggacatgcgcatctttcttttagggataatgctgaaaatgtaaatttttaatagattgtgaagtgaattttttattttttttaatggaaaaaatttaaagtagaatagtataatctgcttgtactcctctcttagctttacaaacttaaataattacaaactcataggcagtcttgtttaattccatttactctccgtcttctattggcccctttgccccaccctgttttggattattttgaagcaaatcccaaatgttttgattatgttttttgaaaatttgtctttgcacaaggtgagacacggtgatggaaattttagacaggaaaacgttaagagtatgtgttaggttgtttttattgtgtgttgtatgtatgtatttaagtgttttaactaatagatatggaaatatttctaagagaacatgaaaaatatgaaactagtaggattcaagtactgtagaatctttgctaaaaatgtattaatctttcaagtatatgtttttaggctgaagccagtcacaagttgtaaatatagcagtcccctcttatccgtggtttcactttccgcagtttcagttacccatggtccaatgtggtttgaaaatattgagtggaaactttcagaagtaattcataagttttaaattgcatgccattctgagtagtgtgatgagatctcctgctgtccagcttcatccacctcatcctgcccaggatgtgagccattccgttgtccagcgtgtatccgcaatgtatacactactcgtgcattcgtcacatggtagctgtctaggttatcggattgagaaaacagtatttattgggttcggtactatctgtggtttaaggcatcctcggacggggcttggaacataccccttgtagataagggggcactacatttcagagcttttttagcatggggagagaggaatggtttgatgatggatgttaattttctttttgaaatttcaattgaacagtgcttttttccttagagatt

SEQ ID NO: 6776 - DNA, 1053 bp, Homo sapiens
atttttcaactcttgtcctctttcctacctccccacttttgaaattcccaatgtttattgttcccatcttcatgtctgtgtgtacccaatgtttagctctcacttacaagtgagaccatgcattatttggttttatgtttgtgataattttcttaggataatggcctccagctgcatccacgttgctgcaaaggacatgattttgttcttttttatggctatgtagcattccatgggcgtatatgtaccacattttctttgtctaatccaccattgatgggcacttggattgatgccatgtctttgctgttgtgaatagtacccgataaatatacaaatgcaggtgtcattttggtagaatgatttattttcctttgggtatacacccagtaatgggattgtcgggttgaacggtaattctatgttgagttctttgagaaatctccgaaccactttctacaggggctgaactaatttgcattcccaccaacagcgtataaaccttcccttttctcctcaaccttgccaatgtctgttatttcctgactctaataaaagagaacagttgtaaaacactgtaacaaatctactttctgtgcttctcacgattcaaatctgacttcagtttaaccatttgaatatttggccttaaatacaaattgatgacatagtgatggattgtgttttatgacatttattttatatgggctaacaattctgcatgtaatttcattgttgtagggttatgagagaatttacaatgaaattccggacattaatctggatgtcccacattcatactctgtgctggagcggtttgtagaagaatgttttcaggctggaataatttccaaacaactcagagatctttgtccttcaaggtactttatttaaatactactttctcaatgtaaaatagtggatgagatctttgggaaggttaactgctaagttagtttatcgttccctgaagtcactgaagaacgtgactcttgtgagttcatggagaaagaagggcgaagcttgttttagcccccttgtaaatctgtacag

SEQ ID NO: 6777 - DNA, 1029 bp, Homo sapiens
ttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcc

SEQ ID NO: 6778 - DNA, 1021 bp, Homo sapiens
caaaatgaattacacattgataaagcaattgttgaacataaaagttattggccatatatctgttaataagaagacagctttattttctcaattagttcacgtatatacatggctgaaatttacttattgctacaattctattcttcttccttttttttgagatggagtcttgctctgttgcccaggctggggtgcagtggcacgatctcggctcactgcaacctccgccacctggattcaagcaattctcctgcctgagactcccgagtagctgggattacaggcgcatgccaccatgcccggctaatttttgtattttcagtagagacagggtttcaccatgttggccaggctggtctcgaacttctgacctcaagtgatccgcccccgttggcctcccaaagtgctgggattacaggcgtgagccactgtgcccagccctattcttcatttttgtagatgtaaacactgagatgaaaatgggaaaatttttttcaatctttgaacttacgttatatgctaacaatcacgtagtgacctatcatcaagaaataattttaaatgaccagcagactactcaattaggtattccttcagtattgttgaaagctgagaacagtctcttgacttgcagaagcactacttacttaataattagcgaagcccttagtctttcttgagttaccagtgtttccttgtctctgtgtgtagctcctaagagatgtttattttctggagcatttttgtcatagtaagattctaccaggctagagagatgcctttccttcatacatccttagaaaaataattgggggactggtgcggtggctcgcatctggaatcccagcactttggaaggccaaagtgggaggatcgcttgagcccagttcaagaccagcctagacaacaaagcaagacctcatctctacaaaaaattaacaaaaattattcgggcatgatggagtgtgcctgttagtctcagctactcgggaggctgaggtgagggtactgcttgagcctg

SEQ ID NO: 6779 - DNA, 1081 bp, Homo sapiens
agaatatttttaagtcctttagcttaatgaatgttagttctggaataatctggtattctgaatggcatcttgtttttcaagggtagtgtccatttattttcctcacttaattggtcctatatgttaaaagaaatatgtttgaaaaattttgatagctagtgggcaagccttcttctgttctctgatttgaacatattcttatattcatttgcctgagtttcattttacctgtggcacctgagagaagctaagtattttttccaccccatttcttttatgtgactgactgtatatttcttagtctcaaatataaaaacacatctaacagcttcacagaaaattttaatgcttggtagattattggagctttcaatttttagcctttgttactctagttattgatcatttcagtatttttaaaatctcaattacatttttaataatttataataataaaatttgatcaatgttttaatttgataatagtgcctatgtttactactaaataagtgtactttgagcagttgaaacactgtgagatattgatagatatttcccaaaaagggttttgtgatccaaataaatttgggatatcttctatgtaatataataatgtactttgcgaagaacgtatagaacactaataatttctacttaaaggaagagtataattagattggaagcacttcttattccaaacctatttgatagtggaactaaatgttgtagaaatacattttgggaaatgctgagaatatattatagaatattttcagatcagtgtgttgttaacggtattccagtacatgtatttgcatgtcagttgctttttaatagggataaatgataattgctgtcccaggatgtaaatataatcagaacatttaactgtggtagtatgttttctataaatctgagagttttttgacatggaaattttgttaccattgattttccagactaaaagtaatttttgagtgcctcctatgtattaaacatcaaaaattgatcttctttggaactactttctgttaagtcttagcaggaggaattttggaaatcttgtagccctcccgactta

SEQ ID NO: 6780 - DNA, 1023 bp, Homo sapiens
gtttgttttgtactttgaagggttctttacccacgtgtgattttgattcatcatacattggtcttctggctctttgagttacgcagattttctaaatgttgacacattttatcatacagtattaaataaagacatttgttaataattccactgatttcgtcaggaaggtctttaaatattgggttgctttaaagttcatggtggtgaatgcatgctttctaaagttctaatttttatttagggtctaactttatcactggcaacaaatattctgttattttgtttttgtttttgtttttgagacagggtcttgctctgttgcctagactggagtgtagtggctcagtcgtagctcactacagcctctaactcctgagctcaagcaagtctcccgcctcagccccacaaggtgctaggattataggcatgagccactgtacccagctcatttgtttttgaattaacaggctcatttcctttattttcaagaaaatgtctgccaaatactagagactgaagagccgcacgttctcctcaactggctcaggttttgataatccataccaggctacctctctgtaataacatcctcttggtctactcggactctttcatgtatatttgaattactttctagtgtccttccatttcaacccaaagtactcactttatttctaatagggcaggtctgttagcaatgaattcttctggtaatgctttcattttaccttcatttttgaaggatagtttttatggatatagaattcttgttagacagtttaaaaaaattcttttagaactttgagtatgtcctcccactgccttctggcctctatattttctgatgagaaattaaatgttaatacttagtatctcttgtacatgatgagtcacatctcttgttgcctttgttttgagttttttcatcctcagttttctaagatgaagaattctttctgtctgtcagcagtttgataatcatctgccttcatgtggattctctttgaatttatcttcctcgga

SEQ ID NO: 6781 - DNA, 1029 bp, Homo sapiens
caccatgtacaaaaatcaactcaaaatagattaaagacttaaagagcgaaaactgtaaaattaccagaagaaaacaaagggaaaagtttcttgacattggttggggcaatgattttttggatatgaccccaaaagcataaggaataaaagcgaaaatagagaaatggtattgcatcaactgaataagcttcggcacagcaaaggaaatgatcaacagagtgaacaataattgacagaataggagaaaatatttgcaaaccatacatttaataaaggcttaatatccaaaatatatttaagaactcaatgatacaaaaacaacccaagtttttaagatgaacaaaggacttgcattgatggtcttcaaaagacaacatacagtgtacatcaggtatgtgaaaaaatgctcaacgtcattaatcatcagggaaatgcaaataaaaaccacaatgagatgtcacctcacacctgttagatgtcacctcatacctattatccaaaagacgataataagactgtaagtgttggtggggatatagagagaatagaactcttttacactgttgtaaattggtacagccatgtactgaaaaatagtatggagtttcataaaaaaattaaaaagagaactaccatatatgatccatcaatctcatttctttgacttcttggtacgtatctagaggaaatgaaattattatattgtgaaatgtctacgttcccatgttcattgcagcattgtttacaataaccaagatatgaaatcaacctatgtcttcattgatggaagaatacacacagaaaatgtgacgttcagccttcaaatctaggaaatcctgatattggtgacatgatctgatcttggcccactgcaacctctgcctcccaggttcaagcgatcctcccacctcagcctcccaggtaactaggattatagccatgtctggccaatttttctgtatttttggtagaggtgggatttcaccatgttggccaagctggtcttgaactcctgacctcaagtgatcc

SEQ ID NO: 6782 - DNA, 1033 bp, Homo sapiens
acctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggtaagaggccttggattattattatttgtagtatttgttatgctaaataattttgagtgctttctcatatcaaaaaatgcctgatacttgcctaaaaacagcttatttctaaattacaacttttttatggtttactttattccattttcagcactgttaatagtacatggcttgaaattgtttcatagacttaaaaagtgagttagaaaatagatgtaattagatctttcccacacaaacctaatctttaactttcattggagaataagtaaatttaaagaagaaaagatgtttgcctaattttcaagttgttgctgtgtttaaagtatctgttgatacaattttattagatatatgaaaactacattttctcattctctgacttttccacctttatctgaaagatgtttaaattcacatcactttctacctaatttaccacaaaaggttgacaa

SEQ ID NO: 6783 - DNA, 1042 bp, Homo sapiens
taaaggctggtagtaggagaaaaaaatagggaatataaacgcgtgaacatgtcagtaaaaaattaaaaattagttctggcatttttaattatggaaaaacattctgaaacatttggaatatagtaatccattgacatcagttttgaaaaattgataaaggtattgcctctgtgggccctttttataagatttgtaaaaattgtcataagaagttgattatgaagctttttaaaggatgttttctttttgtattaaaggcaatttattctgagaaaaataaagattatatttttgttgctttcagcattggtcttataatgagtgataaactttctgatttttaggttttgcagcttttcaaagatatgatattctgtgggtgttttaatattttgtttagctttgaaaaaagatgtggtttaaattttaggtatgacttgttacatttaactcttaactagacaatccaaatattaattaaattttggtttaatttaatgtgtttagaaaatttatgataggttttctcaagtaatatactgtagagtatgacttactcacgagatattaaaatattcccaggaatttctgggtgaaaatgttccattccatgtcttcagataggaatgtggttgttgaatgacttgttttagtgtcatatttagtcaaaatttgacctgcatgttatggctcattgtggaatagaattataggcaattggagaaataaatgctgaatttctacatagaaatataaaagttacttcctgtctttgttcttgttgttttgtgtatgtgttacactcagtcctaaaagtctagctttaattcacaagtctctaaggactttttccatagcaatgctatcaaattacctaggaattaagaatatacatatatgttcttgagcatatagatagcatttttactaaaaagtgaatgtatcttttaaaattggcatattttaagtaattatgtggcttatatttgtggctacctaatcttttgacctttattcctaaattgtaattttaaaaacagcc

SEQ ID NO: 6784 - DNA, 1111 bp, Homo sapiens
ttagattgtttgcccatttttaaatcacataatgatgattattgttttgctgttgagttcttgtatattaatctattgtcagatgagtagtttgcatatattttctttcattctgcaggttgtctcttcagtctttgtttcctttgctctgcagaagtttttagtttgaaataattccatttgtctatttttgcttgggtttgccctacttttgaggttttacccataaaatctttgcccagaccattgtcctgaagtgtttcccctatgtttcttgtagtagttttatatttttggttcttgacatttaagtcttcaattcattctgagttagttttttgtatatagtgagagataggggtctagtttcattcttctgcatatatatatatccagctttctcagtaccatttcttgaagggtctgtcctttcttcaatgtatattgttggctcctttatcaagtatcagttggctgtaaatatgtggatttatttctgggttctctactctattcaattgatctattgtcttgtttttatgccagtactgtgcattttggttactctaactttgtgtatactttgaggtcaggtagtgtgatgcctccaattttgtcctttttgcccagtattgctttggctatttagagtcttctatggttccacatgaactttaggatttttttttcttttaagaatgtcattggcattttgatagagattgcattgaatctgtagatcactttgggtagtatggatattgtaacaatattaatccttttaattcatgagcatggaatgtctttccattttttggtccctttgaatttctttcattgttttacagttttcatcatagagctttttcacctccttaaatttacatttaagaatcagcattttaaaaattacctatttgactcatcaacatttattgaaagcaaaatcagtttcttactattgtgcaatatggaggtgttatatttgattataagtcaaatgatgtacatataactgacacatacatgtgtatataattaatatctatatataaaagcatattgaacagagtcagcaactttttcaaaaagttgaccttaagagatttaa

SEQ ID NO: 6785 - DNA, 1035 bp, Homo sapiens
gactagggttttttttgtgtgtatggacaagttttgaatttcgaattcagtttatttaatagacacatagttattcaggttttctatttgttctctattgaaattttgtagtttgatctgtcagggcgtttgtctattttgtacagtttgttgattttgttggcttaaagttcacatttttattatgcttttaatgttccatatatatatatacactatatatatatatagtggtgttcccctttcattcttgaaattggtaatttgggccttctctctttgcttatcagtttggcttgatgtgtatcaattttactgatcttttaaaaattcttttgtttgtgtgttttctttgtttctggtctttattttcaaattccttattactttgggtttaatacgcttttctttgttttcttaagttggtcaattagattgatttcaggcctttattctttcattatataactatttcatagctagaaatttccctcaaagtacttttttagcagcacacaaattttggcaggttatcttttcattattcaaaatattttctaaatatccctttttatatcttctctgatccatggattattaagaagttaattgttcagtttccaaatatatgagagagattttcagattttttttttgctttgatttataaaatagggcttgtcttgataagtgttctaaatgcagttgaaaagactatattctgttgttttttggaggattgtaaaaatatcagcaaggtcaaggtggttgataatgttttacattcaacagtgtcatacagtgcttgcattgtatacctttttctatctttttaaaatgggttttgtaaacagcatatagttaggtcttgtgtttctatcctgcctgacagccacttgttccttttttcccttcctctcttttcttatggattaagtattttttaaataaaagtttcatttatctcaacttttggcatattagttacacatctttgtggcgttttttttagtgtttcctctagtgtttacaata

SEQ ID NO: 6786 - DNA, 1111 bp, Homo sapiens
ttggttaatgcttctccacagcttctccacagcttctgctgtgcttctccactttaaagttaatatttttttctttttaatttatcttgggagatgtttttagactatgcagataccttgtttttccctaatcttttgctcactaattttagcactcgttgctggatcttctcttcttcttttttttttgtgagatggagttttgctcttgttgccaaggctggagtgcaatggcgcagtcttggctcattgcaacctctgcctcacgggttcaagtgattctcctgcttcagcctcccaagtagctggaattacaggtgtacactaccatacccggctaatttttgtatttttagtagagacggggtttcaccatgttagccaggctggtctcaaattctgtcctcaggtgatccgcctgcctcggcctctcaaagtgttgggattacaggcgtgagctaccacacccagcctcaaatcattttcttttgcccaaagaacgtccgttaacatattgtagtacaggtctgctcaaaatgaattcactcagctttgtttattttaaaatctttattttgcctttttttttttttgaggcaggatctcactctgttacccaggcttgagtgcagtggtgtgattatggctcactgcagcctcgacctcctgggctctagtgatccttcctcctcagcctcccgagtcgctgggactacaggtgtgtgcaccacacccagctagtttttgtatcttttgtagaggcagggtcttaccatattgcccagagtggtctttaaactcctgggctcaagcaatccatccacctcagcctcccagaatgttgggattaagggtatgagccactacaccttgctgccttcgtttttgaaagctgtttttcctaatatagcaatgctagtttgaaagtttccttttttcccccctcagtattttagagacacctctgcattttcttatagcttgcctagtttttgacaagaagtctgctgttattctgatcttggagtttataagcctcttggatctgtgggtttatggttttcatcaaaattagaaaaattttggccattatttcttgtaacttttccct

SEQ ID NO: 6787 - DNA, 1028 bp, Homo sapiens
attcttgattggctagtataaatagctaatactgtaactcctgtggattccattatcctctgaaaagtgttacattttgttctgctaggcggttaaattgctgttgagtcaccttgaccgtagagacttagatttagctcttgtaagggtgatgctatttggttatagccttaaacctagggtaaattccttagttttgagatgtgatctttactctcctatgttatagcccttttggaattttgtttattactctccagcaacttgacaagactgaaaatccaaactcttaaagaccacagttggcaactgttgaaatctctgctcagctcctttagccttctagctgtggttctccccttgggctccttgcagtctcctctcccacatgtattttcggagtcagcaagaatttgaggagtgtgtatttgaagattttagggctctgctctttgtgatttcctcctttacagagtatccaaccttgaattccagtcactcttataaccctgaactctgtcctttggcttcttaggcagtaggactctggccttcgacttgagatttacttttcacctgcagattttttagttacttcatggtaaaagctttataaaaaggcatttatgaaagtaaatctcatgtgattgctgtattagttatctattgttgtgtaacaaattactctaaaagataactcttataacaacaatcatttgttatcttatagtttctttgttttgggtatcaggcacaacttaactggaccttctgatttagtgtctctcacaaggtttttcagttatagtgttagccagggcttgggaagactcatctgggaaaggatacacatcccaactcatgtagtttttgttaggacttagttcctagcaggttgctggagagagggcttcaatttcttgctgttggctggagactgctcttagttccttttcacatgggtcttttcaacatggcagcttgccttatcaaagcgtgtaagctaagacatcaataaagtgctagca

SEQ ID NO: 6788 - DNA, 1049 bp, Homo sapiens
tcaatgagaactgaaacattaacaacaagaaaattttaaataacattgcatttacttttatatgctttgatggttgtcaccaagtatagtacagctgttactctgagtaaatggcaaagtaaattagtaatatttattgaaactttttatgatattgtagtcatttatcgattaccatgtttattaaaataattactttatctttctccatcctttccagtcctagtattttgatgatgtagcagaagattgaggtttggtgggaaactttgacgtttgggtcttggtctgttaaaaatttcaacagttttaattgacctttgagattttcactctcatttattgaagatgaagaatttaccctaagtagtggaaacttaattgaattatggttctcctgatacttctccttttttaaatcctactctagttctgagaaagtataacttaaaatgaaaaacaaacagaaagcccaacacctgttctgcagagttgatgctagtctggaagcagctgcccactctcttttccttggactaaagaatcttgccctaaacttgtaactgaaaatcaaatcttgtattgtcttaaaatcacttcccagaaatcactgtatttacttgccttttcctttttttcttttttcttataagtagaccagaatgttttttacttttttctttatttaacatgaacattcctggagtaactatcactcccctgtgataattactgccatttacttccaggctgagaagctagtatcgctgacaactcataggatgtgaggaagagacagaaggaaatgggttggggattaccaagttgcagttaagtaagagagtgcttaaatacatatttatagtttctctgatttaactgttagtctgccttgttgaataaaaaaagtattattttatatgaatattttctcattcagaaattagctatgaacagaagaaaatattaagctttattccaacagttattttgttttaaagtatgaacctgatgttttttaaagccttctggtacctctggtagtttta

SEQ ID NO: 6789 - DNA, 1047 bp, Homo sapiens
ggatctttgaaatctccagtgtttctctgtatactgtgtttttctatttccattataatcacataaggaacaaacttccagtttaactcccaaataaaagcctcattactgtataaaaaactttggaggcttagagttttctgttgctgattttttttctttctatatttaaatatcaaaaaggggaataagattttgtttaattaagaattctctttccgaagtgacaggtatatatagaactttgtttttgtgattctaccttggatgcttctttttgtctttgccaggacaatcagttaacatcacttcccttggattttggaacttggaccagtatggtagaattgaatttagccactaatcagctcacaaagatccctgaggatgtgtctggtctcgtttctcttgaggttagtataaatgagcaattagagaacttcagaaccttccatacgtatctcatttaaaaatttcaaatttaaataagcaatttctatttgggtgaatgtcataattagaaatgttagaactcacttaaacatacaaccctaataggataatgaagtgttgacttaggtagtctagattcagtgcttttgaatttctcttgcctactacaagttggtgtctttgagtgccataaagtattaatatctctaaaagaaaagttctgtaaaagcatcttttagaacaatttttttctttattctgtttaaaaactacaccattgtctaccaaaataattatcgattctcagactgtcatttagaatgctttatcatactttttcatcctaattaccgacctgctattttatttactcattgattattgtctttgttgtaaatctggtatgcctatttctagccctctaattttagtcctattgttttctgtatctagaatgccctcttctcatccccttagtttttttcttttagtatgtttttccataattaaagatccatcttattttcacctcttcagttaaggatgatttctcctgcttctgagttcctagagttttcatccctttgatgaaaa

SEQ ID NO: 6790 - DNA, 1039 bp, Homo sapiens
ggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagtcaaatctagagtttgaatcctctgctaaagaatttgcatccactggtgtaaacagtgaaaggtatttgcttgttgaaaaaaaaaactggcaaagtgaaaagatacagtcaaaaatctagaatttctttaattttgcttctctgacgagttgtgaagcaaaatacctgaagtgagtctttgggtaggggaagggtattgagaccttttctagtatgaatattttttaagtttgggggaagagaaacttgcagtgaaaaggagttttttcattcctgaaagttgcagatcc

SEQ ID NO: 6791 - DNA, 1183 bp, Homo sapiens
gaggagtctcagagcaaggtgcgttctagatgtcatcctaaaaaacacttcatatataattaatcactattttgtataattacatattgctgcttgtgtgtttttttttttttccatttagttgggcgttgtgttttacacaaaaccatttttgaattaaggctatgatattaagatagaaatttggactgttgttctgcttttcctggcactcaaattcatgactagttttgaggtcaaacctatgttcgtaatgagagattttataaggatcaactaagaaatggaaggcaggtgaagatataaaaccctagaatgcttaaatgtgctgtaaaactattgtagatgtcactggattttaccaagtaatatcctttcttttttttttccccccatctgctgtggcttttcagttaaaattttgtttataaaaggaatttgtttattacagctctacctagagcttgtgtgtttgtgtggttttttaaatctcgtatccaggtgtgtttatatattaagatgttgggacttgaactttaaaggtagtaactaaatgtcttttcttaaaaaaaatggttattgtttcttaaaatgaaaatatggtttttaaagcatttttgttccacctttatgttaatctgtaacagtaatgtaaaacgatcagtcttacatgtagaagtcatgctgtgtgtaaacaatataatgacaagttataaaaaattttaaagaagtataaaatgtatatcctctgtaggctgtcaccttgtgagagcccacaaatttcattatttcccaagaaactaaaatggactctgattaagatatccctgtgaaatcaagatatttaatatttaaatagtttgaatataataagggatattgttgaagactacatatgagctaatactttttcctgaaactgcaatgggactaattggcatatccaaaaattttcctttcctttaaagaaattatatttagtctctccatgagactcagcaaataaaataagaatgtccgaggatgttacattataaaaacattgctctaaactttgctttttgttaatatgtagcagaaaaatggcaatggtaatgccaagctgtccttttctgagtttaatactttctaaatcccacatgattattttatacagaaaggaggaagtgctaaataatttatg

SEQ ID NO: 6792 - DNA, 1092 bp, Homo sapiens
gaagggatggttccagtcctgattcaggaactcactgctacaatagtttgttccttgttaggattcaggctacctcaaaatctgcttcatgagctgctgggcaaggtcccagctttttcaattgagcatacagggaagatagtctttagcagttactgatggcccagttatgtctcataaaaaatttaagcatttagggccgggcgcggtggctcacactgtaatctcagcactttgggaggccaaggcgggcagatcacgagctcaggaaatcgagaccatcctggccaacatggagaaaccccgtctctactagaaatacaaaaattagctgggtgtagtggcacgtgcctctaatcctagctactcaggaggctgaggcaggagaattacttgaaccagggagtcagaggttgcagtgagccaagattgcgccactgcactccagcctagtgacacagtgagactctgtctcaaaaaaaaaaaaaaaaattaagcttttatggggttgtattcatctttgaataatatacattcatataaacaattgtgtgtgtgtatgcatctatagatctatatatctgtatgttgtctatatattggtcaatttagtcaacctaagtaatggcttcagtcttttgtttttgttttttttttttaaataaactttttattttagaacagtctgaaatttacagaaaaatcacaaagatagtacggagaatcccatataccccatgcccagttttctctgtgattaacatcatgttaatatggtacatttgttacagctagtgagcccatattgatacattattattaactaaaggtcatactttattcagatttcgttttgttctgtttgttctttttacctaatgtcctttaactattccaggatccaatctgggacactgtaaaacatttagtactcatggatttttaggcccctcatggctatgacagtttctcaaactgtccttgtttctgatgactttacagtttagaagagtactggtcagatattttctagaaggttccctcaactgggatttgctcaatgtttttctcatgattagattggagttctgg

SEQ ID NO: 6793 - DNA, 1029 bp, Homo sapiens
tggttagtagcatagcttcttttgcaaattcttgctgtgtcctgcattatgtatttaacttactttcattttttgaaaactgattgtgtatgccaagctcagtatagtgtaggactataaagatgactgagacatggttcttgtcttcccagagcctctaagttgaaaggttgttcatgtgagggataaatcattaggattacataagagttatagatattttatgtacaagggggtgattaactcttatgttgggttaggaaagccttcaaagaagtgatgatttctgaagagagttttgaatagaggtttgccaggtgggcctggtggagatgggcattgggattaaaggattgaaggcctggaaatatatcagcgttagagataaagatttaggatcataaatacataatatgatagttttaaaatggatgaaattgcccagggacatagacgatagtcataagaaaggcaaggactgaactccaaggaacatcagcagttgaaagatggcctgaaaaatacaatgcctaacagaggaccgtgagacaggagtgagccttcaggagaatgaccagatcagggtgccatgggagccagtagaggagaaagttacaggacgggaggagcaaagtgtaagaaaccacaagattaaataaaaacaggacctaagaatgtctattagtttgggcaaaggaagggttattaatctagtgagagtaatttcagtggaatggtgggggcaggagttagtttacagggagtggatgggaagatgaggaagggaaacagagtctgtacccttgctttcaagaaaattgactggtgatgaaaggagaggaatattagcaaaggggaatacaggtcaagggaggcttctttctttgttttattttgctaatgagaaaaactgatgcttattagtcctggaggtccacggcatggactttcctatcaactgaataccttaaagagaacaggatgttcctcctgatacgtaaatacaccatctcagttttgatccaagat

SEQ ID NO: 6794 - DNA, 1086 bp, Homo sapiens
tttacatctctgtttaccagggatactggtctggagttttcctgtcgtatctttatctgacatttgcatcacggtaatgctagtctcatagaacaagttaggaagtgtttcttcctctgttttctaaatgatgattttgtgtagggttgtttatttcttccttaaatgtttgatagaaaattcatcagtgaagccacttgagtctgagctttctgtgtgaaaagattgttttactaatttaattttgttacttcttatattctattatcttttgagtctatttttataatttatagatttctagcaatttgtgcccttcatctaagttctctgatttattgacaataaattcttcataatatttgtttataatcttttttatttctgtagtgtctgtaacaaatgtctcctcttctgttcatggttttgtaatttttgtgtcttaaaaacaacttttggtttcttttattttattatttatctgttttctgttttgttgattttgactctgatttttatttcctttttctacctactccaggtttcatttgctcttctttttctagcttcttttctagaagtgagattgattttagacttcccttcccctgccctcctttcctcttcctttcctccttctttcctcctcctttcctcgctccgttgccaaggctggaatgcagtggcgccatctcagctcactgcaacctccgcctcccaggttcaagtgattctcctgcctcagcctcccgagtagctgggattacaggtgcatgccacaacacccagctaatttttgtatttttaatagagacagtgtttcaccatgttggccaggacaggatggtcttgaactcctgaactcaagtgatacacctgcctcagcctcccaaggtgctgggattacaggcatgagccaccgcacccagccagatctttctttctttcttaagacaagtgtttaaagctctaaattttcccctaccagctagctgcttttaaaatttaaacctgtggacattttctatattattacccagattaatgttaatattgggctataataaaatttgaaaacaggcttgg

SEQ ID NO: 6795 - DNA, 1058 bp, Homo sapiens
gaatttgaacccaggctcatcagttgcccaaatccgaggcctttctactttataatattgtttcttctaaaggcaagaaaataccagccaagaaaacaaatttaaaggagtggtagaaagtagccccaaaactcaattaaaaattaaggtgcatttacaatgtgaaatataattagagcaaaaataagaaaaagaaaaaagaatgacctcttccagtttacatatcaggcgttaagattgaatgccctgtggttcatgtgagactctggaagagtttactaatgttcatctctgggtctaactggggctaccatgcccaaagataattcagagaaaattctggggagtgcctgtcagaggagttggaaaattagatggatgaagaaaagtcctgggatcattttccctggttggagagttgtagagttgttaagagtcctcacgtctgtgaagagctattatgccaaatatggtcagcagctgtttattgatctctactgcatgtgcaactgcagaacataggtttaagtttaatttggaaaaatcattcctgccagtaaccagtgatggttggtaagcttctttgtgaaaggtaagggacctccttcctgaggtctttttaagatacattcagtgtaagatgctgtgagggagcaaggcaccctaaaggacctctcaaggtcccttctagccctaaggtcccattattattgcatatttatagaacgccaaaatcttctgtgttctttgcaaggactagaattacattcaatccctgtccagtgctatcacagtcaaaattagacagatcagcaatatcttagttgccaaatcgagttaaagtttactgggcacatgtctacctgaaagtgtgtattctcttcaagaacatttgacaatgacctaagagcacggtaaaagatctttggttagtgctgaagcattccagtgagatttgcattaagttcctctaggcatttttgtataaacatcaatctggcatttattcttatctgttaagcaatctaatttagaattgttgtcccaaaaacttttta

SEQ ID NO: 6796 - DNA, 1107 bp, Homo sapiens
catttgcttatttatttatttaatctgtacaaatgtatgggatacatgtgaggtttttttttttttttctttttcagagtcttgctctgtcaccaggctggagtgcagtggcatgatctcggctcactgcaacctccgcctcctgggttcaagtgattcccctgcctcagcctcccaagtagctgggactacaggcgtgtaccaccacgcccagctgattttttgtattttagtagaaacagggtttcaccatgttggccaaggatggtctagatctccaacctcatgatctgcccacctcggcctcccaaagtgctgggattacaggcatgagccaccgtgcctggctcatgtgagattttttacatatttgtataatgcatagtgttcaattcaggttatttacggtgctaccacccaagttaagtatattcactctactctgctgtcagatgttgaatttgttccatcttactgaatgtttgcaccctttaacctgcttctcttcatcctccctcctcctcctcctaattcaactttcccagaccctgttacctatatttccaccgtctacctccatgtgatcaaattttttagttcccacatataagtgagaacatgtaatatttgtctttttgtgcctggcttactttgctttagagaaccacctccagttccatcctgttgctgcagatgacatattttcaattgttttatgcctggataggatttcattctgtatatgtaccacattttctttatccattcatttgttgatgaacacttaggttgatgccatatctttgcttgtgagtagtgctacaataaacatgctagtgcaggtatctctttgatatattgatttcttttcctttgggtagatactccgtagtgggattgctggatcgaatggtacttctatttttagtttgttgagaaatctccatactgtttttcacagtggctgtactggtttacattcccaccaacactgttcacttttctcagcatcctcaccaacatctgttacctttcattcataatagccattctgactagggtaagagaatatttcattgtggttttgatttgcatttctttgataat

SEQ ID NO: 6797 - DNA, 1020 bp, Homo sapiens
aaggtcttcacctcaaacacatgtaaaaggaataaaaaagtacataatacagctttgataataatgcagtataattaaatcaacacttgcagcaaaacaaatgaaagtaagctttcaaaattcaacagggcagcccaatctcctattgtgtggcttcttaaaaatacattcaccaaaatgcaaattggaagcaccagtgtggaacttggatacccatacagaggaactgcttctgtcaaataatagtcataataataataataataataataataataataggataagtctttttgcagtttaagatctgcgtaggccaaaaaataagatacagtttcttcttaaaagagctttacaacttggctgtcggttctcattggatcataccgtagtgtcatgagtctaattaatgtcccgcctctttctttgaattaatactacagacttcattaattcatgtagatactatatacaactttaaaaaaagttttaagaacctcattgtagaaatgactttaaaaatgcctcaaaaaagccctaatgactgattttctttgacacttttaaagaaaatacatgatagggaccttcagaaacaagacctgaacatggttactaatgccactttggcaagtagtataaaagtctctactctgcctaaatgaaaatgaacataaatcagtcactgagtaaaccaaaattttaataggatagtgaaacctaatatattgatacatattataaaaattgcataattgtatttaccatctcaaatagatgatattataggtccatatatgctaatagtatttgctatctattatactataatctgtaacagggatgttgtttgtgtgattaaggactctactcacccacccccaaaaaagagagaagaatgactgagctgattatgtttgtttttggaaagatgtcacctcctccactatttggatgttatcagcttgagttcagacatgtgaacacgttcagatttgacttgggatttcagcttccctg

SEQ ID NO: 6798 - DNA, 1031 bp, Homo sapiens
tttctattaagacataatggcctatattgcaatttaaaaattgtctaattgcttatagtatagagtagtatgaattacttttgagtttaatttgactgcattgattgagaattctctagaattttttttattggtatgtcatcattctctaggtgatacagatgttaatttagaagcttctagatagtgtttttcaacaactctttgaatttaagatgcattactgatgtcctccctcagaaaaagtaataatgatatataaaatgaaggggaaaaatatacaaaaaccctcgccctccaacctttttgtgttttttatcttccctacaggggagcagttgtatatatacactaaatgaatataatcagttgcagttttgatgtataagattattcttgaggtgagggataacataaatattatttttctgcaagatagagtatgtgcttgttgtatttgcatatattcatgtttaggtgaagaatctgaattttcaaatgttaatggaactaacaattgacttgaaaacctctatacgaagaaactacgtgaagcccttgcccctgaatttaagcaatgagtattgtttatgtattaaattgtggcttattgcaatcaacatttttgacagaagatttatttttgttaagcctaattgtgtcaaattagaagtcttaattccaaaaacttaaagcatcacgtctgcatttcttttaaaatattttttatttttgtttgatggcttatttcttttcttatgcctgtagcagcagtttcatcagttatgattctggaattcatgtttctgaaactgtaacatgtaattgaattataattggaaaaattagattaatcaactaacagaataatatactctgaaatattcttttaacagtctttgatatagatctagcattgatatttatagactagattacagtgatgatgctgcattggtatatggcttgctgaggagtgattatttctcagttgggattctaatagtaatcatagagagaatgttaccccc

SEQ ID NO: 6799 - DNA, 1034 bp, Homo sapiens
cacttacactgcagactgtcacagcccagaggaacttaaggaaacttaacataatgcaagttctggatggaatcctggaacagaaaaaggacattgtgcaaaaaccaaggacatatgaataaagttattgattttagttaataataatgtatcaatattggtttgttaattgtgacacatgtaccataataatgtaagtgataatgggggaaactggatgtagagtaaatggaaactctgtgccatgagcataatttttttgtaaatctaaagctattctgaaattaaaagtttatttcaacaaaaggacattgcaatcacagtagtcttcatatttattgagtacccatcatgtaatatcatcattgttgcaaacctgacttctcttttttaattttttattaaaattatagataatttgtcctttccagtaactatgaggcctcatgtctatttaaaagcaccttggccaggtttgggtactagtaaatgctctaagaatatttgcctcttctttctttcctcccactctctacctctccctaagtgcttctagtaattacaaaaacaacaatatgaacttttacttcactgttgaaagggtcaggctaatcaatcatttaatttgatgagtccaggaagtattcgatgtatatggggacatggtcccaacgttcatgtggtctatccccacatgcccatcttcaagatgcataagaatgaatagaccattttacttattagaagaatgagagttaatatttttttctttttcaatctagaaaaacaagagtgtattatgataataatagaaatggtaacataagaataatgagattatagattttttccctattctgaattttctaacatgttactatttaattttacaattaaaaaagaattttctctatatttaaagtgcctaaaatctattcttgaaaaattatttcacatcatagtttttcaaatatatatgcatacacacacaacatacacagagatacagagtgcgagtggggagagattccata

SEQ ID NO: 6800 - DNA, 1027 bp, Homo sapiens
aatatatttaattgtacttgatttactgttgttattaatgtttgagaaacaattttaagtaatctatagctcatggcaagaatattctgacatgtatatatgagaaatgaaaaggaagttaaattggaaacaagtggtctgaaaagagattaataatgttttgcttttctgtgtataaatggaaataatctgtgtagattgaggtttcgcatacacttttcatgtggataaacatttaaagcttttaggtaaggacttcttatgtgagtctgaatcgtagaagcctatgattctaaagttttattaagtgtttaagtattggtagagaagtcgcttttcacatcatcgttgttttgtatattaacatggaaatgtcaagttttgcataacttgaaatgtctcagaattgcctattgctgaaattcaaatgtcagaacaatgcttctgcaaatatatgactctgatatttcaactctaaaaacctcataaatgattcagtatcagtttggccttgttatgatataacttttaaaagaggcagagtgatttaaatctgttctagaaaatggtggtctcattcagtgtagacatcaaacacaaatctctcaacccattaatgctcattaatttttttattatgttaccattttggcaaagaatttaagttttcatgaggactctttaagtatatttcaccattgtaaaaatgaagctatttctttgtgagcaacaggattggcttatatcttatcctaatttgtggcattaattgttttagagggctcaatactttttgtaaaagaaaattttttttgtttttcaagcgatgaatgccttctaggacataaatgatatatagagaccaaaaggcctgtagaaataaaccttctactattaatttactcttccaaattttgcatggcatctaaatatttaaaattaaaagttttacagctggcataagccttggagataagaaacctgactttgtcattttatacagaaaactgagtcttgatgtctagtc

SEQ ID NO: 6801 - DNA, 1044 bp, Homo sapiens
taattttgttcagcgcgttgttgatttctttataacaaaagcaatagaaagaaaagatgaagtaatagtgaaccaaacagaaataattttccgtgtattgtgcttgtcttcactgtgagtttagttttctatagtcaatgtcaaattgatcagacttctactgtgtgattgaagtacttctttaaaaaaaaaaaaacactcatattgtgaagttaaaacagttaagttgtagtgtcactgaaacagtttttctgattacatttcgctttgcaacagagcctgagtttttgcacttcttccttgtttaaacagcttaagtaaatttacagggttacccccctttttttaaataatggagaaatggaatgggtgcaaattttgaatatggttcttttctctgttagaattagcagccaactctgcatgaggagagaaaagttgagagtatataaaaaagatttccctgtatgatggctcctggctttttaaaggagatacaaaaataacaataaagttgactgtgtacaatggaatgctggctttcattgcagatcttaaaaaaaatggttttactgacttttgctcaaactttagtagtagcaatgagtgtttgccaataatttttgttttctttccttttttaggagatgggctagcttaaaatttcaaatatacatatacttacatgtatatttacctcattgaatgctaatgttaaaaaaagtggtgggagctgatcacctatgctgccgtaaaatgaaacagctccccctcttatatttgaccagagacccatagtattgaaggagatttatggaagtgaatgtatttatcaagttcatatatgaggcagcagaacaggctttatttagccttcctatcacttgtaccataaaacagtgggcctctgtttagttggcctaatacagttgttaaattggaataatttttctgatttaaaatttgtagtgtatttatttgttgtttttcagggaaaaactattttaaagagattaccaaccacaatgtcatatgttaacctga

SEQ ID NO: 6802 - DNA, 1050 bp, Homo sapiens
ctatctgcaaagtctgtttttctctagagaaatgtcttttctatgcaaagtgtgcattcagtaccaccaattccctgcattttggtgctcagaccctcaaagacataattaaggggatttcttctttaaaagcctactgtgtggcatctcatacaattatatggcccttgctttttgttggtcttttttcaaatataacatgcagtgttgccaggaacaccatcatattaaaatataaaattaccttttgtgaaaaatggagtcagggcatacatctgggaatccaacaaactctaaactggctgtgtacaaaatttttttttttaagtttggaaactgatagctgcctgaaggttgcatatttaaagtcattttccctgcttccttcattttccccctgtggcaaagcaaagcagcacttcttatggggaaaaaaaaattgaaagaaagaaaagaaaacctaatattggcattctagtagtaaaataatggtaaagattgagcctggattttgtaatactttggatattggaatatcctaatttccagttggaaaaattagtatcaaatgtattttagatgaaaagttcagtgaatgctgacccatattttgagatataaacaaaaaacaattaaaagatagctattttaatgaaggaaaatataatatttaaataaagtgtttagacttcaaagtagagtgttgctcacgtaatagccagaatacctctgtgcatacatctcggaagaggctaaaatgccagatgtatttttgtgctaattttctcaccagcttctggagccagtagaggaattcagcacataatatctcatagaaggtatccctctcagcattttcccacgttcctccttctgattcattgctgaaagcagagataagagagttaacaaataactagactaataataaccataataacaaacatttattgagtggttactgtgtgcctggcaccatgttaaagagtttacatagattatttcatttaataaccatgtaagtcctatcatccccactttacaaatgag

SEQ ID NO: 6803 - DNA, 1044 bp, Homo sapiens
gttcgctgtttaagtttcagcaaatcatttacccattttctattctcatttcttcttttgaatggggttaataacgcttatccgacctcatagacttgctgagaaaatcaaatgaaaaaagtccggaaatactatgtaaatgtgaagtaactttcttattgttttgtttgaacctttttgagcccaagaagtgacctggtgataacgatgctttaggagacgaatctggccagtggcatataggacagctcagaggagaagaaaccctaaggaaagcatttcagacagtatggcagcaggtcatagaagaaataactgaggctcgaattagggctgtgagagcaggaatgaagaagagaggatggatgccagagacatcactgaggaagaatcaacagacgcagcaatttggctctgaggataggaggtggggggcagggatgaagggagagttaggagaaaccctatcagaaatccacggtttctggttgagtaaaaggtatatattgattgagtaaacagtaaaggaaaatcaggaggaagaataggtttggagggcagaaaatactgaatttaagatattaacaaagtgcccaagtgttttcattgagtagccagtcaaacctctgggattgaagcttaggaatgaagttatagttagacatgtagacataaatcattcttgaactgatagtcatttaaatctatatatttcaaactttatccatatgagtgcaacttgtaagctttttgtcatatttgcatgatacttttacttaatattttcaaatctattttaagttagctcactttttgaaagcgtagccccattctaaacaataatatcttgaatttgatgtgatggatatagtttttaagatacccattagatgtataattaccatattgcatgattgtaagatgtgtatctttttacaatttaacatttctgtaattagagtgttttacaattaatggcatcttacaaactctgcaggccagcaacagtggtgatatacttgtcattgtcagcacatgagccaa

SEQ ID NO: 6804 - DNA, 1122 bp, Homo sapiens
tattactgcatgcacaagaattaagtcagaagagagaatattttatgttaagaaagcctgaatttatttcatgggaattgcaatgtgcatttccttaaagttgatgatttatagttttcttcctttttatagatttaatttgtatagggtttgaagggccaaaccttaatgttagggtgctatttaagtgcagatttctcgttttcatgacacaatatttttgtactcagaagatgaactcagtaactgaacatggtttactcttctacccagatgtttttaccctgatctctattagggatattttgagtcctagctaggacctagaggtggaagttggtagctactcaaaagtttagttgatattaagaaaattttattactcagagatgataatgaaaatgtatacttagtgaatcagagaatgttataaagaagaaagtggagtattggttgtatggatgaatgtatagatagatagatagacagacagacagacagatgggcagatagaatatcctctctatatatgtttgtgtatgtgggaaagagatgtataaatttatttattgcaggctgggcacagtgacttacacttgcaatcccagcaatttgggaggctgaggtgggaggatcccttgagcccaggagttcaagattagcctagccaacatggtgagaccccttcttaaaattttccagacatggtggcatgcatgcctataatcccagctactcaggaggctgaggtgggaggattgtttgagcctaggaggtcgaggctacagtgagctgtggtcacgccactgcactccagcatgggtgacagagcgagaccctgtctaaacaataataatattaataaaaataaaataaatttatttatttcattagcccagagattggaaacgagaacagaaggtatatgcccaagataataattaatgtatagtgagataaccacaactcaagaaagaaatatggccaggcatggtggctcacatctgtaatcccagcactttggaaggccaaggcgggcagattacttgaggccaggagtttgagaccagcctggcaaacatggcaaaatcctgtctgtacaaaacatacaaaaattagctg

SEQ ID NO: 6805 - DNA, 1030 bp, Homo sapiens
cctctgcctcccaaagtgctgggattacaggcatgagccaccgcgcccggccaagagaccttgtctcttaagaaacaaaacagaatgaaacaacctatgagggatacctggtgtcatagaaagtactgagcatgaggcctggtgcatagtaaatgctcaaaaaaaataaaagcagttttatctagcttcgttcttcagagtaacatgagactagcacttgaagatccaagaccattctgagtcagttttcttgcagtaaactcttgggcaccttgatttttggctgtcttcagcttaacccctttcacttgtaagtctctaattatctaaagcgtatggttgtgttttcacttatgcaggtagtttatgtaccatttattgaaagacctcttcctttccttctgaaccattgttttccttctgttcagtctccaaatgtacctttctctcctctttagcctttgactgacatttctgtgaagcattttgtgatgtgcatttagaacactacgtaaaaataaactgcattgtgttatttaaatatttagaggcctttgtagccttgcaggctatttttaaaatgacctttaaaaccatttgcaaagaagacaaaagtaatggggggaaagcataaccttttaatgtttccttcattagtggcgttccctaccttggatgcattgccttgctttgatagttcataatgtaggatacatcaaagacccaaataatggagaacaatggggaccaatttttttaaagctgattttgcattattgctgctgccattaggtgtcagatggaaaagatccctttcttttaaataagctggactcatgattgattttctacgtgtggtagacccccttggtaatgctggtgtgtaaagaaagacctgctatgcattcatatgtgaattgggcttatccggtttcctacgactttgcttttgtacagcaagtttatttttgagaggagagagtcaatctgcgttatatctgactcaataataacaagaaaccaagttgca

SEQ ID NO: 6806 - DNA, 1027 bp, Homo sapiens
ttcaataaaaactggttggcatatctgctatgcctaaacaattttgctaatattaagaaggttctcggctaaaattctgactcatcaattatttactttttttttttttaatttaaatgactatttctatggggaatcttttgtaaatgtgtctggtctaattaatttggtgccaaccaggcaccaatgccttgtcgactctctttatttactgtggtatgcagtcacttttcttagttgttccgtgcctcatcctaggaagtaggtttgtcctgtttgctttcataagcatgactggccagtaaaacccttgacctttaaattaatgggtaatacgaattcatctcattccatcatgaaacaaagattctctgtatcagatattactatttattagtaagacaaggggatgggggatgccatgtgctctgaggtatcactattagttaatgagaatggtccacattttatccttcttaggagtaatttttctgaagggcattgggaaattaaataaacacatctgaaattggatttagattttgatagagcagaatgattacaactagggtcccttagtagcctggggttattcaaatacagataaagacaatacatttccataaattctgaagaaaacatgtggctggagtatgagccatatttttctgagtgctggggttgatggccattaaaaatgagaagaactgaaacatgcaggcattagttcctcacatgacagttgctctaaatcaccatttatagaatgcactttttaatgtgagcatttctaaagttaacatgagcaatagaaatgtcaaaagtgaaaattaaatcattaattctaacatattcctttcctaattaagaataattacagcaggggctagattttattcaccctttgacctcaaccttgcttgctcagtgcctgggacttactgtttattgagcgaatgaaaaaattttttttatcaaatcttttgcttaggcaggtccacaaatggcagggggcatacccgggata

SEQ ID NO: 6807 - DNA, 1064 bp, Homo sapiens
ataaactgctaatgattttgcttccacacaaccagatgtatctctggttctacacatcacctctttctcatggaactgtttgggcatattcctgtatacgagtctattactagaaaacaaaggaataaatgaggagaaaatactatgtgtaagttaaaagccagaagagatataaaacattacatttctgattcttcatgtttattttatgatctggtgaccttgtctaattaaaggcacatttcttggtgtacagcggtgatcactgagtacagttttactcacttaggtaaatgaagtattactctcatttagaatagggtaatcaaatgtgtcatagtgaacattgtgtttaaatatataattctgtacatctatctctggatattctacctctcttatataggcctcttttgaaaatttgtgcaggaaaaattaaaaagtcaacatagaattcctttcggtatacattataacctttttccccacagagaggttatttttagtttctgttatgtccctgaccctgacaacgtagccaaaccagactttccatcctgatcttcccccacactcggctcaatctccacaggttttgccccttccaggcgaccttgtccaggagtgtgacaaacccaggcctggctcctggggcagaaagaggaagaacgatatgtgtagtgtccccttgccttcctttcacccctgacgtatttatctggggaagttgaaccacactgtactgtaagaacagtgttgagagggaaagaaatttacagaagaaccaacaagtcacctaagaggtagaggaagaaaggaaaattggttccttctacttttccagggagggagtaaataaaaggacaggctcatagctttactgtttctccactacaaccttagctgcttctgagcgtgtgctgctttcaattccatggattcgcctaactccagagacagctctgtgcacactggaggatcaccgctccctctctccacaccaggagtctgtaactcagatatctggagacaagcaagaaatgccttgtgtaagacagatggag

SEQ ID NO: 6808 - DNA, 1050 bp, Homo sapiens
gtttcctaaagtgtgtttcgctgcagaaggaggcgttccaccaaaagatgacttcatggccaagtgtctgtgtgcaaggctgcgtactgcactcctgtcttgtagagattacacattagcatattaatggttctaagaagtaacattccttttttactttttataccaaagagtttctcaatgtatttggtcacagaccctgtacatcttatcatcccacgaaacaagatggggggaaatgttggacttaggtacacttcatagtttttatatatgctttatgtaagtttttcatagtccccataccatccttatcaggtacacattattgtccccattactcaaatgagaacttaaggttaagtgactcttccaagttcacaagccaagaaaagagcaaaaatttgtacctaaattctcctaatctgggaaccattccaccacactgtactacctcttagattcatgtgtatcatttcagtgagcaccagcgtgtcccatccttctctggaccctgtctctagaagtcctttataaatgtacttctaccttggcttttccagtcatagcatgtagcacgaaatccttaattgtccactgtgtaacacctttcatgacatgtgctgttccatgtggcactgactactccagagtccctgggaacattatgctttttttgcacactcgtctccattttccacgctatacgctccttatatgcaaggtactcttagtagttgcagcatctgtccaccgtccttggctccgtagtatcaccgggtgcttctttactaaatgagagtattcctcagttgtgggagtcgagagagagaagaaggagacagagagagagagagagttggggtgcttattttaactctggttctaatcatgctgcagggtcagcttgccaagaaacacttaaggctctgttttctgtatgtaggcaggtaatcctctgatagagaaacatagagttatcccatcaaaatgtgagcacagaaatgtatcaacaacatgccataagccagtcgatatacctaaaagcca

SEQ ID NO: 6809 - DNA, 1091 bp, Homo sapiens
taaaaaaaaaaaaaaagaagaggtgtaatgggattgggtagaagagccaggactagaaagagtcacatacgtatttctttataatggattaagggaaaaccaggaaataagtgcagactggccatgtttcaaaagaaaataagatttgaaagataaaaatcatcaattcctataatttagatttttacccagagtcagtgtgttcatataatctcctttattcttttaagcatttggtgtagcaaacttctttcaaacatcttgaaaattttttgtccaaatagctatactttccagtattggtttaaaaatgcgaatttaaaaatctgaagtacaagttaggaagtagattggtagaaagttgaagctatgtaaataagaataggctgttacttaagttttcaaaattccaattatgagtattccagtgcatttagacaagctgggtttgttatttttggagttagtaagcaatttcacaatgtgctatatatcacttttaaagacatgataaattgtccctaatggtattgtgtgtataaactagagctgtttctgccttgtgtataatgctcaggattgggtggtacacctgaaaaggctcggattttaatggggcctttttagcacttttgcacctcgtatgttcaggattatgtttgattgatgactttaaatgtgctggcatgagagatatgtagatcttaatgctcttaaaccatttgttttccaatctctataaaaggcccctctgttttggggtaacactttatccttcttaagtaaacagaaataggtttctgggattttgctttttaacattgtaaatccagcaggaaagagacaggctagaggcttttaagagaaggctgaaaacaccatgttcccattttattagagtagccccaaaaagtcagggcatgtgtgtatgtatatatacgtagatatatttttctttcttctaaacagtattaaaataaccttttttttttttttttgccagaactctctgaatcttttctttcctttggaccacttgatatctcagccattatcctcagcctgctggctgagaactctctttggatccc

SEQ ID NO: 6810 - DNA, 2023 bp, Homo sapiens
gcagtagttatgtggacgcatcattcagttctagaatcagtttgaatcaacagcttggctccacacaaaaccttcctttttcagatgatgtggctgaagcacagagaggtaaaagcccccttccggaggtcacataacagtagaaatctgagattttaagaccatgaaatcaaaaacaattatgaattttggggcaactgctcagcttcttcatgtggctatatctttattttttttaatctacatcttcaaaaatccaagcatttctgcctttgaaaacaagatttttttctgtttattaggcaaattgaatttgagatatataatcaacattcataaagttacagtatatttatccattgatttatagaattaatctgtactaatgaaattataatctttttctgttgctgaggacaaggactacatcttaatcttctttgtgtccctaaaagtgcttagtaaaataactcctaacaagtatttgcaaaaaaaaaagaaagaaagaaaaaagaaatacagaccagaagtgatcttaaaaccaactctagccgcttacaaaggagaaaactcagtcctagtgaaggaccatatgtgttggtcaaaaggagatagagccagggttttccagctggtagtccactgctcttcaggtacattggggatgactttgttttcagatagcctgcatttgccatcttccagttaaaatgggtaaaggcttaatctaataattttattaaatgtaatattatttttaaattcacacaaatgcagccacaaagcctgcatcataacttttcacttccaagatattttgttctgttcagactggtatagtgtttaaccacttaaaaattaattgcaaacacagcttgctgaaatattcgtccactaatagccaattaattaaacttatctaatgtttattatccacagttgcctggcagataattgatcctcattaaatatatgttgattcagtcttccctgtctcagctctatctcaagatgagctcttaaatgatgagctttgaataatcttggatgatttttaaaaaataaaaattcctcctacccaaccctattcagaatctctggggatagaccttgggattctatttttaacaaactggacaggtgcatgcatagttgagaatgaccacctaaagtaaggagattgaaattatcattgatgaaaataccttccattgatcagtccagttgaaaactagagatacctaaatgttatcaccagacatatttttaaagtagttatataggttcagcaaaccctagtccttatatgacagtttttaaaatgttttatcataccttaattcatctttattacaaattatttaaataagatagaagtatataaaaaaataaaaggatcgtcccctttacccctacccatctatctctcccactctaactactcaaatataaccactattcatagtaggtatttaagctttgagggtttctcccctatgtattcgtatgttttgtctgtatctaagtacgtttatatgtgtcaatatatatgcacacatacatgtgcatatattcatatttacatttataatgagattatttattcaacaaatatcgaagcatctactatgtaacaggacctggtgctgagataacaacagtgaccaaactgatgagatccctgttctcattaactcaacattataatagtgagacaggcaatatatcaataaaaatgtgatataaaatgtggtaatgatatataatataaagtaaaataaagtaggataaaaggatagataattccagggggttctacttgacctatgatggtcagggcaagactctgagggatatttaggcagagaacagagtcacatgagaaaatgagccccgcgcgtgtgttggagaagtggacgccaaggtcttctagactacgtatgcaaaaccacacgtttttctttttaaaaaataaaattctattacatatactgtcctgtaccttaatttttctagccaactc

SEQ ID NO: 6811 - DNA, 1055 bp, Homo sapiens
tttttctttagcatttaactcttaagtaaagaagaaattaaaaagtaaagtaaaattgtaaataagtaattgcacctttatttctgtactgtacatcccataaagatagacaatatgattgacctaaaagttctaaataaataaacttaaatcagaatgtgtggattagggagtaaaatggtagtacgaaaaaattgtcttgtatacagttgctttttagatgtgtaaaaactgtttacttgacacacaatgctttggaattaatcacatatgcaagcatgttgtttgttggggaaaccccttatagtctctacatatgtgaatgaaagatgggatttgtttgaattactctatagccttcattgttaaaatcagaattaagttctttgttcagtgaagcattcgtagcaatccttgagatttctgagcagggctggttgttggcagagagttctcagtgtattatgctgtttacctaagggttttattcaagaagctctctgaacagctgggctgattattgaaaatgcctcatagtaacttccagcctaggctgatcgatatcggtgcaaagctttacatgggagggagttatttaaacattgagagccccagggataaaagagaatgaaaaaataatgctggacaaatatgctgaaatgttcaaaagaagagagaagtatcttgtcttggtatagaggggaaattcctaaacaaacaagctagaaaatttgtaagctgatcttattacaccctaaacatttacttattttaacttatagcaatcccctaaatatttatttatcttataacaacaccctaagtatttggtggcaagaggaaagattaattaaaagtaccaaagatcaattttatttttatttattttgaaatgtaacctattacataaaattccatgagacactttttagtgataatattgggaaatatttaactttattgtcaaatagattcagctctcatagtttaaatgtagcacaaatgtatttcacccaaatgtaagcagaaaattcctatttctttaattttttttt

SEQ ID NO: 6812 - DNA, 1046 bp, Homo sapiens
aaagcaaaatatcatttaaatactgagcttttagacgtataggagactgactttctgatgcttattcttttgatgaatcacatagacaattactaattggatagttattctataacagtgacattttggaattttcaaaacaggtagctctttgaacatgtttgtatttctctcctcatgttaacatcatcattttggcatactcagacctagaagcttcatgactgactcactaatgaaattcagcaatcatacatatgcaaagaactacctaattcattgaaatatttaagaactgacatggggtgactagatgttttaacatttaagagctctagaacaggctgaaaacactaacatccaagtgtttacctatgaattgatattggaatacaagaaactaacttacattgaaaaggtatatacagaatatggaaatttttataaaaaacaaaagccagcttagtctaatagtttgtttttgcttttaaaagaaaagtttgtttgaaatcttcattgactctcagctgctggttccagaaactacacatattcccaatatggcttatgccagttttctgctttgaagactaaaaaatagaccagaagacaaaatatgatttcatgattctgtgcctcccttgtgacagtagaaaagtaatttaactcctttgtgcagcttttcttcaccagtaaattaggaataatcatgtcttccaccttctgttggggactttgaagagtaatgattcaagggccatttggagttaaaatagaaatatgaaattatttttctttacccaaagacttaagttcatggaatatgagaatatctcttaaatcatttttatttttaaatgcccatttaaaaattcagcattttaaatctatttactttgtgtttatattgcaaaaatagaacacagatgctaaagatgtcatattaggacatctttaatagcaatatctatcaatgccattaaaatattatctatctatgaagcataaagtcccactgttctaagagtaaaacatgggtgtttaaa

SEQ ID NO: 6813 - DNA, 1049 bp, Homo sapiens
ctttccttactttgcacaatgtggaaaggttgaggacctttccccactcgccgcggctaggaaactgggggatttggagggactcacagaggctatagcaaatgaccaggtgatgatgtgcatgacagtttgggctcaagaggggaggtgaccttagcaaggaatagaagtggcagttctgatagtgtggagatgatctcaggcagaaactcccaacagcagttggcaagggtcccagcatcaattccaaagccccactcgtagaaggtcacccttaaaagatcttcttctctattacctttagtatcctgtcccttccaaatgttcctttcccattccctaattatccattttcagtgagagcacgagattagccaaacttgcagttatgtttttttatgctgcccaaagtgcttgcttttacaaaccacatttggccccatatcaatccgttgtgtagaccacatcaagtttccagtccacagcccaactcctgcacttgcgcttgtctttgaacacaaatgggccgcagaaagaggaactgttgggctttgtgagtgaccggaaacagggtaccattgagcagaaattgaactgatcgcaccgtgttaagtcaggaagattctcaacccagaccactctttgagcaccaagttaacatgtattgcatttaaaatgtaataaatgcagtattcataaacttatatgtgtcttgtgccttttgtgtcagcagggtttctgtaggcctctatttacatcaaataaacttcaaatattccagaatgtagaccgcatctggttcatttttgaagtgtccctctaggaacatttctaaaatagtagattgttccaatttttttcctaatgagaaaaatccatgtgttctgtgattattaataataatggcttcaaataaattattgactggttgcaatggaatgcactttcgagcagctgaggaactccgcacaaaatgtctgagttgtattcctctgatccccccctctccatcagttctatgggttatcagccaacccaagcacagttgc

SEQ ID NO: 6814 - DNA, 1052 bp, Homo sapiens
aaaatgcaagaatggcaaatttgaccacaattttaaaaagaggattgaagcagtttggaattacgaaaacaaacagcaccttagtttcctgtgcaattatagtttacctaggaaaaagctattccactgcccacctatcttccaatggcttaatgattttgtgatgaggggaaaaaaaaaaaaacacctgtcaaccatttaattcccaaatcagttaaagatgtccgaatcaggtcccccaatgctttcctgaaaccacactccctgtctcaagccatagggcagtggttcctatcctggagtgggcttcatggagtcttgaatctctgaagttttctaaaaatgtatgtgcatatgtgtgtatatgcatctttctggggcttttccattacatttccttaaaaggttcaaaagagtctacaaccaactccaaaaaaaagttgagaaaatgagatattgttaaagaactgtgtccagtttcgtagctaaataccatttaattactttgatactctggcttacttaaaatgcattgacctacaaggaacacttattttgaatttgtccacaaagttcaacaagacactgaaaactcaaggatgccatccttgggaaatcagatcatttgtcaaaagtacgtccttaaagacaatcagaacaattacatttatatgggaccttatggtttgtaagacacagtcacatatattatttttttaagttattcttcgtaagaactctgaattcatattgtcattattatcttgtggtatagatagttgagacctacagaagttgagtcttgcccaagttcatgccacaaagatagagcagaacttggaccagaaccctggttttagccacagaaatcatgttcttagcagcattctggcggtaacaccatcagcctcttcttcaacatcaaatgtttaatgtctactgggtaaaagggcatatggagattcccttaagaatccaatgttagtcactggagattcaacaaattcaaaactctactcctaggtagcttaatatctaattgggagcttttg

SEQ ID NO: 6815 - DNA, 1028 bp, Homo sapiens
atattttatctgttttaatgcgaggctcggtggctcacccctgtaatcccagcactttggaaggccaaggtgggcggatcacaaggtcaggagttcgagaccagcctggccaatatggtgaaaccctgtctctactaaaaatacaaaaattagccagcttggtggcgcgtgcctgtaatcccagctactcgggaggctgaggcagaagaatcgcttgaacccaggaggcggagcttgcagtgagctgagatcgcgccactgcactccagcctgggcgacagagtgatactccatctcaaaaaatatatattttttatctgttttaatctggactgcccttcccatctccctctccaccccagaagccttaaagctgcttgagggcaagggactgaagcttattttgctagtaccttgctagttcctggaacagaatggacactcaggaagtatttggatggatggatggatggatgggtggatggatggatggatggacggacggacagacttaatgaataaaagaacagacgagctgtgacactaatttacatgaagcttgctgacttacctttctgcattttagttaaagatctggaaggaaacatttaggagagaactctaatgtctggaagcatgcctctgaatggcagagttagtctctttatttggggtgattttttacttctaacctcctttaaacaaagtttgacgattcagtctcaaaaaaaaaaaaatctttttcaatctgagttggtctcagaaagcatatgttccagctgggcacggtggatcaagccttgtaatcccagcactttgggaggcggaggcgggcagatcacctgaagtcaggagttcgagactagcctggccaacatagtgaaaccccgtctctactaaaaatacaaaaattagccaggcatggtggcaggcatctgtaatcccagctactcaggaggctgaggcaggagaatcacttgaacctggggggcaaaggttgcaataagctgagatcacaccacttcact

SEQ ID NO: 6816 - DNA, 1072 bp, Homo sapiens
aaaaagatacagatagcagacatttcacttcaaggggagaaccttaatagcaccaaattcagtattaaaaccaggattcgtttaaagcattactatgtcacatagtgccctgatttttttgcttgttcgtttgtttgttttcagacagagtcttgctctgctgcccaggctggagtgcagtggcacaatctcggctcactgaaacctccacctcccaagttcaagtgattcttgtgcctcagcctcccgagtagctgggattacaggcgtgtgccaccacacccagctaatttattttttatttctttgagccagagtctcactctgtcgcccaggctggagtgcagtggtgtgatctcggctcactgccacctctgcctatgggttcaagcaattctcatgcctcagcctctgaagtagctgggattacaggcacatgccaccacacctggctaatttttgtatttttggtagagatgggatttcaccatattggccaggctggtgttgaactcctaggctcaatggatccacccaccttggcctcccaaagtgctgggattataggtgtgacccactgcgcctggctctgccctattttttaacctcaataaattatattactttagtaggtacctgggtactctctagtattaactaattgggcctcctttttggctagaccattcttattttaaactcagtagtgatctgatttttttaatcaatgactttaattccaacaacaaagaaaaggtggataaatctgccttggttacagtaataagctgttaaaggcaaaattatactttttatacttttcaccaataatgtctactactagatgtatttttttttcattgtgagattgatttgcccttgatatgtattgataagtgttttctttataaatgaaatccatttaaatcattacaccttgggaagagtttttaaactgatcagaatgcatgatcttaaaaatatttctgggccaggcgcagtggctcacgcctgtaaccccagcactttgggaggccaaggcgggcggatcacttgaggtcgggagttcaag

SEQ ID NO: 6817 - DNA, 1493 bp, Homo sapiens
gttcctggagttggtgatacctggcctgagctttgaagaataagtgtgtgttagccaatgaagagagaacagggacatggaggccttaaaacaatatgttgtgcccaggagctacagattgaccatccctactctgaaaatccaaaattcaaaatgccccaaaatccaagtttttgagccccaatatgatgctcaaaaggaatactcactggagcactttggatttctgatttttggattagagatattcaactggagtgttattttgcatatattcccaaatccaaaaaaaattaaaaactcaaacacttctggtcccaagcatattggataagggatacccaacccctacaaactgttccgttttacttgaggaaaaaagacaaggcgggagccagggtttgagccagtggtaccttagaggggctgtaggttccccaccaccccaagagccccttgccatgaatgctgccagggccaccccaagcaaacatagttggagtaagaggactgtgcttgctatgtaaacgcagcttcgtaacaagtgccgttgcacctctgctgccctaagctcctctgtatggaaaatctagagattccaccgaagggacattggctcagtgctgagagttggaagctctgagtcatgactgagttggaagcttacatgttgatttacaaggcgtctttgcccattacatttatttacatgtccagaggtcatggcctgaaaggcttggctccaaatatgatgtgccctttctattgttgatgatgtgactctccattcagttctctttttctcttctcctggttatctgttgctgagtagcaaaccaccctagaaatgcagtgacttcagcagcagtctctcaggattttggcgggttaggaaaatcaggggttgcttggctgggtgttctggctcagggtctctcatgagccttcttcagacagagatcagagctggaactatgtaggggggacaggagcctggagtagctcgggactggctgggcacctttctctttctgtcattagtcaaaaggcccttccatgtggtctccctgcatatgctggtttgggcaatcttacggtatggcagcctcagacttggcagcccagggcacctaaggtgagagctacaaaagcaagaggcagaagctgtgtggctttttcttacccaatctaataagtcacacagtgccacattctgtgcctcattctactcagcaagacagtcgcaagggcctgccgaggtttaaggggatgggatgtgacacataccccactctttgatgcaggggtggcaggttgacgaagaccagtggggcaggaaatattgttgcaaccagttttggaaaatacaatctgtcacatccccgaagaacattttcatccactcacataatcctttaagttacctaaaaattaatttactcattacggtgtcgcccacaaccttccttgctcccttcccacagcaaaatcca

SEQ ID NO: 6818 - DNA, 1046 bp, Homo sapiens
aacatcaggacctctctccccagcagcaacacctggattgagttatttcacttctctggagctgaatctcactgaccatagaagagggcatatttctcagcaaaacagctggaaaattatgctggccttttgtacaagtcatgttaagctccttcaaagaatacatgaacaatctgcattattttaaaggtgaagatgggctttttaagggggagaggttacagctaccagcaaaccagagatttcctccattctgtgaccctccttcctctgcattcttaaggacttggctagaacctgagttttccatttctcctggtgagaatgtgtcttcaggagcttattgataattctgtctttcagcacaactttgtaaagttgaagtccctgccaattgatagtcaccttgtggcgtgatcttgtcagtccaaaagaataaagatctacctttacattcatttagagtgagggatgatgtacagccaggatgcctaagtgtcacctcctgcagttcactgacacatggagtccctttgacaggtgcccgagtttctttttcctatgtattacaacatctacttttaggattttttttttaacctctttccccctttccttcctgttctttcttccctcttttttcttctttttccatctccttggctttttaactctctcctcttttctctctttccctttccacttttcttgtcagcagtttattcaaccaccgtataataaatccagtaagtgatcataaaaataccaatcccaattgcaaaaatggcagcacagcctcagcttggaaaaaaaatttggaaaaacaaactgaaatcatcaaagactaaagaccagatactaaaaagatgggatttgctgtgagatatattttataataaaaattctgctataaagaagcatctttttatttttttccttgatagtctgaatagtttatacctgatgccaagaaattatatataattagtctgggtaatatataatttccatttgattatatatattaaagtgattaaggaacttca

SEQ ID NO: 6819 - DNA, 1050 bp, Homo sapiens
cattttatttatcataatacctatcacagccagtctttaaaagggctctttgtaaatttctgtccttttccaattaaatactgagcttcatgaaggcagaaatcttgccttactcattttaatatctagcagcaaccattgtataagtcctcaataaatttcttttttttttttttttgacacagagtctcactctgttgcccaggctggagtgcagtggcgcgatctcggctcactgcaatctccgcctcccaggttcaagacattctcgtgcctcagcctcccgaatagctgggattacaggcgcctgccaccatgccaggctaatttttttgtatttttggtagagatggggtctcaaacttctgaccccaagtgatccgcccatctcggcctcccaaagtgctgggattataggcatgagcaactgcgcccagccctcaataaatattttgttgaatgatttgaattttcttctccaaagaaaaaaccatgggcctacaaggaccccaagtcaaggagagaaccagtctgaagcaaagtaacaaggactaacatttaaaatagtaattatttttatcttctgttgaatttaaagctacccacagtgatttaccagttttaattcgcagaaaatgcaactttgctttttttcccttctgattatgttcttcattacaaatctcaagagttttatatgcagttgccaaaaatctctcttttgacaaattgcacaggaggcattttgagattgtgtgatagactcgattgaatttaggccaaatcctgtacacttgtttcactcaaaacaaaaatacagatgtagggctactcaaacatttacctatttattttctcccaaccctccaaattcatctttctttaaaaacaatcaatcggattccttttaaattaaatgccgagtaaacaatgcaaataaaactattttgtttgctgagaagtaattgaaaatctgcaactaattacaaattggcaagctctgagcctacaaagagctgaaacactctgctgaggcattgtttacagctg

SEQ ID NO: 6820 - DNA, 1053 bp, Homo sapiens
ctgttttctcaggacaagctcaacttcacttcctcccgccttatcgaaccctttgtttccaaaattgttaatcaagccacttggggggttgaactcaactcctccctcccaatatcctcccagctcaaagtaatgagaaaaacaattgcccacagtgaggatgtccatggtccccattttccccagtctatcatgccttagacagatactgttgaattttgtcagttgcatgtcccacatgctaatggtggttatttggacatctctgcttcaagcccagcttaaaaaaccatatggccccagattcttcaatgccacagctatggtgctcttccatgttaagagacttaacagatgaaatatggttttccgaacctcttttcatttaccatcaaaataacaagcgatgtcttgtatttcaacagagacattcttttcactcagttactctgcaaagaatgtgcccttgtctctgctgtagatttttattttatttgtaaattgtgcgtgctgcatgctacggaatactgaaaagccatacaccctggcttgttggttgacacatagtatgtgtgattacagattgtttgaataacagtggactattgaactgccatccagatgtgtgtggagttaactgtgggaatgtccacaaaggaggattatctttcttgttgctggggccaaggcccccagaaagtggaaacataagcatggcagctactcaaatagaacagtagctacaattggctcttcagaagcaaaattaatcattttttttaaattatgcattgcaattaagactgggtttgttctctaaaagtaaatcatgcaaagaaaatgccaaacaataacacaaaaatttgcagctttgaatgccctttgtgaatggtttcgtcattttgtttttaaacgtttagaaattcagaacattgtagattaaagataagacctcaaccattgcaagcctccgagccatcatcttgtagacttgatctgtgtttcctgcactctcttccattctttgtactgtacaggatactgtaagcattg

SEQ ID NO: 6821 - DNA, 1055 bp, Homo sapiens
ttgggaagctgaggcagtcagatcacttgaggtcaggagttcaagaccagcctggccaacatggtggaaccccgtcctactaaaaatagaaaaattatctgagcatggtggcacgcgcctgtaatcccagctactcaggaggctgaggcaggagtatcacttgagcccaggaggcagaggtttgcagtgagccaggatcacactactttactccagcctgtctcaaaaactaaaaaacaaaagagtgactgttaacggatattggggtttcttttgcagtgatgaaagtcttctaaaattgatattgatgatgattgtacaactcagtgaacacactaaaaattcttaaattttaccctttaaatgggtgaattgcatggtatgtgaatcatacctcaataaaactgtttacaaatgaagatgaatgaagatattttcagataaaaaaatttttaaggtatttgaaggtgagtttttaaaaattatacttaaaattaggatatcttcaaaaatcaacatatctgaacttttttaccagcgtagaaaaaagggggaaatgcttttcaatttaatagcttatatcttttttttctttcctggaatgaaagatctgttacttgttcaacagtgtcaatgctttctatctctggttggaatctgcagcagtcagttggcacccagccatcaaatacctagatttacctttgtgcaataaaagtccctttagcaatgcatattgagatatatcattttgaacctattttaaattctgtagcaagcaagtaaaaaaaataaataaatcatgaaacatcaggcaagtcaaaggaaacaaagaaacgaataggaaatcctctctagattccgttcccactttactttctgtagtttgatctaaagaaaaatgtggaatttcctgcagagtgattaataggctaatgtggtgactgacaggcactctgagcttgacctggcaggtaaaggctaactggcacgttaagttgattacacaatttcctctaaataagttgacaagtggtttgcacagttgccttgac

SEQ ID NO: 6822 - DNA, 1024 bp, Homo sapiens
tgtagccacttttgtaaataggaccaataaaggggataaaattgtccatcactccactgaaataaggaaatagagcaagaacctaggagttatagtactctactagagattacacattatagaatagtgcagaaagcaagccacatgaaagggtcaatttaatgtcgcatcctgcagaggtgaggagttgatctccaactattctcattggttacacaatcacattgaggtatttaaatcctggcaggtgggagcctttgcttcctttgctcaacggtgaattcacatggtggtgtggtaggcagaggttgcacggcattctctaatagctacaacttacctagtcttatccagtataggtatcagggaagtgattacacatgttcagatacatcaatttaacagtaatcaaagagttcttttaacttagaactcagggaagtcaggtctgtcttctcaagctgagaagaaccaaagtcatggtatagacataaccatacacaggtaatgtaaaactataagctgaaaacaggtatagaaaaaacacgagaagatgcagttatgagagggttgcagatgctaatgaccagttcctcccaactaagctgtggtgagacccagagtcaggagctaccaggactgaatccagcctggctccagccagggtccccttctctgttgtcatactgattccattttgtcctctgatccccctctgtcttttccaggtttgtgctattctgattacattatcgactagtctgaagcagagctgatatctctttaccggggagtcagcttcaccagccacagctgctgaaagaatagcttggagatttcacccactgcatttctgttgctcaaactttttgacctttgtgctatttgagaaatctttgaaatgctgaaggtatgattctccttcagggggaacatgctttggaaaaacgcccacttaataaaatgtattttctttctgctgtggctgccagggtttttataaggcccatttgctttagctagg

SEQ ID NO: 6823 - DNA, 1306 bp, Homo sapiens
accagtccaggcacagtggctcacgcctgcaatcccagcattttgggaggccaaggcgggcagatcacaagaccaggagttcgagaccaggctggccaacatggtgaaaccccatctctactaaaaacacaaaaattagctgggcatggtggtgtgcgcctgtaatcccaggtaccggggaggctgaggcaggagaatggcttgaacccaggaggcagaggttgcagtgagcggagatcgtgccactgcattccagcctgggtgacagagcaagactccatctccaaaaaaaaaaaaaaaaaaaccaaaaagttggaaacaatacagatgttcattgatgtataatattaacttcacatttgatttaagaatgcagaaatcggacatagaacccttgtcagcactgctttattttagtgataattgaaccaattatatacgtgagcatttaactttttttattttcaaggctgaaaaaattaaagtcaacctcttactcaggctcatgcataccatggactgtatgtcttgaggaatccgctgctatttaacgaagtgattgtgagatctttgctcttctgtgaggtgaaaaactagaaaattgcaatgccatgcccatgtttgctgaagtgatcacccttagattctgtggggcttatctcttggtataatcagcatggccctcttaaatagagctgtcttaaaaacacagatctactggtaaggtttgttttaatttcggtctaacagccttaggattacccctcaagactatatcgtcaggcttttgtacaaacaaggagcttacacaaaactcccattatgatggtggtttgaggggaggaaaaagccttgtttgcttgattgagttatgattgtatagggaacaaataaaggctttctttccttaaacataacaattatgtcttactctcactaataatgccacattttcttttaaaaaaatatttacacagcctgacgttattcttaatgtcaatgcaatgtgttacctctaagttaaaatccagttttaatcctataagctagaaaaataagttcgattttacacaactgagtttggaaactgctgattctgttgctgtatttattaccagtgcttgttctctttccctcctgctctccctcctctctctttctttctctgtgtgtgtgtgtgtgtgtgtgtgtgtgtatgtatatgaatatattaatatatgtatatgctgatcttgtatctttgtgtatctatacacgtagcaatcttgttcttgccataagaaactatcttattttgttttctgaa

SEQ ID NO: 6824 - DNA, 1045 bp, Homo sapiens
tacttttgcgatagtcaatctgtgacttcttcagtgatggtaaatgtgcaatctgatcttttgaaagaataaacagttccttgttaattaatttatacagctgtcagtgcagctttctctgtcttcgcactctaagtgtttccctgccatagattttcttgccgtttctggcaaacctccagtgagagcctgggatttattaggctgacttggtgcagagtctattgattgtggccccgagggtaataactaaatagagctggagcaacaagtcaataacaccattgttgctgcagcctgcattcactcgaggagtaagattgttttacagcagccgagggtaatcgtgggcagatcagtgtgttcaacacgcgctgcaccgtgttagtgctgaggactatttgaaagctttcagcgggatcactggagaattggggtggggtactgggattatgaaccctgtgaactccttcattacagcttaaaggtttcaactttagtttttaacatctgctgcaaccttggggagctcaggagtaaggctggtgcaggggagtgcagaaacaggctctgggccttagcactaggcggtctgttctggtctgtgtcccggaaacaagatggttatgagcagagagattatctcacagctgctgtctgacatccatccgtctatccggcctcccatctgtgtgaggtgccagccagtggcaccatccctacctcctcatcccccaggatgcatttaatgtaaaccatctaaacagaagaagccacattattataattttctcacttccaaatcttgagttaggctgacttaatttttttttttttttttttgagacggagtcttgttctgtcgcccaggttggagtacgtggggtgatcttggctcactgcaacctctgcctcccagaatcaaggaattctcctgcctcagcctcccgagtagctgggactacaagtgcgcaccaccacgcctggctaatttttgtatttttagtatagacggggtttcaccatgttggccaggctggtcttg

SEQ ID NO: 6825 - DNA, 1062 bp, Homo sapiens
atttagtatttcttgtacagcaagtctactaaaaaaaattctcttattctttgtttatctagaaaagtctttatgtcaccttcacttttagtggatagtattgctagatatagaattcttggttgataagtcccccacctcaccctttttgacacttagaatatgtcattccactgtcttctcttccattgtttctgatgagaagtcagccattaatcatatttgttatttgcctgtgcatgatgagtcatttttgtcttgctattttcaagagtttagctgtcagccatcatttctaccaacatatttatctgctactctctctcctcttcttcttggattcccattacacatatgttggtatgcttgatattgtcacacaggtctctgaagccctccctgttcatttttcatcagtcttttttcctttttcttcttcagattggataatttctttagacagattttcgagttcataattcctcttcatttcatttactgtatattcaactgtagaatttccgtttggctcttttttataatttctctttctctgttgagatttcttctttgttgaggcattgtcatcataatttcttctaattctttaagcataattttcttcaattctttgaacatatttctaatagctgcttgggagtctgctaaatctaacatcagatccactcagagtcagtttctattgactgcttttttcccctgaatatatagatcacacctttttttctttcctttttttttttttggtggttgttatcatgtcatttttttgttgaaaataggacattttagataatatattgtagcaacacaagagtctagtatttttaagtagcttttctgaatgtagtctctagaatctgtctccgctgcagtctactcagttgttgcttttttcttttcctcaagtcttatctttattttatgaggctggtttcctaggggttgcccctttgtgtgcatagcttagtggtcagccaatgactgggcagagattgtattcaaaaacctccaacccataaggcttacatcctctgcagt

SEQ ID NO: 6826 - DNA, 1158 bp, Homo sapiens
aagaatgacagagtgaaaggtcgctgtctctttgcaagacacaggctgccttttgacttagtctgtatgaagatccctcctaattcatgggtgattttcctactcattgctgccaaatacaggacctgagagagtgatcaaaggccacactactccttggcaactagttttctttatcttcatcaaatccacaaatacggttcttggtgcccatcctcaagggtgctgggttctcatatgtttactgccattttaaagatggataaactgaggcactatttgttctccggaagatcacacagcaaattgtaagtagaggcaaccctacaaggctgcctttgctcctcatcctccaagagagacctctggctttcccattccaggcctcctgacctataacacgctgcatagaaaatgcacaccatcctcccctagagtcaccagctgggcttttccagccacgtgctgcagaccatgccaaggtcagggggctgcagatgtgtggtccagccctgatctctgcttatgcttctcgtgagagtccatgaggcgcgcacaggctggtttctggctcctgttgacccctccctggcctttgactccacggttaggaatcggttatgggctaagttggatgatctcagtgtagaccctagttattgatgctgccacagaggctgaacttcaggcttctgagagccgcaggggtcaagagggctgggcttttcctgcctccaagggaatctccaggagggtaaggcagggatgcgctcaccaccactccctcttccttttaatttcttccttagtaactagtcagaggtcgcagactgaaggcccacagggtgagtctaccccacagatgtgctttctttggccatccagtgttttggaaaactttgactttgttgccaatatttaaaacttgggagatttcacaaagagaacaccatttctggcttatcttggtaaatcagaaggtctcagtcccagcagcagtcagcagcagcccctcgctttagaaaaagggcagatgcccctgttctcccagtccctgcccctgatgcctacagcctgcagactggatctcccccaccctcacaggactttcttccttggttagagggaaggatatgtcttcccaggctggcaggtgat

SEQ ID NO: 6827 - DNA, 1075 bp, Homo sapiens
gctctctcagggaaccaaccctgccgacaccttgaccttggacttctggcctccagaactgggagacaataactttctgttgttgaagccgcccagtctgtgggactttgttatgccggccctagcacactaatatactgactatctggccctctgcagacagagcgtgctgattcctgttgagctaagtattaagaaaaatttagaaacagggcgaagcgactccagtcctcactcaggacctaatctagatatgccagggctcagggagtggatgtggctcctcagttccttgctggagaaagtgctcatctccctgcccatcaaaactcatccccactgtgtcccagtccctcaggtctctcggatgactgactacacctaaattgatgttagccagtgggggctactaatggctgatgatggcttggtagattggcccagagatagcatctagttttcttccctttttttttattattttatttttgagacggagtctcactctgtcacccagggtggagtgcagtggcaagatcttggctcactgcaacttccacctcccgggttcaagcgattctcctgcctcagactcccgaggagctgggactacaggcacacgccaccacacccggctaatttttgtatttttagtagagatgggattttaccatgttggccaggctggtctcaaactcctgacctcaagtgatctgcccacctccgcctcccaaagtgctgggattacaggcatgagccaccgtgcccagccttatttttttttatttttgagatagggtctcactctgtcacccaggctggaatgcagcagtgcaatcgtggctcattgcgatttcaccctcaggcttaagcaattctcctgcctcagcctccttagtagctgggaccacaagcacaggccaccacacctgcctaattttttttaatttttcacagagatgagggtctctctatgttgcccaggctggtctcaaactcctaagctcaagggatcctcccacctcagcctcccaaagttctgggatttcaggcatgagccaatgtacctggcctt

SEQ ID NO: 6828 - DNA, 1049 bp, Homo sapiens
ggcaacatcattccagtctctgcctccatcttcacgtgcccctctttgtcctctcttaaggacaccagtcatcggatttagggccaccctaaatctggaatgatttcctctcaagatccttaatgaagtccagctgtggtggctcacacctgtaatcccagcacttcggggaggccaaggcaggaggatcacctgaggtcaggagttcgaaactagcctggccaacatggtaaaaccccatctctactaaaaacacaaaattagctgggcgtggtggcacacgcctgtaatcacagctacttgggaggctgaggcaggagaatcacttgaacctgggaggcggagattgcagtgagccaagattgcaccattacactccagcctgggcaacaagagtgaaactccgtctcaaaaaaaataaaaaataaaaataaaaaagatctctaatgaatcacatccacaaagaccttctttccaggctgggcatggtggtggctcagcatggagctcatgactgtaatcccagcactttgggaggccgaggcaagaggatctcttgaggccaggagatcaagaccagcctgggaaacatagtgagaccctgtctttacaaaaaatttaaaaattagccaggtgcggtggtgcatgcctgtagtcccagctacttgggaggctgaggtgggacgatcacttgagtccaagcgttcaaggctgcagtgagctgtgattgcaccactgccctccagcctgggcaataggccaagactctgtctcttaaaaataaaaaataaaaaggaccctatttccaaataagatcacattctgaggttccaggtggaacctcatgaatttgcagggacactgttcaatccagtacaatcagtatgatttaaagtaagaggctgggtgcagtgcctcatgcctgtaatcccagcactttgggaggctgaggtgggcagatcacctgaggtcaggagttcaagaacagcctggcaaacatggtgaaacctcatctctactaaaaatacaaaaatcagctgggcgtggtg

SEQ ID NO: 6829 - DNA, 1011 bp, Homo sapiens
gagaatcgcttgaacctgggaagccgaagtagcagtgagccgagatcgcgccactgcactccagcctgggtgatagagctggagggaaaccctgataccacttctgggtccagatggctgtggctggaatgcggccacagccaggaacagcgtggtacggataccagtggggctctggtcttttcccagaggctggcacctttcatgccgagttgggcctcgggtctcggggctctaggccctgctgtgccagtggcctgatgtgtggccttatatgccagtcacaccctgctccagacctcggtttcctcatccacaaaatgggaaagctgggctagaaaatctctcaggaaggtaggtctctgctagctcccagccttccatggcagtgcaaagggaaccttcccaacaaagtaagagccaaaggctaagatggcagtctgtggtttgtagaaccttctagaagaccacgagacttggtaagctgagcttctaagtggtccaggatgcagggctggtgtcacaggtgtgtgaccagtagagctacacagggctttgtgcccagaagggccccacgcttgggaaataaggctctgcagtcactgtcttcaaattcttaataattttatctttgtcactgtgttttgtaagtgaagtccaatgggacagtggaatgtgaactgggagcatggagcctcccatctccctgcgtccaggatctgcttctcagctgcttgctcctctgcccccacagctccagctccagctccactcaccttctacctccctgcctcccacccagcaaccactgccaacctgcccccaacctgggcacaggcacaccctgtgggggagggggacaagcacaccccacagcatctcagagtggggcatggtggcagcagtccccatcctgcactggcagcccagggcacatttcatgtgggactctgcgggggtgagcctctagccccccccagatccagtacctcgtgtgtcctggtacaaaat

SEQ ID NO: 6830 - DNA, 1031 bp, Homo sapiens
gttggggcaggggcctgtgggaggatgcctggctcaacctcctgccctaggcctggagcacaacatgtgggcccagcagctcacaggaaagggagccagaagatgggttcaagtgtttgtgtgttccccaagtcaccagggtgcctgtgggggtctgcactcccccaggagaaccctcatgtctagggagcactccatggggtcatctccatgcctgagaggaccctctcttccttctttcaaccttccggagcccagcttgtctcttccggccaggtcaaggtatcctcctgagagaaccgtgaaatacagtgtgccgctttgataattccacatgcatgttcaatattcggatatttccagttaaaactggcattgcacaatataaaaaggaatggtaaaagtcatgctaataatttaaaattttgactttacttagaatggtattaactagcaaatttaaaacaccatgacaaattgaaagtgagactggggaagaaagcaaaaagcatgttttctgactgtttgaacaaggggccccacattttcgttttgtagtgggtcctgaaaattatgtagccagtcctgcctggtgagccacctaccctcttgggcatttagttgtctatcagtaaactagatcattaacactgcgcctgcccctcctgctcacgggcacgttaggaacatgcgcttggataaaatccaagccagagatttagaaaccagtgtgtggtgccagctctcagccttggaaccacaagcccatttttcttaaaaagggatctggactggcatccaaagagatttcagtcccctcatataggtttaaccaccatgggcaaggcagtctctctcccaggtattcctctcactaggtgctctgctctagaaatgaagtctaaaagcagccccatcaatacagaacagagttagaaccacccggagagatttaatctggaatcccagcaagttgtgaaatggaaagactagtcggccagagagctgaggtctcacagtgtgcaaagacc

SEQ ID NO: 6831 - DNA, 1034 bp, Homo sapiens
agatcccacaagccatgcgctgcaagtctaatgatccagaggctgaggtttcggccgctgtacactcagcagccccgcgctcttgccggccgacaccacagtgtgggaatcgagaatatcggcttcggcttggaatttaaggaggaggagagaaaaaggatagctcggctggtcttcaatgattttcttgtaaaacttttacaagggagacttaggctgtttgatgtgttctagacaatcaaatgcccgccgagtctgcggcagagagtggctggttttctccctagtggaggagggggtgtattttgatgtagggcaagttcaaaacccccaaagccttgcacgctggtaggtcggattacactcgcaagctgggggaaaatacaacacgtaaaatgtgaaaaagacctctgaccctgaaagtctcattctgcccaggccagggctgttagtgggctcttagttaggctggagagggcctgggtatcatttaccccatggaggcttctgccctgcctgcaccccgtcgggcccctatgcattcctgctctcacctgcacttcatccattttagccaaaggggccctgcccaccaagctgcccagcagcgcatccacatcagacttacttcttctctttctcagaagaatgaagggcggcactgacccaagttggctccggtggagttgtgaatatttcaaagctgaggcttagatcaaaagtcataacctctggctttcagactgtcctcttcccttacctgggtggcccctgcatccaatatggaaatgtttcccagagaatctcactcattataggtgagcggagcctgaaatgactcattcagcagaaatgtggcctctctcagcagtggccacgggagcccatttgaaatgcaagaggctcctctgtgggcctgccaagctctgtaactcagctccctcccagccctggccctgcagtaattctgctagacctggtgcctccccttgcagggtaggcagtggggctttggcaggtgatgggtccatgga

SEQ ID NO: 6832 - DNA, 1033 bp, Homo sapiens
gcaaagccagaatgcaaagtttggtctatcttaaaaacccatgctctagactgggcacagtggctcacacctataatcccagcactttgtcaggccaaggtgggcggatcacaaggtcaggagtttgagaccagcctgaccaacatggtgaaaccccgtctctaccacaaatacaaaaattagccgggcgtggtggcatgtgcttgtagtcccagctacttgggaggctgaggcaggagaatcacttgaacccaggaggcggaggttgtaatgagccgagatcgcgccactgcactccagcctgggtgacagagtgagactctgtctcaaaacaaacaaacaaacccgtggtcttaacaactatgttattaggcaacactgaggaaaagctgtgagtttactgagtgagtagtactatggtgttatcccaacttagccaattgaagaaccgaggcagtcagtggttaagacaacctgcccacgttgttgcaggcacccgggacctgctgggaaggtcttggatggtagatctctgcagagagtgtgaactgccaagggctgctgggtctagaagagagggcctggaaggtgttggagtctcggatgaacagctctctagtaagggcagacaagatgatggtagaaagactttaggctctgaagggtgcctccgtcctctttgtaggtttgcccttaaacccagtgtgactcggtgcaaacctccatttcaggtctgttttcctttcttccttcccttttgctcatcctcgtgcagagcccagggtatttttggtgttttgttttttcactttccctcctgcactgtgtgactgcggcagaatgttccgggaacatctagttagagatcacttcgtgtgctccaaggcctggggacatgctgtcctcctggccaggcggccgccaggaactgttaatatggcagcagcactggcctcccggggctaaggaggcactgaatgggcctggctcagtccctcaggactaccctggaggctctgtaggcagaccagac

SEQ ID NO: 6833 - DNA, 1044 bp, Homo sapiens
ctagtgggacttaacatttcatgaaatgattcactactaataaacaaaaaagggaggagggaggcctcatgggttaatagtttctttcattgtagatgaccaggaactttgaccagccccttcacttccccaagctctctgaaagtggagggttgatctttccttttgaccacttttgtcgcatcccgtctaagggtggctgatttcactgctgaattaaccaccaagcacccccccaccccctcccccagccaccactttctcaaatactacccttccttttccccctcccttaagacttatttctaatatttctaaagtgcactgttttgggcctctccccatccccgccccccaagtgggctttccttccgccttcctcggctcggattcctgacttggtcgccacccccttctcctcctctcccaccccgcattgtctttctgaaaccgccccctcccggagcaagtccctgcaccctcgcccagaatcccgggctcgcacacactccgcgcaggccgctccccctgcacactcctccctccgtctccccccggcttccccgcccctctcttcctccttctttccctcctccctctcccggcgcccgaaaggatcattgttagccgcccccgccccgcccaccccggctgtttatttatgcacacgtcactgggccggccccgccctccggcatctcattaaggcagtgtgttcctctcgccctgtcaataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccc

SEQ ID NO: 6834 - DNA, 1028 bp, Homo sapiens
atggccgagggcttgccggacgggagtcgatcagatctacaagtgtttttaagcattaaaatattaactatcaggtttgacttgcttttttgggccctggcaaaatggcaagggcatgctagaccggtcattttttttatggctagggaagagaaataattattccccccctgcccggcgcccagacatgcttgggaagctgggagagcggttcggctcaacccccttctccagggccagttccaccaggctgcaggggccgcgctctgggcttgcagctgtaggggaagcacagttcgcttactttgtatttttcttgggagcttgtggggcatcttaaacgggaccgttcggctcagaatcgcagtgttcgcctaccaataaaccggaccaagcaacattccaaagaatccctgagaatttctgcctctcctcccctcccccttccgatggaaacctccctggtattattttaaaatccacttaaccatctgaatattgagctttgatggcgggcttgctagctttcttgactctttttaaactcgctgtctgatactggcaatcttgccatcccttctcaaacttgagcagttgtgttgtcttgtaattagcaaacagggaaattgctaaaggcaaataaatgatttcccggtgagaaaaggaaggctcccaatgatcggtcccttttgtgggcattataggaatagacggcgtctagttattttaattgtggacatagcgggtggcctggtgctgtgacatcagattgagtctcagaacacatttctgaactcagtaggcagttttagtacttacatgtcaaacaccagcagacatctttgtgtacactgccccttcgtccttcctccctgttacctgggttagattatgtgctccaaaattaaagttatttatttaggctggtcagcagagcagtggaaatgaggatggtaggctgttgtgtgtcattcctgacgtcttcaatcagaaggccagcttgcaatccagatttgatacagctgcgg

SEQ ID NO: 6835 - DNA, 1028 bp, Homo sapiens
aattagagagtatcattaaatcggcttatgatgaataatacattatctcaagaataatgctttaattgctgaagacaccataaagcttgatagtaataattttattttaaaatgacaaagatttctgcataatattaatttagtctttgattcagtaataggaatggcttttaaaaagacagattcagatacaaaactgcattaaggagaggtctagttaagtagatgggaagtgttagaactgcaaatattagaactgtggtaacatttgtatattaaagataagaatactgtaacctattaaagttgattggaaaaagtagttttacatttctttttccctcctggcaaagtggaaataggaatatggtggttgaaattccagttaggtttgaaatttctttttaaggacttgattattcgagcccttgcatcttctcttatccaaagttatttgcttttcaaccgagctctttgctactaggttgaacagataaataagctgcatcttgaattcatttttgaacttggaatccagcatttaaaggaaaccgagaggggcctattcattgggattttatttagccgggcaacttctctttctggcttgtgaaaaatggacgttttttcctcactgaaacaacataatcctttctaatacaaaagatttagaccttggagtgtgaagggttaatggtggtccttcccagttgtcctcccacccccccacctcacccctgattgttttgacaacacttttcaaagtgtgacattccaagcccctacataacaatgtaatattactgtaattacacaggtcattacattttaaatagagaacaataaaatgcttatcgccctgaaaaagaacaggtgttcttacccttctttggtatttatgctaattgtttttcatctccttcagaaatatttatggcgaacatgtttagatttcaatctcaatgcaaccgtattaattccatgctaatctttataggttggggtttaatgtctgcagtatggattat

SEQ ID NO: 6836 - DNA, 2072 bp, Homo sapiens
cttttcccttttcttttctccctttttcctttctttctcttttcttaattccccccaacacccccaccttttttttttttttttttttttttttgagattacattgcctatattgtgcattttccccaggaatacttaaagaaacctggtatgggagacggctctttaatttatatgatgttcccctgagtggaagggaaaatgtacacattacatagtacactagttaaactagttaacgtgagagtttttaaaaaagtgagatgaggtgaagagagttgactaaaagaatataataggtgaggggaaaaaaaatccaggtttacactggggatgggagggctgcttatttgtgaaaaatgtactggtatctgcgggaggaggcacagaaaagtagccagaggagacagaataaatgcctaagaaagataagaaaagtataatacaagagaacaaagatttgggtttgggggaattgaaattggagattggaagtttccttatggaggggcgtgggagtaccctgggctgggctattaaaaagggatattgctttgctcagcaaagatgggctgcgatcccttcattacccagggtgttctacctagccacagatgtgtttcctatcagttactgtgtaagcatctgagggtgaggcattatctgtggtggagactggagtgtgagagagaaggccagttgtcctgctgattttaatttatgttgaaaaagtgggctgttctggtgtattacaaactgactacgcggtataaggaggaagtgagattcaaaggtgtttgccaggccaggagagatgatggctctcatttctgactggatccttccttccatccaacccaaacttaaagacccaggccgaaaggttttcttttctaatcaatggcatgcagaaacttactagccctcagggatagatatgaatccctaaacagctcattacaaagaaggggctgtgggatctttgaacgggttatcagccgaggtgttctttgcttttcccaagataggttttttctccttaggcacatctgatttcgggctagtaattcgacctgttatattttattctttttgtcatgcagtagccccaaccaggtcggtctacggaggaaggaatggccaggagtggcatcagccctgaaggagttaaaattgctccctaaagtttggcatcatgaaaataaatttgaggcctggtaggcattagcagggcacagcacatttacagagcttaattagtacgcactgtaattgttcatggtctgccagaagaagtaatgttcaggaaaagtggagtccctctcttgcagtcttcagcttgaaaccgataaatcacttgcatatttgtgtagtgattcaaatggagctaagacctctcccatcccaacatgtggtaaattgtaaagtcaatgaattgcagatgtaggctacagtgagattctctaagaaaatgcagaatgaatgggaaagagtgacgctataaatatttactgagaagataactagattccttcgtgctgggccaattatgatgtactaaaatatattagtaaaatgcttaaaaaattgagaggatttgtgtgggtctttgggtgggttggtttgttttggaaagtgaaataaaaggcactatgttgttgtcgtgtcagttttattaagcctgaatcacaatggcatacccagggaaggacacatgaaacccacattaatgcaaattaattcgttatgagttgcagcactgcgactgctaagtggagtaatgatggggcatcattttaagagttttagtgtagcaacttttaatgaaaaatgctgtgttaggaacatgtctcagcacttcagcccacgtgtttttctatatgctagaaatatgttttgtacaagagcaggaaacttgattcactttattttttcccccagacagtttaagagctttaattatgttttgacgttgaaagaaaatcatctagtttttctcaaaaatcaacccagaaatgcccatcaccataaagaagttcaagctcaactttttttttttgcgagactttgca

SEQ ID NO: 6837 - DNA, 1063 bp, Homo sapiens
acttagacacagaataagctgcttgtgctgggtgtgtttgtgagctgggtgaggttttctgtgtcgctgggcacgtgagggaagttacgtggctggggggtggggtggggggcattagaagggagtatgggtgtctgtgggcgctcgcgtgtgcgtgtatgtgtgtgtgtgtgtgtgagagagagagagagaaggtaaaattaactttgtcctatatgttggtttctctgctagagtcttaaggaacttgcagctgcatttttattgtttcaattacagcattctctctaggattgttggtgttatttgggtgatgatgaaggcaaggattaagaacagaactggacaagtgaaaattgaatttggattaaccacagtttgattaatttattcataagattgtgactatatgaatttttttcaacaacatatccttagttatcaggtgtccactcaattttaattgacaatataagattcctatggtaaccctgtgtacagattgcctaggggctctgcagggattgtgggaagagaagcttggacaagtttccattaagatctgaatcaggcgattggaaaagaagagaataaaaccaactgaaaagagagggacaagttgttagtgttgcctactctgctttgaaggagaaccctcctcagacaagagctactttctggccaagaattccaggctcgcagagaaacctgtcccaggcacagaagttgttttaacatgatgcagaattgtcacagtaattagtgcaatctccgtttactgactggcagtttttacacaaaggagatagggacaaagggtgcaaagtcatctttgtttttcagcaggtcactttacttatttatttttattttttatttttgagatggagtctcactcttaccgcctaggctggagtgcagcgataaggtcttggctcactgcaacttctgcctcctgggtccaagcaattttcctgcctcagcctcctgagtagctgggactataggcgcccgccaccacgcctggctaatttttgtattcttggtagagacggggtttcac

SEQ ID NO: 6838 - DNA, 1054 bp, Homo sapiens
ttgttatgatcatcttatccatagcaacaaatgaaagtacacaggtcttgattgaatgccaaggctgcagttcaatctaggaaggtttgtctgctattcataaactgcttaagatgttttcttgtagtttgtgacataagcagaacgctttgatttggtttctttctacagctccattttcagtccggcagcacacattactctgcgtacaaaacgattgaacaccagattgcagttcaggtaggaaacgcaagagattctgaagcttgaattgtctatatgtaggtctcttgtgtgttttattctccgccccttcccccaactgagataatgatgatgatgatgatgatgatgatggtggtggtggtggtggtgatggtggtggtggtggtgatggtggtggtggtgatggtggtggtggtggtggtgggggggggttgaatcactgggggagaaggggagcaaaggagagagaagcaggagaaatgctgctgaaatgatttagagatatggaaagaaagagaaggctgtgcttattgttaagagtttcttgaccgggcataatgggcacacagaccccagcttgactactgtttttctttgcttagggagggatcttgaattgggagtaaaacggggtggcacaatgtgaatgggaaggcttaaggggagaggtgggagaggaggccgtgcaacagccagagggttgtttctggtggatcaaaatcatgttaagtggtgctaagaatatctctttggacctgatcatcctgaaatgttgatttctcttggacctgtctatgtatgacactaaatgtgctggaagggaaaggcgacagatcccagcttctgatgagtgtcctgtttcctgctcacgtagtacttccattctcttaaatccgaaggctaaacaaatcatggactaatatagactcggagctgaactgatgccagcagaatgcagtagaggagggagagcagactaatacgattttcgtctgtctgcctggccttgctgggatggatgtacctcatggtgtaactaatggtacca

SEQ ID NO: 6839 - DNA, 1074 bp, Homo sapiens
atctcgggtagtgctggaaaatcttattgcctggggtgtgggaattgttgaggttgaataggatagtgatccttatcttggtgtggaaaggctggctggggccatgtcactgggagactagcccagaccagaccagctgttgtatctttacacccgttgctgaagtgccccttgttaggccgagcagttcgtctttctccaaaccacctggcacggtgcaggccatgtgaagctctttctcaggaggaagatggagtaaattacagagctcattgttttggaggactgaaaccattactattcctccatgaacaggtagtattgttctctgcttctatttgctaaggcttgatgcccatgtgggcaaacagagagacattttattagagacccagcaccatgcttttgcagtgttcattctccctcagtctctgctagacccgcacaaggccaagctaaatggcatctagctgtaattttagtttgatcctcaaaggataaatggaaaaagcaaaaccaaagaagcaaagggaaaagaaggggaaagcttagacgaaatgaaattgttcccaaagtacattggggagctcataatcttttcgctctggatgtggcatagagcagatatgttcctttcgctccattctccaacttaagactaaatgcagcgtgattgtcggggcagaattattgtccctggaaacttaaaactgttcaaccttaataaatactagatttcaatagaagctgagcttgttgctctcctaagctacatcctaaaataacccagagtactatgaccctgtgcatcacattagactcatacgactcatactcttttcccttcccatccctcctgtaatctcaggactcagccaagctcactgtttatatgaatggccttgggtgattctatagacacgtcactttcttataaaaggtttggacacaatagcagttgctatgtttagatctttcctacttttgacagcctcctagctccccttggttttgaaaagacaagagcaactcagatggccacgttctcccaaaatggataacacaaatgaaact

SEQ ID NO: 6840 - DNA, 1545 bp, Homo sapiens
gcacccacttacccaagaactgattagttcctaaaagaagcagtgagttgattgcttacagagatgatgtaagctttgctctggggtacatcaacttggatttctcatgctttatcttataaagcctaaattaacagctggtttggtttgagttctctgggatctgactaagggattagagtccattctcaagtgagtcaatctagtttaatttatttcaggtctatcaaaaaagatcaatcaaagctcttttgaaagtaaagctataatcggtctgcacacttataagtcactgttgttgcacttggtgtttctctctggtggaaaaatgctcaggctgtggttaagaggatgtattagagcattttctgtgtacctccctttcttgcagcctccacacctccctgggaagattttgaggaagtgtcatgtttgagaaccccacttaagtgggagctgcactcacctccgtctcctttttctctgggcatactggatccctgttttggaagtttctagttcagtataattttaatacctggacctgaacaagtccagcctgttttatgtcactgtttttgctcctgggctttttcttgcagatattggtgggtgaagacatgcattgaattctttccagaatgtctgctgtgaagaattactcatgtcatttgcaaggcttaagctgaagcattcgctgctatggtcgatctaggcttttgtgggcactggaaacgacaacccgagttgttcatttcttttgtttctattttaaaaatacttaccgagcatcttctggtagctaagaactattcgagatacacttgatgtgccaagagaaacatcaagataaaggaggtagttaagagcttgactgtagagttagacctgtctttgaatcctagctttgctactttgtgactttatatgacctgcagcaaataaatctcagtttccttgtctgtaaaataggcatagtaaaactgtctccctccaaggattgttgtgataatgaaatgaaatgatactgtatcttttgctttttaaataagccacttctggggagcttccaggaagcagaagttttttttttttttttttcccccaaatgcattcaaaataaacaaatctccttttactaccataacggtgtatgtgaatgtcctggcggatgctctcaagagcgtcaacaatgtgggaaagagaagcaaacaccaggttcttctcaggtggagctccagagtcgtccagtttctaagtgtgatgatgaagcatgggtgcattgacgaatttgaaattaccgatcatcacgaagcagggaagattgtgatgaacctcacaggcaggttatcaagtgtgaagtggtcagctggagatttgatgtgcagctcaaagatctaaaaagatggcagaatcatctgctcctgtcccagcagctggcctgcattgtgctgacctcagctggcatcatggaccacaaagagatgagatgaaaacacacaggaggaaaaagcctgggattctttttctaggggtgtaatacac

SEQ ID NO: 6841 - DNA, 1061 bp, Homo sapiens
gacgatgaatcccctctacaagagagggacagggcaaaaacgacacctcttgcctcgcaagctgtcttgggccaaacctcaggtctattctttcttttttttgaaagtagtggctgggcacggtggcttacgcctgtaatcctagcactttgggaggccaaggcgggcggatcttgaggtcaggagttcgagaccagcttggccaacatggtaaaactccatctctactaaaaatacaaaaattagctgggcgtggtggcgcatgcctgtagacccagctactcaggaggctgaggcaggagaatcacttgaacctgagaggcagaggttgcagttagctgagaccatgccattgcactccagcctgggcggcagagcgagactctgtctcaaaaaaaaaaaaaaagaaagtagcagctctactgagatatttagaaaccataaaatccacctatttgaggtgtacaattgagtgattttctgtatagtcacagatctgtgcagtcatccacaccctctaactccaggacattttcctcacccccgaggagaaacctcccttacccattagcagtcactcctcatttcctctccccccagcccctggcaatcactgtggatttgcctgttcttgacatttcatataaatggtatcataaaatctatgggcttttgtgtctgtctgctttcacttagcatacggttctcaaggttcatccagtattgtagcatctatcagtatgtcattcctttttatggccaaataatattttattgtatggatagacattttgtttattcatttatctgtttttggttattatgagtaacactactatgaacattttgcacaaatttttgtattgacatgttttcatttctcctgggtatagtcctatgagtggaattgctgggtcatataataaataactgtttaacattttggggagctgccaaacttttaaaaccttgggttctgtgatgtaccagttgtgttaggcagcacagcaaaatgtgacttttgattgccagaaacaatatttaaaaagtggttataaaaa

SEQ ID NO: 6842 - DNA, 2007 bp, Homo sapiens
accaactcacccttgatcatactcgttgtttacacgaagggaatttttattgtcttgtgagtgttgagtgatgattaaacagaagagatgtgactccaagcctggcttcactaagatagtcttgtttgtttcttttcctccaaagtaatttcctaaagaattaaaagcccctttgaaacccagcactaccttgtctctgattatcagcataggcaggaagggcttttaaggtctgagcccagctgtttagaggctacgagacgtgaggcaaatcctggtatctctctttgggcctcagtttcttcatctgtgaaatggcacagtactaccctccaccaaggatgatgatgagaattaaatgggatgacaggtttcatccccagctcctgttcttaggaaggaaaaactgtgacttatgaagcctgtaggttgtgttcaggtttgtatgaggcctcggacttcatacaaaggtatcaaagtggcaaaccctgatccagatgttttcagttcagtcagctggtccttgagcctgttgtgtgccagatatcctgaccaaagaagctagatgggagctgctgtgttgttccttggggctgctggatgcaagttgtttaggtcggcggttttcaaatgctggtgattttgctcaccagaggacatttggcaatgtctagagacatttagcatggccagtcattgggaggtactcctggcatctcgtgggcagaggctaaggatgctattgaacatcctgcaatgcccaggacagccccctgtgacaggagtcatccagcccaacatgtcactagtgctgcagtggagaagccctggctgtgtgtgggggtgtgtgtgtgtcctcttctacatttgataaggtaactcacacttgctgcccccatgatcgctgtgggggatgcttatctatgccccagtcctggtgttggttgatgggaacatcaagattcaggcaagatggaaaatagcccttagaactagcaggaaaagaatctcctttcatttgtctagaggttctgttaaagtgcctttgcttctattttgagacttgttcttaaaaaaaatgcggatatgaaagaaaataaaaaccacattatccctccactttttcttggaggaggatgtgttgaagaagtcaaagttcaccatccctttagatagaatcattttgaacaatttcatatgtcaatacattttgctcatctctaaatttcattttagagcctgtggtgttctgtgcatggatatgtgtgcgtgtatgcacacaaaaataaaaggaaatatttattcttatgaataagtatagaaataaattaatttttggaatctcaaactatcagagacttatgtaataaccagaggcaggcctgattatgtatgggcaaagcatttgtgaacaatgtctccattgtataacatacaaaacaagcttttcttccacattggatatgcaagtcggccttctccaataagggcctgtctctttccaactccccccacctcccacctttgagcaaacattatttattgtggctgatgtgtgatcaggtcttgatttggggcctctttttgatgccttctctttgtgggatctcacccacgtgcccctggagaccctttggctgccagggcctttgtttcccagccacccatgtggtgccagtagtgtctgctttgtagcgagctgtccccagagcctcagcatggcttggggatggtctctgaggttgggcttggatccctcccacttttgggctcagaaagaatgactgccctctatttccctgtccctgccctctcttatcctgtttcccagcccgcatcatgttatctttgcttcttgtaacttaccaaacgatttatgggcaagtaggggaggtgaagagggaactcatctatcaagataacctactttgtgccaaccactgagcatagcaattgtcccttctccagccctctgaggaccgtggatgggattctcatgaaatgaaa

SEQ ID NO: 6843 - DNA, 1032 bp, Homo sapiens
cagggtagctgtggaggggtgccccatcttgctggtcttaaattttctcactgtaggcagggagcatgacctggctgaattctaagtccttttctactctgaggttcattgtgggtgtgacctgctgggctcagctctggctttgggagacaccctctccccttgatctcgacaaccccttagcagagcccagtggctcctacagtgccctgagctgcttgcccgaaggatgcggttgtggttatctcaccccctgccaccctgtttgcgcaagggtttgagattgtgtggcccctccttgtacttcggggtgaggcttgctccagaaaggtggtctgcaaaggggttggctgggggggaggaggaagtcattctccaagtgtttgtcctcatcgttatcccaaattgcttgcctggaataaggaaggaaagaaaaaaaaatactcttgagtggtttgggccaggattttagctgatggatctggtagttccctctgtcagatttgttttctttgaactgtctgggccggtcacagtgtcattgtttaaatgtggaatgtaggtgttctgtgttctgggaaataaaaaccaaaactggtccaggggatccacagaggtaagaaaagaacattccaataggaatgtttcagaaccaggaggggaggagagaaaaacggctctgttggtctcctagaggaagaacttgttagatttggggagagtcaggataaatttgaccctaagagtctctgattccttttagagacttttcttataagaaataaaatggaacttgggagaggcggcaacttgggaaacagcacattctgccgtaatgaaagtcgtcccataagaatttctctatccctttagccaaatttctgtttctaaaaggggaaaaggggctagagataggcttgtttgttttcttagttgaatcttactttttgtatttccagcccattctgcagggtaagaacaagcacagcccgagggctcactcagtgtgatgttctagagcctggctctgcc

SEQ ID NO: 6844 - DNA, 1050 bp, Homo sapiens
gctgccagaattccccttggattctttagtgtggcttctcaagcatcccttatcgctataacgccttcatggtttttggcataactgtatactacctgtgctattatttatttgatgcattcaaacatttgattcatttatttaaactcagtctcactgtaatccttaattaacacctgtgaaattataggtttgatgtgctacttatttatttattttttaatacacattagtataatcccgtaacggctaaagtaacactttgtactgcctaaaaccatgcttgggagcgccacagtttgagaaagtgcttagccttcctttccctcctttagtgacttgtggtttggggcatctgttgactcctagggctcccttgttcatctttctgttcctaagctcagggattagttgctcaacccaggtgtggcctcaaaattctgctcatggaatagcctcaggcttctataaatctcatcttttttgttttgttttgtttttgtttttgagactgagtcttgctctgttgcccaggctggagcacagtggcgcaatccactgtaaccattgcgttctgggttcaagcgatcctcccatctcagactcccaagtagctgggactgtaggctggtaccaccaggcccgactaatttttaaattttttgaagagatggggtctcactatattgcccatgccggaagtctagttttatagtgatgagaattcatctggggtccaaggggccctcctgtgttgcttcctgtgctcccctctaaataaagatactccttccaagttgtcctgattttcaggtcatcaccattttttgagctggatggggaagttggcctggagcagccttccctgtctccgagttgcattacctcctgagaggtctcagcaaatcactgccatctcttgatcagagttgctggcaagagtcctctgtggttctaggttttcagccctggagactctcgcctgcattcattatacatgtccttttggtgccttgttgaaaggcatctcctgccaccgaagggtgtggg

SEQ ID NO: 6845 - DNA, 1031 bp, Homo sapiens
gtagaaaaatcttaagatgcattctgccattttgggctaactgcctccttattttggagcttgctgtaattgagcatgtgttatttaatgagttatacctctgtcatatgtgtgtgtttatatcacaaaataacttatttttataaaaccatattttgagtcatcatttgtgacaatgtcttcttttctctggtataaatgaggcatgtagaaagaagattgacatttgctagaagcttcccctttcctctaactccacaataaaatggatgctcataattacatctgctcctataaggtcaagatttcagggctggaagtgaccttagatcatttaggcccaacttgccctcaggaaaggaaactgaggcccagagatgccttaagtgaattgcccaatgtcacacgctgagtcagtggccagagcaaggcttggatccagttctctgctccctttccagagccttgtgatgtcttctctcctacaggaggtgaaaataactgctgtggctggttctgttttgctgactgtaaattgggtcatggtcagggacagtgcataggtgtaaagaagttgctggttgggggttctaatgcaggtttctccaaaagtgaatgccctgttaaaaaaaaattcttaacaaatatacagagattttttttttaaaaaagtgtgacagttctagacacctagagagtaaagtgaagaagcctgttttcaggtttcccgcctccctgaatttcccagcatggtccaggctttgaaatttatttatctgcttttggcaatggttgatgggaatttcccacatttattttttagctacagagaaaggacattatctttaaaatctcttcgttgttctctctctttgagtgaggagagaagatgtgaatcctggcagtggttcagagtggacacagcccctgtgtttgtggcataggctctgtgggccccatgccagggagcagtacccccgtgtaaaggagtgggggtttgtccatttggatagagcaaagatcctccacct

SEQ ID NO: 6846 - DNA, 1072 bp, Homo sapiens
gaataagtgagtgggtagagaggacatttgtcaaggagcgggagggcgggccattggcttgggggaaatgggctgagactctaggggtggccagcaccgcatacggaggccagcagggttgggcttggctaagtgctgtggtgtctggatgcctatgtgagtttcctccagaagttttcagttggcaaagtagaacctgctggatatgtagcaagggtgtggattgtcgggatcctgctgggcgcaggcgtgtgataccagaggtcagaacagaagctgagggatgaggctttgggagctttttgtcatgcactgtcctggagcctcagttactacaaagtctgcaaatgatagaccggagctttggttctgcctgatgctagctcccctgttcctgatttttcttttcaatattagacttaatcccagaattcacatgttgaaagaaaacttagaggtctagtgacataaaagcctcattttgatcgttacagaactgatgccttgagaaatggagagagaagtacacgatcatggtaatactggatgttcactgagcactcactagctccaggccttttctaagtaatttatgaagttgtcaggtttaatcctcacaacgcccttatgaatgagctattgttattatcccgatttggcagatgaggaaactgaggcttgaggggaggatgacgtactcaaggtcacacagctgggaggcggcaagctggaagttgaacccaaggagtctcacatcggagccaggactctcacccttcagtgttatgctgccttaatcaggcacacatacaggcggggagaggcaggtttccggacaccagactaggctggtgccggtcaggctacaccagggaacctggaggcctgtcattcttttgtgatgctgttagttcctgttgaggaagtgaggctttgtgggttcccaggaggaaaaggtatgaactcatggcaaaagaaaggaaccaaaaaagggagatttgcatcacaatgagccttctattcatcctaaattatacctccttttataccatgtgtgtctgcaaacttgtgg

SEQ ID NO: 6847 - DNA, 1025 bp, Homo sapiens
aaacccctgtgttctttgcctacccctgctgttgccacatcatcttggagagctggctgcttccctcctcaactagaagttcctagtgcctgcttagttcttgtctcttgcttcccaagtgctcacaaaatacatccatgttcgctacgaggaaatggaccacataaggtttccgtgaaaaccttagcccttaggtctaacacagtaggaacagaagttaatgttttcctgacgtagaagtttctcttgctgcttctggtcacatttctttcttgtgtggttcttctatggctactgcacttttttttttttcttactgtctcccccttcccccacacaccaccttttggggatagggtggcaggtgagaatataaacagataatggttaagagatagtttagtctttctaggccagattatttagtttttgccatctaggtaaaattcggtccaattaagcgtccattaagtgttttaatataagctggagaaggagttgaacctggaggtcagggctctgtggtctattacagtccccctggggtctctagcccaagggagactccagggtcttaataaatgactgggggtttcattttgaggcctttactaccaaagactgaataatacattgggcatgatggttttgtcctaaacattaacagccacaaaaggtagagagtgtgtctgtttatagatacacatgtatcatgaataattagttggggactgtgcatcaggtctctcattttacattcgaggaagcaatgcacggaatgaattctggacctgcgaactctgaatttcaattctctgtctcctacttttactggagtgcttgcaaacagtacagtgtttttgttgtgaagttataccgtgcctgtaatctctctgcgggtggccctcctaagccctacttcaagaaatagctctaagctcatgacacccgccccacccgatgcctacatatgtcttatatccttggagtagtgtttggggttgcaaatttgactttagggagac

SEQ ID NO: 6848 - DNA, 1065 bp, Homo sapiens
aaaggagggcccagggctggccgtctcttggaggggcccgggatggggtacgcccccttggaaggggatggtggttgcggtgggcgctgtaaatgttgtgtccagctcagagggtgcaacagtgtctgtaactcatattctttttttttttttttagacagagtctcgctcctacacccaggctggagtgccgtggtgcaatctcagctcactgcaacctaacctcctgggttcaagcaattctcctgcctcagcctcctgagtagctgagattacaggtgctcaaccaccacgcctggctaatttttgtatttttagtagagacagggtttcaccatgttggccaggctggtctcgaactcctgacctcaagtgatccgcccacctctacctctcaaagtgctgggattacaggcgtgagctgccgtgcccagccagtatctataactgaaggctgtttatttctgcttgcctaacccgtccaggaggatgtgctggggccatctgaacaaccattgacattcagacattatttagaaatggaattgggaagtgtttaaaaggcatagactagtctggccttctgcccattcagagactgtgtatgtagtcagtgtacagtgtattcattgagggcccctcgctggatgtttcagccactccctcacaggttctcgtgtctgcttggtacagttgagatctgcaagagctgattcatcggcctgattgagattcctttgtaaaaccagatattcaagaatactagtggcaagaatgctttggtgagcgtaagatagcggctcccactggatcacatggctggtcggtgtcagggagatcactgtgggaggtagcaggagtcagtctttaaaaaaattattgggccgggcatggtggctcacacctgtaatctcagcactttgggaggccaaggcgggtggatcatgaggtcaggagatcaagaccagcctggccaacatggtgaaaccccgtctctattaaaaatacaaaaatcagctgagtgtggtggcaagtgcctgtaatcccagctactcgggaggctga

SEQ ID NO: 6849 - DNA, 1913 bp, Homo sapiens
attaacgagtggtataaggttcttagccctttgtctggtatctgctgggtgttcagtattcatttcctcgctttccctgcatattttgagctaataaatgtttggggacaccactttcctgtagaatctcatgtaatcccaaacagatcctagctgcttgctatggcccatctgcgggacccgcgtcaaggctttcccataaaggagagccctgcgggaatcatcatgtgccaggcactgtgctaggctctttaggtgcatcttgaaacttaatcctcgtgacattttggagtagatactatcatccccacagaaggtactgaagtctcaagcacattaatagcttacctaaatattgctaagggtcttccagatgatctttaggaaattttcagccaggggagagtgaaagctctatttgctatagttaaagcaaggaaccctccttcttaaaaaattatacagttattgagatataattcacataccttacaattcatccatttaaagcatgcaattcagtggttgtagtagattcaggagttgtgcgagcatcgtcacagtcaattttagaacattttcatcaccttccacaaaacccccgtgtctcctagtagccactccccattttccctaagtcccacagtcctaggcaacaactaatatattttctgcatctatggatttgcctattctggacatttcatatagatgaaatcataggcccgtggtcttttgtaactgacttctttcacttagcaaatggaagggtttttgatggaatcttagctcagatgtcgccctaggcttggccttctggaactcactgttctcttgcttccttccaccctgcctccctacccgctttgctacaagaagacagaatgtagaaacccccagttgactttttgagtagaaatgagccatgttctatttagtggtagaatgtttgctgggttagcccaggacttcagatggagtgcttcctcctttttaataccttgtgactgctgtgttggcaagcagagggttaaatgctgcaggaggacatgggagagtttttgctttgagggtccactggagcaagagaagcttgagagtctgtctctgagatcccagaacagacatgaagatatggtaccgattcccttggtgctaaaaggaactccaggggaatttcaggaaacccctccttttctcgtctttattctcaccccgtccccccgccacctctctccccaagttcacactcaggagggaggaatcttttaccttttccgttctgggcagcagctgtagggaatgttatcagtgttgggactgggcacgggaccaagccttcctggtgcctggactgcaaccaagctgagagctgacatggcagggcgagttgtgtgtgagttggctgcccctaggctcataggcctagcacaatagagaccctgtcaatggagggacactatcaggcaggtcactatcaatgtgacagacactatcaggcaggtcacattggtgcagatccttggaggactcccccccaccccccatgagtggattcctccaggtcaggggctggctgggactgtggatgctggagtaagtggaattgtgggtgcactctgcttcagcagtactctccaaggagaatgattgttttaataaattactgttttaataagggaggtggaagagctttttaatcacttgctttttaaaaatttttaattttattttaattaattaattagtttatttattttttgagacggagtcttgctctgtcgcccaggctggagtgcagtggcacgatctcggctcactgcacctctgcctcctggattcacaccattctcctgcctcagcctccagagtagctgggactacaggcacccgccaccacgcccgactaattt

SEQ ID NO: 6850 - DNA, 1044 bp, Homo sapiens
gtacagagaggttgtgtgtgtgtttaacatttccataatgtacaatttcctctaagagtaaaggccatgaggaaatgcccgtggaagataaaggagaccatgtggtctgtggcaaccatggatacatttctttcccaacgcattctctgaggcactttggtaactctgcctctttgctctcagcattgtgttagaaaataaagccagcagacaaggattaaaccctcatgttgctgggttccttctagaaacaattggagggctaaccaagtcacctttggtggaaggcagtaaggtgagtcattgctgtggctggactgaataggatagccttagctgtaaaattgggctgatctttcaaatggactcatgcttgccgaatgactcacgctcctgtttacaaatcagctctgtgaagaaatgcagagtgggaggctctgcttgccagacggagaccttagacctccaggggtggagaacggagtacttcctctggtgctcggcttcccttcctgggggcagatctctcagcttctggttggtggctctcaaaatccagacacaaggtcagctgcagccagcgtgggccctggagtagctccagttatggggcagcaatggccccctctcattttgagagctcactttgcctgtggatggttttaatccatctggataaacttgaggcccatgggaataccatatactatggtaaccatgtacactgctctaaagatgtggctgctgttgtataactttttcctttatttttgtcaatttcctattttccagagtcttgcatacccactatgtctactgtgatagtgaacgtaaaaacatacaagatgttggtgttatcctcaatctcttattcttaatcctgaacaaattacatgaaaaaatcgttcatggagtttttcttcatataaaactttttacaatgaacataaagggcatagctatttctttttttttaaaaagaaacgtagaatattatttcttggttgtgaaatcgcccttcttggaccccaagttgttttttac

SEQ ID NO: 6851 - DNA, 1065 bp, Homo sapiens
ccgtctcaaaaaaaaaaaaaaagagaggtgtggtggctcatgcctataatcccagcactttgggaggccaaggcgggtggattgcctgagctcaggagtttgagaccagcctgggcaacatagtgaaaccccatctctactaaaatacaaaaaattagccgggcgtggtggtgtacgcctgtagtcccagctactcgggaggcaggaggcggaggttgcagtgagccaagattgcaccactgcactccagcctgggtgacagagcgtgactccatcaaaaaaaaaaaaaaaaaaaaaaaaaaaaaaagtgagaaagaatgtggttttggtactcagtgtctaggacgtctgtttaatgggatggttaggagcgtgtgctctgtactctgagctcaaaccttggctttgcctctgaccagctgaatgaccatgtgcaactcactgtttatgcctaagttttcacatcataaaaccaggacattattttgcctatctttacttattagtagatttgaatgaattacagtatataaggcaagtgacatacatggaaactggcaaacatctgttttttgttgttgttgtttgtttgtttttttttttttttgagacagagtctcgctctgtcgccgaggctggagtgcattggtgcaatctctgctcactgcaacctccacctcctgggttcaagtgattctcctgcctcagcctcccgagtagctaggattacacgtgcccaccatcatgcccagctaattttttgtatttttagtagagatggggtttcaccgtgttggccagggtggtcttgaactcccgacctcaggtgatctgtcttcctcggcccctctaagtactgggattacaggcatgagcacctggccatatctgtattttttaattcacttctttgatttgggaggaaagaaacctgaaccctcttcttagtgggagtgggataggctttaatgttaatactatgcatcatgtattaaaaatccactatccttctggcactggattaagcttttcataagtattattgtttcacccttacagctgcca

SEQ ID NO: 6852 - DNA, 1057 bp, Homo sapiens
gggccctgccagtttcttgtaagtggtggttttcctagatggtcccctgtgcagcctgcgtgcctcctggaggtggggccttggggtaggaggtccccacaacatgtggaaacgcagtaggcatgggagattgaagtctccacttctgactcacctgctaatgggaaaagtgcagactcttgggctccataatggggtaggggttgagaaggtattttaaaagccaggcttagtggggaaataaaaactaaagcagacccacccagagagctgtcttacaactatctattattttcacatggactggggggagtatgggatgggcagagttgagtgcatcttagaaaatccaggtgagaggctgtggccaagggaacccacgggcccggtgctctgaagccctgggctgctggaaccggcttgacggtgtctttctctgttctcctccccacagtctaacaaagtgccagtggtgcagcaccctcaccatgtccaccccctcacgcctcttatcacgtacagcaatgaacacttcacgccgggaaacccacctccacacttaccagccgacgtagaccccaaaacaggtaggctgtgggctacggagccaaggtagagtgctggtcctggggttctgggggaacctttgaggcctccacaggaaccccaggggtggagcagtaggggactttgggggaacggtggtgggggggcccctgttgcttttctgggtgttgaaaaggaagctctttggggtggttgaggcctggtgtggcagtggttttccactccctttggagaagttcatttgcagtgttaaagatctctttatggcttccagtacccctgaaggggctgtcttgggaacctggctatgagtcctcagtatgtttcaggagtggcttttaactctaagagcctcaggcagacatggatgcaggaatcatattgaaggcatttcttgggttcctcctcagcttcctgggaagatgagacagcatggctttccaagcctcggctccctcactggctaagaggctccagtcactacttgaca

SEQ ID NO: 6853 - DNA, 1092 bp, Homo sapiens
cgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttccccctta

SEQ ID NO: 6854 - DNA, 1030 bp, Homo sapiens
agagcgaattttctctcctgttcacagacctgaggatggcaggtgatcaagaggcttgtgcagggtagcaggtgtcataacctcattgtatcagcttcataccctttctagactgtggtcctgaaccaagaaatggagaaaagcgttgctgagccgttcactttataagtgtttggtttttatgtgtttgcattttccttgttgcatttggagggttgagatggggaaatacagcaactcctggatcgttcactttatgcaagatcattgaaaaatgtttgtatgcctcatttaaaaatgaagggctttggtatgcttccgtggtctcctattatttttattcacttgagtacctttaaaggaaaaacataacctaatgaacttgaactctttaattcaccacacactcacttcctgtttttgttgattaacttacatatagtttgacatgttttgccgtcatgtgagtgccgttttgcagcctggtgtagatttgggacttcggtgggttgaccatgtgtgatgctcatcaacttgaactgtatgatggtttgttctgttgatactctgtctcttgcttagctattcccctgtcgttcccaatttttcactcttaaagattgtgctcctggctgcatgtttatggaaattttgttttcttttttcctttggaccccacgctcacagacagttgcttttttccacaggagccatcccagggttgggggatgctacaatggggagccggggcatttctgccggtcagcagagaagggagaggccagtgtgaccttcccagcccgagtttgaatggtcctgtggaaaactccagcgtgcagttcactgctgattcagtcacaggccttcagggccaggcagcctgtgccagtcttctatcccctgctgagctccgagcatgttgagtttttattattacagagaagaaggaaactcacttcctgtcgtcgcagagcacagcctagttctgatgcagaggggactgttttcagatggagacactaggtactac

SEQ ID NO: 6855 - DNA, 1084 bp, Homo sapiens
ccctcaagccataggtcacctttttgatagacctcagggctttgttttggatcaggtggcaaataattctttttgattcataaatcattaacacaaacacaccaaggacatatttggaaagcccagccaccaccacagtactgaggtggacatggaaactccattaacttgtaggttcatgcatgatcggctctctaaaagtacgcaacaaacatcagaaaacacaaaagccaaatacgatgagtttgcttcggcataacttttggtttttatggcactatgaatatttatggcactgcagttttctaacaaatatttgttgtaatcatttaaagccaaactgtcaaagaatttaaatttggaaggcacatggggttatggctgcaaataaacgaggctgagcatttcgcgagctttaagtgtctgacccaagtaaatagtataagattcgagaaagagttgggaaagaggaaggtgtacatggtgagataggtttggtctccgttgctagttctagcttccgttattttaagtagatctcaattagtatagcatcaaacgttttagcagaggtgcttttaaccattcatgtttaaaaattaggctctgagtctgatccaagttctaatcctaactctgtcatttaaccatttaatactcacataacccacataaccttaggcagtccttcagtttcctcatctacatatgaagatggtaatgtgaaaattaatgagataatgtacatgaaatgcttagtacaatgcctggcacaaagttgtaaccgaaagaggatctggctgctcaccacttacagaaagaagccaaaataacaagaacaaggtgtgatcaaaggagagtgaattttattatccaatgccaacaaggggaaaaggtcagaatcctttctgaaaattgccaccttttcagtttctggagagtgggcaatggtttaagaatagaggcttggaatacagggagggggaggggctcggaggtgccaggtggcatgtttcactccgatggcttatcttaaattattgctccaactggcgaaggggccagcaccatcttgggcccaacc

SEQ ID NO: 6856 - DNA, 1047 bp, Homo sapiens
tgaggtgaatgcgccgtttggaaaccacaggacagtgaacgtttcgtctctcccagcgagactctcccgcgggcccggcggccgcatcgggagcccggcggaaacatggcggcgcccggaggccggggccgcagcctctccggcctgctccccgcgcagacctcgctagagtacgccctgctcgacgccgttacccagcaggagaaggacagcctggtctaccagtatctgcagaaggtggacggctgggagcaggacttgtcagtacccgagtttccggaaggtgaggggctggcgtcggggtgggggcccctcccggcacctccccttcctcggggacggcgccctcccgcgaagcggtgggctaggcgggtttgtgccgctggcgccccggggagtggcccttcgcctaacttgggccgctgttcgcgtgttctgcaattcccaggggtccccaagcggccaccgacgggggtttccctggcacggggatccacatactcgtctgtgtatcctgagttccgcccgcgcctgatattagccaagtggacactccgtgaatatttagtgtccccggtggcaatgattgcaacgtccacaccattctgtccattcaatctggttccccagtgtcttctggtcatctttctgcatcatcttgacatttattgatcactttttcatgtatcacacacagggtttttttttgtttttttttgatacggagtctcgctctgtctcccaggctggagtacagtggcgtgatcttggctcactgcaacctccgcctcccaggttcaggcgattcacctgcctcagcctccggagtagctgggactacaggcccgcgccaccacgcctggctagttgttttgttttgttttgttttgttttgttttgtttgtatttttagtagagacggcgtttcactatgttggccaggctggtctcgacctcctgatttcaagtgatcctcccgcctccgtttcccaaagtgctgggattacaggcgtgagccaccgcgcccggcctgccacacacagtcct

SEQ ID NO: 6857 - DNA, 1050 bp, Homo sapiens
gactacttggagaccttcaagaaaatcagaacagctgactggaacaaatatctaaaattagaatccaagaaaactttctggaaagaaaagaaaccttgaatctacatattgaaagggcctaccaggtaccgggggtgattgacccagaacagtccaagaagtatcctagtaaaattattatactttaaacattgaaaaacaaagaacgtaacttacaaagacatgtaagttagactggccatgcttttcacaaataacgtacaaagcaaggcaacagtagagtgacatttcaggaatcttaatgagtgtaaaccataaaccaaagagattatatccaaccatttgtccttcaagaatcaatcaaggttaaagaaaaacagtttgaatgtcccaaaactcagagaatactgtgcacatgtgccctttctggtgaatctactatagggagagctagagaaccatgggtgagtagggaaactgctaatggatggatggagattttatacatgtagagctaacaccaaaactaagatgtagagttttggtatattagtcatagtttgatcagagaagcacaactgggtataataatgagagaactaatagagaattcattataggtagttgaccttatgttattgtggagctacatggctaactagtatatgtgaggctgttgcttttgtgtgctcctgcaacctacctaagtttactaacttttcacagtcttcaagcagaggtgtgtgtgcgtatgttcttgtgctttggtttggaattaaagttgtaattactggcaaattatatctcctgatggcaggtcaggcagttgagaaggaaagatggatataaagtagcagagaacaagggcaaaccagaaagaacgtgcaaacatgaactagaacttgcaaggataaactgaaacccatgtaagctttagtttagatgatgaagtggagcaaaacactcatctggcccagaaattagagacgcggaaggaggagatctacaacccttatattcttattgctttcatttgccttgcatatcttt

SEQ ID NO: 6858 - DNA, 1029 bp, Homo sapiens
tgggttaatacattaaagcagatgtgttttttaaagtcttgcagactttcttccagacttaaatatgctaatgtattgttgagtgcattaatggggggatatctgtgcagcatttctaaacttatttgaccagagagccctttataggcagagctgcttataggactgtttccatggtgtatattttagggaaaagtggttttttaaattactaaattcttaatgattaatatttctttatcattatctttttggggttgtatgtgtctataattcgtcagaggggctagacctctaatggtgtattgaattagtaaaatagccagcctgcaacattcagggagtacttgtccttcttttttaattgtatgtcatttctcttgctttacaacttaatgggttttcgagtattgaccatgtgctccatttcaaatatttatgcatttaagtataatcacaacaaatttaggttacctgaaattgttttatattctgtgacttaatatggtgtctgcagaaatggaaagtggaattttttccttttaaaaatacaagaatatttattgtgttttatttttgtttaagacctcatttgcagaggattgaattgattatattctcattcatggctcacgaacattgtttcatgcagacccttctcatttagaataatttatttaaattataaattctcctacttccccatacccccaactctcactccccttacattagcatacctataagcagccattgtgatacgtttaatgcatgtttttatttgtatgtgatcttgtaagtgttctgtgtatattttttagttactttattgtgctatattttatgtatcataaagttaacccattgcaaatctataattcactagtttttagtaaatttaacaggttttgcaactgtaaccatacgttgtttttaaaacatttcatcccccaagtaagaacccacatgaccacttacagatagtccctgtcccctcccatccctaggcaactgttaatttactttctg

SEQ ID NO: 6859 - DNA, 1090 bp, Homo sapiens
ggtaaataagttaatggttggaaaaatgataatgaaagctgacttgaacaatttaactagaccaagatcactagtttgtttttttaggaggcttatcacttttgatttgattattcacattcatttatttaagaactaaattgcacacaatataccacatgttgactccacctatgaacttgtctttttcagtgagttaacaaaaggaacctgccttaggtttgctggaagtggaaatgaagagaatcgaaacaatgcctatcctcacaaggcaggttttgcccaaccttcaggcctttccttggcctctgaagatccctggagctgcttgtttgtagcagatagtgagagcagtacagtgagaaccgtttcactgaaagatggagcagtgaagcacctcgtaggaggagaaagagaccccatggtaatgacagtcactcttgcacagtgcgctcggacactgagcaagctgtcaattttgtgaattatggaaagttaataagatttaagagagaccatccttggcctatctgcgaatcaaaatgaaagtcagaccaaaggaaatgtgaatgtaaagcaacgtgaggaacacaccatctaagaaaagtgaactgactctactttattatgtataaatgttaaggtttcagggagaaagaaaggatgaagcattgattattggagaaaagaaaaaaatgtaaattagatattgggcagtggggtggaaagagcaccagactagtggacttgacctattcctgaccagatgtagtattgtgagtaaaactactaagcaccaccaattaatacaggttcaaaatactgtcattttttttctaatctgaatgaagtatccaaccctatttatatgaaaatcagcattttcccttttaacttaaataccatttgtaactgtttgaattttccttcatattctaacaaaacactgtaaaaattataataactgctgtttcttttcttttaaaaaaaattaaagaatttatttgcttttggtgatgttgatggagtaggaatcaatgcaaagcttcaacacccccttggagtaacatgggacaaaaaaaggaattta

SEQ ID NO: 6860 - DNA, 1002 bp, Homo sapiens
acaaaaaactgtacaacattagcaggaactggagacacaaataatgttaccagttccagttttacagagtcaacttttaatgaaccaggaggcttgtgtattggagagaatggagaattattatatgtagcagacaccaataatcatcaaattaaagtgatggatttagaaactaaaatggtatctgtggtaagtaattttaaaatataagttaaagaatgtggttttaagaatgatactaagatcctcacagcactgacagaggcatttttggttagaccatctccaggagagtattaagtggatgcttctgttgtattctttgacaaagagaccagcaggactgctttaaggatatccttttattcttaaaataaaagttccatctgtgctgagagtttgagaaaaatactggaaattggagataatctaatgaaccttcaagaaaaaaaaaaggagaggactcagatctgtttttaagtgtacagacatactgacatacactacatacacctgctctgtgggttgggttatttagcttattgtttttgtttttttttttttttcagtgatctttagattaacatgtaacctttgtttgcctgtgatgaatccattaccaaataatctaacaaaagctttagaagccactttctcaagacatcgaaaataagattgtggaagaaacttaaatgagttatagtcagtttttaaagatatggacgtggtttcttatagaattttcaaggggaaatgtctattataaactaactcttgatgtatgacatttacctgaaaaaaatgcaacagtttttttctgaaaaactggtaatttgcacggtatatttttaaaagaaacatagattactattgcaacataaatgtcatttctcttcacgtagatctctgatataagatgaataacatcttcttatagttgacaatgaaaattataagaaaatgtatatctagcatgtttaaatttataaacttttgctttaa

SEQ ID NO: 6861 - DNA, 1436 bp, Homo sapiens
agctggagatatagagaacatttccagtcaaccaacaatttcactacaaattcctgatgattgcttatcacttgaagccattgtatctgtcagtgtgtttctttattactgtagtgcagacagcagtgcttgtatgatgaaggcaattttgttcagtcagcctttacaaataacggatacacagcaaggttgcatagctccagtagagctcaggtatgtattttagccagccagctagctagcaacccattgccaccacctactgtctcccatcctgactatcactgtaatttaaggaaagaaaacttcagttctgcctctggataccaagatgcccattgctcagttcagacaactgatattaaaataaagctatgctccttacttacttcttttattataaacaaattcctttgctttggctgatactagctgagtcattgatcatcattggtaccatgatattgtaatctatgctgctatttggcacaagactgaagttcacactacagtagagaatactataagataatttgcaataaatactgataataataataccagatattttaactaactttttctacctttattaatagcaatcagcacacttgaatgtgtaaatttcacagtaactttaggcagaacttaagctccaggccacatttgtataagaacaccaagtattcaaggcataaagtctgttgtaagccaaaaaaaagtcttttcatcactgtagaagcttaaggagtacatcagtggtaaatacgatctttattctcttctgtggttttctcagttgagatatttttaaaagagagttttgatctatttttattataaattatttgttatttaacataccattatgaatgccttaaaactttgtacagataaagttggacatagaatctctaaggactgactcctttaactgtttttgagtgactacattaccagataatgaatgagtccccagaaatattatgactttcaaggaaaaagggactttaggacacattacttagtgtctgtgataaataatttattgtgacagctaaatctgatggttacatatcttgttttggaaatgtacatttcacttgtaagcattaaatgcagatttgttgagtttaggttttgaggtttttttcgttcccatattcagaatttaaattatgatcatttattgtgatgtttttaaaaatcacttttaagccttaaaagtgaaattttcagtgtgaggtgctttcatgctattaatagatacagtatatcctaatatattagtcttcaaaatattaaggccgaaacagtgatttaatgatactattttttaatttttgttgttttttatccctaaaaaaagatattggaaaggttttttttctattgtcataatttataactacttaaaagcctaatcttgttttcct

SEQ ID NO: 6862 - DNA, 1050 bp, Homo sapiens
acgtagtctggctctgtagcccaggctgggagggcagtggcgcgatcttggctcactgcaacctctacctcctgggttcaagagattttcctgcctcagcctcccaagtagctgggattacaggcgtacaccaccatgcccagctaatttttttgtgtttttagtagagacagggtttcaccatgtcagtcaggctggtcccaaactcctggcctcaggtgatccgcctgcctctgtctcccaaagtgctgggattacaggtgtgagccaccttgccctactggccttagttaatttttaatctcatttgacttattatgtttctcatttctagatggacaggatgagaatattttggcccaatcattttctgtttaaggacttaaacaatttcacactctaaatgaagtatatacaattttaatttactaatttagaaatatctgagtttatttttcaatataatatacaaacacagtgtttgttatacatgttcatgtacagtgaaaatgcaaaggcattttttagactctattccccttcatttgtctagacagttttaggttagccttagcttatacttttcttgactttcaaaatacagttttattgaacattcttattcttacccactgccagtctgcattgttttttacattaaaagtattatttatagtagactaatatgattttgaataaaatcacacttaagcaatatagataggttcctagaatttatgacgaggataaacctctcacataagaggaagcactagaaagtttatttttaaaacttgttgatccatattctataaggactaatgcatattttttatcttttgcttttcttgttggataaattattatgtccagtgatagtttaaaaagaacaagattttagtgtaagtcacctcacttgaaatgccagtaatgtggtattacacacattttatataatacctggaatctttgccctaaattattctgctggtttgtcgctatttttttcctctcctctttattatttcacaaatggtagaatttcttgat

SEQ ID NO: 6863 - DNA, 1027 bp, Homo sapiens
atcacacatttagcgagtggcagggcctggatgggagtctgttcaactctctgctgtattgcctcttaaagtaggttttcttaaaacataaatctttcataactttatatatttatagtaacttaatccaaagaaccccaaaagtactagcaatgattgtttctgcaatttaaataaatccatttaattatacaactttgcattatatactgttattcagaccttggaacagtctataattgtttgtcaaaagattttatgtactactttttcttaatttcagatattatccagagtttttcttggcagatggatgtattaaaaaaatagctttccagtgttagttctcaacagtgctgtttcaaaagttgttttaaaagttctaacggttggtcttcaaaacgtaattaagaccttatcataaagagccttttgcacaggactatctcaaaccctaagaagctattcatatttaagaaaattttgttgtattaaatattagtccaagtgagctctggaaatacagtcttctgctttcttgtttcataaataacactggtatgcagacccctccccatgactcaaatattaatatatgcaattctgttacagtaaagttttcaccatggtcaacctattccagcattaggtactttttgttgttgttgttttgttttttttttttttttttgagatggagtctcactctgtcacccaggctggagtgcaagggtacaatctcagctcactgcaggctccacctaccgggttcaagtgatcctcctgcctcagcctcccaagtagctggcgctcaccactactggtgcccaccacaatgcccggctaatttttgtacttttagtagaaacagggtttctgttggccaggttggtctcgaactcctgacctcatgtgatgcgcctgccttggcctcccaaagtgctgggattacaggcgtgagccaccgtacccagcctagcattaggtactttgttttgttttgttttgtttttgttttttttgagat

SEQ ID NO: 6864 - DNA, 1079 bp, Homo sapiens
aaaaggaaaatattgcaactatttgcaaacatacttccctacctgtacaagcagccatatactaaaaagcactaaacaagcacaaatgaacactaaatagccttataccaaaaagcattcttgtaactgtcagggcatggtatgaattccttcctctttaagcagcaacttaccacaggcttggtggctttaagtaatatagcattaagcaaatggtcagttattttttaatgttgaaaacttccaagtgtgaataatacggacatagtttactaccttttgcttttaatatacctggttatctatttccatttgaaataaaatgaaaggagacctcaaactgatgctgagaagtagacaaaatcagctctcagacttaactctccccaattaaaatagtttttttttcccttcccatttttttgtttttaagagatagggtcttgctgtgttgcccaggctagagtgcagcagtgacatgatcatagctcactgcagcctggaactcctgggctcaggatccttctgcttcggcctcctgagtagctaagaccacaggtgtgtgccaccacacctggctaatttttttaaaattttttgtagagatggggacttgctatgttgcccagactggtctcgaactcctggcctcaagccaccaacctctcaaattgctagaattacaagcatgagccaccacacctggcctgttattccttctttatctaatgtgtgctaagcttgtgaaaaatatatgttgaggtaaatagggcaaaacattagttgataaattatgctaattaatgggaaaaatagacatgttcctctctgaacatttagaaggactctgccctacaactatcttctgtttttagaatttgtagtcactgttcttagtgccactggaaatatattcattctttgagcatgtacagggtgggctccctgttgtatttattacacttttcaaaatgccagcaagtttttgtttgtatagagttggaatgtattgttcgtgcatgcctgtgatattcatcatcaaaatatacctgtaaaaaataaactactgcttcctctcc

SEQ ID NO: 6865 - DNA, 1032 bp, Homo sapiens
caggccagcccaaatccagtgacctcctcttcaccttcttaaaagagacaggagaatcacttgaacccgggaggtggaggttgtggtgagccaagatcgcgccattgtactccagcctgggcaacaagagcaagattctgcctcaaaaaaaaaaaaaaaaaagtctgccatgtgtatggcacgtctgagcaatggactctccatgagtctgtaggagagctgggtcttactaacctagccaagtggtatgcagcaccaaccatgagctaccggggcaaagggagacatgactctagtagccttgcacctctactgggcttacttagggtaggggtcttcgggtctaacccatgcctggccggcctggtgggtatggtgttctccattgtagaagccaagcagccagtcaacctctgcaaacccagcccgtgcatgaatgagggcagctgcgtcctgcagaatgggagctaccgctgcaagtgtcgggatggctgggagggcccccactgcgagaaccgtgagtggagctcttgctctgtatgtgtgagccagggatggtattgcgagtcctgccaagtcccacaaactcagctgaaggcaggttctaaaacattcgttcagtggaagaaattattcagtcgtttacccacgaaacatttagtgagtacctcctgcatcccaggcattgttctcagtgcaggaacatagcagtaaacaaatgaataaaacctctgccctcatggagcttccattctaatgggaagacagacaataagcaaataatacaacatgtggtgtggtagacggtgctaagcaccccggagaaagtcatgacaactaggagggaggccacagttaggagcacagtagatccagggtacagggatgtagacggaggcagggatgggtaaatgcggtggtgggagctgctggaagctctttttggggtgctatttgctcagtaaaatgggaggaacagctaagtgaggacgaggaggaggtgctagaggtttgagagaaaagaagtcattg

SEQ ID NO: 6866 - DNA, 1027 bp, Homo sapiens
ttatggaacctcaattaatgcaaacgtgagtagcctgttttcttttgaaaaaaaccgcatcactgtgtcatgttatttttgcccactgactacctgttcattgtgctcagttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgaggtaagctacgtaatgatttagaattggacttagattctttgaaatacggttttaatgtattatacttcagatattttcaatacaacctcttttattggctttagaaattgaaagcatgactcacaagatggtaagaagagtaacttatgtaaagacatttttcagttagcttttatcaattttggtttcagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtgtaagtttccatccaactccgtgagttcagcatttcatgtagagatagaactttctctctcctcttatctacctcccttatcctcaaaagaaatacctcttacagtttaaaagttcttaaaagtaaaattagatgcattgatactaccatccttttacattacaaataatattgtgtattcattagacccaataacaaaatagtatagaatgttaatttgcctagaaaatatacataattccttaatcctttatattagcaaaattatgtaacattttctaagaacatagcagagaatcttttggtttagaaaatgtcataataaaatagtgctttttatgtgtcattaaatttaacttagag

SEQ ID NO: 6867 - DNA, 1033 bp, Homo sapiens
gatctctcttctctgtaattgtcagggtgagttactagttctgttatattccctaggattgataaatctgtgcaattaatatgttaatatcattgtatgcagttagtgtcacataatgaaaaatatatctactgcttaaaagtaattattatacattctgaactactattttttcaattattttaaataatatgtaacttttattttaaagaattaggtatgagtccttggttaaagatgattatatgagtagtgaaagtttacgttctttattaaatagtagggaaggaagatttttctttttagatcctgaggttgtctgtgtagctgatttcaggaactgaagtgccttgcctctgtgatgcaggttgttggagaccttatgcttcgaatccagcgtattcaagactttactcccaagcttctgttagtcagaaagcggttacttggtttggaacctgaaggccctatgtaagttagtgttttacatttttttaatccaaaaatttcagtgaacttaatgatcggctgctatcttgaattgatttattgtctgttttttccttaccagtattgaccacatcacactgctagagggtgtgattgtgttagaagagttctgtaaggagctggcggcaatcgcatttgtaaaatatcatgcttcctccacaccataaataacatctttcatgtaactgggggaacagaactactgtgtacatttcaccaaaaaagactcagttccacccagccacaagaggataaaaagcctttttaaacgcagtattgctgtaaactggacagaaccattaagaacctattgagtggacattcttggtgaaatgttgtataatgttgttttcattggctttatcataatggttctatatatacaattgcacattgttgaatccaggatacaatcaaaggaacttcaggaaataagcatttctaatgactgtgaaaagctgcaatatttccaatgtcatgactttgatgatatttctgttatattaatgtccttttaggtagc

SEQ ID NO: 6868 - DNA, 1066 bp, Homo sapiens
gctattggatatactattttttattgcttatatcaatgtagataattttttctcctaggaatttgtcatctcatctaaaatttcaaaaatattggtataaagctgtttataatagtcccttatgaccttcgttttattttgaaataatatcaaacttacagcaaataacttttgctaaattacccaagagcaagctcagccatgatgtcccaccaccccaaattcattactgcaattcagtttgaagaccctatttattttttaaaaacagctttctgaagtataattggcatacagaaatactgtatttaaaatatataattttaaaaattaatatacattcacctataaaatcatagctataatgaaaacagtgaacatatttatcatcataaaagtgtctttatgcccctctctccattgtgagttaatttttgaatatgatttcagatatggattcaaggtcattttttgcatatgtacatcgttttgtaaccattttttaaaagactatcctttctgtggttgccttgaacctgtgtcaaaaaacagttgtccatatctgcatacttttattttgagacttttaattctattccattgatgtatttatttttaaaccagtaccacactgtcttgattattgtagctttgtaagtctttaaattaagaagtgttagccctccaacttgttctttttcaaagttgcttttgccattcttggtcctttgcatttccatatgaatttttgaatcagcttgtcaatttttatgcacacacacactcaaaatctactggcagtttgagattgttttgaagctatagatcaattttggaagaattgacatctaaacaatatcaagccttctgacccatgaaataagatatctctcttcatttatttaggtcttttatagccatatttttgtagttttcagtatcagatctttacatcctttgtttatgaaatctctgagtacctcaaattctgaagtttcaatttctaatagttcattggtggtatatagaaatggagttgatttttgtatattgatcttgtgttttt

SEQ ID NO: 6869 - DNA, 1033 bp, Homo sapiens
taacagatagtaaaagctttatgtatatgtcttcattcatattttctaaaatcattgtttaaaaaatgcttgtttagtaagcatgctaaaatccttgcttatgtgtgttttttttttttttgcactggcttatttttgaggccggctgggagtgttcatgtaaaacaagagagaaattccaacaacagagaagggggaggctggggcggggggacagataaatgcaattttacttgacaacagagttgaatgtgagtgtgtaaaatttctgccataacataaaacagatttgaaatcttaccaggtaaaatttaaaatgtggataatacttgttaagtgccacattaagttatttacaatatttgatccctagagaaacttagaaaagaacttacggggattattttgctgcttgtattctgatcacttcattattaattactgcaggatcatttctatagctaatgtgggattttcctcagatcttcttaaggccatagtcagaaccaactgaatatatatataagatgattgcattatttttattggagaaaaattgaagcaaatgaaattgttttaataaagaatataagactttctccctcttttatcttgttaatgtatattttattctttttaacaaggtagaattttggctataaaacatatactgtaatatatgcttttggaaaaagttttaaatgaattttcagggctgttggtgctgtgaaaatagtacatgtacttctgtggttgttttagtgtcttttttgttgatttttggcagataaaataacacaagaagatattgaaggcattctacagaaatttactggaaatataatgcaagtgccccccctgtaagttcaattagtaaatttggaaaaatgtttacttttcttttccaatggttaacatcactctagttaaaatacacgagtttcctcttagcatatggcaaggcaggttttaaatctgatgtgccaaatgttaaagtgaaggtgagacaggatgtggagcttttgacactcta

SEQ ID NO: 6870 - DNA, 1037 bp, Homo sapiens
atgataaagttgttttacttgtaagaaaacgataaaagatttaaaaaatcctgaaaatgtttcaacctggaacataccaaatcacttcattttgacactttaagttttttatatttgaaaaataatgtcttaaaagttgttaaaagtcatagaattattttatttatagtcttaaaatccaggacctttatgtaatagaaatttgctctttgcaaattcaaagttttgaaatgtgaataaaggctaaacacagtttcctctacctgtactgactagatatttttttcttaaatacttgaattaaaacaagccattgactcatcatcagaaatgagttactgtattaaataagagtgctttgtatcagatcttcagtacattttatgtcccctgaccagtttgaaatttgtatcagatttacaatgaacattttgaggttcaattagatggtgaattgttctgtttcaaagaaagtaagtaatttaccttatatcatgatgtatacaatagaaagagatgtgattcaaaagcactgtaaaatgccaaaacatttaaatagaggaaacgataatagatatgaggtttatgcactgaaatgagtataatggccttgtagttaaatttaaagagagggattgtcttgaaaccatttctttctctaaggtatgtatgggcagagctctagattgtcctaattcttcattaaatactatttattaagcacatttattaaggtgttgaatcagtagtaccttcatttgttaatgtgtgagctaaattctctttatgaataggaatatcttcagattgctgctataaatactgataccggccggaaagttgaagttcgggaattattttgctcttcttatccttaacccttaaaatgcagcatattaactttatttctgtctttaccgttagtcaactttttgatcctaggtgaatcacttaatctctttaggtctcaagtttccttatccttacaacaaaggagacagactagtccatcttgaagaatctctccaatgctaaaa

SEQ ID NO: 6871 - DNA, 1089 bp, Homo sapiens
agaagtgtacatataaggagggaagtagcagtatggtacaagataatacatacatatcagtgaatgatattgccaaaaagtgctattgatagagcaataattcatttctgcaaacagctgctgatctcctactgaaaacagaggagggagaacaggacgcctcgtggtcaggatagaagagaaagaccttgagttgagccttgaacagtatttaatattcaaaaggttaagagaggagagcaattgaggaggggagaatagttccagcacaaatgatggtgtacaagatgaacacagtcagtaaagagcagactggtctggatggagaggaggatttgcatcatttgggattacgtcatttagacccttgaaagccaggattgagtaaagccacagtgaagcgactggctcgtatggaagctttattttaagaagattaatctggtagtgacatgtgccaaaaactgaataggtagaaatgagatgcagagagcccagttagaactaagtctggtgcagtaatgcaggattgaggcaataaacaccaaactacagtatcaccagataatggatgtttgaacggacggtttaaaggaaaattgatggtatttggtaatttattagataatccagggccatggaatgagaggggaaaatgactaaccatagtcatcaaatggtttttcttaatgaatctgaattttggtgtaagagcaacattttcttaggccttgcctagttggtacagctgactatgataatgactgctaccatgcttgttcctcttttagcagctgtgagtcccccaccagccaaacaatgagcctcttgaaaaggacgatgccttttcacttctctccaagtgcttggcaaataggaggccttttgaagttactttatagttaggggttcccagtgagtatttgaaatattaagtcatgcccgtggttgacagcatggccctactgctcatcatcagctattaaccttaggcaagttaatgaacttttctaagccccagtctactcatttataaagtgggattattaataatgtctacttcataaaattatgaagcctgagttaggt

SEQ ID NO: 6872 - DNA, 1047 bp, Homo sapiens
ttccttataaagctgctacgaagtttcatgtggaaggctttttatctttgtatggtcatatgctttcctttctcttggggaaataacctgagaatggctggatcatatgggtagatatatgtgtaactgttaaagaaaccgacaaactgttttccaaagtagttgtatcatttatgttcccaccagcagtgagtcagtgttctatctagttaatttcacatccataccaatacttggtatggttagtcttttaaatttttgtgattctaataagtgaatggtatattattgggttttagtttgcatttcccgaattactaatgatattgagtatcttctcatgtgcttacttgccatccgtatatcttctgtaataggcatttattcaaaccttttgcatgttaaaaaaattttcttactgatttttgtgagttctttacattttctggattactagcttcttatgaggtatatcatttgcatatattttctaccagtctgcggcttgtctatgaaaacaatgcaaagagaatgaaatctcttgacagtatttttcaaagaatctaagttttaaattgattaattccagtttatcatttttttcttttatacttttcatgttgtgcctaagaaaagtttgcctaggctgggtactgtggctcatgtgtgtaatcccagcgctttgggagcctgagacaggaggatcacttgagtctaggaatttgagtgcagcctgggaaacaaggcaagacactgcctatacaaaaacatttgaaaaattagctggtcgtggcggtgtgcgcatttagcccatctacttggaaggctgagatgggaggatcactttaacacaggaattggaggctgcagtgagctgagctgtgattgtgtcactgtactccatcctgggcaacacagcaagaccatgtctttaaaaaataaaaaataaaaaaaaaaagaaaactgcctaaaccaagttgatgaagattttcttcattttttttctctagaagttttgtaattttagattttacatttatatttatg

SEQ ID NO: 6873 - DNA, 1025 bp, Homo sapiens
ttattatctttaacagtaataatacaaggtgattgtcatttattaatttaagctttttataacaccttgtgtacctgtctttgatttctttggtctgccatgaatggttagaattaatgctcaaaatgtttgccataaggttactaattgctgtctggatccacgaaaggaagatgctctggcattttagatatctgatttatttgaccctatttgatgcacagtatacttccagtctaccatttgagccaaaaagtgaataggagaactattttacagatagcataaagttatgaaatgatcagtagatgtgatgaagtttagccaaaaggggaagagattgatcttatcattagatagtagattaatttgaaaataatgattaccatgtgcaagagaagtattccctgattaaaaaatgtttgagttgtatagttatctcagtagctgaagggaatgttgaggaaaaaatgtattaatgagctaaaatcttatttggaaatatccttgttagaattatagagctcagaatcagctgatgttgtagtccatttgtattgctacgaaggaatacttgacgctggataatgtgtaaggaaaagagatttgtttggctcatgattctgcaggatgtacaagaagcatggcaccagcatctgcttgtattgcggggctcaggctgcgtctactcatggcagaaggcaaatgggagctggtatctgcagatttcatatggcaggagaggaagcaaggggtgggagcggccaggccctttttcataaccaactctctcaggaactaatagagtgagaactcactctttactgtgaggatggccccaagccattcatgagggatctgcctccatgacccaaactcttctcagtaggcctcacctctgacattagggatcaaatttcagtgtaaggtttggaggagtcatatattcaaaccatagcagttgagaattaggcctcaaagtcagatagataatggttaaaatatcaactatatcaatactgaat

SEQ ID NO: 6874 - DNA, 1060 bp, Homo sapiens
cttgtgggttattcctcaagaaatctttgcccagtccaatatcctggagagtttccccaatgttttcttgtagtagtttcatatgcttaactacctgttattatgctagacattttatttgaaaattattgatagaaataatttaaggcccaggataatgttatctttctttagagagtaccatgtatcttctgttaggagacttggcatattggcagttctggcagcaccataagccgattttaagacttgggagttttctgctgctcagatgactcatagctaacctacagttgaggtaaaggctggttaacttctggtacaccactattttaatagcaagtcattatgtcccaagtcaaagtgccctgttgtttctttgaacccctatgttttgtgggttattgcttccaacttttgtcctcctctccccttgaggctactaaatgcactctcaaccttttggcagtctcttctaaataagcaaatctctcagaacaaaagcatctctgaatgcctgcctcctcttaaagaatttgcaacttctggatcttggctttgtacattttatcattttgttacttgtaagattttaaaattgtcctttaactttttaagttgtcttcagtggagagtttttctgaattactgcacttagtattaatattattggaagtgaaaaatcagggcaagttatttaacttgttacttaaaatgtgcttcagacttctcatctgtaatatggagttattaattatttactatcttataggttttttgagatttttaaatgaggcaacacattgtgtttatagtggtacctgacatgtagaaaatgcttaagttattattacatttatttgagaatataggaatttgttgctcttcaaagattttccaagcatgaattagccactttattacaaaagtaatttgcagggattatgaaagatttgcaaatgacattaacattgactgacatttctgtcaaccctgatttaggtaaattaaagtttttcccccctaatgtatttaaggctctatactataaggaaaattt

SEQ ID NO: 6875 - DNA, 1029 bp, Homo sapiens
ttcactctgtgctttgtatattatataataaatattatgtatttattcactctgtgctttgtatattttaatttgaaaaatatttcatattcattttcagtccaaatgcagtgttaagattaagattcaatcattttgctacagaatgtagctgggatcatatgtatgtttatgatggagattcaatatatgcacctttaatagctgtacttaggtgagtaattatatttaatcagttgcagaaaagtgactgtgtaattgcttctttaaatatatattgatatgtactgcaaaataaatttagtaaagatattgatagttacatttcacagatgattataatactttgttatgtgctgtaactgtcaatttaggtaataattatgtaaatattgatataacataaataagtactatattggaaatatagatttctttctaaatattttttattctcattgtatttagtttattctttcaaagtgccttgaatatgttttcagaactatctggatatattagcgtgagttctagctgacaaataaatagacaagttttgttttttaatagttgtttttttattttagtgaaatggtaaaattttaaattctgcataaaagggttaagttatgctttgtgcaatgattaataaagatggagtttctaccaattgtcaaaatgtgagagttttatttgtttcaaaatattttattgttagtcgtaaggtagattattaattttaaaattatagcattgtatcaatttaaaaatcttttcttgtgtatgtttagattattataaaaagtttcgtgaataggagaaaatctattagacacagaaaaaattatgaacatgtatagattttatatataatttaacatgattgttgataagttactcattatattatttacttttgctatttatacaatatctgttatatgttctgtcattgctggaaatttaagtatggataaaagcttattggtcccttcaaaatattttctttccaatttttctttttattat

SEQ ID NO: 6876 - DNA, 1046 bp, Homo sapiens
tgccaattttggcttttgttgccattgcttttggtgttttagacatgaagtccttgcccatgcctatgtcctgaatggtattgcctaggttttcttctagggtttttatggttttcagtccaacatttaagtctttaatttatcttgaattattttttgtataagatgtaaggaagagatccagtttcagccttctacatatggctagccagttttcccagaaccatttattaaatagggaatcctttccccatttcttgtttttgtcaggtttgtcaaagatcaggtggttgtagatgtgtggtattatttctgagggctctgttctgttccattggtctatatctctgttttgataccagtaccatgctgttttggttactatagccttgtaatatagtttgaagtcgggtagcaaatggaaaacaaaaaaagcctgaggttgcaatcctagtctctgataaaacagactttaaaccaacaaacatcaaaagagataaagaaggccattacttaatggtaaagggatcaattgaacaagaagagctgactatcctaaatatatatgcacccaatacaggagcacccagattcataaagcaagtccttagaggcccacaaagagacttagactcccacacaataataatgggagactttaacaccccactgtcaatattagacagatcaatagacagaaggttaacagcgatatccaggaattgaactcagctctgcaccaagcggacctaatagacatctacagaactctccaccccaattcgacagaagatacattcttctcagcaccacattgcacttattccaaaattgaccacatagttggaagtaaagcactcctcagcaaatgtgaaagaacagaagttataacaagctgtctctcagaccacagtgcaatcaaactagaactcaggattaagaaactcactcaaaactgctcaactacatggaaactgaacaacttgctcctgaatgactactgggtacataacgaaatgaaggcagaaataaagatgttcttgaaa

SEQ ID NO: 6877 - DNA, 1044 bp, Homo sapiens
acaaagaagacaaagatccttgtggaacttacattcaagctaggagagacagaccctaaataataaatatacattatatagtatgttagaaggtgataagtacaatggaaaattaaagtagaacagagaaagaggaatagaaagatctgggggttacatttaaaatatgatgatatgcttaggttttatggagaagttgacatgtgagaaaagactttaagcaagcaagagagttcaaccatatagatatctaggggaagaacattctaggcagagacctgtcagttcaaagaccctaaggcaagagcaagccaggtgtacataaggaccagtaaaaaggccattgtggctggaattgaattactgatggggagattagtcagatatgaacttagaagttacacaacaagggagatggttggggatgtggaattaaggggttgctggaggggatggagattcctgaaggatggagctatatcagctaaatattcttagctttgtagaccatagtgaggattttgactcttaccctaagtgaaatgagggagccattgaaggattttgagcagaagattagtattatgtggcttagttttataaagctcctattggtttccacctgagaatagactgtagtagcagtataccagttcagaggctactgctataatctaggtgagagatgatgatgatggtagcttggacaggttggtagctatggaggtggtgacaatggcttgaatactgaatgtgattttaatgcaggattaataggatttgctgatggtctagatgtggggggtgagggaaagaagagtcaaagatgactaaggtttttggtttgagcaaatggaaagacagagttgtcatcaactaatatgaggaagattttaggaagaatatttggttatggtatgccaagttagagatatctttgagatattcaaaaggagatagtgaggaggcagttggatatatgggtctggaaattgatggagagagatctgtactgtagatataaatttggaggtgttcgcttaa

SEQ ID NO: 6878 - DNA, 1033 bp, Homo sapiens
tcctggatatcgttgttaaccttctgtctcattgatctgtctaatattgacagtggggtgttaaagtctcccattattattgtgtgggagtctaagtctctttgtaagtctctaaggacatgctttatgaatctgggtgttcctgtattgggtgcatataaatttaggatagttagctcttcttgttgaattgatccctttaccattatgtaatggtaaaggataccattcttcgaagaagaaaggtagcttctttgtctcttttgatctttgttggtttaaagtctgttttatcagagaaaaagaattgcaacccctgcccttttttgttttccttgagttttcttttgtgtcctaacatatagtctatcctggagaacattttatgtgctgatgagaagatgtgtattttgtagctgttgattgaaatgttctgtaaatgtctgctaggtccatttggtctaatgtgcagtttaaatccaatgtttctttttctgtctggatgatctgtctaatgctgagagtagggtgttgaagtccccaactgttattttattggatcaaataacactggtgccaagaaacggtgccagggagcccaagacaggcactcttagactgccactgtcacccctacggcccaaagattggcccagggccaatttctccctttaaatgtattaatttcttcctttaaatgtaataatgtttgctttatatgtctaggtgctccagtgatggctacatatttgtttagaattgttatatccttttgctgaattgatccctctatcattataaaatgaccttctttgtctctctttattgtttttgacttaacatctgttttatctaattagagttactcttgctcttttctagtttctgttttaatggattttttttctatccctttattttcagcctctatatgtctttacaggtggtatgagtttcctgcagttggatcatgtttttctttttttttctttttaaaaaatccattcagtcagtctgtgttttttaagtggaa

SEQ ID NO: 6879 - DNA, 1050 bp, Homo sapiens
tggaggcttgatgatgaaagaggtaaacatacttccctgacagaactgatatttgagtacattgttttctattttaatactcttgtagcatactaaaataaatctgacattttatattatttaaataattctttaaaattgtgaaatttatttgaacatccaagtccgattgtgagtatatgacttttttcgcctctaagcattacattttctgtgagtattattcttgtaagttatatttcagataatttatgtatatatttgttaatatgataaacattgaattcttaaattctcttaatccatatgttgtatttctataatctgagggctttgtttaatctagtgtgttgtttcattttttttttaataggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaagtaagtatttattttcagattcttgctgttttttaagctggatttttatccaaaatgtcttttttttttaattgttgtccgagagtaaaagtggttatttttgtggtagtgtctatttgctagtgagactgatttgtgaatacatgaactcagtatgtccatagctgtcattgcacatagaagtatgcttcatgtagaaatgttattacttctctagagtacttttaataaattctgagtaagaaaatattaacttcaaatacaggcaggccttgcctataatggataaaatgaatcaaatgaatcatgccacctttttttttaatgaagtataatctcatatataaaaatcctctcaatttgttctgtaaattttagtgtacctgaactttactttgtatgtgctttacaaactttcattgggagaacagttctagtattatgagagagatgattgatttactgttggctcaatagagattgttctctgcatgattggata

SEQ ID NO: 6880 - DNA, 1035 bp, Homo sapiens
aacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctaataaaatcttcatatgaatttagtcaaaatggtgagttatttgagattgaaattataagctgataattaataatttttaatataagcttttttgattatgttagattttgtcctttaatatttaagcttacctttttaaccaaatgaggggaaatattacttaatagtctcattttctaagatttgtgaattttttaaaaaaatatgtgaaattccagtaggtggtgctatttctttggattttatttatgaacgaagtactgaaactatcccagtctctttactatgcattgcatggtttcaggattttttattttttagcattctatttctaatcttactgctatatctttatgtatgtattacttctttaaagtcagcttctcaaggatagtctgctggcttctataagagattattatctgttatgtgaaggtgaaggtgtctagggcaatctacatgtgagtttttgtactatacctttactccattttgtttttctggtacttcatttttttgaattatttataacatttttaaaacagtggtaaccttctttattgtttttagtttgtttacaaatatatgccctatggtggttattcagattcaagaaaataattcttttctggctctggccagtatgatgaactcaaattcttggctcttttgtgtatggacaactatatatacaactatttagagtccttgtgcagtcttaatgagaaa

SEQ ID NO: 6881 - DNA, 1049 bp, Homo sapiens
agatggagtctccctctgtagcccaggctggagtgatctcggctcactgcaacctccacttcccgggttcaagtgattctcctgcctcagcctcctgagtagctgggactacaggtgcgcgccagcatgcctggttaattttttaatttttagtagagatggggtttcaccatgttaaccaggatggtcttgatctcctgatctcatgatccacccacctcggtctcccaaagtgctgggattataggcgtgagccaccgcacccagctggttcttaagaaatacacaccaaagtattaaggacagtaagaatgatgtatacaactgggagagagggagggggagggggagggggagagggagaaagggggagggagaaagggagaggaagggagagagagagggagaaagaattaatgataaacgggaaaaatattgacaattagggaatctgaatgacaggtatatgtgtatggggagttctttggctattgcacttttgaaattatttgcaaataaatgtgaaaatagaagaagtagataaatgttttttcatatttggttatgtggaatatatgtttaactgaagattttaagaattcccttgaacttgctgtggcagtaaaggaaatgtcagtttgtccttttttgttatacttagaattacggcttttagggaatctacaaatctcagaggggaattatgtggatggttttactaacttggaccataaagctcttctgggttagtcctgtgggaaatttatttcactttagtttagcaatacctcataaactttctaagaatctcaatgtgagtctcaaggtgagtataatattaatgttttgctttagtatttttcatgctttaagaattttggaggtgtagttgggaagccataattaatgtcatttaatgttaacttttttccttttgatctaaaaatcattagattttttcagaaaggtatttttttaatataaatttattgatactatgagtttctcctctgctcttaatatcacatgtttttaaaaattctgtggtg

SEQ ID NO: 6882 - DNA, 1023 bp, Homo sapiens
tgtactctattctggtccattgatgtatattatggttattctagtatcacactctattgattactgtagctctctaaatctggcggtgtaagtcttccatctttttttccattttaaaaagttttgagctattctaggtccttcatattgcaatataaaatttagaatcaacttgtcaatttttgaaagaaggctgcaaagattttaattggggttgcattggatctagagaggggaaaattgagtctttaacaatatggagtcttgtaatgcatggacatggtatatcacttctttatttaggtctcttttgtttcagcagtattttatatttttcaatatactggtgttgtacatagtttgctaaattcctaaatatttcatatttttaatattactaaatggtatttaaaaaatttaaatttataacagctgattgctagtctatgtaaaaattcattttcaaatatgggtttggtcatgcaacgttgctaaacacacttattaatatctgtagcccattggtcaacaacttattttctatatagatgctcatgtggtgtggtaataaacattgttttactctttctttttcagtgtgtatgccttttactaattttctttgtcttgtatttttaggatcattagtacactactgagtagaagtagtgacagcagatattcctgccttttcccttattttagcagggaaatatgcagtcttagcaatgtgtttaacatgacttttatcaggttgaggaaatttacttttatttctagtttgtttagtttttttcatgaacagtgttaaatttcctcgaaatagtttttttttccacatcttttgagaaaaacttttgttttttcattttctgattttttaatatggtgaatggtattgattgacttttacatgttaaactgcaattgcattcttggataaagcttacttggtcataatatattatccttttcatatattgctgaatttcatttgctaaaatcttaaagacttctatgtct

SEQ ID NO: 6883 - DNA, 1050 bp, Homo sapiens
tggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttc

SEQ ID NO: 6884 - DNA, 1088 bp, Homo sapiens
tctaggtgaaatctgtattcatttcctatggctactataataaactatcatagacttggaggcttaaaacaacagaaatttagcttctcacagttctggtggctaaaagtctgaaatccaggtgtcagcagggccattccctcttgaaaggctccagggaagaatccttctagccttttccatcatttggcagctccagacattcctgggcatactttgattgtagctgcattactccagtctaactcttggacttcatatggacttctccttgtgtgtttgtatgtgtctgaacgtggccttcttgtaaggacaccagtcactggatttaggacccatacttgtttaggattagatctatgtgatctcattttaacttaactatctgcaaagaccctattttcaaactaaggtcacactccaaggttccaggtgaacaattttgggaggacagtattcattcaaccagtacaatatcttttaatttctttttctgtttatgatctgatagactgaaaggcaattgattttttattactcttatgtctaacagtttgctgtatttttgtaatttatgtgtagacttttttagcgttttttaaataatagttgatcagattatatacaaataatgacagttttgtttcttcctttctgggtcttacagctttatatttttctcgtcttacaatttctgctataatcttcagctcattgttgaatagaagtgtgataacaggcatctattttattcctgagcttttaaaaaatgctttcagtatttcttcactaagaatgatgttcattgtgggttttttagatatcattataaagaaaggtctcttttttcctggtttgataagggtttatattatgaatggatgcttggttttgccaaaggctgttttaggaatgacttacttgatttttctactaaataatttaatgtggaatattattttaatttactttattattaactcaacttgggttaaatcaaacttagtcataatgtattatgtgttttttttagtttgctagtatttttgtaaggatttttacattgatgttaatatgtgagatttgca

SEQ ID NO: 6885 - DNA, 1034 bp, Homo sapiens
ttttaagggatactatttttttgtctttgttcccactactgctattactactatttccaggaatcattatttagacaatgaatttttaggtaactaaatgaatatttctggtaaatagttaatattgaaactgattgtggaaaaatgtcttaatttttctatggtaagtacatttttttgttcaagcttctattaaaatttattttattgtcactgaagaattgtatgtatttatggggtacatagtgctggtttaatacatataatgtatagtgagcaaatcagggaaattagcatatccattatgtcaaacatttattatcatttacttgtgttgggaacattcaatatcctccttctagccatttgaaactatgtgatatattattgttaacaatagtcatcctacattattatagaacattagaacttattcatcttatcgagctgtaattttcaatcctttaataaatctcttcttatccctccctttcgccttactcttcccagcctctagtacctctcctctacattttacttctataagatcaactgtttttttttttttttttttttttagcttccacttatgaatgagaacacagggtgtgtaactttctgggcctctcttattttacttaacaaaatgtcctccacttccatccatgttgccatgaatgacaggatttcattcttttttaatgactgaatattatccccttacttatatttaccacattttgtttatctatttttttcttgttggaaacccaggttggttccacatcttggctattgtgaatagtgctgcaataaacatgagaatgcaggtatcccattgatatactgattttctttcctttggataaatgtccagtagtgggattgctggaacaaatgatagttctatttgtagttttctgaggaacttctatattgttctccataggggctgtactaatttacattcccaccaacaacgtataagaattcccttttctctgcatcctcaccagtattttttgactttttga

SEQ ID NO: 6886 - DNA, 1033 bp, Homo sapiens
atttgatatgtgagggcttatttatggcattttgttaattgatttatggttgttttatatatcctttgctcctttcttattgtttatcattgtggttttttagttttctgtagtggtagcatttgagtcctttctctttcttatttgtgtccttgcttcgtcagggagttttatactttcatttgtttttatgatggcaaatattgtcctttcacttcctgaagcgtctgtttcaggtcttggctagtggtaatgaatttcctgtttttgcttgtctgaacatagctatcataatactgaagagggaaaggtgaaagctttttttttttttttttttaaagaactggaacaacacagagatgcccacttgcaccactcttgtttaacatagtactgaaagtcttcagactgagcaattaggcaaaagcaagaaattaaatggatctaaattggaaagaagggagtcaaattgtacctgtttgcaggttacataatcttatatgtagaaaagcataaagattctatcaagaaactgttagtactgacaaatgaattcagtaaagttacagaatgcctaatcaacacacaaaaatcagtagcattttcatacatgaacaatgactaggagaaaaggaaatcaagaaggtaataccatttacagtagctacaaataattaaaatacttaggaataaatttaaccaaggagatgaaagacctagaaacttttaacatatacattttaacttgttaaaatatttttcagatttatattactaccagtgagatgtaataatgttattcatataggtctattctttttcttcattttggtcttatttttgctactacatctatatatgttgtggacccaacagtactttaataaaattattactttatataattttatatcttttaaataatttgagtgatgaaaggaggataagtatatagttatagcttttattatattaatctttttaccatttctggttttctttatttgttgccatggccccaaaccatcaggta

SEQ ID NO: 6887 - DNA, 1133 bp, Homo sapiens
ccttcagtatgatactagctgtgggtctgtcatatatggcttttattaggttgagttatgttccttcaatccccaattttttgagggtttttatcatgaagggatcttgaattttatcaaatgcgttttcactgtcaattgaaatgattagatcatttttatccttcattctagtgatatgatgtgtcacatggactgatttgcatatgttgaaccattcttgcattccagggggataaatcccacttggttatgaatgatctttctgatgtactgttgaattttgtttgctagtattttgcaccaacattcactagagatattggcctgtagttttctttgtttgtttttgacatggagtctcgctctgtcacccaggctggagtgcagtggcacgatctcagctcactgcaacctccacctcctgggttcaagtgattctcctgcctcagcctccaagtagctgggactgcaggtatgtgccaacaagcctggttaatttttggatttttagtagcgatggagtttcaccatgttagccaggatggtctagatctcctgaccttggcatctgacagccttggcctcccaaagtgctgggattacaggggtgagccaccacacccggctagttttctttctttttttttcttttcttttcttttctttttttttttttttggtgtgtgtgtctttgtctggttttaatatcagggtaatattggccttgtagaatgagtttggaagtatttccttctcctctatttttcagaatagtttgagtaggattggtattagttctgctttaaatgtttggtagaattcagctgtgaagccatcagaccccaggcttttctttattgggaaactttttattataccttcaataacattacttgttattggtctgttcaggttttggatttcttcccagttcaatctcggtaggttgtatctgtgtaggaattttttatttcttctagatgttccagtttattggcatgtagttgttcatagtagccactagtaatcctttgaatttttgcagtatcctttgaaatgtctccttttcctttctgattgaatttttttgtgtgtcttctctgttttttcttagtttgtctggctaaagg

SEQ ID NO: 6888 - DNA, 1064 bp, Homo sapiens
tgagactatcttcctggcctaagagatggtctgtcctcaagaatattccatgtgctaatgagaagaatgtatatttttcacccgttgaatgaaatgttctcttattgatcattaggtccatctggtctgtagtgcatattaagtctaatggtgcattgttgattttctatttaaaatatatgttcagtgttgaaagtgggtgttgaagtccccaggcattattatattggagtctgtctttctctttaggtctagtaatgtttgctttatattatctggatgctccagtgttttgtgcaagaaatatttgcaattttaatattctttggctgaatttgaccattttattattatataatgaccttctttgactcttcttacagtttttgccttgaaatctattttatctgacataggtatagctattcttgttttttgtttccatttgcatggaatatttcatttcatttccttcatttttagtgtatgttgtttttatagctaaagtaaatttcttatgggcagcatatatttgagtcttgttttaatccattcagccactctctgtcttttatttgaagaatttagtccatttacattcagtgttattgttgaaaggttaggacttaactacttccagtttgtcatttttcttctgattgttttgtacattttctcttcctttcttcctctcttcctttttagattagtgatttcctctggctgtatgttttaattccttgctttttattttttcaatttctattataggtgtttgctttgtcattactgtgaggcttgcaaaaatattttatagctaacaacgttaaattgataaaaactctaatctcaaagaagagggaacaaaaggaaaacaagcaaagaaaaaactaaaaaattctgtactctaacttttcctctaactccctcctactttttgactttttgttgtctctatatcttttcatattgtctatctttcaaaaattgttgtagttattatttttgatagatttttcttttggtcctcatgctgaaaatgtaagtgatttacacaccacaat

SEQ ID NO: 6889 - DNA, 1048 bp, Homo sapiens
aatgtattatgactatagatacttcattacttttttcttttaaattttatactacagctaaaagtgatttatataccactgttactgtattactgtattctgaatttgactatagatttacatttactagtgagttttatattttcatatttttaatgttgttacttatcatactttcatttcaaattgaagaatttcctttagtatttattgtaaatcaggtcaagtggtggtggactctcttagctttttgtgtgtcttgaaatgtgtttctctctatttcacttctgaaggacacctttgctgatgtaaaagtcttggtggtgtttttttcctgtaagcaatttgaatacatcatccttcttcctcctgttttataaggttgttgttttttttaaagggggtagggatttccattaatagcctaatggagattccttgatatgtgatgattctgttatctcttactgctgaagattctctgcctttgactttatttatttatttatttttgagacaggatcttgctttgttgcccaggctagagtgcagtggtgtgatcatagctcattgtaacttcaaattctaggtcaagcaatcctcctgccttggcctccccaagtagctaggactacagatgcatgctaccacatccagttaatttttttagtttttgaagatatggggtctggtagctaggactacggatgcatgctaccacatccagttaatttttttagtttttgaagatatggggtctcgctatgttgcccagactgatcttgaactcctggtctcaagtgatccttctgcctcagcctttcaaagtgctgtgattataggcatgaaccacccagtcctgtttttgacttttgacaattttattatattttgtcacagagtattttttggattcatcttacttgagatttttttaagtttggaaatctggatgtctgtaaccttcccaatatttgggaagttttcagccagtatttctataagtaaactttttctccctttgtcacatcttctggtgatcccataa

SEQ ID NO: 6890 - DNA, 1051 bp, Homo sapiens
aatagcagtcaggacaaagaaaattgctcaagaaattaaataacgtgctctggaatgacttttggataaataatgaaattaagggagaaatcaagaagttctttgaaaataatgagaacaaagctaaaacataccagaatctctgggatatagctaaggcagtgttaagagggaaattcaaagggctaaatgcccacatcaaaaagttagaaagatctcaaattaacaacataacatcacaactgaaataattagagaagcaagaacaaatcaaccccaaagttagcagaagacaagaaataaccgaaattagagctgaactgaaggaaatcaagacgcacacaaaaaaaaaacatttaaaagataaacaaatctaggagttggttttttgaaaatattaataagatatgttgcaagctagacttatttttgcagttgaaagtaatggcaaaaactgcaattacttttgctccaatgtaatagcgtgccaaccaacaacaacaacaacaacaacaacaacaacaacaacaagcataggtcctgatgaattcacagatgaattcaaccaagtgtacaaagaagagctggtactattcctacggaaactattccaaaaagttgaggagaagggacccctccccatattattctatgatactcatatggacaggaggcagggaaacactgggtagaagagggcagtccctgggagggccccaccctcaagcctggaacagtagcccaaagggagaaatttctatcaccatatttctgctcgaatgttgccttttccaaaatcgccctggcccaccccactcccctgattctgtacccataaaaaccacaggctccactggcagaggtgctgcagaaaaggagagaagagaagaagcagccagacattggagagaagcagcttgacttcagagggatggcttgacggggaatatcagaggagagcttggctggggagagcaagactccggggaaagaccaccttctcacctcatattctttccacctccccttcccactgcaagccactttcatt

SEQ ID NO: 6891 - DNA, 1108 bp, Homo sapiens
atcatcagcaaacagagattactttttctttctgatttagataccttttctttttcttgcctaattgctctggaccttacttccaatactgtcttgaatagaaatggtgagagtggacatcccttccttgttctggaacatagaaggaatacttacagctttttatcattgcatatggtattagctgtgggctattcacatatgatctctgttgtgttaattttctcctatacctagttgttcagtattttttatcatgaaagggtgttgaactttgccagatgtttttctgcatctattgatgataacataatttttatccttcattctgttaatgtagtgtatcacatttattgatttgtatatgttgaaccatccttgtatctcagagataaagcctacttgatcatggggtgtggtccttttaatgtgttgttgaacttggcttggtagaccaatggaacagaacagaggcctcagaaataataccacacgtctacaaccatctgatctttgacaaacctgacagaaacaagcaatgaggaaaggattccctatgtaataaatggtgttggggaaactggctagccatatgcagaaaactgaaactggaccccttccttacaccttatgcaaaaattaactcaagaaggattaaatatttaaagtaagacctataaccataaaatccctagaagaaaacctaggcaataccattcaggacataggcatgggcaacgagttcatgactaaaacaccaaaagcaattgcaacaaaagccaaaattgactaatgggatctaattaaaccaaagagcttctgcacagcaaaagaaactatcaccagagtgaacaggcagcctacagaatgggagaaaatttttgcaatctatccatctgacaaagggctaatatccagaatctacaaggaatttaaacaaatttacaagaaaaaatcaaacaaccccatcaaaaagtgggcaaaggatatgaacagacacttctcacagaagatgtttctgtggccaacaaaaatatgaaaaaaagctcatcatcactggtgattagagaaatgcaaatcaaaaccacaatgagacaccatctcacac

SEQ ID NO: 6892 - DNA, 1032 bp, Homo sapiens
tttgaatttagtttgttctttttctagttcaagttgtaaagttaagttgcgtatttgagatctttcttcttttttagtatgtttataactaaatttcccttttatccactgctttacagtgttccatgagttttggtatgttgtgttttaattttcacatttctctaaatattttctaatttcattgtgattttgtctttcaaccattgatcaaatgtgtgttggtaatttccacatactttttaatgttcaagtttttcttctgtttttgatttctaactttatcccactgtgggtggtgaagatactttgcacatttatcttttaaaatctaccgagatataatttgttacctaacatatattctgtcctggagaatgtcttctgtgcccatcaggagaatatgtattctgttgtttttaggtagaatatcctgtatatatctattagatcttggtggtttattgcattgctctagacctctgtttcctttattatcttctgtctgattgttctatcctttactgagaatggagttgaattattgttttaatcatttggatttctctctgttcctattgttactttttgtcttaaagaacatttttaacttaaatatagtatttctttattagaatttgtctatgtctttttgcatatcttttaaaattttttctcttgttatattttgtgtatgtttcttttataccaaaaatatctggatattttggttttgttttaataatctgggaatctcttaattttatgtgacagggaaataaatggaaattttcttttttcttctcttctgatttttattaattgaatgagcttcttattaattgaatgagcttctaatgttcttttattttccttttagcagtttaagaattatagttttttttatttaatgattactcttaaattttaacaagcatatttccctaaccaacaataatattaatcagtatgtcttttatcctcctgaatcatataggagaactaaaaaacttcaaaacttttacttatcat

SEQ ID NO: 6893 - DNA, 1049 bp, Homo sapiens
tggcagcaagaggatcccctgagacctattctccagacaaacaacgctaactagtgaaaaaatctttaaaaaacaaacaaccgactgggcacagtggctcatgcctgtaatcccgacactttgagaggccgaggctggcggatcatgaggtcaagagatcgagaccatcctggcgaacatggtgaaaccccatctctgctaaaaatacaagaattagccgggtgtggtggtgcacgcctgtagtcccaagtacttgggaggctgaggcaggagaattgcttgaacccaggaggcagaggttgcagtgagccgagatcctgccactgcactccagcctggcgacagagcaagactccatctcaaaaacaaaaaaacaaaaaaacaaaaaaaaaaaaccatttaaaatacctggaaatagttttaagtgcatacggaaaacaaagaaacacttgttactggtggagggtcttgagtatgagttgcccgggtccttggagatttggacaaagtattgaacaaaatgcacaaagtagcagaggaatgaaatgcagcaaagaagcagcaaaagcagaaacttattaaagagagaaagcactccacagagtgggaggaggcctgagcaagctggtcaagggcctggatgcaaagttttctgggttttaagtacccaatttgaggttcttattggctaccccttatctggaagaaggttttgtctgtggctaaaggctgaggtgaattggcagcccatgcagataaagggatggtccctgctcggcctgtggcctatccaaggcactctccctttccatctgagatgtggcggaagggggagggctgtagggagagtagcttttgatcctttgttactcagcttggggagagggttctttttttctttttggtttagttttaggaagtttgtattaattggcctcaggttccctgcccccaaacctaggcgttttccttttgatccagctttgggaagtcagcatgaattggccctagattttctgcccccagaccttggtgttttctgttttaga

SEQ ID NO: 6894 - DNA, 1026 bp, Homo sapiens
ttgatgagaagtcaaaactgtacaaacttattttcattatagtcacattttgaacactttatatctttatttctctttactatttatttctacagtggagcatttctaatgcacttagaatattcttttagagagatatttttaagaattccaggataccaatccagctatgtaattctgagaaataatttttagaaccacactacagtggagtacctctcaaaaactacatggctctaactcaagtttataacagtaatataaggaaaatgactgagaatttcagtaggaaatttaagatgcagcaagctaaattacagtcttagagaattaaattaaaatgttggcaaactgctttagatcatgttataaattctatgaaatatgacaataatgtaaaataataaaaaaaggcttctgctactttttccttcatttaaatgaatgtgtgtgtgagtttgtgtgtgtgtgtaactgctttttatgttggtgtagaaagactatgtaattgcatggttattatgttatgcaagtatacatttgtaccatgttattgtgttgagtaatggtacagacttacggcattcaagttctggctttctacctatgcatttatagcaattaatatttattactttggtcctaatggcttgctttggaaattaacttagaatgacttagaagcacacactcatcaactactaatagcttatggtacaatagcatccaaatttcaaatctatacttggtaagtattttcaatcaaactatgtaagattataattaaaaactttaaaagtcgttatatattttgcaaatttaccatttgattatttttattatttattattgccatcctaaatttttctactagtataaaagtatattttgttcttaaaaatgccaagttattgccataaaataacattaatttccatagacgtacaggttagcaagattctactcagtctatttctctaaaattgtttgagtaaaagtgttagcttcttatttcttatttctatt

SEQ ID NO: 6895 - DNA, 1029 bp, Homo sapiens
ctaggaaagggaactccctgaccccttgcgcttcccgagtgaggcaatgcctcgcccgcttcggctcgcgcatggtgcgtgcacccactgacctgcacccactgtctggcactccctagtgagatgaacctggtacctcagatggaaatgcagaaatcacccgtcttctgcctcactctcactgggagctgtagaccagagctgttcctattcggccatcttggcttctcctcccaacaagttcttttgacactaaacttttaaagtagatgtaaaaatatccattttaactattaaaataacaaagtttatcttccaaaccagtagagaaaacaaatagaacagaagtagtaatggagaaaggagaggagaggagtttattaattcaaattaaatgaaaaaaaggagaaagaaataagaaatgaaaatcaaattcaagtataatagtaaacatgataaatgcaaatggttcaaattcactaggttacacagggattatcagactggataataaatggaagttttcctttcttttttactaaaacacccctaaaacatgaagagacagtactgttgaaaatgaaaggatggaaaatgttaaacctgatatgtagcatcagtttggctctccggaatcattctagactgtcctcccttctcatccctctctcacccccaactctcacctcagctctatgccatggatggtgatttatgtatggactacataaatgagcctcttttgctgtgcagcttctgatggtctcaacctgtgggggacacaatctggagcttagagtgttggcagatagagaggtcagagcattgttctcctaagttccttcctgagagaccatagaatggcaatatgtgtgttcctctgtcaaaagccaaaactttagtaagatggccttccacagtattctgtggcctaggaagatttatgaatgcagagttctttctgctttcaaagctaagtgttttaagaaccaaaccctttgggaggaacaacaaaaattggggtgcttt

SEQ ID NO: 6896 - DNA, 1034 bp, Homo sapiens
tcactgacataaatattgcaatgtgttatagaataatgaagttactgataatgtaattaaatattcactgcttctggattagcatttctaaatcactattctagtgatgtaatgtcattattcacaaaacttcatggttcattgccaaccctattccttcttcgtatatggaaatcaccatcttcttccactggaaatattttctcagattagagatgccattgtttatagattttcaattactgtagttgatctaatttcacctaggagggtatatattgattataaatgtttacatgggataattacattttatcggttaaataggaaccagtatatatgctattggtttagtagcaatgcctttccaattacagcccacctttatatgatataaattgtctttattctttccccttagcatttttagagtttttaaggacatggtaatttgtattgaaagttacactactcagtggtattttccaagaagactctgcaaatcttttacattctgtgttactagcaatgtgatataaatcagttaacatccataaccgatagctactcatctacaaagagtcttaaagagtaaaacgtacaattcagaaatctgaactctggtgttaaaaaatcctcaagattattagagcaactaccatttgaaaaacagatctgaactatgaagttctgtatcagaattttgattttgaaaaatttctgtaggttaaataacaagaatcaagaacactacataccatacttttggacaaaagtttattataaccctatattataataggccaagtatatcacagtggattcattgttattactaaaagtatgcattcatagtttcagtcactttaattatcatacatggacaatgactagattttttattattaaagatatgtaaagtaaaatacataatatatcaagaatatacatcactgccactaaatagaagtgttttcattgttggaaatttaaaattatttacctattatgaaaacgttagttcttaaaaggat

SEQ ID NO: 6897 - DNA, 1045 bp, Homo sapiens
tggcccagaaatttaactagatacttactcaagagaaatgaaaacataagcctcaaaaacttacatatgaatgtacatagcaatattattcacagtaaacaaaaagtggaaacagctcaaatgtctagcaactgattaatgaataatcaaatcatagcatatccatacagtggaatattatttgctaataaaaaggaatgacgtacagtcatatgccacataacaaaatttcatcatcagactgcatacacagcaatggtcccaagagatcaggagttataggaactgaaacaggacgataaaaaaagaagaacccccaagtaaattcatagtaaacaggtcagaagaagctgttgcagacctcaagaagctccttaaaaagtttgaaaacatggacctcaatacctagtggtcttaactaacagagaagaatgtccatggtgtattatctgcttaaaagcaaatctatgatgaaaattaactgaccatatcaccgtggacacatttctgaaaagggtgacaattcctcaagaatagccccacacaagtcctttaggaagcattccagaaaaaggcatgcttgtctaggagatgacagcttcatgaatgttattgctcctgaagacattccggtgtaataagatgtggaggtggaagacagtgatactacttaacctgaagggtaatatatgcatctgtcttagtttttttaaaaaaactttaaaaagtaaaaccaaagttaaaattttaaaaatgtgaaagtaaatcaaagcttatagagtaaagacctaaagaaaatatttttgtatagcagtatgtatgttttaacctgcgttattatggaagtcagaaaattaaaaaaattacaaagcttataaagtaaaataattaaaaagtaagctaaagtcaatttattactattattattattattattattattattattattattttgagatggaatctcgctctgtcacccaggctggagtgcagtggtgcaatcttggctcactgcaacctccgcctcccgagttcaagcaat

SEQ ID NO: 6898 - DNA, 1641 bp, Homo sapiens
attaatgtcctaggcttccacattcactcactactcactcactgacaccaagaacaacttccagtcctgcaaacttcattcatgataaatgccctatataggtatgacattttaaatcttttatcctgtatttttactgtaccttttctatatttagatatgtttagatatatagacacttaccgtagtattacaattgcctacagtcttcagtacagtaacatgctgtacagtttgtaacctaggagcaataagctgtgctatatagcctaatatactccatgatgttctcacaatgacaaaattgtctaatgatgtatttctcaaaatgtatccccgtcattgagtatcacatggctatattaatatgtatagtaagcttgaaccttgcatgcattattctaagtgaaagaagccagacacaaaaggccacttattgtacagaatgtccaaataggcaaatccagaggcaaaaagtagttagtggtttcagacactttgagagtagggaatgagtagtgactgctaatgggtatggagtatcttttaaggaaaaccaaaacattatggaattagatattggtggtaattgcacaactgtatagaaaaactaaaaaccgctctttggacatgaacatggcgaattttatggtatgtataaaacttattttaaataaagaatcaaatgaagattataaaactgaaagattcagtaagagaaataaaaataatttgctggattagccagtagtaaagtagagatgacagagaattgaatcactgaaattgcggataaaacaatagtattcactctgcagataaaatagagtgaaagattatgaacatagcatcagttcttacatgataggaactaaagagccaacattaataccatctgagtcacaggagtggagaagagggtggggctgaaagaatatttgaggaaataaaggctgaaaactatcccaatttggcaaaatacagaaacctacaggtccaagaagacaattgaacaccaaagaggttaaatgctaagaaatccccaccaaaatacatcataattaagtttttgaaaaatataatcagagaagaaaatcttaaaagcaaccagaaacaacacactacatattgacaccaatttgaatgtcagcaaatttctctttttaaactatggagtctgtaaagaagtggcataatttccaagtgctataagaaaagaacttcaaactgtgaattctgtgtttagagaaactatccttcatgaatgaaagggaaacaaaaacactgtcagatgaatgcaaactaaaatcatttatctgctacagaccttcctttaaaattgtgtaacagaagttcttcaaatggaaaggaaatgacaaaggaaagtaatttaaagtataacctacataccattggctatcctcttcctcatgaaatttgtaaatcttttatgattgaaacaaaaagtataatcctatctgatactcagtgcaatgatatttaaaagttgagaaggtaaaggtaaaaattggacatgtggtttcacacttcattctaagtggaaaatgctgatactggtgaactactttaattcatatatgtatgtagcagtacacagagcaaccactatggaaactacac

SEQ ID NO: 6899 - DNA, 1069 bp, Homo sapiens
aatacaaatctggaagacaagcactctgtcctatttcttgatagtttctgtagttttagcaaagcatcttgcattgtagagggatctcaattctttaatgactgagtgtaatatatagcatttttcaccaaaaagagtcatttatcctatagtaaaaaaaaaacaataaaataacactgaaagcatgcagagacttgggtgaaatttagaagctttggaacatgtatttcatcagtaagttatttactttgtttatgtgatagtcctgacatggaaaatcagtgtaagccaagatagtattgacagaaagagcataataaatagaaaaggggtacatgaatcagattatttacattttgaagatggtggctgcaatgagtactgcacttgaattaatccaaaagatctcccttgagctgaaagtgtgtgtagtcataattgcgtgacctgtgacacattgtctttgtcccactggcaggttacaaaattggcactgaatcaagatagagtaattataggaaagtagaaactgtctggatattccactgaaagctgaagatgtgatccattcttgatttgctttgctaatagctttaactttgagaagacagagagaatagtaagataaacaaccaacaggtgggggatgtaggagtcctgggagagagaaaattatcatgccatttgagagtatataatataaggaaaagagaatagagaagtgaagcatttacatacccccaggttttggcaaaatgtattccaaaatgtttacaggaaagctattttgattctgtggcaagagagctaaaataaaataccctaataaatcattcattcatttattcagtttaagtaatggtattagaaagggtaaagctataagtgagttaagccttcaaaatgaactttttttctttttttgttaggataacctgactgatacagcaaggttatgctgcagatatgatatatcttaactttgtaatggcatttatgaatatctggtgttcttttgaagttgacagaaaaatggacactgggtaatagcatagctattgttggtggt

SEQ ID NO: 6900 - DNA, 1049 bp, Homo sapiens
tacccacatttggatgaaacagattcttatactatattttattcactcattcattgttcattcataaaacactgttgactatcaactaagtattgtggggaatgaaaaacaaaaataggcttttgccttaaagaagatcccagaaaagcatggagacataaagagatggtgccatattaatatcacaaataattcatagaagaggtgatcatttcaaagttgaggtgaggtagaaggacatttgaaggtggaggagagaatagatagggaacctatgcaaaagagtcatgtagtaggaggtatgaagacaattgcaggcagagttagtcactgctttgttttttatgtatgtgtatttttaaggagtattatcctaaagtcattcaaagagttgtatgccttgtggtgtttggaaaggtagctagtatcaagtttggggaatgataccgtatttgaagtaatagtattaagttgaagaattatctgtattcatatttgatagaatcactgactctacctggttgtcaaatttaagcgtagatattcttttcttttgtatttatttatttatttatttatttatttttgagacggagtttcgctcttgttacccaggctggagtgcaatgacgcaatctcagctcactgcaacctccacctcccgggttcaagtgattctcgtgtctcagcctcctgagtagctgggattacaggcatgtgccaccatgcctggctaatttatttttatttttattttttagcagagacaggatttcaccatgttggtcaggctggtcttgaactcctgacctcaggtgatccacctgcctcggcctcccaaagtgcttacaggcgtgagccgctgagcctggcctgattttcatatcatttttaattccatggtttgttttataagagattttgaatagcaaaacagttattatgtacaacaaataagatagtaacatctctttaatttttaaattttcttcacaacaatgtttatggcagtatgattataatctattgtattatgatcaatttgttct

SEQ ID NO: 6901 - DNA, 1025 bp, Homo sapiens
atatttgttccaaatgatgattcatgaacccaagaaaggattaaagaaagagttaatatcactatgcttttgaaaatggaaagactgcaaatgtctcagtttaagtgtctttacgctattctaactcagataaagtggtatgtaaggaggccatatgccacagagcccagatgttcttgaaccagtaaacattcttcaatctgaatcaggtaagatctttagcttttcttaactgcttcaaaccttaaccacctcaactttacagtttatttaaccaagctccttagaaactaacagcaggcacagcaaaatctgtttttaaaggaataaacagggcaaaatgaaattgaacctttacattaaattaacattattttatccctaatgttgattgttgtttctgttaaataattatgatgaaaagaaaaagtgttgatgcaatcacaacttgacattttgttgttaagcctcctcattttgttaaacctcctcacatcatctaattgattattaggtggctgatttcattcacctggctatagtaggccacctgtaaagcaactgtgcctatcctacagcatgactcttcagtgctctgaaaagagaaaagggctgagaagttgaaactgggagtctgtcatgttcttgattctattggtcattctgttggatcttttagaaaatcattttacctctctgaccttcagattttcaatctgtaacttaataatagcccttggcagtgaaatgtcttgaatggtgacttttaacatagcagcagtcataaaaatataagagtataactatataaaagggtttctaggagcttactcttggggcaaattgttttgccacataatattttttaaacggacaggacagttatgaaagattctagagagtgttgtcatgttaactgatcaaatatatttgttaggagcatttttattaatcagtacacatgacttagcctgttttaaacaatgtcttcaaatcttaaatatttcatttaaggatattaaaag

SEQ ID NO: 6902 - DNA, 1033 bp, Homo sapiens
gttgtaagttcagatatgctgatgattattatctgtgttaaagcagcctcaacactttccaaaatatattcatataatagtagctcattatctatattaaaccacaataaagttaatattaataccatggattttataaaataactttgaacgaagctgaaagcttcatttagtttaataataacgatgcttgaggaccactttggttttaataaaaacatggaaagtagcagatgagaaagaaccataaagatgccagtcgaatagctgtaataccaattagttggcaattgattcattcatcaaatatttattgactacccactatatttatgtaccatcacaccttggaccaatagaaactgaattaagttttaaaactacgatgaataagggtgcaaatgaggaatgactgattgataatcccaatgagtgtgggatttttctttgtggtgggtgatgaaaatgttctataattacatgacaacaatggttgcacaattctgtgattatactaaaaatcaatgaactatgtgcatccactctaaacatgttgattttatggtatgtgaattaaatctcagtacagctacttagaaaaacaaagctttattgatggaagacaacaatgtcataatgatattgatcataaagttattggctctcagccagtgttgaacaagtagacaagtgtgcatcaaacggtttatgagacaatcctaaagaagtcggactatttggatttgggattaacatttgctctactttgcatgcacaagaaaactcaggccttgtgacacagtatgcatgcctgtttttaaacaatcacaaatttacaaaaaagtatttacaagtatatataaagaatttttttcctcataccatttcagagtaatttgccacctgacacccttttatctcctaatactttgatgtatatctcctaaaaaaggaacattttccacataaccacaatgtagccatcaaaatggagaaattaacactgatgtacgactaccacctaatcctgact

SEQ ID NO: 6903 - DNA, 1018 bp, Homo sapiens
gtaagtaatgactcacaagttggaaagctgaaattgaccaataaccacaaaatgatttaaagatatcacttttttatatttcaaagaaatcagtaattcctgtgctaattaaactgtttcacagcataaagaaaaaactgaattttttccgaagcaagtgtaaatagttatccttttattatagaatgcaaaacctgacaaagatagcgcagtaaaaggatgccttgaaaaactgatgatgtaatttattcaagacaataaaggtataaaaagatctggtaaaagtctggaaaaaataacaatgaaaagtctaatggagtgtgaataattatcccagatattaaaacataaaactatagagattaaaacaatgtgggctttggcctcactacacaaattagttaaaaagaaaaagaatacagaaatagattcaaatatatgtggtaatttagtgccataataaagaatataaaataaatgaaggaaggatgacttttcaatagtagtatagggagagttggctggaagctgttcaaaaaatatgaattcaaccattcctctttatattaatttttaagttccagatagataaaatagtgtactataaaaaggcatacataaatacataagatcgaaatatgagtaaacatttttacaaacttgtaatagggaggacccacaaagaaaaagactaatcgctggtgactgcaacactgacacataaattctataaccaaacctcagtgaaagactaaatcaaactagcaaattatttatatcacttagaataagtatccctaacataaagagtcctgattaactaattttcttaatgtgctaataggaaactaggcaaaggaagtgaatgggcaattatacatacatacatacatacatacatcccaaagaaagaaataggaatggcctatatgaacatgaaaatatattcaatcttgctaataattaaggaaatgcaagttatgactatactgaattatcatttatgatttattagata

SEQ ID NO: 6904 - DNA, 1048 bp, Homo sapiens
gcagatacaggcaaaatctttgcgtgcccagagttttgtctactatttcctatttgacttcaagcttctcacttgatgttaatgaggatgacggtgatgatgatgaagactgacatttttgaactcttatataccaggcgttttttaagccctttacatttaatcctcacgatgacttggtcaaaagaattcgtgtgctagatccactaaaacgtaaactccatgaggtacagaatctttcatatatcatcagttttgttcactgctaaatccttggggactaaagcagtgcctggcatatagtaggcgctcaagaaacacttgttgagtgaagttatttgcttctcaaatgattttttaattatcaaggctttggagttttctgagcatctatagtttgacggtgatttcttattggtagtaacagattattattgaaattattaactaaatttatataatacattatagtttataaaacactttcacatacataacctcacttaaggcagtcagtgacatttttccactagaaatactgaaatacaatgtctctaccaaatgaaaaataaaatacagccattattacaatactaccattgttccatttcttcaatgagcagtaagcatttaaattaagaatgactagggtttctaataaggattgtcaagtatcagaattgttgggggtttttttaattgaaagaagaaaatactagaaaatatttctccagttggcttagaaagaaggaatttccatttgagttccaaatttacttaacaatctggaaaggtagctgcaagtctgattctggtaagtgtttgtgtctccgaaatcagtggcaacaaaatattttaaataaaccaagtaaagtttttgagtatgtaattaaaaatagaactgatgagatcacttgccaagaaccgtgaggatttgcattaaaaacaatgatttgagacagtcatgatttattcagcacattctacccaatgagagaacaattcgtatgaaagtcagggagtgctcagctatgttatagaaagtgtt

SEQ ID NO: 6905 - DNA, 1055 bp, Homo sapiens
tgatacatttggttttactcaagagttatatgggactcaacagatatgaaaatgactcatatgtagctatgataagccaaattatctggttgagccatggctcctataaatttaatgaaatctttactatccctgagcatcttaccaagtgttcctgtccatcattggacaaacaatgtaacaaagcagatcaacataattaaacaatatgcttcttaaattacctatgatagctacagctccgcatttgtggtcacattcggtcaataatactcaaggtccttttctagtacttaagacgcttgtcagctaaatgtcaagtggtctttcttccatgtccatttgtacatagcataactctatccatggagtgcttttgtaatttttaaaacagtttatgagaatgaaaagtcaagccatagactgggaaaaaaatatttacaaaacacatatctgataaagaactgatatccaaaatcttcaaagaactcttaaaactcaacagtaagacaacaaacaacccaattaaaaacaggcaaaatatctgaacagacacctcactaaagaaggtatacatgtggcaaagaagtatatcaagaggtgctcagcatcatatgtcattagagaattgcaaatttaaacaactgcaagatactgccacacacctattagaatggctaacacctaaaacactgacaacaacaaatgctggtgaggttgtgaagcaacaagaactctcattcattgctggtggaaatacaaaatggcacagccactgtgaaatacagtttggctttttttttttttaactaaactaaaacataagcttaccatattatccagcaatcaggctcctaggtacttatgaattgaaatgttatgttcacataaaaacctgcacacagatgtttttaacagctttattcacaattaccaaaaattggaagcaaggacaatcaagatgtccttcagtagtgaatgcgtaaacaaactatggcacatccgcacaatggaatataattcagcaataaaaggaaacgagttatcaagccaaa

SEQ ID NO: 6906 - DNA, 1106 bp, Homo sapiens
gtggcaaaacatgagtgggaatttcattctcagaccctgctggccccaggggcttgttcttaacccggagggcagtggtggtagtggcagtggtggtctgtactgggaaggctggctgccacacggtcacatcggagccattgccaaaggcttgaattgcattttctgcagtaaaacaggaggaaatccaatttcaaagtcaagcagcaaacgtaacagacaggatatacacagccagagaggcacactagaaattctgattatagcattggacttctctgaacaaaacgcatccatccatttgccctatacatgctgagagccagtctttggggtcagttgctcaaaaatcaattcagtcattacaccctgagctggacacttagctatgctcagaatgcaacaaatatttattgtgttcctgtttacgtgccaggtgctgagcaagatccttgccctaaaatatccatcagtcaagccctttgaaacccagcatcagtactgttacttgggatcataactgtcccattttccaagaaaattcttgtgctctgtcaatattctatattaaaaggaaactaattagtgctttttaaaaaaaatcctaatcatgagactgaggcaattccgtggcattcacattaatatggcaggcaaaatggaaccagtttctttaaaaaaaaaaaaaaaaaaaaaactaccccaaatctcatcagtatctagtgaaaatttaagtaagattattttttttctttctgctccagtcttccaagcaaaatctgcataattaggtaggagcagccctgcttaaatgaaaagtttaaaatgtaaaacttcaaaagcttattacaatttcataggattagattgtttttatggcaagattaaattggttgtgtgttgttcccctccccaaaatgaataaaaaacagtttctaatcaggtcttcggggatttggcctggatttagggtttttttttatttcatattcattgtataaaaaaccaaactcctccatttgggacctgaatgtgcaaattgttaatatatgactcttagttggcatttttctatatacaagacagaataatttaagcctaatctt

SEQ ID NO: 6907 - DNA, 1952 bp, Homo sapiens
gatggagtcttgctctgctacccaggctggagtgcagtggcaccatcttggctcactgcaacctctgactcctgggttcaagcaattctcctgcctcagcctcctgagtagttgggattacagatgctcgccaccatgcccagctaattttgtattttttcagtagagaggggttttcaccatgttggccaggctggtcttgaatgcctgaccttgtgatccgcccacctcagcctcccaaagtgctgggattacaggcgtgagccactgcgcctggcctgcactcaccacttttattgaacatcatactggacatcctagccagtacagtaaggaagaaaaagaaataaaatgcatacaaactaggaaggaagttaaatagtctttatccacaagtgacataattatacatatagaaaaactacaggaattttcaaaaaagctactaaaatgaacaaatggacttactaaagtcacaggatacagatcattataaaaaattacttgtatgtctatgaaattgcaactaatgactagaaactgaaattttaaaaaagattccatttacattaacagttaaaaaactaaaataatttaattttttttttttctttgagactagatctcactctgccaccctggagtgctctggtgcaaacacagctcactgcagcctcaacctcctgggctcaagtgattccaccatctcagcctccagagtagatgagaccacagatgcaagccaccacacttagctaatttttaaaagttttgtagagacagggcctcaccgtgttacccagcctggtgtcaaactcctgggctcaggcaatcctcctactttggcctctcaaagtgctgggattacaggcatgagccaccacacctatccttaaaaacatttaaaaaaaaatagctttaacacaaaaattgtacaatatctatatattgaaaaagaaaagaaaacaggctgggtgtggtggctcctgcttgtaatctcagtgctttgggaggccaaggtgggaaaactgcttgaggccagaggttcaagaccagcctgggcaacacagtgagaccctgtctctacgaaaagtagctggtcatgtagcacatgcctgtagtcccagcaacttgggagcctgaggtgggaggaccacttgaggaggttaaggttacagtgagctatgatcatgccactgcactccacagtgggtgacagagtgagcccttgtctcaaaaaaaaaaaaaagagaaaaagaaaaggaaaacaaacattgctgagacataaaagaagacacaagtatttaaagagatataccatgcccagtatattggtatggtatggattggaagacttaatatagttcaaatgccaaattcatctacagacgtgatgtaatttcaatcaaaattccagcaggcttttttgtagaaaataaaaaattggttctaaaatgtatggcaaggcaacagatctagaataaccaaaaaatcttgaaacaaaagaataaacttagttcatatatgcaaaaggaattgaagacttaaactacaatcaagactgtctggaattggcataagaaaagacttacaggtcaatagaaaaatagagagaagtccgggcacggtggctcatgcctgtaatcccagcactttgggaggccgaggcaggcaaatcacttgaggtcaggagttggagaccagcctggccaacacggtgaaaccctgtctctaataaaaattaaaaaaaaaaaaaaattagccaggcatggtgacacgcgcctgtaatcccagctactcaggaggctgaggcaggagaatcacttggaacctgagtggcagaggttgcagtgagctgagatggtgtcactgccctccagcctgggcaacagagcaagactccgtctcaaaaaaaaaaaaaaacccacacttataaagtcatcttattttca

SEQ ID NO: 6908 - DNA, 1027 bp, Homo sapiens
ccagtagctgggattacaggtgcatgccaccatgcccagctaattattttgtatttttaatagagatggggtttcaccatgtttgcccaggctggtctcaaagtcttgacctcaagtgatctgcccgccttggcctcccaaactgctgggattacaggtgtgagccgccacacccagcctaggattttttattgtcacggaagaatgcatatggcataatggtaagttaaaaagtaggatatgacattttcgtattaataataataacatttgttaagtgcatatgaagttttaggcactgtttagatgatgattacaaggtgtcttaaaagcaagggaaaatgcctgtggtataacggcatgcaagaaagcaggatataaaatgctgatgtttagtaagaattaatatgtatcaagcacacatgaagctcatcactttgtgtatcatttcactaagccttcaaaaaattatatgtggaggctactattattgtacatttacagatcaagaatgaagacagagaaagaggttaagtcatttgctttagggacctacctggtgagtgaaggagccagcattcaaagaaagggagtcttcttctacacagagaaaggactagaaggaaacagggcaaaatattagcagtggttgtatgtgggtgctggtgcgaggacagctctgtccttggcattgtctttggctctgagtaactgagaacctagaaaacaacagcttgagcaagtgaggggctcattttcttccattccaagaagtctgggggacacagccacggttggattggaggctctctgacaccggcagaacctggcctcaaccctctgagcatgtgagttttgttctcaggtttgtcacttgtgtctcaaggtgactgcccacctcttgggtcatttcttgcattcagagcaggaagagggggaaaggtgaagggctagaggtggaaactggctgaatggcccctttatcaaataaccttcctgtaagttccaactagcaactagtttcaca

SEQ ID NO: 6909 - DNA, 1049 bp, Homo sapiens
agtctcctttagccattttattatttctcttttctgatgaaagtacttttcaaaagtattgaatatgtcatgatttgagctggcaaaactatagataatttttcttctttcttataaaaccctggctggttcttgaacctgttgaccatttgggtcaagggaaagaggttgggggctgttcaggaggaaggtacaagaagggatggtagggacctctctggaggagagaatttgaggatcctctgctctgaagtggggtggggagagtgcttctcccattggcccttctagtttgtgtttcagatctgcccaggttgtttctttgttaacattcagccaggaaccccagggacactcgctttctaaggaccttcagtagccaacatctcagtgatgccataagacaaatcacacttcttcctctgtcaattggcatgccactctgtttcttaggcctcattgaaagtggagaattgaatcccaacgtcaaattcccaagtactgaaatcagagacagagaacaatacagtaaaatctttctaaagctggaataaatttaacttagaaatcttgtctgtctggctgtcagaaattttggatatagagagaaaacatattgtgtgttgagctccagctcgttgccaaacacttactcaaaccatctcatttaatctttccagcaatattcagaagtaagaatcacccctaatctatccacaaagaaggcaaggtttagagaggttgaccagttatccaagatacacagctaacagtggaagttgaatccaaactttcattttaagctgtttttcttgtattgactccacatttttatactttgataaacatgagtatactgacatttttatctttctaaaaatgtaaataaagaaaggaacatgctgctatgttccacagaaacaccctacagtgggattttgctatgttttcaaagtattcctagcaagcctgtattcctttaagcacgcatcaaacataaatagatgctgtctgtattaggggcccttgtttcctctgagaaagtggtg

SEQ ID NO: 6910 - DNA, 1024 bp, Homo sapiens
tggggtacatatgatgttttgatacaggcctacaatgtataatgattacatcagggtaattgcagtatccatcacctcaagcatttatgatttctttgtgttaagaacattgtgattccacttctagttttcttttttttttttttttttttttttgagttggagtctcactctgttgcccaggctggagtgcagtggcacgatctcagcatactacggcctccacctcccaggttcaagcgattctcctgcctcagctgcctgagtagctgggattacaggtgtgcaccaccatgcccagctaatttttttgtatttttggtagagagtagagatggggttttaccatgttggccaggctggtctcaaacttctgacctcaggtgatccacccgcctcagcttcccaaagtgttgggattacaggtgtgagccactgtgcccagccaacttctagttatttttaaatatacaataaactatcattcactgtagtcaccctattgtgctatcaaatactaggtcttattcattctaactatatttttgtatccactaaccatcccaaattttccccctctccccactacccttcctaacctctggtacccaccattctactctctatctccctgagttccattgttttaatttttagctcccccagattagtgagaacatgcaaaatttgtctttctgtccgtggcttcttttacttaacatgatgcctccagttccatccatgttgttgcaaatgacaggatttcattcctttttatagctgcataatattccactgtgtatatgcaccacattttcttttccattcatctgttgatggacactcagtttgattccaaatcttggtggttgtgaaccgtgctgcagtgaacatgggaatggtggtatctctttgatacactgatttccttttttgggggtaaatacccagcagtgggattgctggatcatatggtagttctatttttagtttttcgaggaatttccatactgttctccatagt

SEQ ID NO: 6911 - DNA, 1024 bp, Homo sapiens; identical to SEQ ID NO: 6910

SEQ ID NO: 6912 - DNA, 1051 bp, Homo sapiens
ggttggccttcttagcattcctccatgggagattctaggattattccagctgtgttacttcaaggattcttgaaactcttcttggacccatttgttgactgactgctttgatggactgtaaatacacatcattaaggctagatgccttaacgcatctagcatactgttttgactccgctagatgatgacatgtctttgtctttcaaatgcgaatttgatttttcggaaaatcaaattttgttaggcttgatgcgtaaagtggccattttggagctggagagtaaggggcaagaatggggaatgagaagactgggacctttcccagtgccctgtgctgggttggggtttataaaaaaccctccaaggcattggctttgttaggctgggctcttctgggtgtgcagcgttgtgtgtttgttttaatagtaaccaccattattttataataaaatgacggttggtggaaggtgagcactcctatccttggttgacaagctgggcagttgatgaagagatactctgtctgtaatcctttaaccagggatgtgcccagtagaggctagattcctgttatctctgtctagtgaactagtgaccaactaatgagcagggaggggtgctttagcatgtgcaaaatccgagtcaattgaactgacatgattcaagacctcctgggtgtgtaatgctggctggggtacttcaggaatgcaaagatgtgagattctgctcttcctcttcaggaccttccagcctagttgggggaaaggcaggtacatgatcaactccattacaaagtaatctaagtacagaggcagccttgatggggggcagggatcagtaaagctttcatcagagaagtggtcttgagctgtgccttgaggacaggtggctggtggtatgaagacagcatttacagggcccctaactggtgcaggctctgtgaaggaggctttatagagatagatgtatttttcaccacggtccaatgcattaggtttcattgtcttttgcacatgacaaatctgacaggctaaggacacattcaggtagg

SEQ ID NO: 6913 - DNA, 1029 bp, Homo sapiens
cttttctgcatcatactttctgctcattgtgtttctcttcatatgttcccactaccagctaactgaatgttgacaccccaaagagagaaaaattggttggtgagttagtcactgcttttctcttggacagagccctcaatttaagtcatctggtaggcacaccagtcattgttggctgcccttgggtcaagtggcctgccctgggccaaccagctgtgaccagggaagtgggtcagagagttcagagcagcgctgtccaatggaaccttctgtgatgatggaaatgttctgtatattatggtagctactagccatgtgtggccattgagtgcttgaagtgtggcttgtgctaccaaggaactgagtttttaatttcatttaattttaataaattaagatttaaattcacatagctgcatatggctagcggctaccatagtggacagcatagctctagaacatgggcccagtttttggcgattatgaataaagccactataagcattcacgaacagctttttctatgaacataagttgtcatgttcttggcctcttctctccactaaataatgtggtataacattctcttgagatcagttgtttttttttttgagacggagtctccctctgttgcccagactggagtgcagtggagcgatctccgttcactgcaagctctgtctcctgggttcatgccattctcctgcctcagcctcccaagtagctgggactacaggtgcccaccatcatgcccggctaaatttttttgtatttttagtagagatggggtttcatcgtgttagccaggatggtctcgatctcctgacctcgtgatccacccgcctcggcctcccaaagtgctgggattacaggcgtgagccgccgcaccggccaaggtcagttttttaaaaagccaattaatatctgatttgtgattctgaatctttaacatatttaaccgtctgctttttttttttttttttttaattcacagatgacatggtctttttttttttttattgatcattc

SEQ ID NO: 6914 - DNA, 1055 bp, Homo sapiens
cctgacctcagatgatctgcctgcctcagcctcccaaaagtgctggcattacaggcgtgagccaccgcaactggcctgtaatctcagctgcaactgagcacttttctgagccagacactgttccatgacctttacatgtattatttcatttcatctccacagtaaaccttgggaggatggtttcattattatcctcattttacagatgaggaaactgaggcacagagaagtaatttgcccaggttcacagagggagagccaggctctaacccagtgtttgactctaaaaccaggttttcctcagtattgacaaaaatgttttgtgaacctttctaccttcttgactacaaagtgataggatttatattttcatgggtaatagctgaaatgtatctttagctatcctaatcattatagtgtagcctatatggagaattaaatagcctctcaaatgtcaaagcaagcacattaaggaaggatctatgtagaaagaaaatgctaatagtgtgataactagtttgtttgttgatcctgtgcctgcattgactttcttgcaaaattcatatagttacagggaatgttgttatgtaatgaattgactagtagtagtttttccagctacggtcagttgatcaggtttctcttcttaagtgtttggaagatctgcagtttgggaagggaatagatacaggggagatctttgagcagatgcattgacatgtgtactcattgggaactatttcctccagtggtgagcaacctgaagcctttctcagtgtagcttttcaagagtcctagatccaatttcatagacatcctttcagagcatgcacagcagaggtgaaatggaggagaagcgtgtagggcaaaactaccttcttcaaagaagggagaaactttgtagaatcactggttcctagacgcttgtgttttggccaggccctggccagcaaaggctagccaaaggcatgctttggaggagaggtagtatcaagtttttttagagtagaccgtgaaggtgccagaaactaaggtgcactgacagcttggtctat

SEQ ID NO: 6915 - DNA, 1050 bp, Homo sapiens
caccatgttggccaggctggtctcaaactcctgacctcatcatcctcctgcctcggcctcccaaagtgctgggattacaggcgcgagccactgtgcccggccccatacttttttctttgaagccatatgaagacccttaaattatggagaggttactgaatggtaggagcctggagttttaaatacatacacatttctcaacttgatgtgaaagttactaacatttattatgtgacggatgctgggcacttttcacataatcctcatgaaaacctgggactacaggtgtccggctaagttagatggaattctgtttacgaaggaggaaactgaagctgagaggggttcagagactgtagtagagctaggattcttcacccaggacaccaaatgcagactacatctatagcacatccaagtagctgaattctgtccagctttccagttctacagtcagccccaggtcacccttgcacattctttcctgtcacctggctctctggcttcaggccccttcatgttcatcctctacagatttgtcctgtgttctatctcaaatccaaatctgccctgctggaggaagcggctcctgaatttactacctgttgtcccgctgagtgggttcctgtttagttcttcagcctcattcttcctgctccctgtcttattctgcatggccagcagtaccaaactatttggagtcttctttgccttcagtggacatctgagtgtctgctatgtgttaagcagcctgctagaggccaacaacagctttttatttttatttattaattttaatttttattttttcttgaggtggagttttgctcttgtcacccaggctggagtgcagtggcgtgatcttggctcattgcaacctacgcctcctgggttcaagccgttctcttgcctcagcctcccaagtagctgggattacaggtgctcatcagcatgcctggctaatttttgtatttttagtagagacagggtttcaccatgttggccaggttggtctcaaattcctgacctcaggtgatgcacccacctcag

SEQ ID NO: 6916 - DNA, 1059 bp, Homo sapiens
ccttcccagttcattccctttcatctcacactggctgttctcctgctgaagtggcttaagtccatggttcacacccatattactctccttatcagagggacttgggcacacctgtagtgttttcccctgaacgggcctttttaaaaatttccatagtctggctagaacttttcaaatctttaagttctacttcatttttgcttaacaactctgtctttaagtcatagctctcttctcgcattttactataatcaggcaggaggaggcaaacttcatctttgacattttgcttagaaattgcctcaggtaaatatccaatttcactcttaagtcctcccttccacaaaatactagaacatgcacaaatttcaaccaagttctttgccactttataaccaggatcatctccatattgtccaataacacgttccttattttcatctgagacttcatcagaatgctcttcacggttcatgttttctactgacattctgctcaggattacttaggaattctctgagaagattgaggctttttctacagctcatctctcttctttctgagtcctcaccagaatcacctttaaaggttcacacagggcagtgtaggctttttctaatagtatgcacctccaaactctttcagcctctacccattacctggttccaaagctgcttccacatctttagatgtttgttatagcagcacccctgctgcttggtaccaaaatctcgattagggctttccagaaccaatagtgtatacgcgcgcatgtgcttgcatacacaggcgtgtgcacacacacacacacacaaacacacacagttgacccttggacaacacaagtttaaactgtgtgggttcatgtatagtgtattttcttttgcctctgccacccctgagacctcaagaccaacccgttctcatccttcctcttcctcagcttacttaacatgaagataaggatgaagacctttataatgacccacttccacttaatgagtagtaaatacattttctcttccttatggttttctttttttttttttttgagatgga

SEQ ID NO: 6917 - DNA, 1031 bp, Homo sapiens
tgacaggctgaggctggaggattgcttgagctgaggggttcgagaccagcctgggcaacatagccagaccttgtcttgtggaaaaaaaaaattaatgagtgaatggattttagaaaataaaataaaaacaaataaaggaggcctggcaagggttaagtcacacagctggcagaggtggggcctggatctagactcaggctgcctggtcctatataattctgctgagctgccgccctgttacctgaacatcaggtaacagcaaagcacacactgccccacaactcaacacatgtttttccatgtagagttcttggggaggaactttggggacagggttaaattgccttaagaataagtaaaaataaaactatttttatgcttcaaatgtcactggaagtttgacaattgaattttaagaaacaaaatgaatttaagtggactctgatattaattatttgttacaggaatcgaaaaaagtttggagttcttaattctccttttattggtacttatgctagaacactattcactattgctgatcgagagacaaaaaacctaggtggcaattaggcctattaaaagcagatgtttgcagtttttgtctgcattttttttgggtgaagagcagccagactagcaaaaattttgttagtttcctaagccagtaaatttgctggcagtgtcttttggatggttttgctgacacactgaaagatcaggatggcttgttatcacagacctttcccttgagggtgggcacccctttggcctggcattcaggtttgagcactaagactggggtctctggcagtttgatttagagatgggaaccagcccgcccagcactttatccatctgccagtcatgatttgcatatttggcactcccagttcttcggaaattaaatgtcacacatcatccagaaaaggttgggacctttgttaggcctttcagggaggtgttctgatgtccttcatggccaccaatctgtaacatttttgagactagtagctgactattcaataaaaagg

SEQ ID NO: 6918 - DNA, 1035 bp, Homo sapiens
tctctcaagactgtgaaggaaccagcctcaggatcagccgatatgctggcagaataaaaaagatgggaagaatggcagagtaaagggatggaaagaacctgtgtccttaatggtattgggaatcactattaagccatgttggaaccgtcctacctccagacttgttctgaggtatgagtcagttgactcaaatttgtcatccgcagcaaaaaaagccaccttgacacatgcatatacacaataaaaaactcaagtcaaaacaaaactatgccatatatactattgtgcagctgttttcatttaaggtctcatggctgctgtttaatcatttctctattggtggacctttaggatatactagttattttgctattataaagactccagaaaatatctttcttttttaaaaactccatggactaggaacagaacgcattttatatattttgggatacttgtatgttttatagaataaatttatggaaatgaaattgctggatcagacattatgtatatttaaatttgataccactctgttgcttctgaaaagatcacaccaggttttttaaaaaaaattgttttaaagcaacagtaggagctagtgcccatttcctcacatattgaccagtgcggtctgtgtttagtattcacgtttgcctaggtataggtgaaaactcattttctgttttaaattgcatttctttgagtattaaagttgtcatctcttcattgagtataggttcagaaattgtagtctcatgtttattagctatttgtatatttttttcatgtggattttctctgtatcctttaccatttttttccgtattggatttaggactctttatgcattattggtttttatgttgcaggtatattctcctaggtagcactttgctttcttacctttgcttatactgtcatttggtacacaggcttaaaattttttaaagttatgcttagaaagtcatgctccaacctacatttatagaagcattattctgagttttcttctagctctattatcattagaaa

SEQ ID NO: 6919 - DNA, 1051 bp, Homo sapiens
ctacagcctgcagctggctgtgggttccccactccctgccctagaatctaggtttattgtattaatgcacataagtgagtgcaacaagaggtgtagtgaggctgggtatttttattggttataaagtggtcctggccttttataaaataaataggtcaactaatattctttttttttttttttaacaaaaaccggtttcaagtggttcttcaaaatatcaatgaatagtgggatctaaatttatccactagattgaatgcttgcctttaggctgaaatctaaaatcataatctttaatattataaatcagagacattttgggaaattgtagcccaagctttaagaataaagcactctagttctattttatctcatacgttttgtgtgtttttagtaagaggggcataaaatgtgcttgaaagtacaattaaagatagtatttatgtattaaaaggaataaaaaacgttgactgtggattcatagggaaacatcccatgatattaatctcatggatttttttcactttgatagtaaatactgttatgtatggatataatatgtggactttaaaaataagagatgaattttcctcacacacaacctagcagaaggtttttgtgtttgtttaagccatttggtaaagctattttgattcatgtccttcacttgtatttttagtggcagcaatccaacttaatatagcaccaaaaaaaaaaaaaagagtacttttacttcccattcagaaataactgctggcagcacacctgcattttccttgagttttaactgcacttagatttttaagagggtatcaatatcatgattgtcaatatcatctttcttcagtcaagtgtttttgtgtctactttgggataatcaaaattgggaaaaaccaaaaggtttatttctagtgttggctacgattttgtagggtcacattacacttgatgatttgatttccaattctgtaatttttatggaaaattggtaccctggggtgaagagtattagaaaatgtaaagtgtatatagctttgctatttaaagtttg

SEQ ID NO: 6920 - DNA, 1048 bp, Homo sapiens
gtgataaaatacacgtttaaactctacagaaattagttcgaaagagatctttgaaaaatcattttaagaaggcaaagttccaaacagggttacacaggagtctactcagtttcctggccatacaggattaacgctgtgccttacgttagagcaacaaacttgactgtccgtgtatatataggtgagggacaaagggtttctgcagccaagcactgcactccattccgctgcctgggcgggccttgagcaggaaggtccctcttgcaccacctcctccacttcagttcagctctctcatgtcttccaccaagaggacatggtctttttccacacagatcacatgggatggtgaatcttcttactcatgaaaaacagcccaaggtactgctaatttgggacgttttatttattggaaaggttctttcaagggaacttttctgcaagaccaagcaatgtatgtatttttctttggtaaattacaatttacattggcacaaaaaacacatggtgactaatgtactttgctctaggacaattaaagaaaatgtattttatcctcacaaatccagtgaagccttcattttatttctaaaagtttaaggaaggtctagtctaccagttataaaaatgaaaaccagttcaactctaatataaacattatttacatttgtttataaaaatagatttgagtttaggaaaagttgaacaactagttatttttacttcagttattaggtacaatgaattccttgatttttcaaggctgaccctgtttccttggttaacaatttcaatttaggccttataggaaaaaacgtaagggatcctttatctgcctccaactaggtaagttatttgataccactgacagcttaaaaagtaatgtcctaacctttctgaagattctggttgccataaccatgctactacagtctgttgttagtttgctctattaaaactaattggtctggagaaaacctacctgcagttgtacgaggctgttactggagtagcagatgttagctgatctaacatacttggaaccaac

SEQ ID NO: 6921 - DNA, 1027 bp, Homo sapiens
catttgtagttgatgctaatcagaaaaaaagtttctcggaccaggttgacctcaagtttttctaaaggatgaaagataccactgagtttttttttttttcattcttttaattgttgggaatgaactaagaaatacaaataagtccaagtgagggtcactgacctgaaaagaggggtgggagctggaaatatatcagagaagtggaatgattcaagtagacacaaggccttgtgcagcaagggatattttatttttagttacaaagaaactaccaaaaggagtattttgaatggtggagtattttagttaaactgatgtgtgtaaataatgagagctcaagaagctcaagccctagtctcagcagaggtcaagaagcttggagcccggagcttggaataaggctgcctgttggcaggtctccaagggcagggaccgaagtgtgcctgtgtgctgtgagtgagtccagccctctgatggattccatgcctccagcaaggaggtaagagggaatgaggcaggagcagggaagattaggaggaggaatatgaaagctacaagctagggaacataaaagtttcgtaaggaataatagtaacgtggacttttgaggtgatatacagggaagatgcttttattttacaacttggtagtagaacagaagctaaattatttggagtcgttaatacccacagtgaacatcaagttgggcaaagggatgggagatcttcccttggttagaaagtgaccttctcagcaatttggtattctgtaatgataagtctgtgatagtgcatgattttagggaatggcaattaatggttgacctacttgggaatacaaataccacgtgttcatttgtacaataagtgctttgtaggtgagattcctgacacaccccttcttgtcaacagagttatctttagtctcttgttatcactatagaaataaaaatatatgtatttgggtagtcgagtaacagttgaattatttcttaccaagaaaaaaagataaaaaataatatgtaagg

SEQ ID NO: 6922 - DNA, 1023 bp, Homo sapiens
tttgcagttaactggaagaaaaatggaagagtaatcttccctctttaaaaataaaatagaaatctttgcatatgacttatatagcaactaactcttcagagaatcccaaaattcatagtatagttataggcacaaataactttaaaaaaaaaactgaattgtttttgagacagcatctcactgtcacccaggctctggagtgcgctggcatgatcatggctcactgtagacttggcctcctgggctcaagtgatcctcccacctcagtctcccaagtagctgggactataggtgcaagccgccatgcctggctaatttttaaattttctgtagagatggggtctcactgtgttgctcaagctggtcttgatctcccgggctcaagcggtcctcctgccctagcctctcaaagtgctaggatcacaggcatgagccaccacatgtggcagcacaaatttttttggtttacctttatttatacttttaattttttttttgatgtggagtctcgctctgtcacccaggctggagtgtggtggcacaatctcggctcactgcaacctccacctcctgggttcaagcgattctcatgcctcaacctcccaaatagctgggtgtacaggtgtgtgccatgacttgtggctaacttttgatttaaatttttttttttttttttgaggtggaatcttgctctgtcgcccagactggaatgcagtggtgcagtctcagctcactgcaacctctgcctttcaggttcaagcagttctcctgcctcaccctcctgagtagctgggattacaggtgtacaccaccacactcggctaatttgtgtatttttagtaaagacggggtttcgccatgttggcctggttggtcttgaactcctgacctcaagtgatccacccacttcagcctcccaaagtgctgggattacaggtgtgagccaccgcatctggcctatcttgatttatttataatgactatctacagaaacaactcatagtctgtggggttttcttagtg

SEQ ID NO: 6923 - DNA, 1043 bp, Homo sapiens
atggaaacgcatagatcttttaaaaaattatattttttgagacaggatctcactctgtcactcaggctggagtgcagtggcgcacgcatggctcactgcagcctccacctcctgggttcaagcaatcctcccacctcatcctcccaagtagctgggacttcaggcatgcaccaccatgcccagctaatttttctgtttttttagagatggtgtcttgccatgttgctcaggttggtcttgaacccctgagctcaagagatccacccacctcagccttccaaagtgctgggattacaggcatgagccactgtgctgaaatgcatagatcttcagtgtgcagtagggtgagttttcacgattgtatgcacttgtgtcgtcactgcctaaaacaagaaattgaacatttctgagttcatttctatgttctgtgttcatttctgtttcatgagagagctcaggtagctccctcatgcttctttctagttaactcctcctaccacaaaaccactcttctgatttccttcaatatggaatagttcgcctattttaaaaattcatctaagtagcatgaacagtatgtattcttttatacctggtttcttttactcagtatttttgagattcgtctaatgagagccaatacttctgcttagttgtaactgtcttgctatactttctttgcttcttaattatttttcttaagaattttaaactatagacatcatgacatttgttccctaaatatttagtatgcatttctaaaaaggacatgtaaacattttttttaatttaaaaatttttttgagacaggtctctctctgttgcccagggtggagtgcagtggtacgatcacagatcactgcagccttgaccttctaggctcaagtgatcctcccaccctagcctcctgagtagctgggaccacaggtgtgcactaccaggcctggctaattttttcttttttctagagatggaggtctcactatgttgcccaggttggtcttgaactcctggtctcgagctatccttccaccttggtctcc

SEQ ID NO: 6924 - DNA, 1075 bp, Homo sapiens
gatagtggtcctagaaaagataccaatatgcatctacctaggaaatttgcagcatgagttaaattaagtccagccttgttggggaagtgggggtgagggtccaattaggaagaggcaagttgaggcagggcgcagttctaaaggagaccactgggccatcaggccatgagcttggagtcattgggcagctctaatgaattcttcagcctgcacacctggccttgatcctgagcgcctcccacctggcacccacatctcctatgtgggcagtgactttctgctctggaatttcctttggaagcctcattgggaaagtcatcccaactcatacttttttctggggtttcattgttgcctaaccttagattataccagctgggattgccttgaaatgtttccttcaaaaccatgttgttctcctatataaacactgacttggtagtatcattactgggtcgtccactatttagtgagttgctttctcctatttgggagcacattgcctggtctgtatgcagtgcttaaagggacagaaaacaggaaggtaagctggtagccttcatgtttggatttggagaaacaaggacttctttgaccttgaccataacattggactttagtaagtggtgcttcaattcttgttctttaagcactaaatgcatgagacaaaagtctaaggcataattctcaatcatcagcatcagtaccatttgagatattgttaaaaatgtacatttccgggccaggtgcggtggctcacacctgtaatcccagcactttgggaggccgaggtggcggatcatgaggtcaggagatagagaccatcctggctaacacggtgaaaccccatctctactaaaaaagtacaaaaacttagccgggcgtggtggcgggcgcctgtagtcccagctatttgggaggctgaggcaggagaatggcgtgaacccaggaggcagagcttgcagtgagccgagatcgcaccactgcactccagcctgggtgacagagtgagactccgtctcaaaaaaaaaacaaaatgtacatttccagaccagctgtataagcatgtttgagg

SEQ ID NO: 6925 - DNA, 1047 bp, Homo sapiens
tatgtaaagcgcttagtattgtgactttcaataaacagtagttatctacatgattattgattatcagagctgaagtttcctgagtattctggcttgtgccatcatccattcatcagttcatattgcatgggggatgcaaagataaataagatgcagcttgtgtcctggggagtgcccaggtagtgacagatggtgtatttaagttgatgattcctgggataattggagaactatggtcacaggtgaccatcttgaataggacaggctcttctcatgatgccaagtccttaattctcccacgagtctgattattatttacctttagcaagcctgctattttagtttcttttttccctaaatacccgagacacatcctactaatggctgaatcaagaaataactgaacgctgtttcctggggactgtctgttgaacatgttgctcagagccgttgaagaatagggcctgtcaacgagacattagctgggggcagacactctaaatgaatcactgtcaacttgcacaacaacctaccaggtgggggattgtcccagttttacacataagggcactgaggatcaggcaggcttggtaacttgtctaaggacaccagctctgacaggaatagctgtaggtaccagctggaggaattcctgctgtcttgggactttcaatgatcaaatacaacaaaacatttacagtccatgtttatttaagtaaataacaaattttcttctctagtttgttggaaacggtggtgagttgagtagttgcctccaaacagatacgtttaagtcccagcccctggaacgtgtgagtgtgaaccttatttggaaaaagtgtcttggttgataataatatgacatcgtagactagaaatttgctaagagagtagatttcaggtgctgtcatcacaaaaaaataaagtaaccatgtgatgagatggatatggtaacttgtttgactgtcgtaatcctttcgctatgtgtatttttatttgaaagaatgaacactgttttacatgccaaaaaagaaaaaggaaaagtaa

SEQ ID NO: 6926 - DNA, 1032 bp, Homo sapiens
aagtattgttcctgggtttatctgtgagggtgttgcccaaggagattcacatttgagtcagtggactgggagaggcagacccaccctcaatctgggtgggcaccatctaatcagctgccagcgcggctagaataaagcaggcagatgaacgtggaaggatttgacttgttgagtcttccagcctttatctttctcctgtgctagatgcttcctgcccttgaacattggactccaaattcttcagcttttggaatcttggacttaaccaatggtttgccaggggctctcgggcctacagccacagactgaaggctgcactgtgggcttccctatttttgaggttttgggacttggacggctttcttgctcctcagcttgcagatggccttttgtgggacatcaccttgggttcgtgtgagtcaatactccttagtaaaatccctttcatatatacgtctatcctattagtcctgtccctctagagaaccctgactcacacaaactccttcttgagaatggaaaatggacctgcattctatacctcccctgtcccccaacctgctatagagccttcctgttcagttctctcacacagtggcaccagaagtcctcatctcttctctgtggcaccagccttgaaaacctagggatctgcatcactcagaatcactcatcaattcctttaataactcgctggggaattctaacctggagattttcccaaagcatgcttgaaccagtttgcattttctctcctacccatttgagaagagcacattctctctcctccagcatgtactcttcaaaccagtcagtcccaagtcctcacagtccttgccctggtctgtggctcctgctccttcccccaacgcagtgccctcctggctcttccctatagcctaccctgcctggcacagtagatgttgagaaaatgcatccacatcctgcctacccatctgtcaggtctggattcatgtttccaaacttcctagaaacctttgattatcaagatccacatttgcttctccatat

SEQ ID NO: 6927 - DNA, 1046 bp, Homo sapiens
tttcagggggtcctgtaagcaaaccaggtcctagaacaggaaggaaaagtgctttctggaaaatataattggccacatttgaacaaatggtaacccatttttcctgctctgctgtttcctgcctagattcctttgtgggtggagtcatcggcctcatttttgcatacatttgctacagacagcactatcctcctctggccaacacagcttgccataaaccctacgttagtctgcgagtcccagcctcactgaagaaagaggagaggcccacagctgacagcgcacccagcttgcctctggaggggatcaccgaaggcccggtatgaccagtgtcctgggaggatggacactaagccctgggcacatctgccaccctgacatcataacacaatagaaatggttttctgtagtgtatttttcatcagttgtttctcaaagtcatcgtacttctgcttctgtttcactgatggtgttcctgctactttaaatgtctacttccaacatccttgaatttgcaagtgaaggacaacaatctctgagagacgtgtggaagaggctgtgaaggtggggtttggggagcttggccgattcgtctatctgaaatgtttgctgtaacagccaccttcctatgttttcatggttgtaaaacataataaaacctcccacgtggaagacttggtgttggccacccagcgcaacaagtcatttggagatgcagcaggtttctcagagacccaaagccagctctgtctgtaggtcattccaggtgctgagcttggaagcaaaggctcagaacctttctgagccatcagcttctcatagcccacgtctctaaaatagatttgaaacttggagtgacagcttgagcatttccagggcttttgaatcattgaatctggaagcaaataaaattaataacttcatgcacagacttccaccaaacacaatgagcatgaagatgcatgagtgcatgtgtgggggatgaggtcacagcagttgcctgagggttcatgggcacaatatccttcccatcttccagtctaagt

SEQ ID NO: 6928 - DNA, 1031 bp, Homo sapiens
aaaatgagcgctggaaatcataggcaaatctttcttatgctgtgccttggagcaggagctacgaatgagtggaatccatccaccttccagacgccttagctatctgcaatgcccccctcaggagacaaagcccacgcagtccctctctttggacgtccactcatttgcctgcagctccatcaaattcagctccccagattacatttcaaatgatggagcatttcagagtgctctctgcaaactgaaccaggctttgtaaatgtgagagaagattgtggttgacatccatcattcagggggtgcattaccaatttccaagattctctgtgtttcagttgaatgttgtgctgctgtgctgcaccctggcctctgaccacagacatcatggcccgtgggaagttctgatgggaaatatttcacccagaaatgtcggggcctctgcagcctttatcttggagaaaagtgcaaagagggcagcagctcacttgtagtttgtgtttatagtttaggacatctgtgatctctcagcattgattccttttactttaaatcctgtcctatgcctaatgagtcattttcaagcagaaatctgcacagtgtgtgatatggttgcccactgtataataaccatgggttagagtctaggaatcattgtagctttaaggtctttgttaagaatgcaaaaacggaaatgaaaattaactccatagtagggcagctggtctcagcaaattcagttgttaaaaagaaagaagtggattcataatggattcctcagtcagccgggaatttaacaattacttctggaatgtttaagattgagaatttctgcagattttcaaaggaagttctgatagttatatcatgggctccactttatacatcactctgagttcaccctgggtaagtaagcatggtgtctacagttctgtgtatgagatggtccagatacgatcttctgccccaccagtttttgacaggactccctggagcagctagaatctgtgagaataaactgagcatcaccagac

SEQ ID NO: 6929 - DNA, 1048 bp, Homo sapiens
tttatcacccactcttagtaattatttatacttttcctttcacactatatacatgtttgtgtttatgtgtgtgtagacatgtatgtatatactcatgcatattctttctatttttggcaagttaatcccaatattctgtagtggtttataggaaggaaatttgtatacctttttaatgaacagtcttgatttcattgtactgtttagatttagcttttgttagaatgatttttattggagtcatctttttagtttgagacttgctaacctaagtacgaatggtatatgtgaaaataatgccattgaagtcttaactattgacagtgatggtgtatatattatacacgtgatttatgaatatatatatttgtatttgttttatatttacttataaaacattttgtaattacactgacacattaaggtttcttattagaaattatgaataagttatttaaatctgtttttcatgaataccaattttgtatgtactttacagagtacatcagattgaaaagtaaccctttcaaaaggcagtaaaatgagaaaaatgtggtacagtagttcactctgcagaaactgttctctaatgcaagttctcttgctttgttctgaagcctgtgtagtgctttaataccaggaacattgactgaaacagtgtttcttagaagacataggtccctgcattctggatagcaggactcgggagtaatctatcctttgaggtgttagttgatgcaatttaagtcctatagccaggtacagagtcattgtgtccttaataactacagccactaaagtactacattaactacattatacttttagacctgaagagcatttctactgaaaattttctttagctttttaagatcagcatacactgtagttaatatatttgttatttttattacaaatcagggcaaagtgcaattgctggggaagaacatcccagaggttcaattctgcgggaagtgcacctcaagttcctgctgacgggactgctttcaggactgcccgcaccacagtttgctattcgtatgtgtcc

SEQ ID NO: 6930 - DNA, 1174 bp, Homo sapiens
tgtcttatattgaattggaatgctgagtcttcatccacctgagactggacagtcgagtctctgacgctgtccattcatctcggaaataccaggaggctcatccctgcagtgctgaatcccaggctccttgtctgtaattggaccaccccagtctttatgtcatgtcagttttcgttgggtctttattgactaaaaatatagtcagggttaatagcttaataatagcagggttcttcttttgccaagagttatatattaaatattatttaaagtggctatggtccctataaattaagatttgccttttggtgtgaaattgtgtatttgtatgttataggtagaaaaatttatctgggttccaacttgctgtcacattgatttcatagtaatgtgatgaacctaattttctttacagcatagagaaaaaaacaaaatttagtttgctattaagtacacattattaaaatacatttctccaaaacttctgaaaaacagtgtatttgtttgaaactcaacatttcttcttaagatgctatcggctggcttctggctttctcccccagtctattaacatgtgatttgtggtgaaaacctcaccatatttattctgtggccaacatggctgacttctcagtgttaaagactcatttgggtattactgtttggtagtacccttctgtttttttctgtgcctatcttttgaaagcgatttgatttttatgattcaattgtctatatatgtgtcccgatttatataatgcagataaatgtttaatttttgctttagaaactgttgattaatatttcaccactaatagattttaattaggattcatcagtgtgcttcatatgtgcatgtatgtattatgtcagtgttcctgatttgtcagttaggattttgtcaatttcttggggaaaactacttcttgggatagctatgtaataagagctatggcaaggtctgagctttccattgtagaataagctgtattggtatgtagtgaatatcatttactgaatttagtataacaaagtaaaaatataagtacctaaaagtttgtctagaggtgtcactaagaaagataaataagagttcagctatggaattaattctccttgtggtgcccctagtgcattagatcataggttcagcattgttaaaactttcagattg

SEQ ID NO: 6931 - DNA, 1043 bp, Homo sapiens
acagagtaatctgtgaaggagctagatggaattcactctgggcctttgaagcctcagaacctgaactcttcacttatacttacagtgcatgtgctgcatctcctgctaaaatacgcacataggttagtaggaatcatgttggcagtaaaattaaaatgttggctgagccaagatttgtgctaagaatttcacacatgcttctgaaaaatcaaacatgttgtcttttcaaacacagaaagttttaatagctaattaatcagagaggtattaattttaagtaaggtttattatcctggattagtcaggttatagatgtcactaaatacttgacttatacatgttaagataatatttatggttgagtaacattgaaattgattataagtgttacttgggatactaactctgagggatatactacttatcagataaatgtgaatgatcatacaaagatactccatttttatatgaatttttcctcttcattgccattttgaaaataatttgtattttatattcagagatactgcccaagagaacactaaaatcctgctttgtgtttcagttaatgcaattttagtattataatcaaaagccattaagaaaatttcacagaaatacaaaaattagctgggcgtggtagcatacacctgtaggctcagccatttgggagcctgaggtgggaggatctcttgaacctgggaggcagaggttgcagtaagttgagattgtgtcactgcactccagcttgggtgacagtgagaccctgtctcaaaaaacacaaaacaaaacaaaacaaaactttcacgatgtattataaaaatgtctgaatttattagcagtaaactcaaaacattttagattttcatgtccaaataaggttaacttttagaaagttgtttttctaccttttattaagtgtgtttttaaaaaatcataatctaaagcacttgaaggttgtatatactgtgccggggactcatgacagcagatagcacaaagtgtgtgtgtttttaaaaccatgatgttttaacttgtgatgc

SEQ ID NO: 6932 - DNA, 1073 bp, Homo sapiens
taacttcaaactatttgggtgttttgccaggtatctttctgtaaatttctactttctgttggggtcacacatggtcctgagtggaagaatctcagtcctttgatacagggagtacagggatcttcctactctgtcacatttcctctatgtcagccatcatttgctgataatattttagttcctcataatgcttattgagtaatcagtgctcaaattatatttgttgaattgcactcgttgatgtcattcagtacttctttcaggcttaacagaaagtgaataaagtggcatttgttgaataccaactgtagtagaatgatagaaactttacatactttttcattgaatgtttaccataatctgtatatcaattaattgaggtacatgatgagattctcctgtcatgtgtgagaagttgagcctcaggagggttaacataagttgtggcatcagggtttgaatctatgccactctttcttccaagttggactccttgcctaattgtgtgagactgtatgttctcttacaggtcacttagagctttaccttcttatgactgttaatcatggtgctaaatggtagtttaaattgtctatatttagaatgcgtcagctgagtttttcaatttactgaactttttatttgctctaattcatggtgaaatttttgcaaaaaggggcttatttagtaattttgtttattttaggcagtatttggcagtcgtattcagagataaacccctggagctatgggatgttaggacttgtacccttcttagagagatgtccaaaaacttccctacaataactgctttggtaagttacaatttaagaatttaatagcttatttaggtatatatgtatgtggtgaatgttttgcttaagcttgaatcaaaatcattactgccaatgtcatttttttggttaaaaatgtgtgttcagagaagatgatctaaataaatggagataattcttattttcttggataaatcaacctaatatcatattagtgcaattccaattcaagtttcatttggatattttgaggaatatggtaaacatattcaaaaatgt

SEQ ID NO: 6933 - DNA, 1035 bp, Homo sapiens
atcgtgtgcacataagagatgggggaggagacgaggaataggcaatactatcattgaattcattattttcattttgtaagtattttataaaaacatcaaaaggtcagaccttttggaagtttgccataaaagctccaattaaaatgcattcatttagcctttctctaagtaggtaaaatctaaagaacaaatgtggattcatgtgtagtaataataaatgatactgggcagtggtgtgtgtgcccagctcttctggacgattctttgacagaaggaaacctagcacttctaggtttgtctgcatttgctttacaggagtggtcaccatctcacaacttgaagagcctgagaaagaagcaacttgcaactcgagaggccatggcccgccagaccgtagtctcagacacagagctgagtattgttgaatcatctgtgatcaggtacagtacagtgtttcttgacactgtcatttgtgccattagcatcatgtctgggaagttgacaagtatcatcggaaggtgtctatggtagcaagttggactctgcttttgaacatacttagtttcatctttcagtacatacccagattactaaaaagataattttatcatttttagtattgtactatactgtttgttataactaataacatatgcagtaatattcacccatcagcatctagtagtaaatgtgctcattccgagtgcccttctactccatacacttcagcttctgaaattcaaatgaacatagcatagacatacagatagatcatattatcatttatacacaccaaagaaaatgtgttgggaatcctaaatttgtgtatcatccccatccataccaatcttacagataaaaggcttcagagataatgttgggtcactgtacagcctcccttctgttgagcacagttctatagccaaaatctctatgaattttatttttcttgtgttaagtttagatcaccatttctctctgtgcagggtaaacttcctctgatgttgtggctgttaaggagtgattcatgtttac

SEQ ID NO: 6934 - DNA, 1031 bp, Homo sapiens
ccatttatcagtttaaaaggcagcttttggctgatgcaatacagtgttcatccttggaagatacttgatcctacttggagtggaggagggaacttcttgcctgagtattctcccagcaaaactttggtgcacactctaggctgatatgtagaaaatttcatgagacttttctgaacctttgtagagtcaatatttggcacttcagacacagtaaggttttaaaaacctggtttttcactttgtgttcatgcttgaggcactactgagttgctgctaatgttagcagggctgcctttaacttagttaggtatgctttggtttttgtcactgcccacccctgcccactgcatttgggcaccaccacttcttactatgtaactgactgccatcaggtgaagccagaattcaagacctacattcccatgtctgtccttgtgtcgtttgccagctctggggaagcaccaggatggcctcctaggaaagggcaagcattggtattcattttaaacctaaaggtattgaggacattgaaggaacttcaagggtggtttttgaaaaaattggttactaattctagataaagaagtgtggaactgctatctaaatgtttgaagagcttttccttcacttttaatataaaatttgaatctaaaaagctccaaagtcaaggtgtagcttgttcttaaattaaactgactacagaaatggagtccattgtattaacccatgttcaataccatacttgaacatctggcctgtggccagattttagatcacatgtttcttttaaaatttttctgatttttttttatattcttttcaatctctaatgttacagcctcagccagaaagagaaaactaaatagcaattgggaaaggtcatgcaattgtgtattcattccacaaattgaacttcaaattcagaacaacccttaataaatgttaaagaatgaaaactatggtagtgtaaatgtggagtgaggaaaaagacatctgtgtgttcacctccagattcatggccgatttggtct

SEQ ID NO: 6935 - DNA, 1042 bp, Homo sapiens
accaaagaaaccctcactccatagtaatagtcacagtaaggaaacgggaagtgggcaagaagcaaaagctcaggtggacagaagaatgccagctgacaaatgcggaaagaataagattagaaaatcaccactttgcagccccgatacaataattaattgtatacacaagcaaggatcacttgtggatgtcaaatcactgagtaaaaggatgtttgagaataggaaattcaatctgacaatatttcctccacatattacttactaattaattatacagtggagaaggtgccctgataagagctctggtgaataccccttatctagatgatcagatttagtgtttcctgtaaccagacagctaacatgttccttctgatgcaatgcagtgaaaagtacacagcatcctttgttcagactctgtcaaaaatgtttaacccgaatctgataatcagaaaacagacaagttagaacgtagggcattctccacagcagctgaccaggactcttcaaaaatgaaaaggtcacataaggccaaaaccaaaaaggaagaggaccattctagattggaatagactaaagagacatgacaatgcagtgtaccagccttgactggacccgatttttaaaaataatacagctgccaggacatttggggaataacaagggacttttgaatttggactgcattttaagtgattttactgaatcaatattaaaattcttgggtgtaaaaaaaaagtattattaaaaatatttccaatcactttctggcttttaaattgaaaaatccacataaaatattttgtgtataatttaatttttatttaactacatagaataaagttttctaaagcagagttttccaatagaaacataatgtgagccacataggtaagcttaaattctagtatccacattttaaaaagtaaaaagagatgaaattgattttaattaaaattttatttaagccaatatatccaaagttttatttcaacatataatcagtattaaaagttactagtgagacattttacttttttaa

SEQ ID NO: 6936 - DNA, 1019 bp, Homo sapiens
taattcgtatttcagagcaatatatctgtatgtatatatttcataatattttccccttgtatgtacctccttccctgtagacagtttaggctttctttcaaaataataccaataaacctcatgagaaaaaacatatggttaaccagcttgtaatttagacttccataatgcccagtggagcccagctatttgttttgttttgtttttgtgtctgaattgactggtacaaagctaaaataggcaattactcgagcacctagatacaccagcctctggctttatgtttgtctcaaaaaagtagtgtagcacctctgtttaatgtttgtatttgtaaacaaaatattcaattgcattttttgaaaatgagtgttttcctttagttttctaccttatgaattttaaaaagttatgttggaggaaaatgttctcataattagaaaaaccgtttctcttactagacagacagagctgtgcagttgctgttggaaacaagtgcagataaccagcattattactgtgattcactgaaagcctgtttagtcactactgtcacctcgtcaggcccctctcagagcaccattaagttggtggcaacgaatatgattgccaatggcaaattggcaggtaaggcacacttgatatgtttgtcatctctctgaaaaatgagaccttgttcccagcaaagtatctgattagtagggacatttctttctcttttacatatgctgaagaaaaatagaaaaattattgctacctataaatcagatgaatataattgtctaaaccagaattaattgtttacacttttcagagtgaaagggggcactgttaataattgctgagataataggcataaatccaacaatcctaggcaaatcagaacaataaaacctgtgagagaactatgctctccctacttattctccagactgtattgtgcttcctaccctggttacttgagtaataacagtaaaactcttaatattatgtttcagaatttaaatcaagaatgtcttcag

SEQ ID NO: 6937 - DNA, 1075 bp, Homo sapiens
tacagaaactcatcactgctatatatgcagattatgcccggagtttgaagaacctcggttttaagcagggagcagttctctttgcttcaaaagccggagcagctggcaaagacttattgaatgagcttgagtcccccaaggaagaacccattgaagagtgacagcttaataaatgccagggaatctgacctggaaggcagatgggagggggctggtctggctgtggccaccgtcacagtccaggatgaagaggagtacagggtcctgtgagctgtttgaccactgttctaagactatgtgtgcccaaaagcacataagcatctatgttgagagtaagtttgtatcctgcgttggtctcagaaagaacgtgaatgcttaagattttgaaagtacataatattttatactttgggagagagctttaagagtccctggaaatactttttaatttttttaacttaaaattcaagagactgaatcacttttctcattgattaaatgtaaagattattgagaaacctatagtaaatgaaatttgtgagatgttttctcaaatatatgctgtgcctgtacttatatacagtctttcaagagagatacaaacaaggcagaaacatttaaactagtattaaaggtagtttaccaaagcattttttgttttcttaccttgaaaacacagaaccgttaattccttggtttaagcagttgctaagttttgtaattttaggctcagaggaccataggaggttttaagatttatgtttagtccgataggtgaggtctttgatattttgaattttaactccttttatgatacatcacagtaacctcatttttgaagtctttctttgtactttaatgttctctctgttctaatagttgaagtatgagatgtaactattataaactgttgctgaaaacataaatgtctgtaacttacaaacatgataaataaattaaaaattccatccaggcctttgtgttctctgcattgctgtgcatgaggccaggtcatgaggtggctccttaggagtcatctggtcgcccagcctctaaagcctggctgctcctgctg

SEQ ID NO: 6938 - DNA, 1047 bp, Homo sapiens
atgtaccatcataaccatttttaagtgtacagtttggtggtaagtatattcatattattgtgaaacatctccagaacttactcatcttgccaatctgaacgactgtatccattaaacaacaatttcccttcttcccttctctccccagaccctggtaacactattagactttctatttctacatatattttttcctcttatttcttttaacagtctttcaagtaatgcatttatctccattttacaggttcagaaactgaagctcaaagaggttaatgaacttgcctagggcttataaatggcgagtaagtggcagagctggattcaggctcagatctatgtccagagtctgtgctctttgtactatacttgctgcccctgcccacctaagcccctggaccctccatgtgatttctgtgcccagtgttctggtgagtcagcgcacctgtggatttggtgcactggctttgggcatcctcagctgagatcttgatcccagaggggctggtccgttcagctggctttgtgctgttttgatcaggaggacagctacactttcactcacctgactgtatagcttctcccagcatctggctgagtttatttgtcatcttttgagaagaacatcaggctgggtatcgtggctcactcctgtaatcccagcatgttgggaggccaagacgggtggatcaccaaaggtcaggagttcaagaccagcctggccaacatggcaaaaccctgttcctactgaaaatataaatgttagctggactgggtgtggtggtatgcacccgtcatctcagctactcgggaggctgacgcaggagaattgcttaaacccgggaggcagaggttgcagtgagtcaagatcgcgctgctgtactctggcctgggcaacagagtgagactccttctcaaaagaaaaaaaaaaaaaagaaaaagaaaaaaaggaagaacattggctgccggctccctgccttgtcctcccggagtaatttcctctcctttgagcttgccgtaaaattcggtccttgggctcattaatcc

SEQ ID NO: 6939 - DNA, 1070 bp, Homo sapiens
aaaggggtgactcatggccctttgcagaagcacttgttgatagtacaggcttccctccctgacattccagtggcaaatcaaccctttgctggcctgactaaatttatagtgggctggccccagcagctggtggcagcagctggtggttgaaatctgacagattttttttttcctctgaaaaatatttcagtcactctagtcccagaaccaccaccagcagaacttagaagccatttatagcctcttacagttgttctgagaagagctgttttagaaaaatccccccatttccccagaaattagctctctcccatccttagccacctggaaaatattcagatcgttacaaagtcagaaagggcccggagctgacagcacaaagtcaatttgacagtttatttctttgtagcagtttcatatggttgagcctaatatatatgcgtctatacacatatgtgtttatttttaaattataagataatgatttggtacggaaggtttgtagatctttattcagagcctgttgactcctgatttatgcacgttctgacactctcagccatgtttcttagcctgtagcctgttagaagcagagaactgcaaggcagaaggtggcagggggaggcaggtgagtgggtaagtagaagtgacagctgacggcctgagagcgagggacaaggctgagtcagagttctcggtgatcaagtagtctggcgctttcacttttacagacagaaaggctaaagctcagagaagtcccctggcttagatcccatggtgggcctggactggaatccagtcccctcaacttcacatacggtggttacatttggtgccacagcactaatgtcactcacttatgtcatagttgccgaggacggctgagtgtcattgagcaagtatttaattatgttcaagatcctctgtctcaaaaaagtcagggaagtgtttatgatttgaaaaataattccattccaaagagtttaggtgaaaatgccatcacgtagaatatgtgggcagatatcttttattccagatcttctttgctgggacctcattttccagtggtg

SEQ ID NO: 6940 - DNA, 1064 bp, Homo sapiens
caggaatttgggaccagtctggccaacatggtgaaacctcgtctctactaaaattacaaaaaatcagccatggggttgtgcgcctgtagtcccagctactcggaggctgaggtgggaggatcacctgagccttaaagtttgaggctgcagtgagtggtgatcaggccactgcactccaggctgggcagagtgagaccctgtctcaacaaaacaaaacacaggataaacccctactgtttttaaagcaatttacattacaattccaagtgaaaccagaagcatgacttttaagtagcaggaacattgagataatggaaaacttggagcctttgagaaaacaaagcacaaagctgctcttgaacaccttgccatgaaagtaacaaaacgctgaagcatgtttataagtcagggctgaaaatcatgatgaagaggaaaagccaggtgactgctgtcagtttcaataccttatcctgtttcttttatcatgaaattgagtagttcgtcagcaagaaggtcaggtctgagcatctatttaaactcttaaccttgagactgtgatgcttatgtgatgtgggaaattgtatctgctcattagagctctgatatgtaattgaaatctgagattacttatctgccttgtcgtatttaaaccactgattatggctctgacatttttgttactcttcaatcaaccagtatataaaggattcagaatctcttggaattaagaaaaagctattatcttcctggtatcaattatagcgcaagtaaaaagcaatgccttttttagccaaaactttgcaaaagtacatgctgggatctcagatctttccttgatgcccttcactttaacccctacttttatgtgtgacacaaacccggccacttctcaccttggaggcgagcaagctccatacccttcttccactcctgctcctgctgctgttgttacagctgtcagaatggccttctaaaaacaactcaggggccaggcctgggggctcatgcctgtaaccccaacactttaggaagccgaggcaggaggatcacttgagcccagaagt

SEQ ID NO: 6941 - DNA, 1045 bp, Homo sapiens
taccttagagtatgagtaaagctgaaggagaaatttgggttgggaggcatgttaataatataattgtgtctggttttgcctcatgtaagtttcactaaaaatataaatttaagtggaaatacagtatttgaaactttttccttccattatttaaataaatcagttaaatctggtaaatgattcttgtctgatgaggaagaaacaactttctatctggaaacttaacgttaatctttgatgcagtaattatgggttacttcatccgtcgttcaacaaatagttactgagggtcttgcatgtgacagccactgtgttaggcattggagaaacaacagtaaataacaaatccctgctgtcatggagcctacattacagtgtggggaaacagacaagaatcaggtaaataagtaaactgtatcattcattagataatcaataaatgctaaggagaagaataacatggggaaccaaggtggaagtagcaaaacggtttggaggatttgcaattttagataagatctaaaaggcagtgttcactgagaacgtgactttgagttacaagtccccgagtgggaatcttgtctggtgagtccagcggccaaatgaatgagtaaggtgggtattgggatggggtaacagggcagacgaggcttagtggtctttatgagggctttggtttttaggtttttactttgagtgagatgggatcccattgaaacaggttgtcaaccttggccgaacattagaatgattggggaagctttaaaaaagtactgatgcctggatcccatcccagaatttctgatttaattggtcggcggtggtgggggaggtggtgttttaacgtaggcatcaggaatttttaaaattcccaggtaattctgataagtggccaaggttgacatctattgcactgaagagttttgagcagagtgaggtattacatagtattgaggagtgtgactctagagccagactcctccagtttgactcctggcactgccactcccaagcatgtgaccttgagcaagtgccttattagttt

SEQ ID NO: 6942 - DNA, 1043 bp, Homo sapiens
tcattgccaattccaaagtaagatttaccctatattttcttctgaaagttttctggttttagctcttaaattgttaatccattttgagttaatttttataaatggtgtgaggtagggggtccagcttcattctatgtggatatccagttgtaccagcaccagttgttgaagaggcttttttcccccacattgaatggtattagcacccttgttgaaatcagttgactatagatgtataggttgaaatcagttgactatagatgtataggtttatttctgtgctcttaattcttttccactgatctatgtctattctcatggcaagttgatagcttttacctgtggtatatggtagtatagagtattgatttttcaagctttgattacattgtaaacttttttttttttacaaacatggtaaatttattaaagaaattatttcctttaaagtatcagatttataagaacaataacagcaacaacacacaaacttattggatggttttatttaaaactttttggtgtattttatcatttctctgactgcatatggaatagtgatgcagatacatagtatatcagtgtgcattgtaattgaattttcactgtaagttaaatttaccttgagcctctaaataaatagttatgtaaattcatcctgccaaaagatgtgatggtgccagctatagaagtaccagaatagtaacagctgtctggtgcagatttgggctaagcatcacatcaagaaggaatcacatgtctgtagtctctagagaaacagttcttggcacctaatggttttttaactttaatcagtacaataaaagttgcagtactttaggaccagaatatgatacaccttttaagtctattttaatctataatgtctctctttttcttttttttcttgtaataatttacttgctaaagaaacttttttttttcctttgtttcttatagtctggctcttgctgattgaattcctttggtgcagtttagcatgttcctctgtgttctgcatctcctgtaggttggtatttgga

SEQ ID NO: 6943 - DNA, 1528 bp, Homo sapiens
gagattctaaatagaattctaaaaagacttctaagtagcttttgtggtcttgcaattttattttacctgttgaaatttttatagtttttaagataaatttgttggtaaatgattttaatgtttttataattcacatttggaaaatataaatacatagaagttatagaaatccttattacttaataaagtggttataactgcattaaagtgagtatagatttgatagtacttattaaaaataaacttttgatagacacacatttaactcataggatagcaatgaaataatttcctatgctttaataagatgctttatgttaattttattccttaaaaatatcttaccagtttcatgtgcattttatacatttaagtgtattaaagtgtggaatctccaatttgttatattttcctgtgaacattgctgatgatttacatgtagattatttgaaaacttaaaatgtacattttgatgtatgtacttaatacataaatctttctatgggatcactctcattttggtcaactctaatttagtggtctgctaagtactgtgtgatatataaattttaaaattttggaaatccaaaattagagtttggaagtgtgtggtttcaaaatagaggtggttagagggcaatgggtaagggaatgatgatttttaaactatttcctagttataatatcttgccattttaatccattatcctctaacgctatagtctgtgactttccttacttgagtctaggtgggtgccacttgaaattcttttccctttacagttgcttttcaacttatgatggggttacatccttataaacctattgtaagtcaaaaacacaagttgaaaatccatttaataccccaacaaacccacttgtaaagttgaaaaattgaaccattgtaagtcctggaccatctgtattaaacatacgcacaaaaaggaaaagagcaacagtgggagaatcagccccgaagggggagtatcaatgactggagtgaggaaaatcaaattttaaagtatgctttccactgttcatttatagtggaaatatatatagtggaaatatagtggaaacaacataaatatggtggtttctgttcccttattgattattaaggaatgtctaagatatatatggtttattcctgaacagagatccattatttttaaacatgtcttttttaaaatttaaaaataaatgttcgatttgaatctaaaaattagtactttgaatttgtggcagaaactccacaagtttgatatatttttaatagaaactggaaacaagtagatgtagaattctcagaaagattgtaagacccaggagtttgtgtctgcacgtttttatcctcagtgaattgaacattatgacaatttcattctttctttttatccttttttttttttttgagacagagtctcgctgtgttgcccaggctggagtacagtggtgctatcccagctcactgcagcctccgccaccggggttcaagtgattcttgagccctcagcctcctaagtag

SEQ ID NO: 6944 - DNA, 1035 bp, Homo sapiens
taaaatcatacaataaaagatgaaagccaggcaccagaaattgaattaggaattcaaagcctgggtagctagagagggatgaggtttaatttatcgcatctctaagggaagtaatgagatttttcactgcttggcatgtctgattgtgggttcatatcagggtaattaagtggtgactaacatttgacattcttagaaacacaagtcttatgtctgtgttcatctctggtagatgaaaaactggaagagaagatattttcaattggatgaaaacacaataggctacttcaaatctgaactggtatgttgttacgtcataaatgttgctataagaatgtttgaaaagtgttgcaatgtagtgattatatataatttcttgtactgttctgtagtttcagaataagtctagtttttagaggtaaatatagtttatttggttgtgatgcttttggttaatgatatttttcttaaatacatttttaagtaaaaagatcctatcttcaaagcagcattccaccttgaaagatctgaagatctcagaatcctctagtctataaatttcctctaaaggggctgtcctcttggggggttagccccacgtggagtagggagagaagggcatccacatggggaaggggtggtggcagagatgggagaatggtcacatacacagtgatttataaaatcaggaactatattaagtataatagaagccaagtcttttcagagaaacaatactttttggtgaatgaatgtatatctgtatatatgatgaggaatgagatatttacatagtttcaaagtacctatctactaaaataggtattaagtattgtacaaggggaaaaagagtaacattacagtgaggaaagtggtgtaaagaattctgtctgtaaaagtcaatatttaaccctctgtatttctttctcttgagattttctttacctatttcacattgactcataaatcacttcacataagatgtttttatcttccctgaaggtagaatcagaaattgaaattccctcttcgcct

SEQ ID NO: 6945 - DNA, 1047 bp, Homo sapiens
gtgttactgcactccagcctgggtgacagagaccctgtctcaaaaaaaaaaaaaaaaaaaaaatcaaaaagggatgatttgtttttgttttattgaagttaaatatgcttattccagaaaacttggaaaatatagaaagatttcagaaaaatgtggcttataaaacattcagtcccacattgaggcaaccattcttatgattttgctccctttcttaaggtatatatttttataataggtggggtcatactaaatatagtgttatatcctatttgtttcatatattgttatttttttcccatgtcattaaaaattatctgaaaaccttttagaactgcaccatactccattgatgttccaccagtaaattgtgtctgtattactctgttgctgtattgtgtctgtgttactctgttcatgtgcatagtttttgtacatttactgtaataaaatgatgaaaaacatctttgtgcattactttgcctgatttctttagggtaagtttctagatcgagattaactatcagagcatgaccctttctattttgtcaaattgatttctagaattgtatttccattagtaatgaatgaagtatactctacctttggctacttgtatttttttttttttttagtctttgttaatattacttattcaaaaatattctgcattttaaactttttcatatttctagattctagaagtgtaagggattctagaatctagaaacaagaggcagtatctctgcaccccgattggggccttatttaattggattaatttcatagtaaggtttaaaattcacattgaaagccagacgtatctgtcaatacttattgtaggatttagggtactactagaaattatttccagaaaaatatgtaaaagaatgtcagaatttttaaaaattacacaactacataaatattcttgtagcagattcagacagtgtagcagtaggtagagtgaaataagaagggtttttcttggacttcctcctctccttgttttctgtctggaggtattcattattgacgcctgttgat

SEQ ID NO: 6946 - DNA, 1078 bp, Homo sapiens
ccactgatctcaggtctgaaaatttaaagtatcttaaaatgtaacactgccatctgcggaaagtagtctcatatgtagcatgatagcctttattatctagatttactatgacatatatgctagttacttacacttttaatatttttttctgatagtattataataccgccttttattagttttctggtagtgataactacagataaataaatagaaatcaatgtttctgatttcttagttgttaagtcattctctctttatatcctttttgaaatatctaagaagtcactttcatagatgttcattttgtaactgcctgtattttatgtgactttttcagcagtcaagtatgagactctctgcaaaaacagtgtctgttgggaagaggaaaagttggagaaggatgtttgtgttttgtgctttgtggtgggggcagattggactatctagctatgactgtcagcacaactttctcttttcctccctctacccagtataggttaactctaatcttagctttgcactgtgttccagatgcggcaggccagaaggctgtcgaacccttgtatacagaggtatacatcaagagctggtgaatgcagcacgtatgtgggctctcacgcaaacgtgccttcttagtggagggcccagacttactacttacaactgatcatagaaagttgagttaaccaaactgccttttgcagttatcataactgattttgtcaatactaacgcaaactgtttcactgtagtcatcaggttggatatgtgtatttaaaaataaaaaataaaacatacaactttactaacagaaagagacattaacatataaaaattaatatactcaactgctgcaagagtttcaattttatattatgtatttaaaaatttttaagatacaatacttacgaaatgcaccattgttctaataatatatgcaaactaatgcatgcatatgcattggataaactgtacattactatagtttgcatggcatttaaaaatctctgaaatttagccatctaataggactctgtagtgttttggtaatttgtagcactttgatttcaaagcc

SEQ ID NO: 6947 - DNA, 1039 bp, Homo sapiens
aaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctgacttatttctcattttgtttggttcagcccttgtgtgatgaagtaaatacaatgattaggggtgtgtttggttaattgacttcagtttacatatttaaggacagagtaattatttggtcatctttgcaagaataagaaacttcagatctgtgaattcttaatgcatccctgcatgtgaaattatagaaggaaaaatgatttttttttgataggggaaagaacttgcttatttttcttaattaaaaaacatgttctcaaaagcagaattatcatatgttagcctcagagcatcgtgtggatcatctgggctgctcacagtgctccatgattatttagacggcatgatgtaaggcggaaagcagagggcatcttaatctccgggtgggcagttgagatgcactcaaaaaactatgtcgggtgttagaggctgctccttgcaaacgttccctattggtga

SEQ ID NO: 6948 - DNA, 1036 bp, Homo sapiens
ggtgtgtcttctcctcctgggagtcccatctggatttgggtctggatttatttattcagcaagtagcctctttatagttactttttttttttttttttttttgagatggagtttcactttgtcacccaggctggagtgcactggcgcaatcttggctcactgcaagctccgccttccaggttcacgccattctcctgcctcagcctcccgagtagctgggaccacaggtgcctgccaccatgcctggctaattttttgtatttttagtagagactgggtttcactgtgttagccaggacggtctcgatctcctgacctcatgatctgcccaccttggcctcccaaagcgctgggattacaggtgtgagccaccatgcccggcctgtagttacttttaatttagccatgctcggggctgaaggggatgccaaagaaatataagatgagcccctcagacggctaaagatgaagatgaggcctccagtatgtacctcccacatacaccccaggaaattctgggtgtcactggattctggacctcccaaaagctgctggcacctggaggatggggccccgaggctggacctcactcctgctgggttgctggactgggaaagtactgatggcagctgaggagtgtgtcccagacttcactgagccattcccaaagattattccaagttctcctgacactgcactggaggcctgctgtgctggccttctttatttacagtttctgactggtgtctagcagccctgccagagagagcggcagtgtgtctgcaggcgaccaggagaaatgtctcaggctttagagcaggactttgagcacatagctgtgggggcccagcaggctgtctcctgcacggttacttctccttgtcctttcatggtcgagaggttgctgcctggcccttcaagtgaggatgggacatgctatccattggccttaatttccaacctctgcatgatgcattttatgctcctgcctttgaaagaacttttattttcttgtcatttatgcccagaccccaca

SEQ ID NO: 6949 - DNA, 1041 bp, Homo sapiens
ataagcatgattacttatgaatgggatatgtgcacctgttgggtgtcacatgacctttcaaatcttggagtcagattggacaccaccatgcccatttccagttcaactctgatttttgtgtggtacatgctttttatcacagtgactgccagaaatccaacttcatatggaatcatgaaaagggatgtagtgtgatctgatttcaaaactatgatcaatctagagctagtttacaaggtgtctaacagtgatcaagtatcactgtatttccctagaaaacctgaaatatcgatgaattttctgtggcactctggggtcccttggggcacactatgggaaccatgggattaggaccataaggatatgattttggcttcttcctgcctcagatctaatctttacctggcatttttgccttaaagatgaaagaagcatacattttgatgtatttaaagcacatattcggccaggtgcggtggctcacacctgtagtcccagcactttgggtggctgaggcaggcagatcacaaggttggaagtttgagaccagcctgaccaacatggtgaaaccccatctctactaaaaatacaaaaaatagctgggtgtggtggcatgtgcctgtaatcccagctactcaggaggctgaggcaggagaatcacttgaacccaggaggcagaggttgcagtgaaccaagattgcaccactgcactccagcctgggctacagagcaagactctgtctcaaaaaaaaaaaaaaaaaaaaaaaagcacatattcattttgtgcttattcttttgagagaaacacagataaaagcctatcctttaattcatactccccatactgtgattttcatttttactgcaacaaattttgttcagtgtgataatgaatgtcaaacacttaatgccttgctcttttcagtaacatgacatattggagaataatgactgaagcttatctacactgcctacgtctgttttcttccaccttgaaagaagttgttgaaagtaattaagaagtattatgtgtaaaactcc

SEQ ID NO: 6950 - DNA, 1030 bp, Homo sapiens
caggataaattcaaatacgtctatgccaagtcatatcataattttttgaaaatgaaaaaataaaaaataaattctaaaagaaagctggagagaaacaacatattctcatagagaaataccaagtttgttgacagctgatttctcatctgaaattatggtggccaataagaagaggcacatttttcaagtgctgtaaaagaactgtgagtcacaaattgtatatccagcaaaaatatccgttaggaacaaacagcaagtaaagacagtctcaaataaatgaaaacagattattttgcactggcaggcctacccttaaagaatggataaagcaagttatccaaggaaatgatgacaaaagaatgcttagaacttcagaaaggaagaaagatcaatggaatggataaaaacagaggtaaatatgacaggctatccttctcataagtctcttaaatcatatttgatggttgaagtaaaagttataacaccatatgatgtggtacttaatatatgtagaggaagtatctaagataattatattttaataattactataaatataaatggctagattcaccaattaaaagaaatgtatagaatgggttataaaatacaacccaactatatgcagttgacaaaacacacttttcaaatataatgacgtaggtaggtcaaaagtaggaagatatgccatgaaaacattaattttttaaaaagcagaagtcgtatattagtatcaggtgaagcaggcttcagagcaaagaaattcactagataaaaagagggacattacataataataaaaagacaatgacatagtgatcctaaatgggtatgcagtaaacagaggttcaaactacatgaagcagaaaactgatagatacaaaaggatcaatggacataaccataattatagttgaatacctaacaccccacgctcagttattgatagaactgttagacaaaattataggaaagatatagaactgaatagcacactatcagtcatcaggatctatttgacatttgtaaa

SEQ ID NO: 6951 - DNA, 1029 bp, Homo sapiens
tttaaggaatcatcttcacttttatattcccatttcaattgtatatttagtaaatgtttaaagaaataagtatgtgttcatgactgcggtcatctgttgtggatgtatattagaacctggaaatacactgtaagaagacagcacagtttataaagacacatttcagcaatatatgttggctgcttgttgtatagttcagttgttttgttaaaatattaaagaaaattgatatatttttaaaatgtatttccagaatggaagagcagcctgtttgctcctacttggaatagattctttctaaaaatatggaactgatagaaaagaaacttatagactacattgatcagcgaatatataaactccaggagcacattgatgataagattgctttgttgattgatttgctgcaaaatcccaactccccgcccagtaggctgcctctaagacattatgactctggagaaggactttcaaatggagaaagatgagctctcaacataaacagtgtactgcagatatttgttacatatttattacaaagccaaaacccaaaaatatttataaaaagcaaggatttaatgtccttttaaggatcatcatcttacttactgaagtgacctcagtgttcattattactacacttgtactgtatactaagacttaacatgatacagtattttatttttgctagtaatatttttcactcataagtgtatatgtacttctgtgttatatgttctaaatgtttaaggagttctaatataattcattagttgatatagtatatgtttgattgaagtactgttttaatttatatgaagaccttattttatagtttcagggatataaaaggaatgcttagagtatttgatttttttttcctaattgactcttagaaaactgggtacttaacctggaacctttattttagatcaccaacttgaattttatattgtttatttcagataaaaaattagatgtgatgtttggcatgtgtaaaatcagttcacattggggccattaattgta

SEQ ID NO: 6952 - DNA, 1097 bp, Homo sapiens
aaccacaaaaacagcaaaactaagtaaaatatgactattttcaatcaatgttggttatgttgccctcttgcaaaatgacaggcaaaatcatacttgtttttacatttgcatccacatatattacactgaaaaggattttcatacccatgacatcccatatgaatagtgtaaaggatgttgtctgcaaagtacatatcacagtgctggcagtggtgcagaagctgagggtcctggaccggcagggctggggctggggtgcttggctggctgtttcctatgctgggagtgctcgtgtgggcacttggctcactgcttggacctgccactggactatagttcctttgactatgggatggccgaggttctgggcttgtgggagaggagctctgaggaatacttgctgatacggcagaaactactgcttgggtagagggctgctgaatcatgaaaggcttttcatcagggcagggaactacatcaggggatgcagggttttggttttcgggtggcagactggacaactgccctgctagagtcgagagctgattcaaagggttatcaaccatgagttcttgggggtcccttggaaggccaccagttggtgtggtttttgccatactttcataggagtcagtctggatatttgggatttcgtgggtaaaatcgttaaggtagtctggtttctgaaccaccatggaaggtggacttaagttgattagtgctcttctgctatagcccagattgcttgttttcttctgtaaaaccccccacattttcttgctgcttaaggaagacctagtacctttaattggtaccattttatgcttgcgccttcgatgatgggacaagttacttcgatcactgcagcggaaggaacataattcacatttgtatggtttttctccagtatgagaacgcatatgggcttccagatgacgctcataagcagatgcaaatggacaaagatgacatcgatgaggtttttcacctgtttcaaaagaaaaatgatggagaaactacaagagtagttcatttatggaaagttttgcttgtccattcattggacaactggaaattgatcaaaaagaaaatgcttt

SEQ ID NO: 6953 - DNA, 1126 bp, Homo sapiens
gtgtgctatgccagatgtaataatgaataaaatactctacctccaagaagtttatcttttagaggaaaggttagaactatgtgcaactaaccccatgtcatgtaggtgtggaacaaatcctaaggggctacagtctgcgtgcagattcagaagatagaaatgactaggaccattggggaagtgataggctctttggaagctgggttagagtttaggaggggaaaggagtggtcagaaaactgcaacaaaaggggactgaggccactttagggaattgggggttgatccttttggattgttaggagccattgaaggtcaagagctttggagtttcctcatgccacagtgtaggtagatggctgtggacacaagtggcatggagtggggagaaatgcaaggtagggctaattttggtttctatccagaggcaaatggaaagctagcatttactcacttattgtagaccagggacagcattttacacccactaccctatttactcttcctgtaaacctctgaagtaggtatattagtggcttcatcttgcaaatgaggaactcggaggcaataaccagtgttcccaagtcacataacaatcagattgcaatgctgaccttcagcctacccctgccttctcagaaggtctctcctagtcctgcagatggattagaactgtcctgcccatttggtctaagcaacccaattagtggagaattggaccttgtagttaacctgtggttccaaagcattttaatgtagcttgatatctttttttttttttttttgagacggagtcttactctgtcgcccaggttggagtgctgtggtgcgatctcagttcactgtaacctatgccacccggattcgagcgattctcctgcctcagcctcccgagtaactgggattacaggcgcctgccaccttgcctggctaatttttgtagttttagtacagatggggtttcaccatcttggtcagcaagatggaaatggtctcaaactcctaacttcatgatccacccgccatggcctcccaaaatgctgggattacaggcgtgagccaccacaccaggccgcttgatgtcttttaagagatgattttttttttttttagacaagttttcact

SEQ ID NO: 6954 - DNA, 1042 bp, Homo sapiens
aaccacgacactgcactccagcctgggtgataaagcaagattctgtctcaaaaaaaaagagaagaaaaaaaaaaaagaaagaaaacaatgctaacacagaactcacacttccaccctctcctcagatacaacctccatcctgaagctcatctgtatgcttcctgtttgtgtttttaaacttttactatatctttatgtcctcataagaatatgtactatcatttggtgttttaaagtgtacataaatgctgtcatcctgaacaaatcctctcgctaactgcatctttaactctatactatattttcaagatttgtccatgttgatccacgtagctccctagttccctttaactgctataagatattctgttgcatcaatatatgacaatttatgcatgctttgttgacaggtaattggatttttagtgttttgcctttacaaaaatcactgcatcttttgcacatgtctacttgtgcatatgaactgaggtaaaattgctgggccttactgtaaatatgttgttttaattcactttgcgctgctgtaacagaataccatagactgggtgcttataaagaaaagaaatttatttctcatagttctggagaatgggaattccaagatccattcacaggttcggttgtctggggaagactttcttcacacatcctcacttggcagaacggaagggcctgggttgatgctgtgtgaaacctcttttataagggccttagtctcattcccaaggaggagctctcataacctaatcacctcttaaaggccccccactcaatactatgacattgaatttcaacatctgaattttagaggggacacatgcaaaccatgtcatatgtctttatctttactatcactaaattgtccaaagtgattgcaacagtgatttatatactcaacccacagagtataagaatttctcctttctagctgggcacggtggctcacgccagtaatcccagcactctgggaggccgagatgggcggatcacttgaggccaggagttcaagaccagcctggcc

SEQ ID NO: 6955 - DNA, 1082 bp, Homo sapiens
acagataactgctgtgaatttgaagtagtgaagagcacaaataatatttcaagatatttgcaccaaatcaatgtgatataaaagtatctgtaatttcttttgatgacagagtcacagatactgctaaaactactgtaacttgttgcttacattcataatagaaggaaatgctgtattttagttagaggttagtgaaatgaggatgtaattttacccacatccaagttcatggactttattattctgtccacgaggcccagatttgatcatcaacacttctaagtgcaacagaactctggtcagttgagtaagaaacagatcagactcaagctctggaaagtatttggcaaggcataaatagccattattccattcaagtagcaattgctgttctatacaaaaaaatgtgatgatgtggtacaatgggttataactgtggaaaatcattttgatggagaggacaccaaagctgcaaaggctgaggtcaacactgaagggcaggggacattagaaaatcaacatcaaaacatcaggctgtgcagtcaaaggccaggaaaagaaaagcttcttttattaaagactgtcatagtattaataaatggaaaattttttctgccgaaaaatgttaggtaatatctctcaatgctttggttaaaaatggattccattcacttagcatatgtcactgtattttatgaagagcatcttcaataattttaccctgtgatcctataccatttctaacctttttaagtacaattgtctctgttattgtgtctatgaatctaaaatcactgctatgttttgaatggtcctatactttgtcagtagcaatactgaaatcaagaggctcacagttgtgtccgtgggaaaaataggtattaatgtaagatccactggcttttaagtttctcagtagtgagctttcttttcttttctttttcttttttttttaagatggagtctcactttgtcgcccaggctggagtgcagtggtgtgatcttggctcactgcaacctctgccgctggggttcaagcaattctcctgcctcagcctcccgagtagctgggattacagttg

SEQ ID NO: 6956 - DNA, 1749 bp, Homo sapiens
gtgctttagggaaatgtaacttctatgaccttaaaaattaactgttaagagaatggttatttctgtatctggtgttaagaaccattttaactgttttgaaattacttccaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtgagtatgcttcacctgtatttgagccttttcttgcattcaacccaggatttattaatttttctaaattcatgaatagcattgttgatgcctgctcgatattacagctgactgtagggttggagttgatgttatcatgttctcccaagctttcaatatccgtaggttgatagacgtctgatggataaaattgtgcctagttgttttgtagagaagaatgtcaaactcttattcttcttgaataggctctattatttgaatctctggagttattaccagctcattgcttcaaaattaagttgaggaattcaagaataatttattttagtaaattctatttaagatgtttaagaatttgaactgccaaaaatctttcctctccacagaggttgtttctttaatattaacacaaagtaagtgaccttcaggtcttattggaaactcagagtaatatggccttgcctggaattgcaaatttccttagttttgaaattttcatagatgtctttggttcttggttgtaactgttgactgagaagagccatttacattttttgataccaacagggcaaagctttttacttaattacctctaccaggctttaagggaaatctgatacttcagcatgtgttaaactataaaatacctactccaagtatctgcccagttccttgtcccctctccccaggcccttaaaggaagttctcgatacatatttgtagaataactgaatgttttcaggattcctgtactttgctgagttaaaatggatatggtacccttgctgattggttgagcccctaagagggggcagaatattaaatattccatatcagatatgcttttacaggtttgactttagaaaagtcttagcatgtgaagcctgttggataaagggctgtgtttgcatttaatctgtcacttttgtatctcctgtcctggctggccattttgatctcatgctgttctttttttcttttgaacttgtaggtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgcta

SEQ ID NO: 6957 - DNA, 1143 bp, Homo sapiens
acattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaatgttggatgtttttgaatgttggtaattaatataatttacttaaaaaggcttgtgtaaggcaaaactcgtcatcacaggcatgttgggggatgacattttacctttaagtccactctccctcgtttaattgtctcctctgatgtgtgttggggattcagtcctgcataaagtgatttgttggagttcagccatttccctcatgcccccttgtgccctctcggtggatcagcagggcctttgagccaagtgtgcagcttcactcaggatgggcagagactatgtggcagcctctggggaccttttggctcagtgctttactagtgccagcgcagtagtgcttaggtagcttgtgcatccccgtgttgatgtagtcatagtccacacagagccaaataacagacccttctgtacttagccatcaaatactaa

SEQ ID NO: 6958 - DNA, 1072 bp, Homo sapiens
gctttgttcattaagcatttagtgtcttagaagtgatatgtttactgcagaaaaatttggatagcatgcaaaaaatgaaacatactatcacaatcctatgatataacttaaaaatttctttatagcttcatggaggtatttgatgaaaattgtatatatttaaggtatataatgttttgatacatgtatacattgtgaaatgattaccacaaggaggttactaaacatctccatcaccttgttaaattgagttaaacaaatttacaagttgacaaattacatttacaaatttatgtaattttttacgctttttttttttctcctttttctggagaacggggtctcgctatactgcccaggcaggtctcgaactcctgggctcaagctatcctcccgcctcttgcctccctaagagctgggattataggcgtgagccaccccacccggcctatgtcatttttttatgtggtgagaataaataatctcagcaaatttcaagtatacaattcattattactaagatagccaccacactgtatgtcagggctccagaacttactcatctcataggaggcagctacttttaacattcttggtgtatatccatccttcaggattttctgtatatttctctaacagcaaaagtttttgttagctacatcatgtgaaatgcctgggtagacaaatttaaagatgttatttgggatggtgtgacttgcacaagccacacagcctgcatggtgtccactttgagggggatgcccatagctatacttagaagtcatcctctagagcaagcttgtccaatttgttgtccatgggccacatgctgcccaggatggctttgaaggtggcccaaaacaaattcataaacttttgtaaaacgtgagattttttgtgattttttttttttcgagacacagtctcgttctgtcgcccaggctggagtgcaagtggcgcgatctccgctcattgcaagctccgcctctcgggttcaagcaattctcctgcctcagccacccgagtagttgggattacaggcacccgccatcacgcccggctaatttttgta

SEQ ID NO: 6959 - DNA, 1034 bp, Homo sapiens
tgataccacaacgtggccacattttgttttcaagaccttggccaacctttggtcttcacagccactgccctggtagtaagggacttagttaagtttggtgactgcttgaagtctaagatcaccaaagtggctaatgcaggcactgtgacaatctgggcactaggaaaagcaatgtgggcagaaattccttgttcgagagccttctggttatactttaaaaagaagggagcctagcatcttgtcaaatctttgagcccactcactcagagggcctgtcactcatccagaattgaatctgctggtttaacaggtcaggcagtgtgatttgacagcgtgaatcttagagtccagcctttgaacctggcgctgaatcctgactttactgcttattcagggggccactagctaagttaatttgtgagcctgggcaacatggcgtgacccatctctacaaaagatacaaaaattaactggatgtggtggtgcatgcctgtagttcatagctactctggaggctgaggcgggaggataacctgagtgcgggaggttgaggttgcagtgagctgaagttgcaccactgcactccagcctaggtgacagagtgagaccttatcttaatctaaaaaataaaatttctgagccttattttcctcatctgtaaaatgaagagaatacctagctcatggagttaggaacaagtatgttaaatatttatcagagtgtgcctgacagtgagttgaaaatatctactctctttggatgaaaaatatttaacacttcactctcagatataattattagctgactttttagattcttttttcttttacatgatgtagttctcagatatatacgggatttctagttcttaaatgccagtattttttttctgttaaaatatttatgaactatttcaaacattcagaaaaactcaggatcatacccataaacccactgtttagattttaaaaagttcaatgtttttctgtattttatctcttcattttaaaataaagttttgcacatgtttgaag

SEQ ID NO: 6960 - DNA, 1056 bp, Homo sapiens
agtggacaccagatggatacttgactcaagggcatttgatttcctggttggcctgaagacagtgaccttggactttagttgtccttctcaagaaagatgagctggatcaactggaattcattcctagggcactaaagagactgaacccattggtggtggtctttgcagctagttggagggtcctgtggatttgggggctggggaagccacttctggtccacatgcaagcaggtgagaaagttgagaagggagcagaggtatgcattgaggagcagagatcttgaggcccctgagaaatggaggtcttgccttcattgagacttggtctagggatatgttttgcaatggcatctgggctatattttctaacacacatcctgcatacctaactttgttgggtatgcagaaatgtaacctttgttgggaaacatacccttggttgggtatgcagatcttgtagaactgggatacaattctacaggatcacttgtagggcttttttctgttctgcattgtagttaaaaatcagttggctaaaaattgacaaatgtgatctaattaaactaaagagctctgcacagcaaaagaagctattatcagtgaacaggcaacctacagaatgggagaaaatttttgcaatctatccatctgacaaaggactaatatccggactctacaaagaacttaaacaaatttacaagaaaaaaacaaccccatcaaaaagtaggcgaaggatatgaacagacacttctcaaaagaagacatttatctggccaacaaacatgtgaaaaaaagcttataatcactggtcattagggaaatgcaaatcaaaaccacaatgtgataccatctcatgccagttagaatggctatcattaaaaagtcaggaaacaagagatgctggagaggatgtggagaaataggaacacttttacattgttgatgggagtgtaaattagttcaacctttgtggaagatagtatggcaattcaaggatctagaaccagaaataccatttgacccagcaatcctattactgggtatatacccgaagga

SEQ ID NO: 6961 - DNA, 1029 bp, Homo sapiens
aaaaataaataaaaatttctattttttttcttttgggctatacgaatgtcatgttattctgtaacattagattcttagggcattcattaaatctaatattcttttcctaatgggagagaactttttatttcaggcagtgcattatgtaactacatcttcctaatttccattttattctccagtctctttcaaaacataagttgagttataaactctgaactgctaatgtgggagtgggagtccacctctgaggatgcctacagtgctctctagtattaataaagtccctgctactgcagtgagatgccacctcacccattaggatagccgttattaaaattccagaaaatagcaagtgtaggtgaggatgtggagagattagaactcttgtgtactgctagtaggaatgtaaaatggtgcagtctctacgtaaagcagtatagtggtttctcaaaaaaattaaacagaattaccatatgatccagcaattctgcctctgggtatatacctaaaggaaatgagagcagggacttgaagagatacttgtacactcatgttcatacagcattattcacaacagccaaaagatagaaacaactcaagtgcccatcgatggatgaatgaataaagaaaatgtgtatacacacaatggaatattagccttaaaagaagagaaattctgacatatgctacaacatggatgaaccccctcagaacagtatgctaagtgaaataagctagatgtgaaaagacaactactgtatgattccacttacgtgaagtgtctagagtaatcaaattcatagagacagagagtaaaacggtggttgccagaggctgggaaaagggtggatttggggagttattgcttaatgagtacagaatttcagtttgggaaaatgaaaaagttgtggagtggatggtgagatggttgcacaactatgtgaatgtacttaatgccactgaaatgtacacttaaaaatggttaaagtaataaattttatgtacattttaacccacacatcttaa

SEQ ID NO: 6962 - DNA, 1029 bp, Homo sapiens
aagctgaaataggcaaggacggattcttctctagaggctctggaaggggcagacttctgacttccagaactgcgagagaatacattcctattgtttgaacccctcaagttgcggatgatttgttacggcagccctaggaaatgtgacaggctccaagtcacattttgagaatcctacactgaggcagaaactctgctgatgaggcccactttgtgaatagttgacatgcttccagctttataaacatcaattcaaatcttagaagagaatttccccctctgggcaaaatgggcgttgacgtatttttttaaaatgggagttaaatgctgagggtataaggcacctctggcccatatgggactggctgagtcccaggtcttctgtcttcccggccaggcctgagcatgtgcagggaggaggccgacgactggctgggcagatgcaaacctccatttgtgtattgctacctttccagagcctcggggatgctcggtggacacctcacaggaggtgagattgacagagccggttctagtcttagctgtcttcttccttcctgaaggttcctggacaagtcacctgatcttgtggaacccaagtttctccacctctaaatggaacacactaaattgttatgagtgagcatcagaggaaatcaagagtgtgtgatttagctctgcatgcaacgggctctgtagataattttcattgcagttattttgacttcactttggtgagtcgactaccccaggttttgaaatgaacacagggaggcagaatacgtgttgtaatcccaggctacagttctggagcctttattgaaggagaagacattttttatttgtaagaatgaaaaacggaaggcggggagcctatgtggcatggaattcaagaaatggagcaactggccactggcgatgggaaggcccatggcagattctgcaaatctctctggagtttctgcttgagttcctgttcgccgctgtgagcccctcactctttcgttgctgagacaccttcaccatggct

SEQ ID NO: 6963 - DNA, 1658 bp, Homo sapiens
ggatttgtatcagagtgttgtcttccagtgtctgcaccttccaactctcctgggagggagcaagagctgcagaaggatgaccacaggaagactgagtctcgagagctctttgtcagcccccttgacccgcatcccagggcagaggcatcgaacaaagacctaagtccatggataatccaaggcaataaatgcgctccacattcttggctgggggttagcaccaaagccatcacatgggaaggtttagggtttgagaaagcaccaccattacctatgtgttttcaccacccaggcatgttccctatttgttttgagaagaaaatgaaagaaacaaattttctgcacaaagtttccaactggcaaacatttttccagctgtgagaccttggacacattttcatctcagaactgttttttcttttgtaaaatgatgtaataattgcagttatctccctgggctgtggtgggtattagacaagaaaatgcaagtagaactcacagagattggcctgtaggaagcactcagtaacagctttgctttgtcttcttgtgattgttattcattaataaaatttatgctgctcacagagctctgttacttatttatttttttgagacagggtcttgctctatccctcagggtggagggcagtggtgtggtcatggctcattgtagcctctgcttcccggactcaagcagtccctccatctcagcctcccaagtaattggggttacagtggcgcactgtaacatctggctaatttttgtattttttgtggagacggggtttcaccatgttgcccaggctggtcttgaactcctgagcaatccccatgtctctaccttgcaaaatgttgggattacaggcatgagccaccacacccagctaactctgttatctttgacagggtggatgaagggttaaggttggagtgagaaggtggaattcgtcttgtcactctcggcctgcctagctcctcttgctcacttacctcccccattttctcactctgtttatcctccctgagtatctggggagacttgcaccctaccacctccaacccccaacacctggggaggcagttcaggtgggagcttggctaccacactgcaggctgcttcttttccccggaaccttgatttttactcctcagacgtcatctcagtgatcttcctgcactgggattgtggttaaatgtctgtactcaggatccacatgagggtgagccgctcatggagggagagcacttttcctccacctcatcccaggcctagctcggcatggggcctgccctggctgattcccagtgaacacctatcgaataaacagggaaaccgaaccttgaaaggaaaggggcgtctgcatatagacaacacctctttttctttttttcttctttcttatttttttctttttcttttttaactgtcttaaccatttccaagtgtaaaattcagtgcattaagcacattcgcagtgttgtgcaaccatcaccaccatctgtttcgagaactttccttcatcccttacagaaactctgtacccattaagcagtaactccacattctctcctcccccagcctttattttactttccatctttatgaatttgcctattctggatgcctcacataggtggaattgtacaatatttgg

SEQ ID NO: 6964 - DNA, 1107 bp, Homo sapiens
tggcagctggctttctggagagcgagtgacccaagagagaacaaggtgaaagcaacggcttttctgacccagcctgagatgtcacactccaacatttccacaatgtactgttgcttacacagggcagccttatttgatacagaggggactatacaagaatgcaagtatccagaggcaaggaccattggggggcatttgaaatgctggcaaccacccctggcctcagtgtcctcaccaataaggggcaatcgtgcctgctcaattgcctcactgtaggaataaaaggagatcctttgtgggaaggatgggaagtgccgtagcagttaggagctcagggataagacaggtgtgatggttaattttatatgtcaacttgatcgctaagggatgctcagctggccgggtgcatctgtgagggtgtttccagaagagattagcaattgaatcagtgagctgagtaaagaagatctgccctcaccaaagtgggtgggcagcagccaatccatttagggccagactagaacaaaaaggtagaggacaggcgaatttgctctctctatttgagctgggacatccgtcttctcctgccctcagacatcagagatccatgttttcaggccttcacactctaaggcttacccccagcagtctctccgtccctggtctcaggccttcagacccaggctgaatcacaacactggcttcactggttctccaacttgcagacagcatattgtgggggcttctttcataatcacgtgagccaattctcataataaatcccctgttatatatctatatatccatggttctatttttcttgagaactctaactaatacgacaggataaaacagggtgagatgtctgaattgagatgtattgtaaatgtaaaatatacccccagattcctaagacttaatatgaaaaagaatgtaaattatctcattaacatgttgaaatgatattttggatagtgtgtgaaagacattttttattaaaattaattttacctgtttcttttctttagttaatggggcttccagaaaatttggaatgatgtatatggttggcattctatttctattgggcagctctggcctacacca

SEQ ID NO: 6965 - DNA, 1068 bp, Homo sapiens
ctagagacaggttttcattatgttgtctaggctgtgtttctcatttttaacatgaagaggaaatgaaatcacttgcatgaatgatctgtttcatccactgaccatgagtagagatcatcaaatattgacagaatgagtaagggaaggtagtgttgacccacagcactgggcactcaccaggcccagcagtttaaattgtcaggagatgccaggagagttgtgacagcattggctgcagcaaaagagtcattagacttgagtttaaaagctaggagtgtgaggtcactgcagctgtcttaatatcctaaattaaaatcatattaaggcttcatgaatgttccagctgcttcttagttgcctttgagctgctgcatgaagaatgggaggcccttgggttgtttttcgcaggctcctggcttagactgggcaggagaaggcacagctgggtgtggcatgcacagggccaaggtagggagaccagaaacctcacttgggaaacttcatggtccagagacagaatgtatctcagtacaagggctgttgcttgtgtggggtagatttccaagatcttttaaaagccatcaatatagaggctccagagtccctggaccatgattatttaagtcatttattcgacatgaggctccctctcccgcctcatccaatttaccctctgtcttctctaggtcagcctagaaaggaggaactgattttctttaaataaatatgggttgcagcttatgatgcagagggtctaaggacgcttgtgatttctcagtccccttgtaaggtttaggtttggaaccgaattaaaacaccaaaggcaagaagtctaaaagggagagatgattcctgctgattccttctggcacctgcagtgcctgtgacaatctgccccacggggagcccatgccactgagagggaaatggttcaattcaggactggtaagaaattgggctcatataccagccattagggaactttacttgatgagaaaatgagaaccttttgtagttgctaaagagagcaccattcttaatttgacctcttcttggtcatgggagatg

SEQ ID NO: 6966 - DNA, 1068 bp, Homo sapiens
tcagcctcccaaagtgcctggattacaggcgtgagccacggtgccgggccagtacagttattcttatgctcattaaagattaagaacactgtggcccggtgcaatggctcacgcttgtaatcccaacacttcgggaggctggggcaggcggattgcttgagcccaggagttcaagaccaacctgggcaccatggtgaaactccgtctctaccgaaaaaaaaaaaaaaaaaaaaattagccaggcatggcggcgtgcccctgtagtcccagctacttgggaggctgaggcaggagaattgcttgaacccagggggcggaggttgcagtgagcctagatggtgccactgcactccagcctggcgacagagcgagactctgtctcaaaaaaaaaaaagaaaaaacaaaaacaaaaaaatacaaaaatttgcgaggcatggtggtgcatgtctgtagtcacagctacttgaggggctgaggtgggaggatcccttaagcccaggctgttgaggctgcagtgagccgagatagcaccactgcactccagactgggcaatgggagtgagaacctttaaaaaaaaaaaaaaaattaagaacactgagttggaccaaaggaaggaataaaagaaaatgtatatacagattgacagatttttgggtgttcaccctgttctgcatttaagataatctgaagtccctggtagtgaagtttggaatttgggtaacccaaggggttcttgcttgcttgcaggatttactctattttaactcaacatcaccctccgtaatcatcatccttaatacacattaaagcattggtgagttgtgaggagttagtgaagtgataaatgtgaaagcaccatgcacactattcagcacacagtacctgctcaataaatgattgttttgagtattaaacttccttgataaattccacatacaatggtgttttaaaatgttatacaggagagcatggctgcttgcattttcaagttgactgcgcagtggagctaaacagaaaatgctgtccctcttgcagccttggccactgggcttaggatgcctgggaca

SEQ ID NO: 6967 - DNA, 1047 bp, Homo sapiens
tgttcatttgtgaagattatttatttggttattttgggctctcttttgcttgttcctgtgattataaacatagcatacataattattaaatgaacactgtctctcttttttttaacttttattttaagttcaggggtacatgtgcaggtttgctacataggtaaacgtggggtttactgtacagattatttcatcacccaagtatgaagcccagcacccattagttatttttcctgatcctgtccctcctcccaccccccaccctctgataggccccagtgtgtgttgttcccctctatgtgtccatgtgttctcatcatttatctcccattcgtaagtgagaacatgtggtatttggttttctgttcccattagtttgctagggataatggccttcagctccatccacgtccctgcaaaggacatgatctcattcctttctatggctgcacagaattccatggtgtatatgtaccacattttctttatccagactatcagtgatgggcatttaggttgattccatgtctttgctactgtgactagggctgcaatgaacatacatgtgcatgtgtctttatagtagaacaatttatattcctttgggtatatacccagtaattgtattgctgggtcaaatggtatttctgtctttaggtctttgaggaatcaccacactgtctttcacaatggttgaactaatttacactcccaccaacagtgtataagtggaatgaatactatctcttaagaaatgttttatttttcctatttgcaaaaggcctatgttctttgtagaaagttcaaataatatacagatgtttgaaatagagtataaatatctccttgccctctactttagtattactccctaaagggttactattgaccaaagttaggtgtatattattctagattttagaaatgtaaatagaagcttcatgcacagctacttgtgaacacaaacactcatacccacacatccacacaatgcatatattgagttttttttttttttttttttttgagacagggtcttgttgtgtt

SEQ ID NO: 6968 - DNA, 1024 bp, Homo sapiens
aagctaagattaatttattattgacgaaataaaataaaaataagtttttataaatttagtgtagcctaagtgtatggtgtttaaacatctacagtagtgtaccataatgtcctaggccttcacatgcactcttcactcactcactgacactcactcagagcaacttccagtcctgcaagctccaatcttggtcagcgatctatacatgtgtaccttttaaatatcttttatatggtatttttactgcaccttttctatgtttgaatatatttatatgcacaaatacttaccattgtgctataattgcccacagtattcagtacggtaacatgctgtacaggtttgtagtgtaggagcactaagcactagtctatcccatatagcctaggtgtgtagtagcacatctaggtttgtgtaagttcactctgtgatgtttgcacagtgacacatttctcagaatgtatctccatggttaagcaaatcatgactatatattcactttgggagttcaaaggaatttagcagggataattgagtctgtaggaatcccttcagtgacagaagtggatgggttatctagttcttaaacttgtgagttgcagagttgaactagcagggttgagtcttagctttgtcagttattagtcattagccttggttttcctcttctgaaatcggtgatgatatcagtacatacttagaagatgaaatgagtctacacctgtcaagccggtaccaaagagcttggaaaaaagtaaacacttgaggacaggtcactgtgttcatcccattgtcacctacttccagcctctgcttgagagatggctatctcagttttcctggatgctcattccttagtttggtagcctgaagtattagaaagttcttcatttatggagctgcaatttgtctatttctacctcaaagtcattggtccttgttttgtcctctgatatgacacaagaatcagtaaaatctcttctctgtaagatggtttctcaaatattgaaggtggtgctatggt

SEQ ID NO: 6969 - DNA, 1051 bp, Homo sapiens
taagacaggtggctattatgtccccatgaaatctcttctctaggtataactctctgtttcctgccctcattcctcaaatgcatggttttgagagccttggtctttggtttgagtgaaacattggttggaacaataccctgccactcattcctttggaatttaaaacttattggtctatcttcagctgccgatagaacacatcagcacaccaggtaccccttgatgacaagaatctctccgtaccaaaaaaggacaaagtgtcaattttagaatacaatgtaatggacacacagcccatctaatcctccgggaattctaaattctactttttctatcatgttttacaggtcatcagagagcaacatgcccaaatcacgtgagcatatgctcttacaggatgttttttctgagttatgttgaaaatccatttctcattcttttcatatgaaagcagtgctatcaaatcgtgtttgctgtttttataaagtcatttgtgccaactctgtcttctttttgtccctacagttcccctgggaatctgtctgtgactacggagacctcacaccatgagaagggactatacccccttggcccatgcacctgttaggctccctcacctgaccattagagagcaccttgacagagagctgttaggggctgcccatcctctgtgtgtctgatgatcaaagtaaagaactctagtttgtcttagtttttaaactccttaaagtttttctaagggtagcttcaggcagagggaaaggaaatgttttcatagatctgctgggcatttggggattttgaatttctttggaattcagagaccttagcattttgtggtatcccatcccctttgggtatctttatgttatgcgggttcccatttgctttcctctgtgtagctaattaagcacttcatgcattagttgcatagaggctaattacgacagatgatgttttagctatggcacctgtatgtagagctccctgtagacaagatggcctgtttgtttttgcagagaccaaacaatcttaattttgagaataccaa

SEQ ID NO: 6970 - DNA, 1025 bp, Homo sapiens
agcagtgtgagaatgtactaatacagtgttcttcaatccttgaggatcccaaatggaagcccagggaatggtagctggggacaaccccagatgttcaccggggacagggacattaagtaactggtccatgattcacacaggtaattagtgacagagcctgaatttgaacccagatagtcttactcaagagccctttctctgacctgtggtccttctagattctccgactcttaaagtcttgtaataaatatcttacacgtatatcttatggtttcttcactaagaatgtcactctgtacctaagtgatactaacttttggcaaacaataattccagaaaaccatagaatgtatcatcttatggtgtgaagtggtagtaagggcactggattaagaactaagacttggtcccctgttaaccttggacatgtttcttacctcccagagcctctgttttcctcattggcaaatgaagggtgatgactccccttacatacctggctgtgtggttctaggggtcaagcaagacagtttgaagagcctgaaaagcactaaacgtttatgagcacataaattattatcactatacataggattgtgatctattttgttccaaatatgagaacataacactttttttgaatttgttaaatttgttaaattttcttcatttttttctctctctctctagactctctctctctatgtatatatgtatatatactgtctctctctgtctatatatatatacttgtactgctgaacttaaacatatacatatacatacatacatatatatgtgtgtgtgtgtgtgtttaaatttaagttcaggggtacaagtgcaggttagttacataggtaaacttgtgtcatgggggtttgttgtacagattatttcattacccaggtattaagtctagtacccattagttattttttcgaatcatctccttcctcccaccctccacccttggataggcccagtgtctgttgttcccctctatgtgtccatgtgttctcattatt

SEQ ID NO: 6971 - DNA, 1041 bp, Homo sapiens
ttccttaagattattattttgagttccttttctggcatttgtatatttcctcatgattggagtctgttactggagaattattgtgttcttttggaggtgtcatattttcttgctttttcctgtttgatgtgttcccacattgatttctacatatctggtgggacagtcacctcctctaattttatagggcagggaaagacttattcataggccttgggatgtcagtatggtggggtgtgttggttattcacaggccttggttctacgtggatgcagtagtgtagtctccatacggtttcttaagctgtgatccatgctagtggcatttgtgagtatctcaggggcctaggctaagagagtttgtggtgatcatggtgctgcttttctgagggtggactcaccaggctgttgctcagattgggggcatgtacatgcacacagtaggtaggccaattaggggtctggcttgctgagactgaggacatggaactgttactctggctggggacatgggcgggtgtgtagttgctaggccagcctggggtgtgtttgctggggggtggcctatggggctgtttcttaggccctgagcatgggtgtgtagctgcttttccagcctggtggcatgttagcttcttggtggctcaaggacctctccctctcaggggagggtttggctggctcaaggatgggttcaccctggccaggactgccagactgttcctccagctgtaagtacaggcagtggggggttggtttccccactgaacaagaccagagtcatagccgatcctgggctcaggttccacgcagttgaggtagtggcattcagccacttgtgtgggcttctgtgaatgaagatggagccccaatgctgaataggtgcagtggctacttatccccaggggagggcacacttcagagtggctctggacttaagagagtgctgtactgcagcagcttggctcacagtgggtgagtgggaggtggggagtgcacactttgtcctccaatctggagtaatgcagctgcattaattct

SEQ ID NO: 6972 - DNA, 1699 bp, Homo sapiens
gctctgggatccatgtttaagatgaagactacatgggcagggtggtgtgtgcttgtaatcccagacacttgagaggctgaggtgggaggattgcttgaggccacttgtttgagaccagcctgggcaacatagtgagacttcgtctcaaagtaaaagagaaaaagatgaagactacactcaggaaagctaagcagagaaatggaaagaaaatgggttcctgcagatgtggctacatccttgatcaattcttggcccagtaagagattatctccagatctccagactttccaatttcataaatttattttattgtttggtaacaagtaactgttgtgttacttgcaaccaaaagcatccttactgacctacgttttcttcccatcccttgggggttgctgctctgcagagggttatctttggctcttttcttctcacttccatacttgccctgggcactttggttttcttctatgacttaactttcctttgttttctccagctcacgcatctctcttgcattctctatctgtagaactggatgcttgctggacatttccacttggatgtctgggtagcaccaaaatcctgatatgtcccaagatgagcagaactcatcttcaccttgtaagctgcttttcctcttgtcttctctcttttgtttgttgattagcattgccatcatcctggtttctctagctaaagcccgggcaagttcttgtcctctccttctctctcacttctccccctgcccatgaacttattcactcattctggttaatactttccccctagttaactctcaaaaggatctgccattatccatggtcactgctattgctctagtcatagcaccaccataccaatatgaaccctctcaatacccctatctctaatcttgcccatccactcaagagccagagggatccttccaaagtaaggtccttcctttgcttaaaatctttagtgactctttatcatccagagaatcagcaacacttctcataatgtggcccagacccagctcagggtttctttcccacttttcctcccatatcctggctttatttacaattcacggtgttataagccatccctgctctccacgacatttgcacgtggttctttgcatgtgctgtgtcctttttctgaaatgtcctccctcacctcctttccttttatcttcttggctatcttctgtttgaccttcaggactcagcttagggggctactttcttctggaggcatctacagatccctgccccaaactcataccagctgatatcagctcagactggtttataatggtatgtgagagccaatactgggcatctctttccagctccaagttcagtgatttcaccttgatagcttaaaatcagaacggtggaagtatttacaccaccgaaatctgcaaatgctacaaatcagggtgtttttgtttgttgatttggtttttcccagagaggcagtttaccagcacaccagtgggcataattgcccgttgattttcccacttccttctttaactggtaagacccttcgggggcagcctcagcagcccatccaccctctgcccccagtctctgcacagtgcttgatctacaatatgatgcaggagttcaggatgatgtgggcatgccaccctcctctttccttactagtttgccacacagaaactaaaagctggcattttcttcct

SEQ ID NO: 6973 - DNA, 1058 bp, Homo sapiens
agcagtcccagagtatggagggaagactacatgtgtaatgtgggaactgtgctggcctcgggcgcaggggctaagctgcctagaagatgttctgatgggctcctttccccaggatgcctaggaggtacagccttggaagcccccatgtttctgcgtcatcatcatcatcatcatcatcatcatcatcatcaaaggccagagagaggatctccagggggattttgtgaatccaagttccactgatctcaactggaataacttttgctcttggtcctttggatgggccacctgggatttgtctggctgtgtgtatcacctgtgattttacacatccatcagttaaatcaaagatgcagacacaaagtcgagagccagggcatgttgggtggattcatgacactctctgggggactctgggtacttaaatgaatgaatggattttgttcaagacataaatataatcttttcatcagtgacagctatgcctagaatctctcaccaatgtgggctggctggctattgagctgaattgtttttggagaaacttgctgagatatcggagggtaccagggcagctttggggcctgggaggctggcttgctcacatgaacccaaggctggtgctctgggcagtagatggacagggcagtggggaaaactgactccattttaagccaaaggtgagcatagcctgagcctgtttaatcaacaaatatttattcagaacctactacatgccaagttctgatccaggttctgatgatacaaaggtcgctaagacatgacccagcccccaaggcacttgctatctaaatggctacaataatatgtaatattggaggtcctggactctgaaaccatgctcttccaagttcaaatcctggccctgtcatttactgtgtgatcttaggcaaattactgaacctttctgtgttccagtttcttcagctgcaaagcagggacaatgatggtaggtttgctatgaggattaaatgaactaatgtgtatgaacagtttggcacagggcctgtttcatagctagtgctcactaagggtct

SEQ ID NO: 6974 - DNA, 1030 bp, Homo sapiens
tcattgggtatgactcacagtccataagctaaatattatgatctcccttttacagatgatgacacagagaaaacttattgaagagtgtcccttgaaagattcttgttttccatatcaaagccatcctaaagtgggttgtcagggcacatatttggagtggttttctgtttttgtgctcatctggatctcccacacatttctcccctggtgacgaggagcctctgggctatcgtcctggacattggtgagtccagccacagtgtggtctcagtccagggcctggggtctccaggcctggaaccaaaggttaataggtagaaggtgagtcagtactgagtctcctgcctgacagactgggaaacacatgcagacactagtgtccattccctgggcactctcactgattttgatgagtatttacagaacaggccttgctaagcatgacttacctttcttaaatcacaagtttccctacgattttgttatttacctcagtttgaccataaaaactgcagactaaatactctcccaatgtactggttatctgttgctgcataactatacatataggcttaaaacaataatgaacgttctttatgtctcacagtttctgtgggtcaggaatttgggagctgtttggctgggtggttctggctcaggggctctcatgcgttgcagtaaagaggtctgctggggctgccatcatctggaggctctacaggggccccacttccaaaatggctcacatgaggtgggcaagatactgctggctgttggcaggagacctcagttcctccccaggtgcacttctccatagggctgcttagtgtcctcacaacatggcacccgaactctcccaaagtgagtgagccaattaagggcaaggtggaagccaccatgtcttttttggcccagacttgaaagtcacacactattgtttttgcaatatcctatcagttacacaggtcagctccattcagtgtggaaaaagattacatgaagacacgactaccaggaggtgggagtcact

SEQ ID NO: 6975 - DNA, 1125 bp, Homo sapiens
agtcaagcctgattaataataagccttaagcagaaaaaggtgagctttaggacagaagtctttgggtcaccctaatgactcttgagaaacaaattgccatctataaacccaaatatttatgtcctatttccatgctggcttacctgctttcagagcagatagcaggttaaatagcttgttttccaaattctaattcaggaatataaatatattcaggattttcatgagatagaaaggtgagctggatgcagtggctcacgcctgtactcccagcactttgggaggccgaggcgggcagatcacctgaggtcaggggtttgagatcagcctggcaaacatggtgaaaccccatctctactaaaaatacaaaaattagccggtgtggtggcaggtgcctgtaatcccagctacttgggaggctgaggcaggagaattgcttgaacctggaaggcggaggttgcagtgagccgagaccacaccattgctctccaacctgggcaacaagaatgaaactctgtctcaaaaaaaaaaaaaagattaaaaaagaaagaaaagtgaacttgaatctgagacacacattttcccaattaccttgatcttagctctgcctgcctcagaagcaggagctgataccagcgcttgtgggatgtgtgagagctggtgttaaatgtttgtcactgcatgcacttcctgtactgttcgtcttcaagtttacctttctgtgcagacactaagccatctcacctgttgccctcaattgggaggaccactctgaatggggtttccatgattaccatttctcttctatttagagagaatctgccatcttaatatcctgaaaaccaacagacttgaagaggctgcagactgcactgtacgggaagccataagcagaaggaaaataagcttagcaaagtatagaggaagttggagcaggggggtaggagaagaggagaaaaaagcagcttgaatttcagcttttgttgaaggaaataattgaaaattaaaatcattttgattttcctgggaaactgaattgactgggagctcacctgatatgtgaaaagcaagctcgaggttcacctaccatgccgaatgtgttctggtttcccaccagccaccccg

SEQ ID NO: 6976 - DNA, 1031 bp, Homo sapiens
ttcctttgatgaacagagctttctcttaagtaaacatttaagacctaattggatcattggtgtggtgtcacagtaattaatgcacagcctggagtagttacacaaatgttggtctgagcaataccaagtactgctgagaaatcagaggggcccgtgggatccagccaatgagcctggtgctcgattgttcttggtgatgaggaagaaatagcaggaatatctccaggatacaaggtgtattattcaaagattaagaaaaaatctcaacaatggctgaccagtgattagagctttattattttgtttagctaagaatagattaaaatgaccccaaagagagagctcagtgttctcattgattttatgttttgttatttggttgagattggggtgcagaaaccaacttgagctagtttaagcccaacaaaggaattcactgtaaggatgcagaggtttttgctggaacccaagagcagaagtacagctaggcttctggaaaggaatggtcttagtatagggaagctgggtgtgttgtctctatctctcctgcctctgtgctccaaagagccactacctcattttttccctctccctggaaattttctccactggtgttgtagtaaatgtctaatactcaattctctgatgaaagagatgccccgatttgcagtggttgccaatttccatggtgtaaatacttccaccatggctgattcaaagctaccaatgtggaggcagagttgggaagagatgtgcaatagcttatgattatatagtattcccaccttacagatatatggctgtaaagaatctcaggagcatagattataataaactataataaaataattaggaagtggtgcatttcagtacttattacctttgttttaaatataatttaaatttatataatttaatttttaataatggttgtgttcacaatttggcttgcagaattcctgctaatttaagaaatcagtccttgggagctggtacttatgagctgattctagcataccacatttcttccc

SEQ ID NO: 6977 - DNA, 1033 bp, Homo sapiens
caaagtggtcagaaaattcatttagctgctttggaaaaattctaatgactccaaaaacataaagcagaccatttagagtcatttaaatgtggttcaacatagtgaacacatactatctcccagctgttcagcttttaaaaggtgctggcaatactattttgtcctttttttttctttttatacttcttatggttaaaaatagcattggagtttcaactgatgatcttcagagatttatattacatgaaaaaacaaaatctaggaaagaagtaatatctgactttttaagatgatgcctttatttcttgatttctgaattttaacgtataagattttgtttacatttttcttttcaaataaaaacattttttttcaaaattttaaaatttacattcaatcatttggaaacaatgagttttatgaccatacaattgtatttcccattttgcttttgccacgaggaagctctgagcccaaattgtggctggcttctagcaatttgtaggaccctgtggtgcagaaccaggtgtctagaccctctatgccacccccgcttaccctattcttttctatttgttaatggttttgtttatggatttctatgagcctccctccaccttttaaaaagataaagtgaagtgtatagtgtgtgatactaaaaaatcatctactgataaaatggcaaaggacttcccagccccttaataaggcccaatttttctgctggagttgaggtctcccacccaagcatctctgcttcatttacagcccaccccaggacctcacccagagctgagccctccagtgcccagtggggagagtggtaaaaaagagagggatgataaggtggctgaggaatgcttagcaaggaggcccaggaagctcactttccaaaggactcttaattgtgccgggaggaagcaatcctcctctctgtaaatgaggtcttgtgagtgtcccggctgtggaacagggccttggcaaatgagaagagcctttctggctggcaggtgggggttctgcaccagctcag

SEQ ID NO: 6978 - DNA, 1050 bp, Homo sapiens
accaccaccattaccatcaccatcatcacactaccaccaccattaccatcaccatcatcacactaccaccatcattaccatcaccatcatcacaccaccaccaccaacattaccatcaccatcatcacgccaccaccaccaccattaccatcaccaccatcacaccaccaccaccaccatcaccatcatcacaccaccaccaccaccatcaccatcatcacaccaccaccaccaccattaccatcaccatcattacaccacccccaccattaccatcaccatcatcacaccaccaccaccaccattaccatcaccatcatcacacccccaccatcattaccatcaccatcattacaccaccaccatcagtacaccaccaccaccattaccatcaccatcatcacatcaccaccaccatcacaccatcactataattaccaccaccattatcacatcaccaccattatcatcaccatcatcaacatcataccaccaccatcatcatcacatcctcttccttgatgtcttatctccatggcgtgtacactggatgtagaatatagtcttgctgggtactacgggagctgtatctcagtagaaggaatgaagactagctcttgataagctgaaaatcccttaatagcctacattctaaatacgcatattcattgtaccaggggtttctaaccttgctttgatgatatcctagtgtcactgtctcaaaaccaaattaattttggacttgagtatttagcgttgggagaaggagtaggattgtatattattataaccaacattgatgtgcttttgaattccaaaaggacgttttatttctttttattttttctagagacagggtcttgctgtgtcacccaggctggagtgcagtggcaagaccatagctcactgcaggctccaactcctgggctcaagtgattctcctgcctcagcttcccaagtagctgggactacagaggtgtgccaccatgtccagctaatttttctattttttattttgtagagatggggtcttgctatgttgcccaggct

SEQ ID NO: 6979 - DNA, 1045 bp, Homo sapiens
tccagtcctctgataggtggagtcgttcatctctgcagtaaaaagctaatgcttagtctagctttattcatcctttttggcacatagggtatatacggtatggctccatggagccaaccaggagcctctgcctggtggaatgatctgtgtgccaggctggaagagacagacactctgtttgaccaacaaatgtatagaaaatagtggccagtaagtagcaattacgtaataatcttatccaaagaaaatgtgggctcaaattaagatgatttcaccgggaaaacattaaggtatacaaagagttcttaataaatagaaataaatagtgcagggtttgcgccatggtgattttcgatggttatctgccctcgccgctgctgctccagctgcatcttccgcggggctcagcgcagcattttgctctacaaaaacaactagctcctttccagccaatgattacttgtaattatgctttcccctgctattattctaatagacctgtcatgttgctcggaggactctggcatttggaatatacgacggcttttatggatggactgctggaacacttaatatagctctatttttgaattatcaagttctatccttttgaagtctgtgttagtggaactcctatttatgagatgtgctgtgcttaaaggtttgctattgatgaagaggtccaacagagcctttatcgtaagtacggcagcattctccctgagagataaatagccgtgctaaaaggtatgctgtgtacctaggctgcaaattactagccaagtacctcataacagtatacttcaaaaatacctttatgcttcttgtttgttctcttttccatagagatgaatgacatttcttaaaacacagaggggtggaagtgtgttggtcattgctggtcatcgacattaattgggtttgaggaacatgtttgttctggcacagggtgtctgagtagatgcacgaatgtggcttacatctcctgtgcttgctgttgtgagaatttgcttttctttatgttcccttaacctaaaggtggact

SEQ ID NO: 6980 - DNA, 1034 bp, Homo sapiens
tctagaactgtgagagaataaatttctgttcttcataaattacccactctcaagtattttgctatagcataatggactaaggcaatccccaactgaaactctgtacccattaaacaactcattattccctcctccccccagcccctgacaaccactgttctctctctacaaatttgatgactccagatacctcatatgagtggaatcatacagcatttgtcctttttcttttggtttatttcacttagcataatgtctgtaaggcttatccatgttgtcgcatatgaagaatttcctcattttttaaagctgaatcacattccattatatgtatgtaccacattttatccattgatgggcacttggcttgcttctaccatttggctattgtgattactgctgctatcaacatgggtgtactcacttactgcttttgtcattcacttatgatatttgtttagatccattagttcattatgggttacaaaatggtgattttctaatattttctctttaccagttttcaggataatgaagtgatagatcagtattccacaaaggtgacccattttttttttaaaccaacttttttttttctttaaatagctcttcgggttggcttctgtatcctttgacacaattccaggagccttttatcactactttgtttcctggcagaaaaagatgtaccaagctaatattgtgcattttctacccatccctcaaatccatcacttccccaataagacctggttgctttgggatggtatttagagactatatctgggcacttggtgtgctcattactaggggattgtcattgtttctaggtttttcagtaaacagagctaaaatatgtattttttaaaagataaattatgaagtcatactgttattttaaattcaaatttagagtcacagtgtttctacttctttgattctatactgtatctcttttatgatgaaaatcttcttttagattaacataattatttattttattctagactgtattactagtggcttcaaaataa

SEQ ID NO: 6981 - DNA, 1074 bp, Homo sapiens
gaatttttaaagcaaaattcttagtattttgtccttacattcacttactagatagttattgctgatcaggtcttggaccaggcccagggagatgagggaataaataagacaaagtccttatctcaagtatttcatagttaagatggaggggacaaattttaagataatgcagtgagaacacttaggcaaaaaaagaagcaaaaactatccaaatagaaagaaataagtaaaattatctcgatgtgcagatgacataatcttgtatatagaaaatcataaggaatcaacgtacacacaaaaaactattagagctaataaaagagtttggcaacattgcaggatgcaagattcatatacaaaatcaattatctttttgtacattggcaaagaacaattaaaaaatgaatttaaaaattccagctataatagcatcaaaaagagtaaaatatttaggaataaatttagcaaaagaattgtaagacttgtacacaggaaactacaaaacatcattgtaagaaattgaagaagacttaaataaatggaaggacatcctgtattcctgagttagaagacttaataaatggcaatactctccaaatggacctatagattcaatacaatccttatcaaagtccaagctgattctttttttattggcagaaattgatgagctgattcttttttaagtcaactggtcatatcacatgatgagctgattctaaatttcatatggaattgcaagtgacccagaatagccaaaacaatcttgacaaagcagacaaaaattggaggactcacacttcccaacttcaaaagttactacaaagcagaagtaactgagagaggtactgatatatggctagatatgtaaccaatggcatagaactgagagtccagtaataaactcatacattaatgattaattgatttttgacaagagtgccaagaccatttcatagggaaagaatagccttttcaacatatggtgctgggacaactggatatctatgtgcaagaaaatgaaattggatgtttatctcatatcatatacagaattaacttaaaatgattaaa

SEQ ID NO: 6982 - DNA, 1055 bp, Homo sapiens
gggctcaagaaatgaagacgatctctggctaatagcaggtgcattttaatcacaaggcctatttgatcatgtatggcttccctgtgccttacaaagacagagttttaaaagtgtgtaacattagaatatgcaaagcctcggccattccaccctgccccatgaagacttacacgatcccaatgcttaaaatatggagagaggaacaattaacattatgtttccagtgcgtatggtggccctaagtagcttatgggctctgtgtccacctagaagcaataaagtcatgttattatgcattaaataaaagaaacatcttaatcattatatatgaagatctcttttccagtggtcggcagaacgaggggtaaaaccggcttttctttcccttcacagctcacttgagaccgggagaacaggcagagaagcctggaaatccggatggcttctaattgtctctttacagccaactaggctaccaaaatgattgtctttttctctccaagccttactgacctgtggctaatgagatttgtgcttcgattagttgtagaacataaattagctaatcaatggcaatggattcacattatttctcatacatgagttccgctgcagtgatctgtatttaatattcaaatcaatttcgaatgctcaggatgattccgttaacgtggcatgctggaagctggcagcatctgtagcctcctggccgatgaggactaggccaagcctggatgatacacctgcctctcatcggcttccagagctttgcagattgccttgccttccattacacagggtgaggggcaaatggggttcagcagaaagcttgtggaaaaagcaaaagaaaatccaggagcacgtacagcagaggtggcctctttcctgaacaggaaatcaaaaagcaggcgagctaatttcaggtttctgatgtgcaaactttgcaaagagcgaggttgtcggtcagcgtcttcacttttcagcaccgagaagcatatttttgctctttgctgtaattgtctcatctgtacaattaactggcatcttggcataaa

SEQ ID NO: 6983 - DNA, 1024 bp, Homo sapiens
taactttgatactctcctgctcctacgtaaaaggtgcatttgggtgtgttccagagccattctccccttttctgagaattgcccttcacctccgctgtgtccttgcagccaggattgttctatgtgatttgtctccttgagcatggattgagccagagtggacactgaacccaagatgagtcttcacatcctctctaagaatgtgggttgggattccaagatgtgcgtcagtcttcactgtttgcttaaactcaggatgtttggagtcaggtagtggggaatgtctctgtttggccacatgatgtttgaggcagagaaaagtgagagttgtctgcagacccaggtggagaccaaatcctcaggtcctcatgctgcttcctcctgaggactatagtaaagctctctcttcccctcccgagagagtgtgaatgggtatctgtttctttcaagaacaggggtgcaatgtgaagatcacattaaactatgtctgtggaaagatatgttctgatctcaagacaaattctactttacaatgctttcaaagttaataggtagtaagccgttgcatgctttataatttagggttaacactaggatgaatcctctgcactgtgttaaccggatagaagtatcctttatttcatggagaagacaccatgaaataccatgaggccatgtccccacatgggtggtacttgtggactccagtgagactccctaataaagcccagctccccatagactctcagtcacattgggttgagttccattagtaatgtctggccacaacaaagaagtgggttcaataggttgctgtgggtcctttgtgaagaactgctaatctcccccaaattaccgccctttgaatctctactgcatccagcttttttttttttttttgtagattggctccatttaaagcgattaaagtggagatctgattggataacttcatccaaattctgtaaacgccacttccgcacaaacggttgcttgcaatcaatttaatttttcaaataaaatg

SEQ ID NO: 6984 - DNA, 1038 bp, Homo sapiens
accttggcctgcttcctgagcacggaagccagaatccaattccatattggccaagatcctgcacatctataatgctaagaagcttcaaggatcttattagcactgggaggttggggtgaggcttgtaaatacactaagtaggatgggtaatagttaacctagttaacctagacaggtatctcaaagcgcctcggtgattgtttctataaaccttgctccaaagagagtttcttgctgtgtatctgttgtcattcagttctaagcattcttttaatgaactctttcaacagatcctaatattttaccctgtgtccttcttgtttctttttttatgttttaagtttatttacaaacatatctagtatgtcataggagttcgagtttgatccatttttcaaagagcttgtacctctccattatttgttaaacggatgaatgaaaacatccttattttgtttttcattttctatttttatagatttagggcatacaagtgcatttttattacaaggatatattgcacagtggttaagtctgggctttttgtgtgcccatcatctgaatagtgtatgttttatccaagaggtactttctcattcctcagcacccaactcccatcttcccacatttggagactccagtgtctattattctactctgtatgtccacgtgtacacaccgtttagctcctacttatgagtgagaacatgaggtatttgactttctgtgtctgagttatttcacctaggatgatggcctccagttccatccatgttgcttcaaaaacaattatttcattcttttttatgactgagtagtattccatggtgtgtgtctctacacacacacacacacacacacactaatacatatatgtgtgtgtgtgtatatatgtgtatgtatatgtgtgtatatatatatatatacacacacacacacagatataggcattttctttatctaatcatctgttgacggacacttaggttgatgactttgctactgtgaatagtgctgcagtaaacatatgagtgtgga

SEQ ID NO: 6985 - DNA, 1051 bp, Homo sapiens
gtcttccccctgaaaacacacaactccagtttctaatcatgagataaacaccaggccagtccagactgagagacattctacaatacaggtctggcactcctcagtactgttaaggtcaccaagaacaaggagtgtctgagaaattgtcgcaggcaagaggagcctaaaagatatgaagactacatgcaatgtgggattccagatgggatcctacaacagaaaaaggacatgagctaaaaactagggacatcacaataacatatggattttagttaataataatgttttaaaaattagtgacaatacctacctatttttgagtgctcacacgtgccaggcactgtgtgtagcatttgacagggaccgtcacattcagccttcacatttgctagccaatgggaagcgaggcatctgacaccatacacccgacgctgtgtgcagactaagcctttgcccctgcctctaggaccagtttggactcaagatgggaaataatcccaagctgtagcacttacatccattttctctttctcttttgctaacaaagcctcaattttctttgggctggctatgtggcgtcctaaaaagcttctacatattttatcctgtcttagagctggagtgactgtattctatcagtgaaatgtgagtagaagcctttttggggggttaggggaaattttttgccatttaatgttggtgttgcccttcttcccatccaggatatagatgtaaggctggaggtggagcagctgctcggcgatctgtggtgacaagagtggtgatgagaggcacatgctgaggatggctgagcaggaggacagaggagccagggacagtgccgccttcttagagctcctgcccaggccctgagcagcccacctcactcctggtacatggatcccatctctagggctctgccccagctcagctttgctgctggctctgtactgaccagatagttgattctagtaactaaatttttactttattttccagggactccggttcctgatcttgtcttctctttgcctcaggtgtctgccaagtt

SEQ ID NO: 6986 - DNA, 1035 bp, Homo sapiens
atgttaaatttcatgaatcagacctgaaacacttttttcaggtagtggactctctggttgaaggtagaaagctgtaattaagcatgatcaacctaatgaatcacaacagaactagagcatgctaggatgtctccccggctgtgtcccccttggctccttgatgataatgtgtgacatgtttgcatttatgggcatacaggtttaatgtgtcaaaactgtgcatcacatgggggatggattgcctcattcttgaggacttgggtggtataaataaagccaagtctttcattttgaggaggtaatggaacccaagaatagagagtatgagaccaagacctaagttcaaatcttccctcagacccctgagcctctctccttaaagctgctgtctccacccaacgcagggactttgtacaggccagaccctctgcttggaaggttctcagcagatctgctcttaggggacattaaggcgttcatggaatggaaggggaatgacctggactgagcagggtgtaatctccagccctggttgcatgatgtggatttccttccttctcctcattggaaaggggagctgacctgggtgatcaggagggcaatacttattgaccttgaaagctgcagggggccaggcttgaggggattgatagtgaaggaggcaagacttgctcagaacaagctgtcagccaagagaaggaggtataggaatgcagctaggggaggggagatgacaggggtgcttggaagcttggcaagagggtgctaaggtcagaaattttacccaggacgtttttgtctacacaatggtaagagtgtaactcctcgctctgaaatataaaaattatcaggtgttttatacacctcttttagatgacccaattgccaagtaatctgaaaacctaaggggtaaaatttgatttaacaaaaataatcaaattgattccaaagtaatcatgcctgatattgagggccagtcctgctaagttgcttcacaagaagcatctcatttacttctcactacatctctgtgag

SEQ ID NO: 6987 - DNA, 1094 bp, Homo sapiens
taagagcccagacgtgggactggttcaggggccttggatgccatccctaaattcactaagggaagagtgggcagggctgttagaagctaaacccccaggcttgtgggcttgttgtgatacctcacagataggagcacatgagacaactaggaaggagcttccactcctgagtcctgtagacttgggagctcgtcctaagacacagaaggacttttgtttcctgcattgtcttgttgaatcttcctcgttaagtggaggagtcaaaagcatcctcctattgttgactcttcaggctttgacaggggctattagaggcatctaggctaccctttcccacagttaagcccagtgtccatattttaggtgggatgatgagggataggcatgtccaggaggaaatgaagggaaggtaatgagtctgagtacctagaaacactaagggtgttaagtttggagaagatttggggaagttaagcacaattatttgtttcaagtacatgaaggaatgctcttggaagggagggttgatttgcttcttaatgactatagaaagctgaactatgaccaaatggtagaccagatgagccttgagctacctcccaagatagagattctatgactttctatgcacaagtcccccttcttaccctttaattcctctgattgccttcttctgactttcctgtcccatagggacaaaaatggatcctcatactctaatgtctgtattaaaaataaaataaccagagatactattataactggcacaggagctacaagagagcacaattcagttgcttcattttcctaataatggataaaatcacaccagcaatttcccgttgaatacatttgtcaatcaaaaacccaacacttagagagatcccccatagtgtcctccaggtactatctgtaagtgagaggaagcacacttctcggcattgttataactggagcaaataggctgagagcttgtttaattttttgaaagagggttctccagcttttggctggtctaatgaaaactggtctgtgtctactttggctgaattctttgcacaatgacactgcccccagttctataatttctgcta

SEQ ID NO: 6988 - DNA, 1070 bp, Homo sapiens
gttcttgatgattcacaacagcaccttgggtagcagctggcatccctcctctctgcactgtgagggaagtgattctctgctccctagcttttgccccagtccacttatttgcctttttagttcaatgtgaaggtgtttcaggctataaagaactatcctatggttcatgggcattaccaatccacatttctatgttcttggccatgcatcttcaataagaaagatcctatcgccaaatgctttcaaaagaagcaatctcagtaaatgaattatgctctaataaaaaattgatgggatataatatctgaattaggagatctgaagaagcacatgagaagaagaataaagttctaatggttgctattgttcaggcagtgcccttcccagatcttccatcagccgacacagagctggagggccctttatttaaatgttctgagtcaccgacacggcctccactatgtttgtaggtagatgaaaaatgccttctattaatgagtgttcttggacttaattaaaattgataccactttcctcttaataagaacagaaaatggtcccaaatttgaatctgttctcgtgaagaagatagcatcaagaactgggaatgaaacaaatgcaatttttttctcattacaacattcacattttgacctcaaggactttcttagggccctattcttcgttccctcctcccagccactgcttttactgtgcaaagcaatggtacaatttttccctcttgaaaaagaagtcgttgccccgacgtcttgagttgtctgtggggctccagggcatcctctaagtccctaaataggttgagttgaacaactctgcagtaggtgagaaaatattctgccattcacgggatgtgattttgcataaaatggctactgaagaatcctatatagaagcaagaataggatgcatttctacctgctggtggccacattggcagttgctgcattgggctcacctggaattttgggttatgatgatactgcatccgttggctttaagtaaaagagggaggggtgaggcgaaacccaccaaaatccctaaaacctttt

SEQ ID NO: 6989 - DNA, 1087 bp, Homo sapiens
aagtgctcactgaggggatatctctccttggttctggcgttaacttgctgtgtgatgttggacaagtaacttgacatttccagacctagatccctgaattattagaagagacaaaagacaaaaaccctccaaaaacccaggcttgatctagaatacgcaggggccgcatctggcccaaggggacctgatttcccctaggatgagtatctcattaattggcctcaggatggtgggacctggagggcttttgcttcctggtatgttccagttctgcaattgttgatggaatatgccctgaacgtaggctctcgagacaagctgttatctcattactccctgggaggaagaactccctgtcctttcgttttggggactggccccccttggtgaggacttctagtgctgcaggtatctggtggcccatttactgtcctcaccagccctgtgtggaggctgcttcagcttcatgttgtgcacaagaaaataaactcagagagatgaagactgaccccaaaacactagttgatttgaaccaaggtaatcttgactccgaaacccaaacttcagtcattctctttatgattgttgccctgtctatatagcatctgttctattgcctactaaatattttaaaatgaactcactatttgtattacttttaaatggcaaaaaccacaattacttttgcaccaacctaaatacttagattccttttaaaaagatttcctttaaaatcaaatttattttgaactatgaatttgatgtgctatttatatttttactgataaatatcaaaacaaagtaaaaaggagatcgttatgtgcactctcggatatcatcttaaaagccggtgagtcatcaatgttgctcttcagagacactgctctgtgctttgtcccagctaaatgtggctggaggcttggcatcaggtgggtcctttggacagtcaagcccttcctgtgggcttggggaccatttccagtttccatttgtctctgtgctgggagtaaccacttgttaaaagactccctcccatctcctccccagcttgccccaaagtcagcttccacggctgctagatcagctc

SEQ ID NO: 6990 - DNA, 1029 bp, Homo sapiens
acatagcttgctgatattgggtggttgtgactgaggctcacaggaaatggtatctgctcccagtgttaggttatgcatccttgcttgcatgggggttctctttcccattctctagaactgtagaaaaattgagcatctcttatatctatcgagtctgatcttcctaggagttgagcccaagaactgggtcagtgggttgtccctgcagaatgttccttagtggcttcctacacagtggacccagcacccggtgcagccagcctgtcaccgagacagacgggcaatgccaagtgaccctcacctagactcacagagataagtcactacctcctcgcctctctgaggattcgtgcctgttttactactgttaccatcagagttgttctactcttagtcataattgtctcagcacaattggttgagcacttactatatgccatgactttccacctggcatccgcctttaggcattcctttatcatccaactcctgcttcgggaaaatttgtttctgtctgtctccaagatacaaaatcaaaaaggtgttttaatcctgaggaagagtgtgagtctgggaaaattttggatcaccgaggtgcagccataccttccacagccatcactgttgcttacaactcacatgccaagaattgcaagatgaagatggtgatcaggaggcatgacttggtaatactgctgaggctgggagtctctgggaaattctgagtgtgggcaatgattgtggcaatctggttcccacaggcattaatgattttttcttttaactaaaagattagaatttgcaaaattatgttaaaccaattaacaaggggaatggatttaggaccacatgtaaaatgatactttccccaatatagcttaatagaaacatgtcatttgtaggtggaaaaaaccttcatattcatatccccaggaagtcaatggaaaatgaaggtcgatggaaaatgaagttaatatctatgtaaagcttaaaattaaaaagtgaatattaaaaagaaacatgaataat

SEQ ID NO: 6991 - DNA, 1040 bp, Homo sapiens
gacagttgtgtgatcccaatagaaatgtctgcaggcttgagttcagttgagtcctcagcagaaactggcagttgtatcaaggagctgtttgctctgtgctgtcacccattctagccagaggcatcggaaggggcaactctgccctaactcctccttggtcaatgctggcaaagagatgccaacagggtgaggccgatcatggttctcaagatggggccaccctggtcaaaggttcttggaggtctcatgtcctgggctgggggcagcaggaagatcgatgctgcattgaaggcactggccgctagtattcagtaaagaatgggttccatcctggctgacttggaaagttttggacatttccatgtaactgtcatattgaagctggttcactgagttcttcctcggcctttgaattgctgattttttttttccagttaaaaaaggacaagtaaactgatgagctcttgggtggcatgtgctgttctcagccatgggaggtggtggtaagctggggccacacggcatgctgggtgactgttgaattcagccaaggccatgctgagcaggagggggcatggcagagtcacacgtgtagaagaaggtgcccgcctgagaaggtgagaatggaaatgtttccttgatgggtttgcacagctccctggaaagaggagacttgctgagagcagcaaggagacagcaaggcttcacagctgcagcacactgtctgaatcagtgcttgcccctgtggagttctgtatggattttataacaagcctgtgacactggcaccatgtgcctgccatgggccaccacggagacctgccgagttcccatgaggaatttggggtatgggggcctcctgctttggtgccatccctagtgatctctgcttggagctcgtatttctccctttacctttgagtgggaccacgcccctctgcttgcccaaggctccctgtgcctcctgactcttctctgctacctgaaaccctcctcgactcctccctctccctctgcattccccagggtcttcagggtca

SEQ ID NO: 6992 - DNA, 1082 bp, Homo sapiens
ctctgggaagggggtgtcagaaagtaaacctgagaacagctagggctggagggtatgttttcatcttctaggaagttgcagagaacgttggtcaagctgcgagggtgggtgagttcttagaggagtgtttgcagctgtgggaagagtctgcctttgggaagctggcggcgcctgcacaatctctttagtgcaactcagcctcactcacaggctggctgagaggagtgtgtggctctacgcctctggttgttctggaacagtctgagttgggggaagagggtgagagttactttttcagcggaggcaagtgctgtccacactctctctagttttctatccagaccacgtggaagagaataaatgtgggaccattggggagtctccgtggttctttttgggtcccaagccctgattgcttctcatgctatcgctgtggccccagcagtcctcgtaaggagccaaggttcggggggaggtgcttgatctgtcacgcagggaggaaggaacagctgagatgcaagccaggtatgagtgctccccaggggtccccccatatcttagccagcacgtggtggccagatgtacccaagacagttgtctggcagcaccacgggactggatatccacttaaacctgaggagcctggacttgtcttcccacctgggtagggtgtggtattctgcgatgttatccatgcttctttctctggcatttcctcctctccttcttccatcttctagtataggcagcagaagagcaaaaatacaaataatctgcttttgacttccagcagcttaggtcttagcacaggaaaatatttgaaagaatgcaaatcagtcaaagccagttcttattgccctgtggctagataacttttggaggggattgaaagaagaagtgagagaagaagagagagccttggtgcttgtgggaagggaaggagaagcagacccctctctggatctggggactgagagcagaggagacacgcacctccaattcccctggggaaggcctgggaacttgtgaaatctcagtactgcccttgactcattacggtgcaagagctatagggcagaaag

SEQ ID NO: 6993 - DNA, 1353 bp, Homo sapiens
caggacagttttgagagtaaaaggggctgctaatatttatgctggtgcaacaggtgttttctcaggacaatcctagtttaccatgtacatgcattttaaacaaaatctttaatgaagaacataagactttagaaaactttttaacccccaggcaatccccccctatacttcatacttatgacttacaggctgtggttttttagtattttagttcagtatttagttaaaatagaaatttgtgtagatttacctgtatgttttccatttgatttgctcagtttcttcttgtagcatagacacattttctgttatcttttatttttttccctgatgaatgtcttttaaatgttattttactgactatagatctgttggtagcaagcattttattttttgtttataaaattttatgaaattactttttatttcaaactatgttggttacaaattttaggttaacatttatgttctctcagtactgaaatggtatggttccactgtttcctggttgttattatcattgttgagaagtctgctgtcactttaatgtctttgtgggtggtctgtcttttctttctggctgtttttaatattgcgtctttgtctttggtgtcctgcaatttcaatgcactatatctacacatatcttttattctttttggatgtatacttcctggatttatggattcatgtcttttatcaacttgggaaactttcttggccacttttctctgaaaaaattccattttctgtattctttccttctgtgatttttatcagatgtgatttagaacttttaattttagccttcatagatcttagcttctctttcatattttccatctccttgactgaagtgctacactaataggtaatttcttcagctctgtattccaatacactaatctctcttcagttgtgcctcatccattatttaactcatccattgcatttctgatttcaacaatagtttcattcctaaaagttctattgggttatttcttagatatctttggttattttgatggtcttttcttgcttgcttatttttgtaatgccaattttaatttcctttaacagttaatgcaacattatttcatattatctaactagtaattataatttctgaaatattggcagtccaggtttactgttggatgtgtttgctaactttaagtcatagtgacttattttcttgtgtatttggtggtcttttattatggggccatgtttgtatgtgcttaattggtaggaatcctatagatctaaatgctttcctccgaaaagtctttgtattagatttctttctgggacctaaaaacgtctatgaatttggggtcactttagactgtt

SEQ ID NO: 6994 - DNA, 1050 bp, Homo sapiens
acagcgcccataactcctgtgatgcttttagctgttcttgggaataaactaacgacccctctccttcccttctgctgaatgaaacaccggaaggaaaaagtgcaagccaatgggaatcataaacagagaagagagaaatgctttttaaaaaaattctcaaaatatttaaacccagaaaagtgcaaataaaatccagcaccactggccccaggagtcggagcgctggtcttttctgtgctacctgaggtttgagtgtgcagttgcgggcatatgggagggaaggctcctgctgtcagcatcgaaagcagatactcatttaaattccagttgcatgcctgaacgttgtttcttccggaaatgtcagctctcttaattctttccccttttaaacagatccaaatgatttccccttgattgaagtaaaaagagtgtaaatattttagcatttcataaaactggaaacattagaggctactttcacagtcatttgaataacagcaagcatttcctagacattctaatcaattaactttccagggtaatttttcaagggagcagaatggtccaaaaccaggccagtcacactgttgcctgctcacgtttctgtcactttggtcatggggaatttacctataaagggaaagggagacttctcttgctttgaccacaataaattgagtgtgtttgcgaggggcagagtggtggccgtggaagctagcgtgtgtttaggccctgtctggggcacgtggaggaacagctttctccttctcattggcatcaggattaaagagaagaaaatgggttgctgtcttttctacctacgcagcagaaggagcattcacaaatgagaatttccccagccccagcagggtgtctaaggagctactttgtagagtgtaatttcatgtagtatctaaaaaaaaaaaaaaaaaaaaaaaaaaactccttgccagggttccctccactaaaggccatttggaagaacttggcaagcttaacgatgccctgaaaggttgcagagaagaaaatgtatggacatcagcaagtacc

SEQ ID NO: 6995 - DNA, 1826 bp, Homo sapiens
catccctggtccaaggaagggcagggtagctccctcctctttctacttgtctttcctcactacaccttcagggccccgtctatgcaggttggctgagggccagcccaaggaaccaagaaaaatctcctctgtcacaaaaccttgtgccttgttctgttgcaaagttctattttgaaggttagaattgaaatgtaatctccttccttctgtaacaaattctcatcttcccagaagcaaatcgttcatgcaggccaaagagagagaaggccaggtactcagtagaagtaaaaagagaaactcatactaatatttagccaaacatttatccttctatttatttacttgcttacttatttattaactcatgttcaccatttaaaaattacaaaatactgataggtatttgatatgttgcattacaggcttttcctaagtgccttgtatacaagtctactttccacaaaatgagattatgctctacatatcgatttaaagctcactttttgcagtgagtgaacaatttggaactgtaagaacatcttgcccatctagtagacttctccactcttcttcctggctgctgagtcttccatttttttctttctaagagtgctgtcacttattcaatcaatcctttattgttggaccgatcacatatctgaatgttgctgggctgcagcacagctgttttgcgatttggaggaacccaatctttctcctcccacctgtacggtgaatgcttctgctataaccaatcagaataacagggcaaacatctgggtatttgaaacagtatctgatgttaactggacagaaagaccacccgcaaaatgaagttttcatttcacccagatatgtttttccagatatttggaatctcgtagaaggcatcccagagaggccactcctctctttttctggtttcttggacttctgcatcaatttcttggattagggggttgttctgtgtctactcattcttgcttcgtgaaattctagaaattctgggtgcatctttttatctcatcccagagtatgttctgttgtttgattccttcttgtggtagctgagactttaagagtttctttctcaactttttatcttgaaaatctttaattagacaggaaagttgaataaatgtcacaatgaatatatatatatatatacacacacacacacacccatgatttagatcaaactttgtttctgttatctctttctgtataacaaaccaccccaagtgcaatggcataaaaaccacaatttcacaatttctcattctcacgattctgtgggtcgactgggtgattattctgctttacgtggtgttggctggggcactgggatagctggaatgtccaaaatattcttacatggctaggagttcagagctcatggctctctccatgtggctgtttgggcttctctgcagcatggtggctgggttcctagaagaaatggaccaagacacaaagcagaaaccacaaaggcattttatgacctcaccttggaaggacctcacctaggaagacctcacagcatcccctgacacttttgttcacaaggcctgtccagatccaacagtggggagctccatctcttgacacaggtcgggtggagggagtggggaaggaacaagtggcaaggtcacagggcaaaaggtcatgtagacgggggggatgttgttgccttggaaatgtaatctactacagcttttcctctggctacaaaaatttacattcctcccacctgcaaaagactcattcacttcctcccctaaaagtctcatcccattacagtgtcacactgaggctcgaagtccatc

SEQ ID NO: 6996 - DNA, 1031 bp, Homo sapiens
attccagagaaatagaaccaatagggtgtgcgtgtgcttgtgtgtgtgtttgtgcgtgtgtctgtgtaggatgagatttattttaaggaagtggctcacacaattatggaggctagcaagttaaaaatctgcagggtataccagcaggctgaagacccaggggaaactgatgttgcagttcaagtccaaagacaatcaaatccactgtagaattccgccttgctcagaagatgttgttttttgttctattcaggccttcaactgattggacggggctcacccacattatcgagggcatctgctttactcaaagtccaccagtttaaatgttcatctcatcctaaacaccctcacactaacatccagaatagtgtttgaccatgtatctgggcaccacggaccagctatgttggcacataaaatgaaccattgcagccctctttctctgttttgaggaagacaatcatggaggtatttggggatttacacagtacagtgtcattatctacaatgggctctggagtctgcattcgaatcttaattcatttacttaccataagactttaggaaagtagctcaacctcccgcattcactggaaataataagtgctgggaggagtaacaccccaggctgatggggagaggaaatgggaaggtgcatggaaatgtgccctgaaagtgttaacgcatgaagctcaggaaatgagctggatttactattttctgcttggacatgcacttcctccgttgaccccaccagaatggtgtttccagccaggaattcccaatgatgaggctgtcttgggtaccatgggcagctctcctttagtggacatcacattgggttccctggccatggctgatcatgggcagccagagagtggcctaaagtccggttgagtgatgcagagcaggcccgggcgggagcgcatcctcagaagcgatccttcagaggcagcactttaggagtggggcatgtggacaccacctggtggcttgcactacttttttatttttctgaaaaactttgg

SEQ ID NO: 6997 - DNA, 1092 bp, Homo sapiens
agttcctccaaaggatgacatgatggcagatggaacggcctggacgtttcctcttgaattagtgcccgcttcatctaaggtcctcagtgaagggtcagcatggaggtcacaaccctaatgaagagagttgggatcaataaaggcagggatcgttgactcacattcaagccaataagtattgattcaactccttgtggagagaaaaccagccctggagtggggctctctgagactggaacttgtttccaccatttatgaattgtatgacccaggccctgttacctctctctgatctttagtttccccaactgtagaatgggaatgatcataacagaaactcctttgggggttgtggtgagctggagatgagctaaatgagatgatgcaggctaagcgcttggagcagtgcctggcacgcaggcagaaggttggccacgttgtcattggtgcccatctggtgtgagctgtgctgatgccttcttacactaattccttaggtcagtgtttcacagaggcccacccatctcacaggagtcctcgcatgtctgatgtgctgctgacttagctaactctatagaggtaatgctctattagcttgaaatgatcctgccttgggggctggaagacagtgctggcagatccttctcctccatgttgccaaatccttcatctcctgagaacctgtcatctactgcacgtgagaggactttgcatcggagcttccctgatgctcaagggatgttcccagaaacactttactttttaaggctaatgaatcagacttagctcacagggcttttgtgcaaatgttcttagttttcaagcctggctctgcctgggctgcagccctcccttgctagaaactctctgcccacaagcacttactcttatactctaagtcactgccttcctccttccatggaaatccttctttacttgccaggccccacatgaattccagcctcccatggagcttttttttctctacccaacctgcagattaatgagctgttcccaatccacatgggtgatttcacaagtatgttcaccagcaactcagttagatttgcacaaataagaccttgccctgag

SEQ ID NO: 6998 - DNA, 1070 bp, Homo sapiens
ctgaagacctccagaaccttccttttaggaatagatgggggagggcttgggtgtggaagagagatgaacaactacaagggcttagcacaaagggtgctgatatggtttggctgtgtccccacccaaatctcatcttgaaatgtaactctcacaattcccacgtgctgtgggaagaacctggtggaaagtgattgaataatgggggtgggtctttcctgcgctgttctcatgatagtgaatgagtctcacaagatctgatggttttaaaaatgggagattccctgcacaagctctctttgcctgctgccatctgtgtaatacgcgacctgctcctccttgacttctgccatgattatgaggcctccctagccatgtggaactgttaagtccattaaacatctttttcttctcaatctcgggtatgtctttatcagcagtgtgaaaacagactaatccaggtgctctacaaatgtttaagtgtctagcatcagcaaggcctctgtgacgctgggcctgggggagctccacaaaaggctcctgttcatgtctgaccacagaatagaaggtgggcctgcagctgagagtcctgattccattaggcaaggacgtcattatccctaaggttaaggaaaacatgaagtcctggcccatgtcctgcaagatgatgatggagaagagggaacatctcaaagtcactgcctcccttgcccacacgggcacagactcagaggcctgggagcagtgaatccagcaaactctccctccctgctgtgcttttcccatggctctgagcctgatatatggtgttcacattccctaccccaccagcttctcaccccaaggataaaggtcattctgagcttcagcggtttgagctagtaaagatttttataaaaactcactgtcttgatttgtgttcaagtactttaaagttcacatatttcttatttgaactttgctggctgcagtcatttcatccgcaatcagcctggattggttctgcttattcagagcccatcaattacccagaactggactggagcacacgctgcccattcattggcttcgcc

SEQ ID NO: 6999 - DNA, 1105 bp, Homo sapiens
agtgcgggtgagctggtgaatcccaaataagtgggctgctcagggatctctctcctcttcaacccactctttgtcatgcaacactgctctgagtgttaggatctccttcctccttcctctgcttctgttgtgccttttttcttttcctaaaattgttttatggttggtgttttaagatccctttcatgttgagagcccaaccttggggagaatcccaaatcaagctctgacatagagaaactgtggaattgcaaatcaagatggggaagctctatataatgatgaaagttcaagttaaccaataatgaccatggaggtgaggaagacaagatctctgccctaaaggacagggcactgtggggtgggagagcagacatggcataaatcattcagtcccagaccggctgagctgaatgctctaatagaggcataaacagagcataatgggaatgttcggggccggggagagattgataatcttggtttgcaccttttagttctggcttagacaatgaatgcatattcacacatttgaccaagtaaggaactctgatgttttattaagctgctttacagtttccttcgaataataagacaaatgtattaaatctgtttctcccttacaatggtaaattccattttcctgggcacattttgtacgtttatcctgcctaacttgggttctcatccttaaatgctccttatgacaaaagcttcactaaacataagaacacaagttggaatgtgaaatctgtgctctgatcattcagagcatttttgtgtgaagaagttaattctttgctactttcaacactatttctaggattttcttccctgggattttcactaacatttcaggtctttttactcacaagttcaacgtgtgctctcacatcagcatatgaaaatctttttcactaccctcaacagtggtggttttttttttttaaatttagacactgaattctaggttctttcacatgttgctattattgtctttctcttgtgtagcttctgcaaaattggccccacagattgtctccttctgtctcctagggaggtggttaaagatgcagggtctcagcaaccacccctgagattctga

SEQ ID NO: 7000 - DNA, 1079 bp, Homo sapiens
cactctgacccctagaagggccagagtcccagggtggtggactacaataaacacaggaaaacagtcagcatagaaatccctgttgtggtgcaggtaggcatagcccatgggatcttgctctctccccagtctaagaaagttgtacgtttcaggtcctttgtggcgacaaagctgtacttggcatctgtgtgtctactttgtccacagatcctggctgctctccattacctgacccatcctacatctctggccctttctcctgcccctgcctgtctggcaccaggctctcccagcacggtgagctgaagtgcctgtttctggatgctcccccaactcagttcttcctttgtacctattgctccctctgccccaatagcctcaccttgcccctgtatgctcaccatatcctgctcctcctgtagaacctaggaccaccatcattcctccaggagccttccgtggcgtcccactcctacatgggattggttgcctttctttaagctaccagactcctataggctgtgcctccattttggttcttactgtcctggacttgaattccgtgatggtgctgccatctcttgcatagcattgtgatctcttacaggataaggactgtgcagattcacctttctgtttccaaggtggccctgggagcctgctgtgtcttaggtgtttctgaggatttaatgatggagagaatgcatggaacagcatgaacacaccccagtgggcctttctcagcagagaccgtgccagggcaggattctttgtgtctcagaatttcacttctgatagcttaaagcagaggttggaaaactctttctgtaagagtcagaaagcaaatattttagtttttgtgggccagtctctgtcataactacttaactctgccatgtagtgtaaaagcagtcatagccaatacatatacatgtgagcatgattattccaagaaaactttttacaaacacaggcagaaagctggatttggcccagcgcagggatagtctgccaatctctggctgagggtttgaaatggaaccatcttctatgactgcaggtagattttcccttgtcgg

SEQ ID NO: 7001 - DNA, 1052 bp, Homo sapiens
cccgtgctgcccactcagagggcttgctcctctggctttggactcttgtggatatggaaagggcagtggcctggaggtcaggaggccacattctaggtgactgtgggcaggttgagctacctctctgggctcagtttctcctcaagacgctttacgatctgactggcttagttctcaccacttcccacgtgcccccctctatcccccttgtgccttcctcctaacacattctgctggaaaactgcggcacttaccaaatatccatgcacccactgcctgcatttcccagcatctcctgcagttagattgggtcatatgactagctctggccaatgggcgatgggagaaagtgacccatgacacttccaggccatggcagttgagagctgtgtccccagcccctgccacagaagcctcaaaggccatgacatgtttcaggcggacgagaaccaccagatcagaccaagacggaagaccttgctgggcagagccactgagatttggggatttctctgtaaccgctccttgcttgagcttccttgactgggtctcaacagaacttttgctcattctctgggtagctgagtccatccctgcctctgggcctttgtacaggccatttcctgaatgcttttcccttcctgctgttggcaaactccttcccccttcagccccagctcccttctgtgctgtgtggcttctctggccgaccacggccaagttcctcgtgctcttcccaggattactgcagagaaacattcctgcccctggttcatgcataacttcactggcgctctctgttatgtgcctgtctcccccagtaatttgggatgtccacaagggcaaggcccatgtcctctccttcttcatagccttagggctttacccagtgctgggtatatatcaagtgctcagttaatatttattgcatgaatgaatgagtgaacaactggagttggggtccttggtggctttgctctctgagccttgcctgcctcccttgttcccttgttaggatattccacattcgtggctgagcctgtggagcctgg

SEQ ID NO: 7002 - DNA, 1035 bp, Homo sapiens
tctttacttataaacctgcctcccactacgagcctgtgatggctgatactgcaccttgagccatctttgtattcccaacactcagaacagagccgtgcattcaggagtttctttatctatgtgacggttgaattgaatatcctactgcacaccagaaccctaaaccctcacctccttctgctccagtgtgcaaccatatgcaaattcagtgtgtcaatgagatagacatctgcttaaaagtaagatgaatgtgtgtcagtagggggcaataaaagtgggggattgagaaagaaagagaacccagagccaaagaccccacaaaacccaggccccgtgactctcgagtacctcaaatccatggaagcaaaaggttctgagggcctcctggctctacacttcctgcacagctgaagccagctggcgaggtggcagctctctctcacctgtcagaatttcagaacctcattatgacaagcaccacttccaccccacgtgctcctggtgtctgctggaactgctcactgacagtgcttaggtccagaagaactcgaaaatgcttaattggttaaacgaacgagtgactgattaaggaataaaatccaacctgaaacagttgacaaaagtaaaatgatgactctgtcatgtaatgatataggaagactaatgcacagacatctgtggagctccaggatttcaggaatgggtcaagccatagacgccaccaagctctcattttaaggccatggaatctaaagtccggggaggttgtgacatttccccaaaacacataaagctaagttcattcatgtatttaatatttgttgaaggtctgttatgaccaggtacccttttgcatatttggcatgcaacagtgaataaaacagacaaaaatccaggttctcatggagcttccattccagctgggagagagagaccatcaacaataaacatagtaagccacatagcatgttaggaggtgatcagtgtagtggggaaaaagtagaccaaggtaaggggcctaggaatgtgttgttg

SEQ ID NO: 7003 - DNA, 1025 bp, Homo sapiens
gtaggaagggaaataccagtgtgaaacacctatattctctatgcccgtgaaaatcccagagggattaaagagttcagtggtttgttgttgttgttgttgttgtttttaaaaaacacaatatcataaaaaggaactagaattacaataaacatttaacaaaatttgtaaatgaggagggatttctaagttccgatttaatgaagaaaaaggggaaaagagtgagatatttaattactaaaaataaaatttacatgtggcaaacaaaaccaaatcaaaaccaaaactacttaagaagaagtttcccaaaatatgacaaaagattgtgagatttaatatactgtgcattcattcaaattgataagaaattatcatgatcttgtcttttgaaaaacagataattacagccctttaaaatacaaatgactggtatgcactttgaaaaatgtatttaaacttactttaaaaatcaaataggtaaaaactaaaacgtcaatgaaacaaattttaacatcgagctagcactttaaaatgagagttgtggggctggcaaaggtgcagagaactgtgaaatcatatatgtactgatagaaactggcccgatcttttcttttggaaagcaattcagcagtatctaaaatattcatatgcattcaatcagtagttccacttctgggaatgtatcccaaggaagtactaaggaatgtaaaagaaaagctttatgatcggagatgtgtactgtagtattctttatcagagaaaacagaaaagaagctacaaaaatatccagttcctggggaatatcctaaaattcccatgaaccaaggtggaataaaaaataaaaaaactttaaaataaaaaattctaaagtttttaaataaaaaatttaaaaactaaataatcagatcaaaaactactgtatactctttgttataaatcttttgagagttttccttaaaaagctttttgaggtataattgacatacaataaaccacacttctaaaatgtacaatttgatgaagtgtgg

SEQ ID NO: 7004 - DNA, 1047 bp, Homo sapiens
ctgagttggctgacactggcttccttccagagcgcaggggtgcatccttccgaacctcgcattcagtgacgtcaccttggtgatttgaagtaggccctggtggaagtatttacaccatggacatcagcaaatgcaaccaagacctcccgctaccctggagagctgggtttaagacatttgccagcacaccactgcccagggaccagtctcagctccagagctgtgggttattggtaaaggatgtgatttcattgagcctcagtttctgtatctgtaaagcaggaatctatcacttatgaaatatcctgtgcaggcacaatcttaggtgtggaggatacaatacaacgtaagtaagataaaagtatccacctgtgtggagcttgtattttggtggggagacaaacaagggaactataatgatatgtcatgtcataatacatgcaatgatgacaaagccaggtgaaaaggcgatgatggtcattaagttcaagatggggaggggttggggtgagggctggcctgtctgaggaggggcatttgcagtgctggagcaagccatggaggacaggaattgctccagtcagaggaacagcaaggacaaggggcccaagacggcatgtactagaggctccacgcatagaaaaagccagccatccccagcgctgtaactgagtggccagtggtgggaggtgaggtcacagacgcggagggggcatacatggggtgagcgtttcagtctcaaagtatggacagccccaggggcttttgcagaacaaagtgataagatctgatttgccatttaaaataatccttctgagttcctgtggggtaaaagactggagaggagggtgtgtgaggtggggccaggagcccagggagctaggtcggggcccctctgctaagtgaacaggggagaacagtgccttgtggtttcctgacatttaaagtggaggctttaaggtacatgggtgcctcacatcttcaggcattccagacgccgcttcctcccgctcctgattgtacaataacctttaccctctgtggggt

SEQ ID NO: 7005 - DNA, 1075 bp, Homo sapiens
gggacagctctgaggagaaggcactggacagacccggagggataagagggaactgtctgcaggaagaggcggaggaagcgcattccaggcagaaggaatggtagctgcaaagacctcaggaagagagcacttggcgagttcgagggcgtggggtgggggagtgggtacaccaggcaggaacttgaggggcacggagaggtgtccggactttatcctgagtggcaggaagtcagtgaagactctagataggcatatcatgtggtctgatttatatgttttaaagaaatacaaatgtaaaaagtgagacatacaagtcaaatgaaagcaagggagatttcctttgaaaccttggagagaaggcctttacatccaggccttgaaatctagaaagcaaaaacaacgaacaagcagcccaatagcaatatgagcaaaagatgcaaacaggtcatggaagaggaagtgagagaggctccgccttactcaaataagaggtgtgtgatctcggctcactgcagcctctgcctcctgggttcaagccactcttgtgcctcagcctcctgagcagctgggactacaggcatatgccaccgtgcccagctaatttttggtatttttagtagaggcaggattttaccatgatggccaggctggtcccgaactcctggcttcaagtgattcacccaccttggcctcccaaggtgctgggatcacaggcgtgagccactgcgcccagcctgagaaatgcaaattaaaactatatcaagctgccctgtttcatcaatttgacaaaattggccaaaatccaaaagtttgagaacactttctctgtgagagtttgtggaaacagaccctgccacacattgcttgcagaagatacatttgacattatctaccagtggttgcgcttctgagaatttgtcctatctcgtgtgagaaaggacacaagtacaaggtcattcctggcaatgccttttaaatagcaaaagactggaagcagctcagatatccatcagtaggggagttttagggtctgtctgtttatacagcagaataacatgcagtgtaagaaggaatg

SEQ ID NO: 7006 - DNA, 1054 bp, Homo sapiens
cggtctcaaaaaagcaaaaacaaacaaaagccaacgttttcctttttttttaagtttttgttttcttttcctttttaccttaaactatcaggagataaaagccaacgttttacttattccatatctaggagctaaaggagcattttgttgttgaagggtcaaataattttgaagagtgggttgctttgccctttttttttttttttttttttttttgagacagggtctcactttgtcacctaggctggagtgcagtggcacaatcttggctcactgcagcctcgacctcctgggctcaagcgatcctttcacctcagcccccaaagtagctgagactacaagtgcacaccactgcacctggccaatttttgtatttttagtacagacaaggttttgccacgttgcccaggctggtcttgaactccagagctcaacggatctgcccacctcagtctcccaaagtgttgggattacaagtatgaaccaccgtgcccggccatatgaagtcttgtagttgttgaactcggtgtacatgctaaaccaaagcacacagttctgctcaaggagctgtattttccacatctgtttgtattttcatgaagccaacataaaaggattctcatcccagttctgtccctagacaagtcactgaacccctccaaaccacaggtcccatctccaaacagcaggtcccatctctaaaccacaggtcccatctccaaaccacaggtcccatctgtaaatggaaacatgaacccacctctcagactgtcaagaggattcgatgtgaacatgccgttggggctcggtggaggaggagccagtcaccgggcgctgctgtagccactgctggggctcagttcaccctgggctccctgctggtgtaaactttcccctctttctaaaggtgcccctgggcgatacactctgggctcctcctgctggcctccttcccagggcacctggcttcctctcagaatgtacctgccccaacagtgggtttgtcagagacgtggttgtcattgtcaccaccacagcaattactgccatttat

SEQ ID NO: 7007 - DNA, 1047 bp, Homo sapiens
tatttttatttcccctgacagcgcacctcctgacctctatcttcttgccagtgattttttaaatcctaaatgatttggcaataattgctcctccttgcgtgattattgcccttcaccgatagtaaatctgggaatcccctggggtcctgagcgcactttggtatgcggagcccacaagctggcctggacaggcatcactgctccaggcagctgtgcacccagccggccctggcgtcccggcccccagcctccgcctccctcgccgacagcttcccggggctctgcctggaggcagcctcgctttatcccgcagaacctccacgctgttcctgcatgagaactcttcctccaagagaccacgttcctctggtcctgtctccgtgggccacatccacaaatgttccagcccaggaagaaccaagtctgtattctgggagggaaacctgtgtgctgtctggttttgtatgtgggaggagcatgcacacagtttcattttccccggaagcatggaggtgtaggatgacatgtaatatttggaagacccattgcatttccaaggaaccttctagcaggatggccctggagtctctggcagcagtggacatggtcctgaattggagtgctgtgaatgttcactgctgacctcacggtttgaagacaattccttgagaagggcagaggggacccgaatacgggggctctggccggccctgctgccagatgccagcagccgtgggggcttgcccggccagccctggcttttcccaaccctcagagtgccccttgtgcatgcagcagacactggtgctggtcccattcccgggagcacgcggtgccactggctgtgtcttgcctggccaggtgttggtttgatagactcgaaaacctcatttggatttggcaggattttccctaacatcagtcattctggaaaaaacactttgaatttttaccatatctgggtatttttaccatatctgggtacttgccactagctctatttacttcacgtttcttaaaattgattcattttattacttaaataaa

SEQ ID NO: 7008 - DNA, 1069 bp, Homo sapiens
atccgcccaccttggcctcccaaagtgctgcgattgcaggcatgagtcaccacgcccagccattatgatatttttttgaaattttttttaagctcatcagctagtgttagtatattttatgtgtggaccaagacaattcttcttccaatgtggcccagggaagccaaaagattggatactcctgccctggtggatcaaaactataaaacccactcaccacattatagacttatttactaagtaaaggtttgaaactgggtgcagtggctcatacctgtaatcccaacacttcgggaggccgaggcaggaggatggcttgaggccgggagttcaagaccagcctgggcaaggtggcgagaccctgtctctacaagaaatttttataattagccaggcgtggtgttgtgcttctgtagtcctagctactcagaaagcgaggtgggaggattgcttgagcccgaaagtttgaggctacagtgaaccgtgatcataccagttcactccaggctgagcaacagagcaagatctcatcttaaaagaaaaaagacttgcgatgtgtaagacggtatagttagtctttcgtcgaggatgtttttggttttttttttttgagatggagtctccctctgtcaccaggctggagtgcagtggtgcaatctcagctcactgcagcctccacctcctgggttcgagtgattgtcctgcttcagcctcccgagtaggtggaactacaggtgcacgccaccactcccagctaatttttgtatttttagtagagatggggtttcaccatgttggccaggatggtctcgatctcttgaccttgtgatccatccgccttggcctcccaaagtgctgggattacaggcgtgagcgaccacgctggcccatctagggtgtttttatttttcttttcgttttgcttaattctttaaaaccctaaaacagccgggcgtggtggctcacgcctgtaatcccagcactttgggaggccgaggtgggtggatcacgaggtcaggagatcgagaccatcctggctaacatggtgaaaccccgtctctactaaaaa

SEQ ID NO: 7009 - DNA, 1030 bp, Homo sapiens
tatattagaagtgttgaaggcattgtttttatagaaattattttagtaaattcttttttattattgggcacctcctatgtgatttgaagttgcttaggattttctaaaagattacataaaatactgttgaaaagatgattgcatacaaaacataatctgttcattgttaaacgtatacgaaatgttgggatacatctgtgaacaagacaaagtctttgctaattgtgttctatttacgctctagtgtggagagacaaatgaagaaagaaatgtcagatagtgataagtgctgtgcagaaaattaaagtagggtgatgtgatggagaatgcctgagtggtcagagaaaatctttctgaagaggtgacatttaaactgatatctcaatgacaagaatgatgtggaaaatctggggaaataacattctaggcagaggagatttctaatacaaagcacctaaagggagaatcatcttgacttgtaaaaggaacagaaagtcactttatgtaaaaatttgtaagtaaggctggggagttttaattttattctgtgtaaggatggtggatagagtggaagtgctagatcacttagtctctgcagtaatccaagtgacaaataatggtggcttggaataggggtatagcaggggagtctggaatgaagcaaacttttggggacttgtttaggaggtagtatcagtggtagctagctaatctgttttgtagcctgataatcttggacaatgtgtttataatcatggaaggttgtggtgcattagcaagagggtactggagtcagaactggggttcacttcctagccttgtgaccctggacgagatgtttcacctctcctgaaggcacagattcttttttttttttttgtaacggagtctctgttgcccaggctggagtgcagtggcgagatctcggctcactgcaacgtccgtctacagtattcaagcaattctcctgcctcagcctcctgagtagctgggattacaggtgcgcaccaccacacctggctaatttttt

SEQ ID NO: 7010 - DNA, 1027 bp, Homo sapiens
gtctagttatatctctccatatttctgagtgcatggtaaacctttggtaaatgttgtcataggttgttacattagttttgtttgggattgtgatttaaggtacgtgattgacctgggatgtctcaaactgtgtaaaggaactatgctctaagataggttctgctgaagctcaagacatacctgtattacacccgctcactttcttgttacgattgaggaactgaagtgttcagatagagtaagtatgtaaagagctagaaatcctcctgagatgacaagatgaacagaaagagcattaatattgtttcatgctagatttgacacaatgtaagttaactttttgtctttaagatcttctttcattctagtcagtggattgctaattgtctagtggtttaaaagaaaacaagaccattagagttgtaacttttattacagttttttctaatgtatccttgacagattaaaatgtaacatttaaattcgttacattttgaagatttaggtttggttggaatgaagttagttgtagttgtagagggtaatcacctcagttaattaaggcatagtgctgataaggccaaggtcaccctggcaggtgttatttaattttaccttgtccaacttatccacaaattcctgggaagagtacagtgtgtttagttcagatctactcatttgatacagatgccatagataatagtgacctctttttataggaatgccagctcatttttgagatctaattattgattatttacatacaatttcacactaatttaggacttttagaagatacttaatgattgcaaaagttttgtacttgtgtcattgtcatagcaagatttgaatagttaaccagcttatgggttgccacagtgctctggatggtagactttcagagcagtgacgaaaggaacaaacatttattgaacaattttgcggcttttagtagtctaatccctttaatttgtagatgggaaaactgaggctcagaaataggaaattctgattacgaattgagttt

SEQ ID NO: 7011 - DNA, 1717 bp, Homo sapiens
ccgggctggagtgcagtggcgcaatctctgctcactacaacctacacctcccaggttcaagcaattctcctgcctcagcctcctgagtagctgagtagtataacttctcatcatttgaaactactggcaattgagcttatctcagtttgtttcctgagtttgcacttgaagagaattatttgtgtgtattttttttttttttttttttgagatggagtttcgctcttgttgcccagactggagtgcagtgctgcagtctcggctcgctgcaacctccacctcctgggttcaagtgattatcttgcctcagcctcccgagtagctgggattataggcacctgccaccacgcccagcaagttttgtgtttttggtagagacggggtttcgccatgttgaccaggctggtcttgaactcctgacctcaagtgatccacccgcctcggcctcccaaagtgctgggattataggcatcagccattgcgccccaccgagaattatttcatttcttcagttctctatgattgtttagtaggtggttggggaaatttgtagtgtagctacaattttgaggaattgacttcaatataaatataattcttgtacagtgtttagtaatgcttcacaaatattaaacatgacagtataaaaaatgttccattatgtaagtccctttcccccgcctgctattagtacatataccatatttctgcacttttattatctgaattggaaagtatataattaaaaacagttacgaatttagtacttgtcaatttagtagtagtaaatggttgatatatttagagacattattcattctacaggcagagcttgatgcacaaatggattcctggtctccttggtccacaggatgggaactgttggtattgcatttgaaccaaggaatatttgtcttaagagtagcagttttgtcccgttctccttaaagaaggcctagattatgttgattttattgtggttttattttaccaattaattgaagtttgagtccttggatagaatttgcaaatctgctttgcatgcaaaattaaacttgtaaactaaatttacttgggcgtatgaatatatttaatacttaaagtgatatttggtaagttttatttcaaggtagagtattaacttttagagctggctactttggaaataattttatgtactttttggaatgttttgacatctggaaaaagtgtactctgttaatttctttgtaatactgcaaaaaaacacatagttcagttgatgttatccttactgttcagtgctgtttactaattaccacaggtagaaatggctgtctcagataatcttcaatgaattttttcttttcttttttttttttgagacaaagtctcactctgagtgcaatggtgtgatcatggctcactgcagcctcaagtcccctgggctgaagcgatcctcctgcctcagcctcctgagtagctgggactacaggcatgtgccaccaccctgggctaatttttgtattttttgaagagatgtggttttgccatgttgcccaggctggtctcgaactcttggattcaagcaatccacctacctaggcctcctgtgctgggattacaggcgtgagcacctagccactcttcaatgaattttaccttgcagttactaaacaacattcctgcaatgtttcaagttctctcagagtgaacactgtacatcattacgtttttt

SEQ ID NO: 7012 - DNA, 1060 bp, Homo sapiens
tgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggtaagtttctgtattctgcattttttgcgtgggatgggaaaaggtagtaaaaatgatatgaaaagagctgggtgcgctgacacacgtttgtggtcttagccacttgcttgaaaccaggagtttgaggctgtagtatgccatgatcggtctgtgaatagcacttgcactccagcttgggtaacatagtgagactgtgtctccacgcacatgcaaaaatgtgagtgtgtgtgtgtgtgtgtatatatatatgcgcaaagtcactagcatttgattcattcagcacgatagctgtactttcaagtatgcatacataaaaatttgtgtatttgtgatcttgtcgtaactttgtactaaattgcccacaattaattgtgttcatgtctctccattactgggggcagt

SEQ ID NO: 7013 - DNA, 1033 bp, Homo sapiens
aataccacaaaaatgtgtgactccaagaagttgaacaaacatattgaccttgaaaatactggtgttaatttaacatgaatgtcatgtagtaaatgtttgcaaactttatggaactgattacatgtagccagctgattccatacttcaagttatggttcatatgtattgtgacattttcctcaggaaatgctgttaaaggacagagacataggagagcagagtttttcttcagttcttgaccttgtgagttaattgtgatgtaattcacaaaagcagtgacttgagtcttcagtattttttttttgagtagattagatgtttgatttttattaaattatttggatgggctgcttgctttgacatttggtcttatgagggaaattttgaatgattactaagtttaaactttgtgtggaacaatagctaagctttaactataccttagctgtatgttttccctcagtaccaatttcttttatttatccctctgggtacagcccaagaatatggaaagtttaggtgtatgaacctgtgagtcctaggaattgatttccaagaaatcgtgagttttaaaattaaattatatatatcattccccccccccccccgccccaagatgggatctcactctgtcacccaggctagagggcagtgatgcaatcatggctcactgcagcctcaacctcctgggttcaagtgacctgccatctcagcctccccagtagctgggactccccattagcatgtaccactatgccctgctattgttttaaattattatttgtaaagatgggggtctacctatgttgcccaggatggtcttgaactcctgggctcaagcgattctcccacctcagcctcctaaagtgttgggattataggcataatttgctgtgcccagctgaaatcctgagttttcaattttagctttgttctggcaaaaaagaatatcccagcagatgaatccttctgacctccagacttagtaggcacttagcaagtcttagttctagtttcctcccatcctgaggat

SEQ ID NO: 7014 - DNA, 1053 bp, Homo sapiens
gattcatgtcttttgttcactttcgttcactttctttggtgattttatcaagttacatgaaatctatatgaaaaatacacatctccagtcccagtctgggcaacataaaatcatttttggcctcggcctccccaaattgctgggattacagcggcgagccttggcacctggcctcagttactttgaaaaattgtcttagcttttaccttttctttgttcattcattcatgcattcaggtactccctgagtgtgctcccaagcactttgaaagaagtcatgtctctcaaagagtttatagggcaaatagaatttagcaagccaggatagctcagcagaggaagtacagggtcctagaaggagcatagaacctaatctcattaggagatttggagaggacttttggtgacatctaagctgaaacttgaaagagaagaaggaatagtgtttctattagtgagaattttatgtgttaaaaatccagggtggagagaccaaggcatgtcaaataacccgagagaagtcagttggttggagtgtagaatgaggactgtgagagagaacctgtagggaatattgggactatttaacctggttaaataggttaattccttaacctggttaaggaatttagctgttaacctgagggcagtggtaaactttttttttttttccccctgagatgagatctcactttgtcacccaggctgggtggagtgcagtgacatgatcacggctcactgcagcctcaaccttcttgggctcaagggatcctctcacctcagtctcccaagtagctgggactacaggtgcatgccagcacgcctggcttattctttaaattttttgtggagattgggtttctcccaggctggtcttgaactgctgagctcaagcagtctgccctccttgggcttccaaagtgctcagattacaggtgtgagccactgcgcccagcctagtggtcaacttttgaaaagggaatgccgtaattaaatttgtagtttaagaagaccacactcaccctagtgtagagggagcaacacttgagatgg

SEQ ID NO: 7015 - DNA, 1041 bp, Homo sapiens
cctaaaggtaggtagaagattattacaaggttttagaggggccattgtgagtcattgagctcctgagacagtctgaggagtaacagtgggatgatgatcgaacatcagtatatttattgcagtatcacagattgtctggaaacttagcagctaagacaacaaatgtatgttatctcacagagtttgtgagggttagaatccaggagctgcttagctgaatagttttggctcatgatgtcatgaggttgcagtcaagtggtccagggctgtagttgtcaaaagactcaactggggctagagtatctgttcctaagcccactcaggtggcttttggcaggaggcttcaatactgtgccatgcaggcctgtctacagggatgctcatgatacagcagctggttttacccccaacaagtgatccaagagaggcacagagtacaagagagtgatccagtgtctttgaaacctgcagtgtcttttataaattgatttaggaagcaacataccattacttttgctgtattccgtgggacgtgtagaacaaccctggaacagcgtgggagaggtggaggggatttgttccaggcaaagagcaaaattggtcatggattcagtctccatggagtaaatactccaaaggacagaattaaaggggccagtagggagactggaagtgggggagtctggactaagtctagactaagggggtgtgttgcagagaatgctcagccaagttcttttggaatgagaacaggagaacattagagttggggatatgtatgtggggcaggaattttcatcggtttctgtgtcatggaccatgttggtagtttcatgaaacttatggactccttcccagaatactgtttttaaatacaaaaaataagaagtaaatgagattacaaaggaaatcagttgtattgaagtaatagctaccaaaatactaaactaaatttgtgatatataagaaaatacattttaatataggtaaaaagttggggataattgatttaacttgaattaaaaccaaattcccattaaa

SEQ ID NO: 7016 - DNA, 1786 bp, Homo sapiens
ttttaaatgtagctactagaaaatttaaaatttctgtatgtgactcatgttacatttctctcagacagcactgctcaatgaatttagaattcatgtaattctaacagtagtgcccttagttctttgttttgtcgctattagaccttgttaccactttgttaatataaatagggttcacattccacacttcaggatattaaagcatctcttaaataaaggccagtaaaatttcttttaaagagaaggggaaaaagcatctcttaaaatattccctcagtcatgctcccaacagttttacaccatccttaccctcggttgtctgattgacaactttatttttcactgttaaggctatttgttgtatcctgttcaaatcagtaaaggtatgtaagatacgcaatttttctttgaagagccaaagtaattttaattgtagccacatttgatttagagataaagattatcctagagaccaaactcagaaatgtttttgaagaaaaatagtaaaacattttgtttctgactgaaatacctaattgctgactgaggtggcagtgtttagtggaacttgagtggtttatttggatgttagaaatggtgttaaagactattgtctgtgattaagaactgataaatagtagaatgggttaaatggtcatatataaatgctaattttaagagatatcagaatggacttttccctttttaatgtaatggttttttttttctagaaccatagattatatgataaatattagttacctattatagagaaacttgaattaatttatagtttgtaaagaaaaattctggtttctcacttggcatagggtggtattaaatttttgttaatattttagttatgacactctgtactcaaaagcttttgtttgtctccagtgaaattcagttgacaccttttaagagggagggctcagggtggagtaatttcgggaaataggaaatgcatcagcctataaagattttgcagagcatacccagagtatcagtagctttgaactgggaacatttctgtgtgtgttacagtctatatggtggaaacagcctgtgtgcagacctcctcctaaaattcgttagtatggtagtaaaattcatgtattttttgatgacagtaatttacacatatttctctctttttcataagattattgcttccgccaattacatgctttcagaactttttcaattggatgaacctaaaaaggaagaaaattcagaatctcctttaaatgagaattctgatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagagtaagcctttagaatttatattaaatttttatcaaggaaacataattgttaatcgaatatagttagcctttcaaaagataccattacttcaataaacctttcatggtctagcatctagtaatcattagttttctgaattcttaaagttggttttataattgttcgagggtaactgacccacattatgcaagcctatagtggacaggtgtgtaaaccaggtgtctgtctattcttatgtgaaggattttcctttccagtgaccagtgtgtagtcatagtcatgtctcattactagggcacttctatccggtgttggggttgctgggaaatgacatatatagattgcttggtgaacatagag

SEQ ID NO: 7017 - DNA, 1060 bp, Homo sapiens
acttttttcgtaaagtttgtacttgattatgcaaattacacttgtttgttggtatctaaatgttattctgaattgtgttctgctgcgatttttttttccttaagcataaagtgaaaatcagatttgtttttcccaaatctttcagatcaaacatagtttttgaaagtctgtttgtgagatggaaattttcctaaacgtattcagtagtccagatactgtcttatatttagttttcagttgacctgaagttagatagatagtgaatgcttttcctttttttgcagggtttaaaatctgtcgatagcagcatcaaaaaagaaagcgaccttccagcagctgaccccagcactccaatcccgttaaaatatgaagatgaatcctcaagagggggtcccgaggggctagagaagcagatggccttgtttttggacaaaagtaagttgaattgatgtgcaaataaggccttcaatagaataatacactggttctttatcaacagcagacttatgtcaattaaggcattaattgaaaggcattgagaaaaagatatcctgtgaactggaattaggggtagtattctttcatttgaaatataaaaaggataattttgatgtttcatggacatttctaataagagcataaggagcctgcatcttcctgttacccacagtggggaactaatgcttcagcctggtggagttctcgctggatcgtgtaggagccacagacttagccagactgcctaacttcatatcttggctttgcgagggcaagttgctccacttctttgagtcactttttatctctttcaaaatggagacgataataatggtttctttaaagggttgttaaatgattaaatgattaatatatgtaaagtgctcagaacagtgtacataataagcactatagaagtgtaggctgttgttactgcacagtacttgaataagctacaaatgtcacttttaaattatctagttcttcaggaatataacatcatgaagaatatatggacttcgaagcagaagttgtgaatttcttattttaacctaagttgtat

SEQ ID NO: 7018 - DNA, 1047 bp, Homo sapiens
tgatccctggctcttggcaacataaaatgaaacttcagctgattctcaagtcatcaaaggcctattatgttttgtccgatgctgccatgagtcttcagaaatacggaagagcattacgatacattaaattagctttgcaaagccatggtaagccactataaatgaatatgtttaataggcactgggaagagagaacagagaaggcatctgaatcacagtggaagtttactcctatttttctagtaaatctttattttaaaatgactgtttccaatcctgtgtgtgttaccttctattttagtttctgctcagtggtttaacatctctttgctttgaactacatgaagccgtaatatgtattgttggacctaaaataaacagaatagatacagtgctacaaagcgttcagctggtaacacagtttcttcatatttcctatgatcattaatttttttctgcatttgtgttttttcttcttccctccctttctaaacagatacttattgctgcctctgcaccaatatgctttccgaagtgctgttgtttctctctcaatatttgacactttgtggtgatatccaactaatgctggcccagaatgcaaataatagagcagcacaccttgaagagtttcattaccaaacaaaagaagaccaggagatcctgcatagccttcacagagagtccagttgccaaggtgtgccacaggcttggaccacgtggttcacagtgggactgtgcagtctagctcatgcttatttgagtattcagaaaaggggtagaaatattagagttttgatatttgctctgtatttatttatttattttttgagacggagtttcgctcttgttgcccaagctggagtgcaatggtgcaatcttggctcactgaaacctccgcctcccgggttcaagcaattctcctgcctcagcctcccaagtagctggaattacaggcatgcgccaccatgcccggctagcccaccttggcctcccaaggtgctgggattacaggtgtgagccaccacgcctggcctgctgttttat

SEQ ID NO: 7019 - DNA, 1057 bp, Homo sapiens
tcggcggtctccaagaccaccctcaggtttgagaatttgctaaaggactcacagaactcactgaaagctgttctgcttacagccacaatttcttaacaatgaaaggatgtacattaaaatcagccaagggaagaggctcgggaggcagagtcctggagagttctaagcgcggagctcccagttcctctgctgctggagttacagatagtgctaactcaccccggcagtgatgcatgacagtgctcaccaagtgtatcaatcaatacatgtacaactgcggaagctcacccaagccttggtgtccagagttttcattggaacttggtcagatagacatggttgactgccacgtggctgatctttgtctccagtgcctccagaggtcaagctgttaccctggggcccaaagtccccacagtaaatcccattgttaggctatccattgtgacccaaggacccccaggtaaacaaaggcgttcttaccgggcaggacatttcaaggacttagtggttaccttctgggagccaaggacaaagactaaacctctgtacaagatttaatcctctactgcacaccgcacacaattgagttctaggagaacaggagcaaaggtgtcctgtagtatctgatagctctagaaaaattgtagttagaaggctctagaataaaacaaaaccttgttcatctggtctgacttcctgcctttgaacagagatgtaataaactattttacagataggacaactgatactaagtgcttatgtgacttgaccacacaactggtaaaatgtgaggtgggcctcgagccccagactcttttctgctggtcccttttcctaaggctcctgttctgaaaaagtggcctgtcttgacaaaaccaaatggtggggcagggaaacaatgattatttattgctttgtccagacttagtatttttgtcaagggaatattattaaatagaagttggatttagaagatttaagattctcattagcttcctttatagcattttgaaagtctgaattttcattaatacattaacattagatgggtttc

SEQ ID NO: 7020 - DNA, 1054 bp, Homo sapiens
actagtttttaccttatacagttatctttaagagcaattaaagggaacaggaaattttatttaccttcatttattccatttcagtactcttactttttgtgtaggtttctgtctagcatcatattccttctgcctgaaaaacttttagcatttagcatttgtaggtgtgctagcaatgaattctatcttttcaattgagagagtttttattcttttttcagtcttggaagatctttgagcagagtatagaattctgggttaacagtccttttcattcagtactttaaagatgtcactccattgtctctggcctgtgtgttttctgaccagaagccagctgtgtttcctacttttgttcatctgttagaaatgcatcttccttgcctgtaggcgcctcaccccccagcagtttaactatgataggcttgagtgtgtcgtgatggcttttacctctggcttcagcatttttctttcttctgttccattctctctcctcctctgtagcccgttatgcctatgttagactgtttgatgttattccacagctcttggatattccgttctggtttttttgatgccattttttcctttttgtgattttgtttgggtaatttctgttgaactgtcttcaagttcatggattccttacttggttttgtgtcatctacagttgaactttttgaaggcattctttgtctctgttacaatgttccttatttctagcaattgccctgggttcattcttacagttccagctctctgctgaaatcaccaatctgaccttgcgtggcatccatcttgtccattagtgtcttgaacatactaattatagtccttttaaattccctatgagatagttccaacatctgtgtcataattagctggttctgttgattctttgtctcttggaagtatgttgttttttccttgccttccgtatatctcttgtttgttgaaaactggacaccttatgtatgatagtagagaccaagagaaatattttttttttgcctggaattttttgtactttccccctgctacggctttagtgtgg

SEQ ID NO: 7021 - DNA, 1030 bp, Homo sapiens
ctcatcctatatccagcccatcagtaaatcctgttatccagacatttctcagcactaattctgagaccatcgtagtccacacctctatcatctcttgcctggactactatttaatgtaacagcttttaaccggcgttcttttctccatttttgttcccctacaatcagtctatactccacttacagtcagagagatcttataggtctgatctcaggcctctgcttagattgctgcattggctttctagttcatttacaagaaaatcaagagtcttcacaattgagggacggaaaggcagcctagatggctggatcagaataaggaagagagagtgataggaaataaaatcagagaggtaatcatgagtcatgatgagcatggaggggagcatggagagaagcatggatgcaggattagaggtgacaccatggtgtgggtatgtgatcaatcttccttcccttacaaattttactttggctctatgccttgaatgccatctcaccatttttcacttagaactttgactggctcttttattacttttgggttatagaaatcaatgctgcttgtgttaacatgggaaatctatcacaccaccacagtcttaattctaaatcacctgggaatgagggacagggctcttttctacaaacgtgactgttcctgctgaagccatgtggagatgagcccatacccaggaaaagggtgctggacagataatccatttgccgcccatttccctggtggtgccataatagtctgggacagaggtccgagatgtctgtctagacaaagaaaaaaacactagatgagcattatttacagaatgtatttatatctaaggaataagtttaagtcctgaataatgacagtttgttatttggtttagtttgatcctgtttggaacactcccacccgaccccttgtgttttgctgctcacataatctggctaagttagcatttgaagtctgcaaagctggacttaaagagttcaaattggagctggaattgctctaagcaattccagg

SEQ ID NO: 7022 - DNA, 1050 bp, Homo sapiens
gaagagctttctttatgtttagagtgttttccttggagccaaaagcaggttctgcatagggaagctcgattcgcttgataatttctaagagttcagctcgaataacatctgccattctgagtgctgaacagttgaggaagtaatcacgacaccacttttccacacagtctaggagggaaagaacacaaggctatttagaaatgatttgtcagaagctctgaagagcccaggccaggcagttgccatctttaagccctgtgctctcctctcctacaaaggaggccacgtaggtgagtggcaggaaggcagcaaggacaaggatttctggtggctgcaaggtcagctgtcagggcactaccaggaagggagacggtgccaccgacagcacccatgccacctgctggggttctgtgatcccagccaactgtggaaactgttcctagtggtgactgaagatgtatttcactaacccgtggctcataaaggccagagaggattttgtaagatctatgttgtgtctctatgcatacagcatgtatgtatgtggtcccatttaatcaaactaggcaggaaaaagcccacagtataaattcctctgatctatgaaaatatctcatattttatttaatgataagaacaggattactaccaggttgatttgggaattaattatgttatagttaagctcatctatctaccctagctgtaacttttatcttaaaattcaggcatgtgggtgagtttgaagttagtctttctggccacctgtaattacttaagatggacctgggaatgtacatggccatggcaccatggacagaagaccctcatttaccctgtcctgtccactcatgctgctcggagcaaccacagcatgtacttagtgtcacccattcagcatgccctcaaaaggtgccaccagattcctgtgtacctgctggctccactgacaactttttcttctcagctttgaaacactaactccctgttctttatacaattctgtctttcaaattgctgtcatatttttcacactacttcacatatttt

SEQ ID NO: 7023 - DNA, 1038 bp, Homo sapiens
gagggctgttactctatctgcatccttccgctcctctctcctactcccttgtcaaatacccttgcaaggctggcttttaatttgtcttcatatatgggattatttaatcattagtcctaaaatgaacaaagggctaggggctgggcatctggggttgtgatcttgactgggttgcatgatttggggccatgtgcataacccctgaggctcttttttttcttacctacaaaatcatgggttgtctggctcatttcacagttaaatgtgaagtttccatatccatgtatgagatttcaatcactgctttccactgtctgctttagggattggggagtagggtatttagaggtgaaacaggaagaaaggaattatgtgtatgtgctttacaaattcacatgtgcttgaatgtatttacccttgatgtgctcattttatttcatttctatgatttttgacgtgtttatttttcccacgtctagaacagaataggtgtgctggcagggatgctgttaggaactgtgatagatgtatttatggttcctgaaggtttacgaatacggtcatgctgagctggggaagtccagcctctgccctgggcttccttcacctgatgcagttatttcttgttaaagattcactgtaaaatgccaaataaacttaataactaactaataaccatctttgtcagttgaggacacttacattttatgaattttggggaaaatataggaagatacctgaggaaatagaattttcaatatcataggtctagcttttgatattacagaatttttgtgcacatgtggcaatgtgcttgctttggctttctaaaaagaattcaggtagcggtagacatcttgatagcagtaaaaaaaatacaaccaaaaggaaggccttcaccgttacctgagtgttcaccatggaccccattgtgccagatccaacaggggcatcattttctctaagacacaaaacacacacgcaattctacgaggtcagtatccggtccttattttggccattgaaaacctgaagata

SEQ ID NO: 7024 - DNA, 1141 bp, Homo sapiens
ggctaaatgaaccaaaattagcccgaagcttcgtgtcttacaagcagccccagaattgccccatcagtagaagttgtctaagctgtaactggcagctcaaatgtacttctaaatgcttagtggttgcctagaagcatttcggaatgctttggccaacgtgaaaatggtcccatttactgtctttgagttttaagcgtttttcttaaaacaacctgtttttctcatctgcaagctctctgcttgttcaaagcagccaacagacatcttacctcctggtcaggagagatttatcaccagaaatcttccagttggtccattcttacaaaagatgtcattacttttgcaaaatattctgtgccacctttggtataacaatttaaagccaaactgttttctgatgagacatgttgaatctgattttcatgcttttttcctgtttcttgttaatttgtacaaatgtggttgtttttgtcctgtttcctgatcccagtggaatcagtcaaatgaactctctttgtgttcagatttctagaacttggtataactggatttagctgcatgtgccactgaatgcacttgcccttagtaaacatcctctggaggatgtgttcagaatgtgtcactgtatgtgtcctccaggctccttcgtgggggctccctgggtgaagtgagattcccaagtctttgcttctcagcttgtgtgttgccttactcactgaaagagacccactggttgctttgcactaaaacatttctttttatctccgcctgatataatgacaagtagatctgtttgcaagaggctggcagtgaattctgaaactggtgttgttcctctgcagaaaagcctttcgttgccaggtctgggtcccagtaggccaggccttacagtgccttggttgtttctggccttgttttccccatttctctctcttggagaacatggaaaccgtaggtgcatcctgagtttgttgggcttcataggaggcacgtctttgggcttgtcaaagcaagacagctctgtgtggtccagtccatgtgggactggcctgaatgaggacaccaggcctgcgtcactgcggccatttgctcacagagcattcagccttcctctgcccttctgttctatccaggccctcaa

SEQ ID NO: 7025 - DNA, 1050 bp, Homo sapiens
tggctgtttgtcctcctagttcctgccagttgttcctaacgccgtagcctggagggctctagagaggccatccaaatcctccctaacctggcctccctccacgattatcttgttttctttggagtctgctttgccaggtcgggcaccctggcttccttcacctcctcctcgcctgccttttacgtccttgcacctgtggctctcaccttccatacagagggctctctctcgccagagctctgtccttaccctcatcccggggtcccagggtaaggggcatgcatggaggtgtcttcagcagcttcacactcctcccagtctcccagggcctggtgcagaacttgtccttaggaggtcccttgaaaaacacctgttcaattaataccctttaggaccccaaatggaaagggctaaggcatttttatcaaagtggttgtttaaaattccacctgtccttgtctgggcacggtggctcatgcctgtaatcctagcactttgggaagtcgaggcgggtggatcatgaggtcaggagtttgagaacagcctggccaatatggtgaaaccccatctctactaaaaatacaaaaattagccaggattggcggtgcgcgcacgtagtcccagctactcgggaggctgaggcagaagaattgcttcaacccaggaggaggagggtgcagtgagccgagattgcaccactgcactccagcctgggcaacagagtgagactctgtctcaaaaaaaaaaaaaaaaaaaaaaaaaaaaattccacctgtccttgaccatcatggatcatatcaaacagtgaaagcatggagtacacagcaatgcgtttcacaagctccccctctctgatgtcagacaagtggtgtggagccttgtggcgttcccatccagtcaggttccaagcccactcattgatccactgcagaattattagtgtcacttgaggccactttgtgtggtggctgtgatgatccagaaatgaagcagacacagcgtgctccgggaggatgtggtcactcagggcttgcaactgatggtaggaat

SEQ ID NO: 7026 - DNA, 1044 bp, Homo sapiens
taaagccccaggcagccgggtcttgaacacagtatccttttcatctccctgggccaggcattactggaaacacggtggatagctatgctgctcggagagggtaattgggtttcgagtgaaaagtggtgtttaaatgcaagacaggcagggtcaaattcatttccctccagggcttttggccttccagaaagcagggtatgacattacaatgtgtgaacactggcagctgtgatggccccacgtgttctcaagcctctgggacaaccacagtcatgtgacattttaagatttattttgaaattcctttaagctacccaatcccggggtgttccaggcatcccatggtgcatatggagaagtgggttgtaatggtggtgtagggactcacaggaaagttcctgaactcccggattcaggtccttgcaactaagagccaggctttgatctgacagcaaggactgtaacctgagctatactttcccctgctgctggaattgtgtttctacagattcatatgcaggaattcaaggaggacttggctgtaagtttgcatgggagaacaagacatggatgtagatttgtaaagcctttgaaatttggagacaccctctggctcacttggagtctatacttccgagatgctgtggccacccatgtacactgctactgagtcacctgaataggtgactcctcctgcccaaggaactcactgggttctgaacacttttctaccgaagaaacttctattcttaagcttctgacatttgggggtgactcacagaactgaccgcaagctgcgaggtcatccagctcaatccccattgctcaccctcccctttctctttgctcagtgggaccctgagggaagtgaccctgtgtatcagcaactctcagccaccagggcagaatcacacagaccagtgcttggtagtcagataggattacataagccctcttagctgatgtgctagattaaccatatggccctgtcctttcacgacataagtggtgcacccatgatgctgggacccttaactaactggc

SEQ ID NO: 7027 - DNA, 1059 bp, Homo sapiens
tctggagtttgagaccagcctggccaacatggggaaaccctgtctctactaaaaatatgaaaaattagccgggtatggtgacgggtgcctgtaatcccagctacttgggaggctgaggcaggagaagcacttgaactcgggaggcagaggttgcagtgggccgagaccacaccattgcactccaccctgggtaacaagagcaaaactccatctcaggaaaaaaaaaaaaaaagacaaagagtattataaactaatgaaaagagcgagggtgatgttgggatccatatttggcagggaagcaagatatttgtactctttcttacaacttccactgtattttgttaagacctgaatacacctctacagtggacagtccaaataaataagccattcccgtacttaagaagcatgcatatggtggagctttatgtgcaaaagcaacaaagccctctagttatattttagctcctcagatacttttctgagtgattattcctgctgcttaaatctctgtactactcccttttgcccaagttaaaatacctaaatcattggttgtagttctattattgtattcagtaatagttcctttgattggaaaagaaatacctcctttttagaattccctggcagtctgtaataactcccttttataatatttgtaacattgtgtcttaattaattgttgtcatataagtcttctcactagattgtgagtagaagctgttttcctttggctttttgagatgtttcatatgtacaaaaatgttgaatcagtattagtgttaaacacacgtacccacctaaattcactacatattaacattttgccatgtctgcattatccctgcatgtgtaaactttcttttctgacataccaaaaagttggtcacagacacagggacacatcattcctcgcttcatgcaactcctatgaataactgctctgtaggcacaggaatattatgatgcctatgaaaatgaacaatgattcccgaatagaatgtaagatctcttccctgtgaggttttccctttgaccttaagggtccccaccatt

SEQ ID NO: 7028 - DNA, 1048 bp, Homo sapiens
aatttaagttttcagcctgggcaacaaagtgaaaccccttctgtgagtccattttgtgttgctctagaggaatacctgaggctgggtaacttgataaacaagaggtttatttggcccatagttctgcaggctgtacaagcgtggtaccagcatctgctcagctctcagaggccttaggaaacttttactcctggcagaaggcagaaggagagcaggtatgacacatggcacgagcaggagcaagagagggagaggaggaggtgccagcttcctttgaacaaccagctttcgtgtgaactatcaaaccagacctcactcattgccacagggaaggcaccaagttattcataaggtatccactcccatgacccaaacacctcccactatgccccatctccagcattgggggtcacatttcaacatgagatttggaggggacaaaacgtccaaaccatatcgccccctccctacaaaaaaaatttagaaatacctaggtgtggttgtgtgcacctgtactcttagctacttgaggggctgaggcgagaagattgtttgagcccaggaatttgaggttacagtgagctgtgattataccactgcagtccagtgagacactgcccaccccaccccgataaaaaaaaaaaaagaactgtgattgggagggtttggggccaaggttgcttaaacaaacacagcccacagctctgtgccaattgaggtttgggattcctgcctcacccctagataaccaataaagtagctatgatacattaagttccttttgttcttaagagaaggtgatgggtgtaactagagtgttgacaacatgaaaaacctaaaatcaggttggagataaatatttaaatctcctctattggatactgataatgatgctcttaagtaaaaataaatatagcaggggcctattaggggagacaggctctggctttcttacagcatgctgttgctgtgtggtttgggtcacgtttcttaacctctctgggatttcctttcctctggtctgaaatgagcagttgttgtacttgcc

SEQ ID NO: 7029 - DNA, 1058 bp, Homo sapiens
acccacccaggtgtcctggggattgttttattcataaagtaattcggatgatctcgaggtggtccagggagatgggatagagtcagccaaggtgtctattgtaagatagattgtgaacccctcaaagataggctgaagtccttattcctgtcacctgtgattgtaaccttatttggaaatagggtctttgcagatataatcaggttgaggtgggtgcatgttggagaaggatgggctctttattttttgtttgagaccatgtcttgctctgtcactcaggctggagtacaatagcatgatctcagctcgctgcaacctccacctcccaggttcaagtgattctcgtgcctcagcctcccgagtagctgggattacaggcatgcgccaccacacctggctaatttttttgcatgtattttggtagatacagggtttcaccatgttggccaggctggtattgaactcctgacctcagatgatccacctgcctcggccctccaaagtgctgggattacaggcgtgagccgccgcgcccggccaagaagggtgggctcttaatccaatggctggtctcttataaagaagagaagacacagacacacaggaaaaatgctgtgtgaccgtggaggtggatcagagtgaaacatctgcaagtcaaggagattgccagcaacaccagaaactaagaggaaggcatgggacagagtcttccagacgggcttcagagggagcatcgccttgccagcacctggatttgggacttctggcctcttgaactgcaagaataactttatattgctttaagccccccagcttgtggtcacttgtcatgccagccccaggaaactgacatgtcatctctccgtgtgactggttaagtcttgatgtgatctcctagacctacgtactttggagctagccagggtatgatcagcgagaggcttaggacttggttagttcaaccaagctgttggagcccattcttgcctcaacctagtgaaatcaaaccttgcatccttttctcttgcctttctgaagatgtggatttgaaaaaaaga

SEQ ID NO: 7030 - DNA, 1011 bp, Homo sapiens
acaggtccctcctatccccaaggaggtgctctgaacccactccccatggctgtggatggctccccaaccttctgcatgaggtagacacccagttacctctgcagcgtccttcccttcagccaaacccctccccccgccgcccctgctaaatttactttgtcaccctttctagaccaggtcagttccagacatgacctggatgctccttctccttaaagagtgaatgagcaagaggctgggcgcagtggctcacacctgtaatcccagcactttgggaggccaaggcgggccaatcacctgaggtcaggggtacaagaccatcctggtcaacatggtgaaaccctgtccctacaaaaaatacaaaaatcagccagatgtggtggcacacacttgtaatcccagttacttgggaggctgaggcacgaggatcacttgaactcaggaggtggaagttgcagtgagccgagatcatgccactgcactctagtatgggagacagagcgagactctgtctcagaaaaagaaaaaaaaagagaatgaataatgagcaagaatgataggccatggcagattggcacacacataattttataatttcccttttttttttttttttcctggagacagagtcttactctgctgcccaggctagagtgcagtggtgtgatctcggctcactgcaacctctgtttccagggttcaagtgatcctcccgccttagcctcctaagtagctgggattacaagcatgtgccaccatgcctggataatttttgtatttttagtagtgatggggtttccccatgttagccaggctgatctcaaactcctgacctcaagtgaaccacccatctcagcctcccaaagtgctggattacaggaatgagccactgcacccagctggcacacacataattttctaaaccaggggttgacaagctgtaactgatgacccaatccagccctccatctgtagtgtgtatgcatgtgtgtgtcccacaagctaggaata

SEQ ID NO: 7031 - DNA, 1038 bp, Homo sapiens
tcttaaactggttctttttttagcgatttaggagaactcagaataagctggggcaagggaaggggactgtcttagtccactggggctgctgtaacaaaataccttagactgggtactttataaacaacaggaatgtattgttcacagttccggaggctgggaagtccaagatcaaggtgccagcagatttggagtctggggagggccattcctcatagatggcgccttccacctgttctcatggggtggaaagggcaggcagctctctggggcctcttttctgaggcactgatgactttcctaagggtggagcctttccagaggccccaccttctaatactatcaccttggtgattaggtttcaacatctgaattttggggactacaaacgttctgaccacagcagggatcaattgattcagtgtcatagaatctctcttaatccttttgaaaatcctttagttagacaaattttaatttgacttcaatcttagtctttagggggtaagtgtaaaaatatgcagcaaaatgctgtcctctctgtctgtctctgtctctgttcgtctccctctctggcacctgtccaggaatgactgcagatggggcagggctgcagctgacttgggagcagccaacctggaggttcttcccccgtgtcccctgatcaaagaacagaagcacctcagcaaccacgccccgtcctggaaagtgttacccccccaaccccagacttctgtttcttgtacccctgtggcttctgctcgctgtcttctccttgtggcagttttcatttcggttgagacagccccagatgggacaggatgggtggggggaggcagaaggcttccaaaaccagcagcagcattacactaggtactcattggcccctttctgtgaccgagttcacactcagaacacacgtgttgaaatcgggaaaaaaacggagacctgttgtatcttgcaaggaaaacgttccttacaggtatatttacagaggactgtgtcacactcaggcagaaatgacctcaacaagacagc

SEQ ID NO: 7032 - DNA, 1075 bp, Homo sapiens
tacgaggacatcaagagtcacccacagtggcagacctagaatgcaggtcttctgtctccagcttagttgctggctggaaacctcagggcatctccaagcacctgtgagctggccctggcttgcttctgactgagccatgcaaagtgctttcacctgaaaacaaccgtctatctgtaatcatagagccttggtcaggatcaaggtagcagacatttctttgcattgacgtctatttttccccattaaaaaatagacaaaatatttctatataaatctctaaaagacgagggttccccttttgaaatatgccctaaataccatcctcccatcgtaaatgaacaattccttaatatcatcatcaaatatccggtcagacttcacatttgccctatcgtgctaagtgttctatctttttccagtttatctgtgttgggattgaaacacagtccttgcatctggtgactgtgtatctgaagtcacccttggcctcccttttaaatcactgctttcattgtaaatgtcttcgatggattgtgagtgactttacacgtgtctgtgggctggaaagcaattgctctcctattaagacgtcattgacctttcctttaggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacggtaacccgacagggtatctttcctcgctctgcggtagcttcagggacctacctttgccccacctgtagccaacagggctgacggtgggctcttattgaacttgttataaattagcaactcagaaacctggggtcctcctcccctaacctcaaatgtcccaaggcagtaggacagccagagccacagagagacctggaggaaggtgggcttagcatttgtcccccttccgcagggcctggggcgaggccgctctgctgctaggctctg

SEQ ID NO: 7033 - DNA, 1051 bp, Homo sapiens
ccaagtaggagaggctaggccatcactcttaggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttccgtttattataataggcgtccaccaatgattatccatatgtgttcttaatttttaactgctggaagtgttaaaacacacacacacacacacacacattttttttttgagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaagactcacagtgtctgaccaattatgttttcatccttgattgtaaaatacagacgctgctgtttctgttctgctatgttaaagtgcttggtgacacacatttatatatgcacctcttcctccaacattgtttttaatcctctctgttaattgtgtctgatctggagcccagatgggaagtgcccgtgtcccgtgcatggctgcatgtcctgatagacaggagctaagcagagaccagctgagtgcttccccatcaccaaagccagagggctgtggggctgcagatcatgtgggcctcttttcagctgctaatttaaga

SEQ ID NO: 7034 - DNA, 1049 bp, Homo sapiens
ccaacccacatcccaggcttgaatcccattaccaggggcaaccgatccttcttgtcctttcccagattggtgatggatgtccactgtgtctccatgcagctggccactctgtggacagctgtttgtgactcagctcctcccagcctgagggcatctgggccctgcaactccatcctttgctcccctttcttcccgcggggaccctttcatctccctggcaggaccctgtctccacccgagggcacgttctctgacctcttctgcggagtaccctggcttgatgacgcttcctgttccttcccagggttgtgctgggggcatcagtctttgaacagtccctccctgagggctgccgtgtcccctcagtgcccaggcacatcaagcactgctacaaacccagacattcacagggacccctccacctgaagtccaccataaggtagaagcttccggaaggggtgatgcaaaggggtcaaacatttagactacgcctcagagctgcatgattccttcctctaactgtgaagcaaatacagcgatttctctgggtctgccatcgaggccttcttccctctgctctcacctcaggtgccttcctaatgtgcaggtgacgattgcctctgagctcaggcatgcagcttctgggatgcactctcctttcacggcaaagcattctgcataggaaaaaccgtctctgcgtctccaagctgtggcctagcccttcattcatcaaatgggatacaactttcatttcttattaaaatctggaagtcactctccatttgtaagatatcccaggggttgatgtcatcttgtaaagggggacagtgccattttctatcttacactttaaaaagacaaaaccactagctacaaacatcattcaccacagcatgggagaggcaaccccacagcaaaggttatgtcatgtttcataaatgggtatggatttgggggctggtttttttaataaaaacatattttggtactttggaacttgacataatttgagctgtttatgttgtagatgttatgaatagatgttatgg

SEQ ID NO: 7035 - DNA, 1070 bp, Homo sapiens
cccgcttcccagcgtgctgggattacaggcatgagccactgcgcccggccaaaatggataaaagtttaaatgtaagtaccatttggatgttgtatccttgccgctggcctgtacttgaaatggcccaggaaacaatgtgcactttccttagtgactagttcaaacggacacgtgataaatgatgtgtggcatctggggaaggagcacatttctgcagcttttttggtgaagatggagacatttaagaatattaggccgggcgcggtggctcacgcctgtaatcccagcactttgggaggccgaggtgggtggatcacgaggtcaggagatcgagaccatcctggctaacacggtgaaaccccgtctttactaaagaaaatacaaaaaattagccaggcatggtggcaggtgcctgtagtcccagttactcgggaagctgaggcaggcgaatggcatgaacctgggaggcggagcttgcagtgagccaagatcgtggcactgcactccagcctggacgacagacgaagactccatctcaaaaaaaaaaaaaccaaaaaaagaatatcatggtggcttacaccagcaaacccagcactttgggaggatggcttgaggccaggagtttgagagtagcttgaacaacatagaacccatctctacaaaaaataaaaaaagtagccaggcatggtgatgcatgcctgtagtccccagctactcaggaggctgaggtgggaggattgtttgagcccaggagttccaagctgcggtgagctatgatcctgccactgtactccagcctgggtgacagagtgagaccctgtctcaaaaaacaaaaagtgcccgaattttagtacttgtgttgatgtaataattttaaatctactttccaaatcatcgcttctccaattttaaaatttgacatgaattgaaatttttttcttttaagtagttgaatcagatatttacataagttgctgaaatctcagctggtttgtacaatggggttattaatatccatttgcagagtaagcaggtttagtatatgatatgtttaataagcagtagctggt

SEQ ID NO: 7036 - DNA, 1029 bp, Homo sapiens
ttcatgagaaaatgatactcctcatcccttttttgactctgggcgtcttcatgtgtggttcttgcctgtagcctggtgatgcccttggcccatggaggctgtgtggtctccaaagacagctgtgttttttatatgcttgtatttgctcttcagttgattttccttctctgctgagtgcacttgccgctgttaatggccttgtctccatcagacctccgtttcctaatgtgctgcttctaaatctgtgcttgcagacaccaaagggtaacgggctagaattatgtcggaaggaaaattcagcatatttggagtaataatttaaagggctccgagtgagcagagtgtaggaagtggagttcatggacttgtgacatgtattttggcagtactttgtgagctgtggttccctgtatccaggtgactgggttagttagttgggttgtcagggtcagcattgtattcctatatctgttcatatttttctgaacttgagctaatcccactcggttggcaatgtaagtgatacagctttgtgcgtgattgatgcatttcatttgggatgagtttataaggatatttattattatttttttttgagacggactctggctctgtagcccaggctggagtgcagtggtgctatcttggctcactgcaagctccgcctcccgggttcacaccattctcctgcctcagcctcccgggtagccgtgaccacaggcgtccgccaccacgtccggctaattcttttgtactttttagtggagacggggtttcaccgtgttttgccaggatggtcttgatctcctgacctcgtgatccacctgcctcagcctcccaaagtgctgggattacaggcgtgagccaccgcgcccaacctctaaggagatttttgagctgtgaattgggagaacatggtggcgtgaccccatggggcttaggttctttagtgacccgttgtcccagcactgacttttcttgagatttgtgactaaacttgtggctgtatacagataattaaaattcctg

SEQ ID NO: 7037 - DNA, 1057 bp, Homo sapiens
gatggataagtgactttacttcttgattgagttttaaatggacgttactttgcatgtatttaatgtctagaattcagggcaggcccaccaactaacacctgtgtgctctgtagctctttgattagcccaaaacaataaacagaagctgtagctttaatatctacacacagaccccactgcaccccaggcccactgtgggcatggtggcatcgaggagggtggtagctggttgggtatagagaggagctagacaggaatgctgggcaggaatgccagggtctgctcaggggcatgaacaaaactgccccgaaaagtgggttgctgactgccctcaggccttcctcttgcctcaatccatgagagaattttctgaggtcagatcttcgactttttatgtggaaaacaaatagcaagtagtactacttctagttatgttgtaaaataaaagttttttttttttttttacatttttttttgagagagtttcgctcttgttccccactggagtgcaatggtgcaatctcggctcactgcagcctctgcctcccaggttcatgtgattctcctgcctcagcctcctgagtagctgggattacaggcacccgccaccacgccccactaatttttgtatttttagtagagatggggtttcaccatgttggccaggctggtcttgaactgctgaccccaggtgatccgcccaccttggcctcccaaagtgctgggattacaggcatgagtcaccgcgcctggccaaaataaaagtttttaacacgtgcttttgtaaagtgaagcactagcctaccactgaaatgacatcagcactttggaccaatatgttttataaaaacaaagcttgagttccattgatgcagaggctctttttgtcctttggtggcctctgtgtaggttttgtttcctgtggagttccaggtttgatatcatacttcttaaacaagccagtgagacatttttcctggggaatggtctcactcctggaggaaaaaatttttaagactattgctcttgaatagccctgaagcagcagaaacagatc

SEQ ID NO: 7038 - DNA, 1047 bp, Homo sapiens
tgcctttcctcacccatcacaaggggcacagccaacacctagaatagattaccaaggaaaagtataaaatgtatgtaaagacttaggtgacacaggagccttcagaaataaaaacccaagagaaactgcatgttcacactcagattcaacgaagagtgggtggctgtgcagaaatgtgattggacagaagggaaggatctaatcgtagactggatggggaagccttgccccgtgtgtagctttcttccttccaggtacagggcagggcccttctggaatgaaggtctgggatccattttcagataaagtagtgttgaggatgtctttgtggccggctcctgtagtggacctcagatccgggtgctcgccagttacagagtccagttgacaagagcaaggtctggtagaaagaaagtgactattaaccagaactagtcatggggatatggctggattcccacccaaagtaactactttgaattctggagagaaggcaagggtttaagaagtggggagtaggagcttgagctgggaggcgcgcagggatcgtgctgagtacaatgtgtgtcttgttccggcggctgtcctgggcctccgtccacctggagtgcgggctggtgtcatctcaacaagtggccagatttgactgctcaccttgaggtaagctctgggattttgcagctgggtttccacgcttggtctgtctcaagattagtccctagaacttcgaagtaagcacgtaattagagactagctcacagacacatgtgaagagagtatacggtgagaaaggggaggggtatggagtctattttaagattaagggaaaaggcttctgcagtttgctctaaggttgcatctcaggactaaagagaaaggaaaaaaaagtctaaaaatgcattttgaagttaagctgctcagttacactcctacacaaaggccagggaaagttagagtcatatttctagttttttttttttttttttttgagacagagttttgctcttgtcccccaggctggagtgcagtggcgcgatctcggctcac

SEQ ID NO: 7039 - DNA, 1043 bp, Homo sapiens
cgtctctcaggaggcatcgggtgggtgggggagcgccgtggtctgggctgcatcagagctctctgagcactgggacccctcctttgcctggacccttcccagggcctcctgatgacattcctgggcccttactctacaaaaaacattaaaaattgtattttagattgtgttggtgcaaagatgagtatagtgaagaagttcaccattttgtttgttgccagaaatgaaacatttccagggtccccagccggcgtctgctatgcctgatggacaggcttctggggtgggggcgggaagctcccatcaggcccccttcccctcccctcccactggggacccctgcctccagacggcctccaatgcccggtactctcctgctctgatctccttctgtggcaggacggggctcacatcaatgtcctcccatcttacccctgccagtccccagcgcccagcacaaggctggacacagaaataaacatcgccctttggaataaacaaatgtgagagtgactcctgacctgaacagcccagccccctaccccgggcctttcccagctgtcataaatctaatggcttttattgccctaggatttttacagtacccattaccatagcagttgggaacttaattggcaaaattaaggacatgtacttaggaacttctagtaaatatttgctaatggattcatattagcaggtcctgctgggacatctggtacagtcagaacttgtctgcctaaaaacttgtcccaaagctgggggaagctgtttcctggcctgaactttctctggggctgtgagaggcgagggctcaggaaaagatggtcaggttcagtggaatttggatccttgaaaggaagaaaagggtgacggaaagggcagagggaactgcaactggatcctaagccaccccgtctgtgacctgggccttgtcaccgcaaggctctcgtgttggttggaactccgagagcgccgacagacaacacgaggcggtgtggagcgacaggctgtttcagcgagcgcccaggtgcgggcggctc

SEQ ID NO: 7040 - DNA, 1050 bp, Homo sapiens
atgccatcagcaccatcagaagcagcctgggaggtgaggccttcgatgtacccccgtgggctggggtcacaggactggtcctgctcgctggcagctctatcaaaaccagctccagcttccttggaggccaagagggcccaggcggtgaatggctggcccggccatcctgggtgtcctaacctggcctggcaaggtgtggccttggctggtgggggaggcctgcaggtgcagaggcacttcattggtggagagtgaagtggcaggtgcagaggcacttcactggttgttgcttccccagtcagttgcagcctgtttgcactaaacatcagcttcacgttgacagcagaatctgatgagcttttggacagacaaccttgggaatccccacaggccctggaggtggtgtcgcatcctgtcctggttgccttcattttgtgcccttgcttcatagacctttatttagcaaatttatttgagtcaaagttgacttccttttcagctttgtcacacactgccgctggagtgggacttggcgtggcttttctggagggcgacctacatcaaggggcatgcatgcgccctttgagctacagatttctcagctgggaatgaattatgaatgtcctttagccttggccgagagggtgtacagctctgcagtgttcctgtcggaaactggaaatagcctgagtgttctccattatgaattagtgcaaatgaaacacggctgagccttacggtggcataggatgcagtcattagaatacaacattcgaaaaaggaagagctggtcgtttggtaaaagcttgtaacagataaagttctaaatggcatcaaaagaacagacttagtaaatctcattttggttaaagatgagaaataaaaataatacgcctgaatatgtaggtgtatatacatatgtgtctgtgtacacggatgagtctgtggaagtatataccgtacaccaaaatgtcgggggggcgtttctgggtggtgtggttacttataacttccattttcttgtgtgttttaaaatgttctgtgatacaa

SEQ ID NO: 7041 - DNA, 1021 bp, Homo sapiens
caacatgatgaaaacccatctctattaaaaatttaaaaaaaattagccgggcatggtggtgcactcctgtaatcaatcccagctactcaggaggctgaggcttgaatccgggaggcagaggttgcagtgagacgagatcatgccattgcactccagcctggctgacagagcgagactctgtctcaaaaaaaaaaagtgttttcctcacttgacccagcttgcattccttcctggcaccttctgtcttctcggttggttttgtaaaatctgtgtatgtgaaccttcacttttgtgatgcacagtcttgtgggttttgagaactgcctgggatcttgcctccactgccctactgctgcacagagaattccgtgcccttggaattctgctgtgctttccctttgcagtagccacactgtcctttgccagtgcggatgtgcttcccatcccttcccaatgccacgtgggtgggatctacatgacggggccttgttgggctggctccttccacttagacctgcccctgttgtcgcatgaattaacagcatgatccttttgagccctgggcagtattccatggcatggatgcaccagtgtttatccattcccagactgaaggacatcttgattgcctccagtttctgaaggttatgagtaaagctgctataaacattggacaggtttctgtgtgaaaataagtcttaagttctctgggataaatgagtccagtttggggctgtgacttgcatgggctatgggggcttttatagctttggggaacattctgaggcagaagagaagtgttgagttggagaggagacaccccacccaaccactgccctgcttggcttccctggtcctgagtgagcttgcccctcccggggatcctggaaggcctctcccatgggctggcctttgaaggagtcggaatggacacaggaggtgtccacagcaatgtggtgtgatggagccgatccctcaaagggagggacacaagaggagccagcagtgagaccctcagtga

SEQ ID NO: 7042 - DNA, 1080 bp, Homo sapiens
ctctgatatacagcgcggactgaattgcagtgaaactgtttcccacattccctctatccatagggtttttctgctgtgtgagtcctctgatatgtagtgagttttgactttgggtagaaagttttcctacattctttcatatggtttctctcctgtgggagtaccctcatacatcctgaggtttgacttcttgctaacggttttcccacactaattacattcacaggggttatcctctgtgagagttctctgatgtacatggaaggctgacttctcacagaaggttttaccacacttgtcccattcatagggtttctttcttgtgtgaattctgtgatggataataaggtgtgacttctggccaaaggatttcccacattcattacatccatagagcttttcccctgtgtgaattctctcatggatttcaaggcctgactatggctgaaggatttctcacactggctgcatgcacattttttcccctctatgtgtcctctgatgtactgtaagatctgattttggccgggcatggtggctcatgcctgtaatcccagcactgtgggaggccaaggcgggcagatcacgaggtcaggagatcgataccatcctggctaacatggttaaaccctgtctctactaaaaatacaaaaaattagctgggtgtggtggtgggcgcctgtagtcccagctactcaggaggctgagtcaggagaatgatgtgaacccgggaggtggagcttgcagtgagccgagattgcgccactgcactccagcctgggcgacagagcgagactccatctcaaaaaaaaaaaaaaaaaaaaagatctgattttctaactaggattttctcacattcatagaatttttgtcctgtgtttggctcctctcaattaggtcatcaactgtctgaacatctgaaatgagaaaaaataaccacaacattaagcacatattaaccatttcttatgggcttctcatgtaaggaaaaagaagttatttcttatcccactggttttggtagtggttttataaatatatggttttccttactactgacttaatgtaatgaatcacagg

SEQ ID NO: 7043 - DNA, 1050 bp, Homo sapiens
cactcctagcaggtgaccctccctcatgcctcgtggaaacagtgcagcctgaggggctgtgctctgcccgccacacctgcccgctccattctcacagcagctcccggctgtgctccgtgcctccctccccgccaccaccggcagctgactctccctggggcacatggtcctgacttctagggcatgttttacagatcccactgactccgtttccccttccccatccacagctccttagtctgcttcctcatagcacccgaatgtcctttaaacctgggacctcattcctcgtcacctgcccctcctctcttgccacctgaggccgccccggttgtaactcctgtgctgggactgctcacttttcattccgtggtttcgaaccgtcagtgccaacctcctgtatggcaaccgatgattccgccttttactgataccaccttcagcccacgtgtatccccactccccacaaaaaaagaggttgaaagagatctattgcaagtttttgttacatagtattccgttaacaggtaaatattgtgtattactgaactgtgccttttctttttcacacaagttttcactttcctaggtctaatgattgcctgattttctcatatgcttagttatctgtgtctttagtgcatttttttttttagcaaacacttcaacaggtctatcaaataccaacacatcagatcagctctcagctcttcttgtccccagaccagtctccctggcctgaacggccactctgaggcctgctggccgcctggctcatgtcctgagattctcctcaccattttttggaagtcagatctgccatcttccttctcttggctttttctctcattttgccaaattgcctctcgcagcagtttcctgagaaagcatttgtttgttttggctctttgcatattcgaaaacatttttactgctccctcagatttgattgaaaacttgactaggtctagcatttcaggttgaaaattgttttctcccagaattttgagggtagtttgaggtttcatccaccatgtttcctgcaacctg

SEQ ID NO: 7044 - DNA, 1062 bp, Homo sapiens
cctaacagattttaggttagaaaatggaatttctcttgtttttgtgaatcgttgcttaacctaaataataatagtctcaaatataaaacaaaccctgataaaagtcaagcatctcgttctaaaagatattgggtattatagagtgttaagtgcttttttaagatgaagttgttatgtgagtgacagatttatacaggagcaagtccctactgaagttgttcagccagctgcaacttgacaaaccccaggcagccttttttctttttcttcgtatttcggttcacgtctgaaaggctttcacggtccatccattttagagcattcggctggttgccccatgtgcccttccctgtggacttgagtgtgtctgtgggtaagggcggcagtgcacgtgttcatccatggccggaggccgcggatggtgttgcagccgccaagagggtgaagctgctgcccatcaagcgaccccagctcccagttagaagctgcagcaaggttcacaggcgtccacgtgtgcgtcttagaatcgaaggagcgtggaggattcggaaggctagtgagtgagcaccagattgtggaaggtgcagggcctgagattcaggagtcaggtccatagaggcccgttgggaagctctggctgtgcagaagacgaggtgggaagcatagtcagcaccttgagtttcaagcttttcttacttttctgtgcagattaagtcttacaggaaagcccagccaataaaactaaggcccacagaacgtatgggtgtggctgtgcggcccactgccctccaggctcagctctagccgccaggaatcaggtgaaatcagaaatcagcacgtccaaaaagagaaggtgctcgcttcctcctcttcctgtgtgttacttccctgctctcctgcccgtgtccccatgaggcttcctttagaattctctcctagcagagcggcactccatgagatctgggagtgttggagaaggctgaggggttgcttgggtttggggtgactgggatgggagttggaacccgttcatggcagagagacaagcctgcagcctaggga

SEQ ID NO: 7045 - DNA, 1226 bp, Homo sapiens
aactgggctcgagcccaggtgtgtcttggtgagaaaccagcacctgtgcagaggtgtgtcccctggaaggaaactctgcctggtcccaagggggtgccgttactagattggaaaaccgttggttgtttgggtggttgggtggtttggttgcggggggtgggtggttgagttgggtggtttggttggtttttaatgagatttcagccccttttacactattgtttatcaagtgaagactgagtgagtgagcccattccacattagtcttggagagtgctacagaggacgctgtaccgcagaagcctttccctaacacatgtgcctctgggagtgatgttgggtctgttctgatgccatttctccagctttgccgtgtggggtggctacacctggggttgtgcattcctcaggaggagtgtcctcagacttctcacatcgatgttgtcaccgtatttcctatgagttcatcaaagcgagaaaggctgtggcatttgctgaaaatctagtttatagggtcctaatttgaaccaagatgttttgatccaaaatgttggtgatgtctgatacacagtgctgccgcctttgcacccctgaattagtgtaaatcacttttagtgacagtaacacgagttgtgcagttccatcatcatgaaactgctgatcctaaagtagaagtgtgatgggacccccgagggtgggcacttgaccccctccagccttgtccatctcttctgcagccaacaccacctcccacccagttacctgtgcacaccccaccctcagaaacccctgttcctcctgatcagaccctgccacaacccatcagctcacgtgctcattttgggagaacagtaggcctttactaggcccagtcttggttttattcaaggctgcttttgtaggtttagcctaaataaaacgggtataattggtggccctactgaaggtgtgtgagaagtctagttatttcattagttggtgcatggggaagagaccacagacaggtaattctgtacattgacttaggtcggtatttgagatcttacctctctaacagttcagagtgggctatttatgtatctgagcctaactgggtaagagtcagacatgttgctgtttttaaatttttgctcttaaattattttagtgccagaaaagggatataattaaaagaagaaatcttggccaggtatggtggctcatacctgtaatcccagcactttggg

SEQ ID NO: 7046 - DNA, 1784 bp, Homo sapiens
accagcctgggcaacatagccagaccccatctctaaaaatgaaagcaaattattttatatgcaaattaaaatgttttcaataaaagaaggaatctttgtaagtattgcagctatcatatgttttgattaatgggaaatttgttagaggattggggtaggtgtgtgtttttaagcctgaacttggtagaactgactcttcttgctctagagaatccaagggtgtggtcagcactacctgggttaaaatgagggaagcctccctacacacacttttccaagttggttttttacagaattcagccagacaagactcagttgagagcttttctttttcccctaagctttcaaggctctcccttttggtttctaattacaagaataacaaaaaatactatcattaattttttgttttgattttaaagcttatgtttttcttccagctggatgttagtgagacacaggcctttttccttttttcatgtgtgatgctattcctcacgcctgagctctcacctctgaccataggcggcctgcagccagcgcccactcctctctgtcctttctatttctgtgcgaattgggcttccctaggaagcctccctgaccacagcactcaacacagagatgggggcgggaggtaccttctactttttgttttaacctcaagtgaagtgtaatatataatacatacctccagataagacatctgccctataagtgaccagctccatgaatgtttgtagggtgcacatgcccatgtagccagccccagaccaagaaatggaatatcctcagctccccagcaccctgctgtgcaccctgccagtacctggagccagtggaggtttgtggggtttgcaccgagaagcatagtcctagtgcagtgagaagaggtgtgtgcatctagctgcaaggagaggacaaagggaggggtgcagctgagccacccaggaggactttgctgtccagcgcctcagtgtggccactggaggacacacaggagagggagccgcaggcctcggtgcctgggcagtttgttaccctgccagctgatcttctcttcagcaggaacatgtcgacctcggtaatggaagcaaggggaagacttggaatagacagtattccattttgtagcatattttcataactctgctaattggttatttgggggtattgcctgtacagaattattacttagccatgaatataaacttgtcctctttcgttatctactataagtgttctaattatgtgctgctgtgatctttgttttgaattcctatttccttccatttttaggtcccaatattgaagcccatggatcttatggtagaagcgagtccacggcgaatttttgcaaatgctcacacatatcatataaattccatttcagtaaatagtgatcatgaaacatatctttctgcagatgacctgagaattaatttatggcacttagaaatcacagatagaagctttagtatccttcctcagagggacactggcgtcttcccgagggtgctctttagatagtaatttctctcgtccctttatacacctgtatctcggagtctagtcttgtaaataccatcactgcacagcagcctgtgatgtaagttctctgtgatttgaaatgtttgtccctaaaaatacaaatttctttctacctttgggaaaaagttatctgtataatgggaattacctgaagtccactgcctgcctggtttaatcagaggcagttttaaataggctacatttgaaaaaccaacattatgtgttcttttttt

SEQ ID NO: 7047 - DNA, 1211 bp, Homo sapiens
gggtgagacttgggcgtctacgcttctcatgcccatcccttgtccatagctggtgctagaatgtcttatccgaagctcttgcccacggaagtcacagaagatcagaaaacctagagaatcagaaagatcagaagacctagtgttgaggccaagcccttccagagtctctctgaaggggccacttcctacttgaacttgaaaatgatttgttctctgatttttaaacagaagctgaaaacattttattttgtttttcagtttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggataggtaaggcctgcgtggagatgagctgtcgccccaagcttgctggtttccgagagtgcaaggtcagtgagggaggcgagctgtcctccagcgtcagaggaggacgctcatagggtgttgttttccagaccttttgattgatggatgatagtatcaaggtagagaaaataggatctctgagcaagtttctcacctagcttgtcattccatttatatttagacaagaagtatagcactaggtacaggccggctatgtgttaaatgcttagtgaatgatagtgtattactttttattatgctgataatgagtgaaaaggaaggaagtggggaagtgattcacctcactggaatgaccgcgttgcagtctgcctttccttctggagagaagtagatgaaaacaccccagagccactgcctgtcatgcccagacacagcgtggtcatggctggtctgaaacaccaatgtaatttgtaatgtgatggttctagtaccttgataatttattttgtatacattctttaaagatagctatgattagtgtggttgagagttacgttttttttattatgcaaaaagttacgtttcagatgatggaagattgtcttgcaccatttttatatagaatttttgttcagaattcaagagaacagaggagtctattggcaataagtgattgactggatattctgcaaaa

SEQ ID NO: 7048 - DNA, 1650 bp, Homo sapiens
agcatccatccatctcataatgaaattgcaggacaccaaacgcaaagagaatatcttaaatgcacccaaggaaaaaacgcaaattacctctgagagcggacaccgagactgagactcggctttgccacggccacagtgggagccagaagccgtgtgacagatccagcaagtgtgactccttactctccaccgccagcttagaatcaagccttgaagtagatgctcgttcaagaatctgcttgtgataaaggcattttcaaatgggaaacaatgtatcacaacaggaaactcagtagagcgagctgtaaagggagcctggccctgcagaaaggggctgagacagataggcagaggaacgcagcctgcagggaagagcagtgcaaactctgaagctctgccacctggacggccttagttatctgtgtttgggggagaaaaattagagccctcaccagccccacacaataaataaataagctctgagtgtttctaagcctaagacatctttgtgagctctggaaacaagggcttctttaagaaggccccaaaagcccaaggaaaacattaagaaattcaactacattaaattttaaacttctttatattgaaattaaaagtgaaaacaaaatccacaaaaggataacgaacagagattaagtatccagaataggtgcagaattagttgtcaacaagaaggtggcaaacaactcagaaaagagcaaaaaccatgaatggggtttcgcagaaatggaaaaataaatagaaatgctcatccttcttagtgatcagcaagtaaagccagagggacgtcctttcatgcccatcagaatgatgatggtttgggggagagggtggagaccagtggtcttacccagtacccttcttgtgacctccttggtgacattcagtcgggttgggagcttcttgcatgttcagacaagaaaacgtgctcagatacctgaaatagcaaacaactggagacagcccacaggtgcatcattagaggaatggacaggtaagttgttctctatcataacatatactgaaaagcagtgagaatcaattattagaactacatggatcacctaggtggatctcacaaagataatccacaaagaaaattcaggaggaatgcgtacggtgcaatgacatacaacatgtttaagacatacaagacggttttgttttaagaatctgtaactattggccaggcgcagtggctcacacctgtaatcccagcactttgggaggctgaggagggcggatcacgaggtcaggagttcgagagcagcctgaccaacatagtgaaaccccatctctactagaaatacaaaaattagccggacatggtggtgcatgcctttaatcccaccactcaggaggctgaggcaggagaatcgcttgaaccttggaggtggaggttgcagtaagctgagattgtgccactgcactccagcctgggcgatagagtgagactctgtctcaaaaaaaaacaaaaaaaatctgtatacaaaatataaatgtgtgtggggatgacacatatgtactctagcaagtgaggaccccaactggggatgggataggagaccatctttctttccagagtggcaacacagtgcaggggggtccctgtcttagcagtgacttgct

SEQ ID NO: 7049 - DNA, 1810 bp, Homo sapiens
ggatcgctgaatgcagtttctcttctctgagttcgtcttttttttttttttttcccctgctttgaagttttagacaaggtcagtcagacactaggtatttgccagcagccagggtcagtgctgggccatggaagggaagcggcccgcttctttctcatggcaccttgaagacgcgccagcgtgaaaggcctctcaccgcgcatgaccatgggggcaggacgtgagggcgcgggttagtgtcaaaataggaagaggaggcgagcttcaaggacggctggagaaaccagaagggcattgtttgaacacatctttcatcagaaactggactcatgaagccatgggtcaaatcatggcagcgtttgcatcattcagctatttttctgtcatttttgtagaaaatgtaagattgcagaggtttttaccagtattatgaagttatatcatgaggatgtgtgcggtagtagaatttttcgacagcagagacatttgaaagccattacagttgatcttgaagaaacaaaagcatggacggtattgtattgtctggaatgtgtgtgaaatgcagttgttctaaaattctgccacactttgcccagtggatttttactatttctatccgttgcctcatttgaaagaaactttttgaaattaatagaaaagcagtttaactccaaagaaacattgacagatatgactagtaactgttgaacatgataaggattatgttcaggtcattatggatcattgacaaattgcagaacataaggcttaaaaataaactgtgctgttattcatgagtgagataaataggtggggttgtttcaaaaaatacactaatgttaaaagtgtgactccattattttgtttctcctgtgacatggattcttactgacatgattatagataaagctcggtacacattttcactgcatttctcttctgcccattgtgattgatcattcctgatttctgaaagtaactgggttgtgggggagggtggcgtgcgctgtgcaccccaggggtggggtctgagtccttgctgccgctccccccactgaggagtgctgctgtctgctcttgttttgaacagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggcctt

SEQ ID NO: 7050 - DNA, 1230 bp, Homo sapiens
aattacacgatgccaccagtacgttggtttattttcaaagtaggatctttgataccagaaatcaagattttccaagacaaataatacagagctgtaccaatgctgagtgaccagagcttgcttccgtgggatttaacacacgcccactacgtgtccccgaggggagtggggagtcgggctcccgtgcccctgtggagatggaggtgtgtgctgatcccccgtccgcctgtggagatgaaggtgtgtgttgattcctcctgctgctgtggagatggaggtgtgtgctgatcgcccgtcaccctgtctagatgaaggtatgtgctgattgcctgtgcccctgtggagaaggaggtgtgtgctgatcccctgtgccctgtggagatggaggtgtgtgctgctccctcgtgcccctgtggagatggaggtgtgtgctgatcccccatcccatccccctgtctagatgaaggtgtgtgctgattcctcatgcccctgtctggatgaaggtgtgtgctgatcccccgtccccctgtggagatgaaggtgtgtgctgatcccccgtgcccctgtggagatgaaggtgcgtgctgatcccccatctccctgtggagatgaaggtgtgtgctgatccccatccccctgtggagatgaagggatatgctgatcccctgtcccactgtggagatgaaggggtgtgctgatcccccgtccccctgtggagatgaaggtgtgtgctgatcccccatctccctgtggagatgaaggggtgtgccaatcccccgcgcccctgtggagatggaggcgtgtgctgatccccatccccctgtggagatgaaggtgtgtgctgatcccccatccccatgtggagatgaaggggtgtgttgatcccctgtccccctgtggagatggtgtgtgctgatccccgtccccctgtggagatgaaggtgtgtgctgatcccccatctccctgtgaagatgaaggggtgtgctgatcccccgtgcccctgtggacatggaggcgtgtgctgatcccccgtccccctgtggagatgaaggtgtgtgctgatcccccatccccatgtggagatgaaggggtgtgttgatcccccgtccccctgtggagatgaaggtgtgtgctgatccccgtccccctgtggagatgaaggggtgtgctgatcccccatgccctgtggagatggaggtgtgtgctgatccctcgtgcccctgtggaga

SEQ ID NO: 7051 - DNA, 1050 bp, Homo sapiens
tcattaccctgaatcaatgctaacacagtgccacttgagttcacattaagttagaaattgagaatctaaaggtacctttattttaactaaaaaataatttatatactgtatattgattgtgacacaatttacaaagtctgaggtgtggaacagttatttaagcattagtcaaccctggtccttaagacagttctagtaaaatgggattgtatatatttgttcaactattttgaccaaaaagttcaataaattttaaatgtttaactggattttcactgcgtatttggacacccttttccatcttcctctagaatgtatttcccactaaatagcccacctcctccacccccagggcagagcagaaggtgcagcccaggcgggtcccgtgtgtagaggttccacgtggcactgctgctcccgtggaactgccactgccttgaggtctgcggcgcacgttccctggaggtgtcgtcacctagctctggggcgcctgcgggggaagccacctggccagcagtcctgtccgtttctgtgggttctccccagtgcagtcttgatgttctgagaggcgctggcaattccacgcacctatgtccgcaaaaagcaggatccattcactttagagaagtgccctcaacaggcgcggaggaagacgtgccctcaacaggtgcggagaaaacttctctttcctgcttaaagtagaacagtgtcatcagcttctgaaggttaatgctgagcacagttttcattgatgaggattctgggcccgtggttcaggtggaggtttgctgctctctgggctgatgacccggattccatgaacacactttcttcgtaagtggatttaacgtgccttttttgaaagaaaaatggagctcctatgaaccagtttatgatgccctcgtggacagactcagtctgattttggaggccacacgactggcaggtgtggctggagactgcagcatgtgcgtgtctgtctgtcctgtgtggagccaaatcatcaccatcagtgccagaagcctcccaaagcccagtgccatgggattg

SEQ ID NO: 7052 - DNA, 1043 bp, Homo sapiens
tttatatcagaatcacttaatgttaattttataaacttaatgattaaaatgagtgttatgggcagttatttgtattaaccactgtagaaaagaagggttatttacagaagctattcagaaggcacactgccattatcctacctcaaagataaaaacattcagatacgcacacacatcaaacttgtttcatttttaataaaatgtctaatgttacaatctaacgaaaaacacctccagaaaacttgattcttggtctcccatctgtctaaagcactccagtcccagagttgttttttctgaaacagggtcttgctcttgctcaggccgtgtgcactatcctggctcactgcagccttgaactcctgggctcaagggatcctcctgcctcagtctaccaagtagctggggctacaggtgtgtgccaccacacgaggctaatttttgtattttgtgtagagacagggtcttgctatgctcccccaggctggtctcgaacttctggacttgtgatcctcctacctcagcctcccaaagtgttgagattacaggtgtggagccatcacactggcccagtcccagagcttagtacctccaactggttgtttttttttttttttttgagatggagtctcgttctccctcccaggctggagtgcagtggcatgatctccactcactgcaacctctgccttctgggttccagcggttctcctgcctcagcctcccaagtagctgggattacaggcacgtgccactgcgcccagctaatttttgcatttttattagagacggggtttcatcatgttggccaggccaatcttctgacttcaggtgatccacccacctcaacctcccaaagtgctgggattacaggcgtgagccactgtgcccggccatacaggtggtttcactcagagttcagccattgtcatctgtgagggggacacgtggttggctttgttgtgtgctaactttgatggtgaccagggggttcactgagctctgtaaggtgctgaaactccactgatgtttgtgatgaaaga

SEQ ID NO: 7053 - DNA, 1032 bp, Homo sapiens
tgaaagtgactatttgggatgctggggtggaatccaggcaaatagattgaaaaagctctgggataaatgtcagaacagagggaggcagcatcccagaaaaaaaacctgaagcagaggagctgtgaacccccgagggaactagcaccccaaaaccatacaaagggcttcttccccaggggaggtgggctctaagaaattgctgttttacctttaaagcttctcaggttagtggggagagaacaaaagagacccgcctgacaaaagatttcaagtatcaagtcagctgggtaggtaaatcaggtccctggcttccaacggggctcgtttccctccaccttcctgttgcctccaggacctctggcctcctctcctccaggaccctccagggcctattgcacgcagcctcaggcatctgggctccaggtatcccactgctgcctcatgcagagaccttggcttctccttaagtgttgttgccagccttatctttcactccacctctagaacctcattgtgaccatctatgaaatgcaagtcttggacgagaatctcgatgtctgcaaccccttcaggtctcaaagcacacaatgctacaactccactccaaaataagtagaaaacatcttttcccctcatacaactttgcccatggtgagttgcctctgacaagagagagaaccatctgccagttgcagacacagcagtgggtgaagaggtgagggcttggattattaaacacggccctccagagtaaatgggcatgcactttactgaactgatgccctcctggtgaagacagtgggtccttcaaggaagtgatgcccccgccaccgtgacacggtctcgtcacagaatcctacctctcctgcatgttagcagtgacatgtctaggagaaaagggccaagttcatggctacagtgagctataatgattgtgctactgcactccagcctgggggagtaagactgggcttgtaaaaaaaaggaaaaggacaaatacgagcatcctgcgagtcaacaactttagctaga

SEQ ID NO: 7054 - DNA, 1039 bp, Homo sapiens
gaaaatgtgccctgctgatgatatttaaagaagttactttctgcagggttaaccagtgaaggctcgtacaccagaaaatgtggcctgctgatgatatttaaagaaacgggctgggcgcagtggctcacgcctgtaatcccagcactttgggaggccgaggtgggccaatcacctgaggtcgggagtttgagaccagcctggccaacatggagaaaccccatctctactaaaaatacaaaattagctgggcgtggtggtgcatacctgtaatcccagctactcgggaggcggaggcaggagaatgcttgaacctggaaggctgaggttgcagtgacccaagatggcgccattgcactccagcctgggcaacaaaagcaaaattccgtctcaaaaaacaaaaaaaaagtctgctgcaggattgcagggggcatcacaagtggtacattagtttttttttatgatttcatagacaaaaattattttttgaaatctgacaataccaactgctaaccaggatatagagaaacaagaacttgacaaatgggatctagttaaactaaagagcttctgcacagcaaaagaaactaccgtcagagtgaacaggcaacctacagaatgggagaaaaattttacaatctacctgtgcggtggctcatacttgtaatcccagtacattgggaagccaaagcaacgaccagcctgacaaagggctgatatccagaatctacaaagaacttaaacagatttacaagaaaaaaaccccatcaaaaagtgggcgaaggacatgaacagacacttctcacagtaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagtgcaaccattgtggaagtcagtgtggcgattc

SEQ ID NO: 7055 - DNA, 1026 bp, Homo sapiens
aaaaggacctgcatacttcagataaagttctttttctttcccagctagcatctcgtacagccacagtgcatttgccaaaaccaggacactaacattggtacaacatcatcacccaagccacacacctgtcctaatcccacaggttcccgtggacatcctcctcctgacccagggtccccacccccccctgcgagttggcggtgtacggagctgtgtgtccccaccctcccgtcccgccccccgcaggctggcggtgtacggagctgtgcgcccccaccgcgccacgagctttcagtgcacagaactgagtgttccccaccccacgccccgccctctgcgagctgagtgtcccctcatggagctgtgtgtccccccaccccgccacgagctttcagtgcacagaactgtgtgttccccaccccccgccccgccccccgcgagctgacggtgcatggagctggggtgcgcggagctgtgtgtgtctcctcgggctcctccggctgtggcgccgcctgtgtctttccttgtattgtgtggccttggtccttctgaagacttctcgtctgttatttcataaagggtccccagtgtgggtttagctggggttctctcgtgacgggaacgaggtcgtgcattttggtaggaatagcatggatggtgcatcctccgcgtggagcagagcaggtgtgatgttgagggcgatgttgctggaccacggggctgaggttgtgtctgctggtttctcctcggggaaggggcttccttttgggaagtccctgttcagagctttcctccgtagttaatggctctccgagcgctgctttgagactgtgcagggcctgcttcttgggcctggttcttgagtctctgctcctggccttggcaccgggtgctctcgggctcccaggcactggcctgtcgtgcttttccactccctgcgatttgctgtaaggaaaggctgttccttctccccatttgtctgtttgtttatgtcagtagggacacgtggatacttattccatgggc

SEQ ID NO: 7056 - DNA, 1028 bp, Homo sapiens
tttggacaaacaaaaagggaaggaattcatctctgttggacctgtcctataagacatgttaaacgaagttcctcaggggaaaggaaaatgatttaggtcagcaacttgggtctgcataaagaaaggaagcactttagaggaggaatgaatagaggtaaaatgaaatttttaatttttcttaattgatccaaaagataactgtttaaaataacagtagtaacaatgtaatgagcaattatagcatacagataaatgaaatgaatgacagcaatgtcatcaggaacaggaggattgcacgagaggtgccgtcacaaggcatcccactgcacatgagggggcagagtgtcaggtgaaggtagactgtatggtaaaggtatactgcaatgtccaggccaaccactaaaaatatttcaaaaagaagtataattaacaggccaggagaggagataaactagaataatataaaatgcttaattaaaaccagaaaaggcagaaaaatagggaaaaaggaagaacaataaatagactacagttacaaataaggtagatatcatattgaactatataaatgaccacttatttatttacaagacagcgtgtctctctgttacccagactggagtgcaggggcatgatcatagcttactgcagccttgaactcctgggctcaagcaatcctactgcctcagcctcctgcgtagctggtatcacaggtgtatcccaccacacccagataatttttttttgtagagacagggtctcgccatgttgcccagcctggtctcaaactcctggactcaagcaatcctctcacgtcactggaactacaggcatgcactgttatgcctgcctaatttttttgtcttttatagagctggtgataaggtttggctgtctccccaccccaatctcagcttgaattgtgactcccacaattcccgtgtgtcatgggaggaacccagtgggaggtgattgaattatgggggcgggtctttcctgtgctgttgtcatgatagtgaatgagtctc

SEQ ID NO: 7057 - DNA, 1051 bp, Homo sapiens
tctctcagcttgctgcggggctggaggccctgctcaggggtaggcggatgccccacagaccacagggtgccagggcattgggcctgtggccggcagtgccaagaggcagcctggctggcacaagggacgggcacatcggcctcagcaggggccgcgccaggacgcatggctgtgacacacttgggcacccctccgtgtgaggtcctgatggaggtgcgccgaggctgggctggcctcctgtgcaggaatagaggccgttgggccttgtcccagccggtcacctgctgttgcggtctcagggagccaacacctctgagcctgtttgttcaccgctcccagggtaacaacaggtcccgcctctgagtgagccgcactccaccccggtggtcacggccggctccagggcctgtgaatggcctgtggccgctgcccttggaggtgaccactgtgccctctcaggctggcaggagaggccgttccctgggacttctcctacacccacagggaccccatgggattagagctgaggtccggggcgggggcaggtggtggagaccaggctctggggttactgtgcctgggagcagcctcctgcttcaggtgcaggcaccggacatgcagggtcaggggcccagcaggagctgcctggccaggcttgtcctgcagctgggaatggggacccagagaaggcaatgccacccacacccccaccaccgcctgggcccaccgagcctgagaggggaaggcagctcctccccagggtgagccccagggcctcgggctggggtcctgcccctgtccaggctcaaggtcctctctctgctcccctggtctctccctcaccacccacccacccacccacccacccacacctctactgagggccaagcactccactgggcccaggctagaagggggccaaatggggagggctgtgaatcaccagttcccaaattagtgcataatcacacacaggaactgctgagaaggaagggaagaggggcttgaagcagagcatccagcgagaaacctggcctggactgggatccgg

SEQ ID NO: 7058 - DNA, 1039 bp, Homo sapiens
gagggtgggggcaagtgttctaggcaggaggagggcagggcatgttccaggggttgcggaggtggtcagggggcccggtgggccaaggcacagactctgggtgctgttggagaattacagacagaggagtgagatggtcttgttattatttgtcagttaaaaataaaatgaaactttaaaaaaatctgatagctttacaaataaaagcagtgacctccagctgtgaggacagggagagtgacgggggacggggaggctgggcggtgtgcaggtgtcgctcctggaactaggggagccacggtctgtgccccgcatcctcaggggtggctccagttctcgggaggtgcctgaggcctggctggaggcatctcaggggaaagctcagaggcgggtcaggcagagggctgggggcaaggatccgtattcatcgggggggacctgggccaggacaatgcttggcggggagctccacagactggctgcttgaggcagaggctttggagcagcagaggcaggtggagatgacaggtgactggatgtgtgcactgtgcgggagcaggaaggagggtggcggagagtgggtggcactggccagccgtgtggggaggacctgaggggctcgggaccttgcccgtcctgcacctcagcaccactgcaggggaggggggcgtgcccagaggggcggcgggctgcctggtgttttgggagccatgagggccaatggggacacctggtcctgggagccgtgagggccaacggggcacctggtcctgggagctgtgagggccgacggggcacttggtcctgcacaggcacctcctgtgcttccctgtcgtggccagggcaggccgtgctccaccgacgtgcggactggaagctgggcacctccctgaagtggggactcaatgctctcctggtgtcccggcctcttgggcaagggggagatttcacagcttccagacagtgcaggctggaggggtccagcctcctgtggccccaggggcccaaccctttcccctcctgccctggcaggggactt

SEQ ID NO: 7059 - DNA, 1034 bp, Homo sapiens
gggatggggtcagcctcgagttactaaccgggcattaggggatggggtcagcctcgagttactaaccgggcattaggggatggggtcaggctcgagttactaaccaggcagtagaagatggggtcagtcttgagttattagtatttatcggggagagcagagagagcttaggagaccacattgccactgtttagggtcagagtggtcccgcaggttaattcacttcacccagcctctcagggatgtaatgaggctgctcggggggctgtctcaggcctctggccagtagtccctgtcctctccagcgaccgctctctcctgggtgtcagtggtttttgggagtccaggtgcaggtctcagcagcaactctgaggttctgcatagctagtgccacctgtgacactgctgtcactccaaggtgcacctcaccacacctggagcagcgcccgtgagaggagggaagcgacacccttgggctgagcttttccgtgaaccggcagctgtgtcccttgacgtgctgagagggcctggctgtgagccgcatggtacgaaccttctgaatgcaagtggccaagccggcattctggctgggctcgctggccacaggacgtccactgtaggacagctgggagtgggggtgtctggctatttcactattaaaacaagtggaaacactagtttggtcccgcctgacctcatggaagacggtggaggtggcagccgccagagtgtgaggggccatggtcgctgacctcgcctcctgttgtcttagatccttggcactgcaggggcggttctgccagacatagctgttgtctctttggccaccaactggcccctatggcgtttggccttcagggtggtcattgggtgcgtggctctctagggtggacctggccatccttgggtgacagtgggccatgtggtggggactctgcaggccacctggaaaggggtccacctgaaaggggctgcactgtggtccatttgggccagtggcttcagtagccacacgctgcttggtccaggttcct

SEQ ID NO: 7060 - DNA, 1035 bp, Homo sapiens
ttattttttgtagagacggggtctcagtatgttgcccaggctggtctcgaactcctgagtgcaagcgattctctgcctcagcctcccaaagtgctgggattacaggcgtgagccacctcgctgggtccccactgttttttttaattaaatttttagtagagatggggtttcgccatattggccaggctggtctcgaactcctgacctcaggtgatccactcgcctcagcctcccaaagtgctgtgattacaggtgtgagccaccgcactgggcccccactgtttttttttaattgaatttttagtagagatggggtttcaccatattggccaggctggtctcaaactcctgacctcaggtgatccactcacctcggcctcccaaagtgctgggattacaggtgtgagccaccgcactgggcccccactgttttttttaaattgcatttttagtagagatggggtttcaccatattggccaggctggtctcgaactcctgacctcaggtgatccactcacctcagtctcccaaagtgctgagattacaggcgtgagccaccgcgctgggcccccactgttttttttaattgaatttttagtagagacggggtttcgccttattggccaggctggtctcaaactcctgacctcaggtgatccactcgcctcagcctcccaaagtgctgggattacaggtgtgagcctgcgctctgctgatattttcttgttggtgactgcacgtttgccttgagctgtgagctctcatagaaccagatgaccatttgggctcactgttaactgtagcccttctgtggatgccccgtgggcaccttcgtatccatcagtttcatctctggccctgggaagcgggaggagttcgggtggagctggagggttttccttccgacgaggtatgtggagtccctctgcgatcctgtctggggaggggagaaaggggtggcaaggcttctctagctgtcactgggtccttgaacccccgctggcctggtgctgctgctggtgctgaccacacac

SEQ ID NO: 7061 - DNA, 1049 bp, Homo sapiens
gagtccccgcggaccctcaggggccagctgtgcctttgcattggccacagcgaggaagggggccagggcatgcagtttctgcagggccacgtctgcaggtggccatgtgggctgctcgcgccggtgggggcttgtgtgaggtgtgatttattttgtgttcaatccatttttttagagtataagtgtcttccatgtctatgtgctcattgtaaatctttactttgataacatatacctaatacttgttattttaaccactggtaactgtgtagttcactgccgtcctcacctacattgtggtgtttgttggtgagtgtgtagctcactgcctttcttacccacattgcggtgtttgttggtgagtgtctggctcactgcctttcttacctacattccagtgtttgttggtgagtgtgtagttcagtgccttccttacctacattggggtgtttgtcactggcaccctgtctatctccacgtcatgttttatccaataaatttgtttttgattcctccctcttctttccttccgtggacgccctgtgtaactttctttattgaggtgccttctgtaatatttttctgcagtattctaattgtaattctcttataaatgatgctattatgaacttctttgttgacagagcatttttgctctttagaattacttttttaaggactgactcccagaaatagagttccacatttgaaagtaatgagttttttttttttaacatttcccatattttcatagtttttgtattgttctttgagaccaagagaagaatttttgggtgtttaagagaaaaagaaggcatgtgctttctttcatatggtggctgaacacacgcagagctgcttggcctgtgggctgaaatttgagcatttctttaagacctagtttgtttattttttactctcacttcagtggttttaaaaataactacattaaccaaacgtggctgtacctccgaggacttcttgccagagctgctcctgggaaagggttcagtctctctagtttgtgcccatcacccagtgggacagct

SEQ ID NO: 7062 - DNA, 1030 bp, Homo sapiens
tcaagggccatctcacttgtttgggcatccagtgccagttgatcaatgtccttgtccctgagatggtcacacagctgtcatgcgtggtccccaccagtagtggagtctgtacaatcccgggaatcccccgttcggtctccgaccctcgccctgtcaagcagctgcccacacacaagcggcctctcctcacgctctgtggggcacacggggaccacggggcccccactcacaccagagccaaggccctcacccctgtgctcaggatgtagctcctcctgtcagccttcctccctctcccccttggtccctcctccctctcccccttggtccctcctccctaccagcttctttctctcagctctgccatcctttccataaaatggcagcttccttgaccctctcactctcctctgccatgacccaacgtaatgtgtttcccaagtaggggcttattcagatgaaaaagaaaaacaccactgggggagcagcaaattagacattgcagaagaaaagagaaggtgactgaacttgaagacagccacaaaattaaagtgaaacagagagaaggactgaaaagtggatagaaatcactgtgaaataccaggtgtcctaacacgtgtggctgcagccccaggaggagcggggaaaggaggcagacagggtgatgcttacagatgtcatggctcagatttcttcatcagtccatgaaacttacagaaagatccaaatactgcaacaagcttcaagccgaataaacataccaacgcaggccaaggtccgattgctgaaagcaagttacatgaaggcccttccttgccacccatcatcctcggaagagtggggctctgctccccgtctctgcgtgctgccctgccatgggagcctcatctgtgccagtcgccagctacctcttcctcatggggaccatcgctcagctctttccagcttcctttagatataaagacacaggtattttaaaagtgaagggacggaggaggatgtaccttgtaaaacagtcgttagaagaaag

SEQ ID NO: 7063 - DNA, 1029 bp, Homo sapiens
agctggaggagctatattaatttatagcatcaaatacatatattagaaaagcagaaagatctgaaatcaattatctaagcttgtaccttaggaaactagaagaaaagtaaattaaaccaaaagctggttgtttgaaaaaaacaataaaatggataaacctctagccagactaagaaaaaaaatgacacaaattattcatgtcagaaattatcagaataggcagagcagacttcagagctaggaaagttttcagcagtaaagagggacattacatcatgatgaaaagatcagatctccaagaatacataacaatccttagtatctagctgcctaacaacagagtgtcaaatacacaaggcaaaccaagtagagctgccaagagaaacagatgaacccactatcatagttagagacttcaacaccctgtatcaggaatgaacagatctggcaagcataaaatcaggaaagacatagtttaactcaacagcaccatcaaacaaattgatctaattgacacttataggatacctcatccagtaacagcagaatctacgtttttgtcaagctcgcctggaacattcactgagacatcacattctgggccataaaacacacctttacaaatttaaaagaacagaaaccatatacagcatgctcatagattacaatggaattaaaccagaaatcagcaccagaaaagtagctggaaaatccccaaatacttgaacattaaacaacacatatctaaataacatatgagtcaaagaagtctcaagagaaatttaaaaatattttgaaccaaatgaaaacgtaaatacagcttaacattcatgggatattagcaaaagtaatgtttagaggtaaatttatagcatcaaatgcatataagaaagagctaaaaagaaaaaagtgctaagaagaaaggaagaaagagctaaaatcaattatctaagcttctaccttaggaagctaggagaagaaaagaaaattccaaagtaagcagaagaaaagaaataatgaaaattggaa

SEQ ID NO: 7064 - DNA, 1054 bp, Homo sapiens
gtgaggtgtttatgattattaagagaaacttttaagcgattaactaaaatattctcagtagttttagtaattttatactgtcgatgtttttgcttatgtaaagttgtttgatcagagaatgtggtctctaccatagcagagaaacaaaccaactttaatagattcccaattgtacacaacttaggcctttaaaaatacagtgccaaaggtttcagctacggtcgctttcaggggttaaaaaataaaaaaggaaagaaggaaaaaaaccaactcctagcaagttaggtgtcctggttggatgaatgtctcacggccagtttgcttcccacactgcactagctcctccttgggggaaaaaaaactagccccattcgagtctgatattttttagggccccagtgagactgccgatgacgctctcccgccacctgccctgtcaccgtggggcctcccacggtgtcccaggccccagcagcctcgcgcccggttcccactgctgtgttagggaagcgcccgctgttggaaatgtaattcggaacgttcaacccgtgactctccctaagtctttaatctgcggtgtcgtgaggtcgcagttgtcctggagacacgctgacgagccccccagccgtcgcggtggagcagctgctgggacgatgaggcagcccctcctcccagtgcctccgccgcgtaatgagaccacttgtcaaaacagagagagacacccattttcaaggcctaaaaaattgatttttatggctcttcttgtaattctctttttgaattaggcacatgatattgatgtgggcctacgttttaatcataatagctactgacaaggtaattaattttagaacaactgtttttttttctcctgctccaaatggcactatattgaaattgaaagtgagctctgggagggcagcggggctggcactcaggtgattgcctcggccgtgacagccccttcgtcttgcggccgccgtgcaccctttagaggcagctgctgttattaatgggctcaagctgttctgtcagcagagcagggcgaggaagt

SEQ ID NO: 7065 - DNA, 1047 bp, Homo sapiens
aagtggatttctcaaaggaacagtaagcaggaacgtggcagagctcctgcgggcctggctgacccaggtggcgtcttgaagtcccagccgcgttggcgtgtcctgctgtgagcctgaccgcaagctgcctcccctctgcccctgcagcggctgccaggacatgaggctaacaagcaccgagggcagcccaggaacccgatttttcacttcatttcattttaattcagatctgataattcagatctgatagagccgcgtggctattccatgggacagtacagaccaggtgactttcaaccagtgcaggggctaccacgggggaggaacattcccgtggacttgctgtccagccagcttgggctcagctgctccccagtgcatccctgttctcggaaccacagccctgaggtgggccctgggtggggtctccacgctgcctggcagacgtggcggtcattcacatgggatggcgtggtcagccctgcacaatcccagggaagagtcaggcctgggttccccccggtgagaggtcagagaacagagaaggcggccctggaggtgaccgcacccctcccgcatatcaggcacccctcctgcgtatcaggtgtccctcctgcgcatcaggcgccccctcccacttaccaggcatccctgggagtgactgcgtgcctcctgcatatcagatgcccctgggagtcactgcgtccctgccctgtatcagacgcccctggaagtgactgcgtccctcctgcgtatcagacgcccctgggagtgaccgcgtccctgccccatatcaggcggccctgggagtgaccgcatccctcctgcgtatcagacgaccctgggagtgaccgcacccctgcctcgtatcagacgcaggtgttttcagcagcaggttttcttcgctggtgccgtttgttggtgtcagacatgaggaggggaccaaggaagggcacgcaggaggtggtggctgagcctccgttgcatctgctgggagtgggggctctccagccccgcgatcagcttgggagggagctggtctctggt

SEQ ID NO: 7066 - DNA, 1050 bp, Homo sapiens
cactgccctcgccacgtgcccagcgtgctctggatggtgaggcaggccagtggcagcctctctgccctccctgccagctcctcagccacagggacgcccttccctgagggtggaggtcagggcggtgagggcctgcagagggcacgtgagctaagccgtgctgctcggttcactcacttgttattctagagtcttggtgtaaaatagcaatggcaacaacagaagcactgatttaaatcattaaatttattttttaatttttctgtttagaaagagattttatttggtctgtttctatatagggcctatgacatcaactgaaaataaaataaaatgttatacttaattatagtgatgacattaggcttcgtatttaggggattttttctaggaagttcactttgcaaatattacccaatattttcaactggtatattgatgccaagaatcttctcattttatagaaaaagaagacaaaaaacaaaagacgcttggcattttctctggtctatgctgggactctgttcgaggaactgttttttggactcactcctaaatgattcataatccgtagtgtgttcactaatctttaatgcacttttctatattttttatgagctcatactttatttaaaaattcctctgactgcccttggtttaaaagaaacccatgggaaaggtagggcacagagcaggtctctcgtgccaaggcagggggttgctggagaccccggacactgtgtagcctcattcgtcctcctccttcacacatcgcacccggctcccttactagcaatcagtggctctgacaagcatacaggggaccctgggacgagggctgagctctgtgtcctgcgtccccctccctttgccacatccccctccccacgtccagccgtgccagtggaaggctggggatgtccgggaggagccacccagaggcacagcaggtgcttctgccgccgggcagggccagtcctgtggagccacccctgggcccagcagagggtgcccggcatggtgctagacacagcctgagaaagagacccg

SEQ ID NO: 7067 - DNA, 1015 bp, Homo sapiens
tgtcagcgtgtgtgcgtggatatgtgtgtgagcaggcatatgcatgtgagcctgtaggagtatgcatgagtgtgcgtgcatatgcatgtgaatgggcaagtgtgtgtataagcaggcatgtgtgcggacgtgtgtgagcaggcatatgcatgtgagcctgtgtgagtatgcgtgtgtgtgatcgtatgcatgtgtgtgatcatatgcgtgtgtgtgatcatatgtgcatatgcatgtgagcaggcaagtgtgtgagctggcgtgtgagcaggtgtgtcagcatgtgtgagcaagcatatgcatatgagcgtgtgtgagcatgtgtgagagcaggcatatgcacatgagcgggtgtgtgcatgtgtgagcaggcgtgtacatgcatgagcaggtgtgagcaggtgtgtgcatgtgagccttcatgagcgtgtgtgtgagcgtgtatgcatatgcatttgagtgggcgagtgtgtgagctgtgtgagcgtgtgtgtgagcagacatgcatatgagtgggagtgtgcgtgagagcaggtgtgagcgagtgtgtgtgagcaggcatatgcatatgagtgggtgtgtgcatgagagcaggtgtgagcgagtgtgtgtgagcaggcatacgcatatgagtgggtgtgtgcatgagagcaggtgtgagcgagtgtgtgagcaggcatatgcatatgagtgggtgtgtgcatgagagcaggtgtgagcgagtgtgtgtgagcaggcatatgcatatgagtgagtgggtgtgtgtgtgtgtgtgagcaggcgtgtgcatgcatgagcgtgagcaggtgtgtgcatgtgagtgggtgtgtgtggggggtggtttgctttttagttagaaagtttaggcagaccctagcggcagccgctgaggcctgagggaggtcctggccacccaggagcaggtgctgaccccagaggaggctccaggggcctgacacggctctgcaggtctctcttggagactgaggaagactggggagtgttcagtggtgac

SEQ ID NO: 7068 - DNA, 1218 bp, Homo sapiens
cacgcctgcgaggggcgatggtccttctgggctccagagctccctgagtgctccatgagagctgtgggcccgctgtgagcagagccctcattgcaagaggccatctgtgcccctgcactttggtgctgtccaggactgcgtcccccacagctgtgaaagctctggggtcactgcagaaggttggaggaatgctgatccgggacaacttcattaaggacgtggcatcggagggccccacacagcagagctgtcattctggctcacctgagcgggagctttgctgaggactctcctttcctctgtgcccatctctggtacggggtgactgtggcgcagcgtgtgcttcctcatgacgcccgggcccctctctcccatggcccaggtcaaggcaggaggacgctcggtttcccatctgcacagctgggcctgtccttcctgggcggtcctttgtccactgtcttcctgaggggagtttgaggagaagccccaggtctaactctgtggcagacaggcccaccgccctgcatctcgggacacagcaggcagtgtttccactgtaaacgcggggagagggacccactttcagagaaagaatttggcatctggtgagagcatctcgtttccagggggaatttcagaaagagtttgcatccgcataatataaatacacacttggcaaaagcaaaacacaaagccaggctctttggattcttagactaaaaatgtgctgggaccgccaggcttcgtgccacgtctggttcgacctcgactccctggtgtgctctgcagaggtcatggcgtcttcgggtgccacatgcccgtctctgggtggcacgggcccctgagacttctatgaacttgcatctccagcttttcaagttttactggagtgtcattgaggcagtaacttgatgtgagaaagaaagcaaatgcctagattgtctggagaccacacgctgggaacaggaaaggcactgcagtgcactgtgggggcatgtgttcatttgacagcactctgggtgcctgctctgagccaggccctgctctgggttaacaagacagacagacacatccctgccatggagctctgggggtggcaggggacagcatggtggggaggagcctgggaatagtgtgctcagcaggtgagcagcacctgtgggggaggagcctgggggtgccacgaggaagcttgctgaggatggcatggctggtggg

SEQ ID NO: 7069 - DNA, 1068 bp, Homo sapiens
ccctgaccctcagcgttcccagggtgcccatgtgcccagtggcattccagaaagatctgtggaccccgaccctcagcgttcccagggtgcccacgcgcccagtggcattccagaaagatccgtggaccccgaccctcagcgttcccagggtgcccacgcgcccagttgcattccagaaagatccatggaccccgaccctcagcgttcccaggtgctcacgcgcccagtggcattccagaaagatccatggaccccgaccctcagtgttcccaggtgctcacacaggcctggcttcctcttcggcatttggctgggtgagatcagcttccgctttcccgctgcgtctgccctggcggggggtcccgagtgcctctgcgtgccaggctcgtccacctgccgcctcacactcttccccgtgcagctctgcccctgtcaggacacgttggccttcctgtgctttcctgaaggctgccagggctctgaggccgtgggaaggcgtccttgccacggcctggcccctgaggcctgtgtctgacccagctcctcagaagctgggagccgagccgccatctgtacctgctggtctggcagcgtctccttcctgcggtgactcccggttttcagaatcgtttcatggtttttgctgttgttgtttgagtgaacgcattgcaaaccggccgagcagccaagtacatcttcccatcactgccacagtccccgccctggttttgggcagaggtgagctcaccaccttggagtggttcaaggcaccttatcagcattggtgggcaggaccctcccgcgggcagtagaccctccatggggagagcccgcacctgctgaccctgagaggagacagcattcctagcgcagagctccggatacagccgcacccggggcgttggtgcgtacactggcagagtgacgccaggaaatgtgtcattggcggatggttctgaagaccagcggggtcttctcctgcaaaggtgtttgccactgatcccatggatgaatagaactctgctctgaatgaattgtaactgaatgctgtctgtcattttgccagaa

SEQ ID NO: 7070 - DNA, 1089 bp, Homo sapiens
atggacatggggtagcaggaagtctcagccccagagggcttggcaggagccgccctctctgcggagttcttcccagcgggtgtgcgttggtggctggcggggaccccccacaggaactaggtctcaggctgtggaaagggagctgccccagggcccaggagggccggctctgcattccgcatgttcccagagtgaaagagaatgagaaggagacacacaagtgctgttatgacctgggttgttggttggcaaatacagcatctaatagaaactttcttccatcccagaataccctctaccatctgctttggtcagggtgccgctcgaggatttaaaagcaacaagaagaaaaccaaacaatgctgatagactcagaaaaggagtggggggcagtcaccactgctgggcgtggcatccgccttgggcctttctccgaccttctggtgtggccgccctgggggccaggccctcgccatcctccccatccttgttcctcagcaaatggcattagcagctgtcatcagaagctgtgagggacccacagattttggaaacgacctggacacactattgggaaggagatgtggacggcctgtctcctcctgcagggcccaccctaagaatgtatttttaaacacatgaaataagtatttttcactgatggtcttgagtcttcatttctgtgttgagtcaggtgcggagtggttattgttacccatgggtattctgttttccaccctcagttttcaggaagatttataaagtcctggcacccctcagaggtgggtgatggggtaggatacagcactccacctcgtcccggacctcctggctttgggagccacacccagttgtccttgccacaccacttagggagtagacctggtgggggtaggatctgatgcccacagggaggggcactggctctgggggcatggggtgcttgggggtgtgtgggatgctgggggagtggggggtgctgccccagagggtgcaggatccatcactagtgccagcggggaccacagagcctgcatcaggaaatgcaggccaggagattggggctggcattggattgcagagatacac

SEQ ID NO: 7071 - DNA, 1125 bp, Homo sapiens
tctctttatctctttgtcttgtgtctttatttcttacaatctctcgtctccgcacatggggagaacacctgctaagccccttaggactggaccctacagtgatctgcccaccttggcctcccaaagtgctgggatgacaggcgtgagccattgcgcccagccgagaattgattgttaaagagtctggtatggccaggtgcaatggctcacacctgtcatcccagcactttgggaggccaaggcaggtggatcacttgagttcaagaccagcctgggcaacgtttcaaaaccctgtctctacaaaagagatgatatggtcaatgtctgtaaccccagctactcaggaggctgagatgggaggatcacttgagcccaagaggtggaggctgcagcaagctgtgattgtgccactgcactccagcctgggcaacagagcataccctgtctcaaaaaaagaaaaagaacctagcacctccctccatccttctcctgcttcctctctggccctgtggtctctgcacaccaggcctgcttccccatccagcatacgtggacacagcctgaggccccaccaaaagcagatgctgatgctgtgcttcttgtacagcctccagaactgtgagccaaataaacctccttttttttacagcaacactaaagggattagggcatcagccactgggcaatctcagtaaagggtgcatgggagttctttacatgatcacagttgttctccaaatttgaaattatctcgaaatgttaaaaaaaaaaatacagactgggcgtggtggctcacgcctgtaatcccagtactttgggaggctgacgtggatggatcatgaagtcaggagattgagaccatcctggctatcatggtgaaaccccatctctactaaaaatacaaaaacttagctgggcgcgatggcgggcgcctgtagtcccagctactcaggaggctgaggcaggagaatggtgtgaactcgggaggcggagcttgcagtgagccgagaccgtgccactgcactccagcctgggtgacagagcgagactccatctcaaaaaaataataataataaggccgggcgcggtggctcacatctgtaatcccagcactttgggaggccg

SEQ ID NO: 7072 - DNA, 1050 bp, Homo sapiens
cacttatactcaggatatgcttaagggagaacgatgatttttaatatttaatgaatgttaataaatctgcgaattacttaaacccacaaaacccaggaacctccccgtccccccgggtctcctcgcagtcccgccccgacgctcgacccaccattcgtccctccctctgggcccgggccccgcccactccgggcttcgccggaggcggaggcaacgtcgtgcgcacgcgcaggccgtggtgcggccccttggagcgccggaagcccgcagtgccggaggcccgcagcgccggaacctcagaggcgggtcgcagcggcgcagaggaggtcagctgcgggagcgtttccggggacggtgccgccatgagattgaccccgcgcgcgctgtgcagcgccgcccaggccgcctggcgggagaacttccccctgtgcggtcgcgacgtggcgcgctggttcccgggccacatggccaagggtgaggcacggcggggaggggcaaggtcatgcctacggccgcggcgcctctgcttccctcccaccccggtttcggccgtcgcctgcttctcccggtcgttctgggctggccccgcccctcctcccttgtctcccctccttccccgctctcacccgctcccggagccgccgggaccccttcccctgcgcagctgcgggagaggcccgttcccgcgagtgcccccgcggcgcagcctcggacccagggcctgcttgacctcctacctctggcccgccgcccctgtcctctgttcccagcaagttccttctgcccttttaatcccccgaagcctccgtttccacatgttcttgacaagatagacttttctgagtcttttggggactaaatgaaacagtgggtatgaaggcacctgttcagttttaactggtatcttgagtcgttctcctgcttaacgtctttggtaattcttactgtttgtcacaattcggccccaagaagacctctggggccagcccagcccgtctaggtgttgtgatggccactcctgcgtcggctccgcgtgtactgggggccgag

SEQ ID NO: 7073 - DNA, 1033 bp, Homo sapiens
tatagtctttttaggttatttatggtggcgtgtcattctggacggttcagcttgaatcgatcactctagaaaggttgtgagccccttcgctgaggcgtccttctgttttccagggctgaagaagatgcagagcagcctgaagctggtggactgtatcatcgaggtccacgatgcccggatatcctttcacagagcaggggaggcccctctgcctgaagtcatattacacattagaattacctggggaggcttttaaaaatatgaattgcgaggcccctttctagaccagttaatcagaatctgtgatgtggggtccagactgcgtgtctttgaaacttcattgttaatacatatatctgcgtcactcaagcctgacggtacggtgcagcagtggaatcctctagatgggctatgaaactgtttaaatgttcctgccaactggggcttttctcctgtacttgaggaatgaattggcaggatgtgatgattcgttcactgatggcaagaaaaaaagttggttggctggtaaagctttggaggaatttttaccttaattttgccacatcccactttcaggccgcaaccctctgtttcaggaaacccttgggcttaagcctcacttgctggtcctcaacaagatggacttggcggatcttacagagcagcaggtaaaggcctttctctcagacgccttcagcagtgtggctgtgttttcccgaggtcgcttgttctaacggaagagttgccggacgcacacttgtcagtttgcccaggcaggctctgctttagaaacagccctttgctttgcagaagcgtgccagcatcgtttctcatatggcgtgcccccatctaatgtgtggttcgtgacctggacacccagggagtgcacgtctcctgtgggaagtggccaggttgtgctgccagagcccgagtggtcagtgagtgcgcattgtgggcagcaagccacccaggtgccgaggcaagagaccgaggacacgagcttttccagtgtaataaaacatatgaaataaga

SEQ ID NO: 7074 - DNA, 1651 bp, Homo sapiens
tgggatgggccagcccctcctgcctggcctctccaaggagaaggcgcagcgccccaggcagggaggcccctcctttgtcctctcattctcttcagtggaaagggccgaggccgtccccgctgggtgggcagagcctcggcgttaacctcccttcttccctgagctgacctggcctggggtccccttgcctgggtggggttgcagagtctcaggctctagcggccacggtgggccctgtgacccctctctctgcctgcgcagaacctggagtactgtatcatggtcattggggtccccaacgtgggcaagtcctccctcatcaactccctccggaggcagcacctcaggaaaggtactggcgcgtgcggctgatcacctcaggaaaggtactggcgcgtgtggctgatgtgctgatgccaccatctttcttggaggggacgtgcccgaggagcactgccagtcttctgctgaccccgcagccccagagcacatcttgtctcgttcagtccagttcacaggagggctgaacagtgggaccaggtcgttctgtgaatttcacacttaatttttctctcttttaaaatctttaacatgaagatggcttttctaaactttgatatttgttcatttatttaaatccctttggccgggtgcatggctcacgcctgtaatcccagcactttgagaggccgaggcgggcggatcatgaggtcaggagattgagaccattcttgctgaaacggtgaaaccccgtctctactaaaaatacgaaaaattaggtgggtgtggtggcgggcacctgtagtcccagccacttaggaggctgaggcaggagaatggcgtgaacccgggaggcggagcttgcagtgagttgagattgtgccactgcgttccagcctgggcgacagagcgagactccgtctcaaaaaaaaaaagaaaagaaaagaaaaaaaatccctttgatccagagaatacaaagcgtgtgaagtagacggggctggattatcaggcagggaggctgcaaggccattcctccatggcgtccgccttgcctttgctggagggttcctggactccggagtcgcaggcgctcctttcctccctctgtgcctgttctcagactctgattcaaagcaggagccccgagcacccttcactgccccgtgggctcttttccttaagtattttcaagtttaattcaagtccttgttggcttcatttttcatattaataaggcatttattaacaaacccattcatgatgtgcaaatctgaaggctttaaactacggtgaactgttattttacagagagggtgtttttggtgctaattggagcattgttacagtcatttattcttttaagtttatttttaagcgtattattttttatcagtggtattaagtgcatttatagggttatgcagccagcaccactattttcaaatattttggttacctgaaaatgaaactctgtaaatacaaagagtcactcccccagcctcctacacccctcgttccactttctgtctgtgaattcgatgactgtaactgcctcctccaagtggactcacagtacttggccttttgtgactggctgatgtcaccgatcgtgatgtcctcaaggttcgtctgtgttgtcctgagtgtcaga

SEQ ID NO: 7075 - DNA, 1050 bp, Homo sapiens
cgagcgttcccgtcacccccagtccctgctcctccttcgtgaaatcaaggaaatgagcgttcccgtcacccccagtccctgctcctccttcgtgaaatcaaggaaatgagcgttcccgtcacccccagtccctgtgctccttcgtgatcacaccttcctgcccctccctgagcccaggcagccgtctactgtccctgtaggttgctttgggttttctagaattccacgtagatggaatcacacaggatgtgcattcttgttgatctgtcactcggcacgattgttgtgtgatccccgtgtgtcgtcgtgtgttgtccgtcattcatcctttttgttgccaggcggtttcagtgtccaggtgcgctgcagtctgtcccttcacccgttgatggatatgtgggttgtttgcaggttttggctattgcagataaagctgctgtgaacattcatgtaccgacaggtctttgtgtagatccgggctttcgtttcccttgggttaatacctaggagtagagtggctggatcataggggaggcatatgtttgagtttttaagaaaccgccacattgttttccaaggtagttacactgttttatatgctggcaagcagggaatgagtccttcagtttctctaagatcagtctttaactttggcctgtctgatgggcgggcgtgtaggggtgtcgcatagcatttcaatttgcatttccctgatgacagggacgttgagcatcttcatgtgcttatttgtcatccctctctggggaaatgtctgttcaaatccttttccctttttttttttttaactgagttgtttctttccttattgctaagttttaatcttttttttttttttttttttgagacagggtctcagttacccaggctgaagtgcagtggtacagtctcagctcactgcagcctgacctcctgggctcaagcgatcctcccacttcagcctcccaagtagctgagactacaggcgtgtgccaccacacatagctgatttttgtattttttgtagagacagggtttccccatgttgcccag

SEQ ID NO: 7076 - DNA, 2016 bp, Homo sapiens
ccactcttctttgtcaaaattgctttgtcttttcctggttctttgtattctcatgcatttttcagtcactttgtcagtttctacaaaaatccctatgtttcttgaggccgggtggcagattcccctgaatttataggtcagtctggggaagaattgacaatattgtaacactgagtctctgacccgtgaatatagtgtatctcttcatttatttaggtctttagtttttctttgcagtgttttgtagtttacagtgttttgtaagatttatattgaactcttttttaaacttttaatgctaagatttatcttttgatacaaagtagatgttttcagggtacctatgatattttgatgcattcatacaatgtgtaatgatcagatcagggtaattgggatatccatcatcccaaacatttatcttcatgctggaaacatttgaattgctctcttctggtatttgaaatatcctgtagattcctgttaactgaagtcactctaccgaactattcattaatcaacctctgtccatcccctcttcccctcacctctggtaatcaccagtctgctctctgtcttaatgaagtccacgtttttagctcccacatttgagttagaacatgcattatttgtctttctgtgcctgtttatttcacttaacagaatgatctccagttctgtttgtattactgcaaatgacaagatttcgtcctttgttatggctaatatttcattgtgttttatgtaccacattttctgtatccatcatcctttgatggacacttaggtagattgcatatcttggctattgtgagtagtgctgccgtgagcatgggagtgcagtatttcttcagtatattgatttccattcttttgggtctatacccagtagtgggattgctggatcctatggcagttctatttgtagtgttttgaagaacctccatactgttttccatagtagctgtactaacttacattcccaccaacagtgtacgacagctcccctttctctacatcctcaacagcatctgctattctctgtgttttttaataaaagccattttaactagggtgagatgaaatctcattgtggttttgatttgcatttctctggtgattagtcatgttgagcattttttcatacacttgttggccatttgtatgtcttcttttgagaaataattattcagatcttctgtccatttttaaatagttatgtggttttttttgctgttgagttgaattgcttatataatctggttattaattccttgttgagtagtttgcagatattttctcctattctgtagattatcttgtcagtgctttgatagtttcgtttcttgcttcgggtcttgccgtgccgtccaggctgagtgcagtggtgcgatcacagctcactgcagcctcgaactcttgggctcaagagatcctcctgcctcagcctcccaagtagctgggattataggcacgtaccaccatgcctggcttgctgattgtttcctttgctgtgcagaagcttttcagcttgatgtaaatttttttacatttgcctattattattattattatttttgcttttgttgcctgtgcttttgaggtcttatacaaaaaaaatctggcccagaccaatttccagaagcgtttcccttacgttttcttctagcagttttgaagtttcaggtcttagatttaagtcttttttttttttttttttgagaaggagtctcactgtgtcacccaggctggagtgcagtggcacgatctcggctcgctgcaacccctgcttcctgggttcaagcagttctctgcctcagcctcccaagtagctgggactacaggtgcccgccaccatacctggctaagttttgtatttttagtagagatggggtttcaccatcttggccaggctggtcttgaactcctgacctcgtgatccacctgccttggcctgtaatagccaccgcacccggccagatttaagtctttaatcccttttgatttggttttgta

SEQ ID NO: 7077 - DNA, 1225 bp, Homo sapiens
ctgtttttccttgttcaatatactgttggctgtgggcttgtcatgcgtggcctttattgttttgaggtgtgttccttctatactcagtttgctgagagcttttatcgtgaagcgatgctgaattttattgaatgctttttcagcatttgttgaaatgattgttttttttccttggttctgtttaatgttatatgtttattgatgtgcatatgttaaaccatccttgcaaccttgagacacatcccacttgatcgtggtgaatgatctttgtaacatgttgttgaatttgggttgctggtcatttgttgaggatttctgcatctgtgttcatcagggatattggcctgtcgttttctttttctgccgtatccttgtctggtttttgtaggaggataatgccatatacagtgactttggaagtgttccccccttcagtttttttgaatagtttgagtacagttgatactagttcttccttaactgttgatagttcagcagtgaagccatcaggacctgggattttctttgatgaaagacgttttattactgctttgatcttgttacttattatcgatctgttcaagtttttccatttcttcatggctcagtcttgcagggtgtttgtatccaggaattcatccctttcgtctgggttttccagttcgttgctgtgtagttgttcgtagtagtccctaatgatcccttgtatttctgtggtattggttgtaatgtctccttttttgtttactgattttatttattttgatctttttaaaattctagctaaatgtttgtggattttgtttatgtttttgaaataattttttgtttcattgatctttggtattttttttttcaactcaatttcatttatttctgctctggtctcctgatctctgttatttctcttcttctactaattttggatttggtttgctctcacttttctggtgccttgaggttcatggttaggttatttggagtcttctgctttttttagcgtaggtgtttgttgctataaacttccgtcttagcaacacttttgctgaatcccatagactttgatatatggtgtttccatttccgtttgtttgaagaaatttaaaatttttcttattaatttctttattaacccattgatcattcaggagcgtgttgtttaatttccatgtgtttgtgtagtttttgaggttcctcttgttactgctttcttgttttatttcat

SEQ ID NO: 7078 - DNA, 1370 bp, Homo sapiens
cacaccacattcacagtattattctgagtctgtgtgtttacttttgccagtgggttttatacttcacatgttttctttttgtacattagtgtctttttctttcagattgaagaacttttttttagcatttcttgaaagttgggtctgatgaattccctcagctttactctttcatgtttgaaggtgtgtcctcagttgacagttgcatttttttttccttcagcactttgaatatatcatcccattgcctcctggcctatatggatttcctggagaagtctgttgccagttacattggagctcttttataaatatatttgctgcttttctcttactacttgtactacttactgcttgtaggattctttctttgtccttgacttttgagagtttgattattatattctgtagggtagttttatttgggttaaatctgtttggtgatctctgacctccctgtacctggacatttatgtctttctgagggtttgaaaatttttctgtaattatttctttgaataaactttctgtgccttcctcttgctcggttccttcttgaaccccagtaattcctaggtttgctcctctgaggcagttttctgtatcttgcatgtgttcttcattccttttcattcttcttttttctctttcctcttctatatgttttcaaatagccagtcttcaggctcactgattttttcctctgcttggtccattctgctgttgagagcctctaatatatttttcagcaaatgtattttttacttccaggatttctgtttgattttttttttttaatttcaatctctgttaaatttgtctgacaaatttgtgagttgtttttctgtgttttattggagtttgctgagtttttttttaactgttaccttgaattcttgatttgagcgcttacacgttgccatctcattagggttggccactggctctttgctttgtctgtttgagaaggtcgcggttttccgttagctgttgtttcttgtgcacatatgtctgtggttttgcattgaaggatttgttatccaggctttcctgtctggctttttttttcttggatgtttgcttagaggttttttgcagcttactttctgcctggagtttttttcacttctctggtctcatcctcagatttgagttctggaatattgctggtgatattcttggcactggatgtttggttttggttttctttgagagggtgagggaagccagattgcttctacttctctatttggtgatgtcattccctctattaactcttcgctatttttgatactattgtaaatggtattgtttttatgttcacttttgatttttcattgctagtatacagaagtagaattgatttttgt

SEQ ID NO: 7079 - DNA, 1590 bp, Homo sapiens
gggcgcccctgttttttcatagacgggtcctgcactcatttctttgtgtaggtccaggtttccttctggtgtgattttacttctgtctgaaggatttcctttaacatgtattgtaaggcaggtttgctagtgatgaattctttcagcttttggttgtctgaagatgtctttatttcacctttgttttgaaagatattttctctacgtgtagaattccagattgacggggttttttagtgcttgagaggggttggtctccctttctcacttgcgtggtgtctgatgagccgtctgcggtcatgtttgtttgttttagtgcttgagaggggttggtctccctttttcacctgcgtggtgtctgatgagccgtctgtggtcgtgtgtgtttgttcctctgctgcttccaggattttctctctcagtgcttttgagcaacttgattacgatggaccttggtatggttttctatgtgttccttgtgcttgtagttcattgagatttttggatctgggtctttgtagttttcatgaaatttgcatcattttgaaacttcatatctgcaggtgttttttctgtccctctactcctcaggacctcaggcatgcaggtatcaggcacgcgggtatcaggcaggtgggtatcaggcatgcagttatcaggcatgccggtatcaggcacgtgggcctcaggcacacaggtatcacgtgggtatcaggcacgcagttatcaggcacgcgggtgtcgggcaggcgggtgtcggcacgcgggtgtcgggcaggcgggtgtcgggcacgtgggtgtcgggcaggcgggcgtcgggcaggcgggcgtcaggctgcttggctttgccccaccgcagctcagtaaagctttgtgcctgttttgtggtttctgttgctgtgtcttcgggttcactcatcttttcttctgcaatgtataatctgctgttcatcccactcagtagttttcatagttttcacttccgcaagttgagtttggatcgttttaaaaaatatctttcgtgtttcagcttagatttaatgtcttgtctgctaattctaacattgggtcagtttgagttgactgatttttcttctcattagggggtctgtttttttgctttgtaggcctggcaatttttggatgatatatatatatatatatttttctttttattttattttattattattatactttaagttttagggtacatgtgcacaatgtgtaggttagttacatatgtacacatgtgccatgctggtgtactgcacccattaactcgtcatttagcattaggtatatctcctaatgctatccctcccccctccccccaccccacaacagtcccaggtgtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctattattgttggacattt

SEQ ID NO: 7080 - DNA, 1082 bp, Homo sapiens
aacagagtcctgaggggtcctgcgggggctgctccatccacgtgccctggagcagggctgaggtcctgggaaggaggtgggagggttggctgcatctggcagtgaggttgagcatggggtcccatggagatgctgcacccaggtggagacactggggtgtgaagccatgtggaagggctgctgggtcaggggcagggaggtgtagagaggggggtctagctagaaggaacagcaggagaggctggaggtgagagggagccccggggacctgcgtacgtgggcatggagccatgatgtgagtgtggggctgggcgggaggcaggggagggtgcccttgaggctgaggaacacttcactgtcaaggctggtccaggtgcccagcagggcggtgacctggtgctggacggagccacatccccagcggtggggtggaagtctgtgggcagctgcagaaagtgcagaggaggttaggatttgaaggaaaggcagcaatgtggccacagatggatggaagcctggggttgaagggatttgcttttgtgtcaacgatcgcatgcacaagggccggaattctctattacaacaagaaatagctttagaaaatataaaatgaaaagctattcatagcgggcgtggtggcttatggctgtaatcccagcactttgggaggctgaggcaggcagtttacctgaggtcatgagttcgagatcagcctggccaacatggtgaaaccccatctctactaaaaatacaaaaattagccagtcgtggtagtgggcgcctataattcccgctacatgggaggctgaggcacgagaatcagttcaaccctggaggtggacattgcagtgagctgagatcgtgccattgcactccagcctgagtgacagagcgagacttttgtctaaaaaagaaaaaattgcagacaccagcacgcatccatgtcctgagaagaaccaggtggggagggtgatgaggaggctggggggtgtggagggatggatgaagactgagagagaggagattcaaggctccccaggaggtgggagggaaaggtcttcatcttggaccaggcagggtcc

SEQ ID NO: 7081 - DNA, 1044 bp, Homo sapiens
ggatccgtccaggtggcgctgagccgcgtgcgctgtctgggcaccgaaacccgcctgactcagtgcaacgtgtccgcgaccctgcaggagcccgcggggacctcgcgggacgccggcgtggtgtgctccggtgaggtcggaaccgcgtcccccatggcccgtcgccacgggatcccgggcgccctgactctgtctctccacagggagcctcagggtgcggctggccgcggggccggggcgctgcacgggggcgcgtggggcaccgtgtgtgacgatgcctgggacctgcgggacgcgcacgtggtctgcaggcagctgggctgtggccgcgccctgagcgccctgggggccgcacacttcggagccggggcagggcgcatctggctggacgagctgggctgccagggccacgagtctgcgctgtggcagtgcccgtcggcgggctgggggcggcacgactggaggcacaaggaggacgccggcgtcttctgctcaggtgagcggccgttgggtatggaatgatcatgctgttttattacgtacagtcatgcgcacttgctttccagaacagcatcaaactatcgggagctgttctcttccctgaatgcagaacttccacagtggattgggtgaggttcctgttggtatagtaagtgctaccggacaaagtactttggttccgtgcacctggggagctggtcagcttcctgtcgcaggttggccctggggcagccccacctgggctcattttccgccgtaaccagctcaagtgcgcttgaagtttccatccgaaattcatatatatatatatatatttatatattttaaaaaatattttatatttatttaaatatttatttatttatttatttatttattttgagacggtctcactgtgttgcccaggctggagtgcagtggccccatcaccggtcaccgcagtcttgacctcctgtagtccagggatccttcagcctcagcctcccaagctgctgggactacagaagtgaggcactgccgctggcttcagattcttaattttga

SEQ ID NO: 7082 - DNA, 1024 bp, Homo sapiens
cccagccgtgtggggctggagagttggggagagaatgcatttgctatgacaattcagtgttaagagtccacgtgccagcagagcagcccccagccttggcgctactgaccttggggctgggttgttctctgcgtggggccatcctgtgcatcacaggtgctgagcagcatccctggcctccacccaccaggcaccagtggcagcccccttccagttgtgacaataaaaaaatgtctccagacgtcaccaaatgtttcctgggggcaaaatcagcacagttggaacttctgggttagcagcagattggataggatgatggtgagtgactgcctaaaccatcaccagcctgtgtgagctgacaaaggagggctccttacttatgagtttatttgtgtaaagtcttaaaaaattaaagatattagcttagtaattatacacataatgaattaactttactgaaaagaatagtatgtagaaaaaatgagaattttagcaaaattattagacggtgatgaatgtggtgtctccctcctgagatctggttgttgagtgcggcgtctccctcctgagatctagtcgttgagtgtggcgtctccctcctgaggtctggtcagttgagtgtggcatctccctcctgagatctggtcagttgaaagtgtggcgtctccgtcctgagatctggtcattgagtgtggcgtctccctcctgagatctggtcagttgagtgtggcgtctccctcctgaggtctggtcagttgagtgtggcgtctccctcctgaggtctggtcagttgagtgtggcgtctccctcctgagatctggtcagttgagtgtggcgtctccctcctgagatctggtcagttgagtgtggcgtctccctcctgaggtctggtcagttgagtgtggcgtctccctcctgagatctggtcgttgagtgtggcgtctcccttctgagatctggtcagttgaaagtgtggcgtctccctcctgagatctggtcagtggaaagtgtggcgtctccctcc

SEQ ID NO: 7083 - DNA, 1198 bp, Homo sapiens
ttcagtaaactgtacaaaacttatatacacaccacattctctgacaacaatggaattaaattagacatcagtaaaagtataaactaacaatcttcataaaattattttatttttagctgtggtattggcattgtaagtagtttgagagagattagagagagtaaggtcttaactctaaagatgcaacaaaattaactgcattttgaccattgttgaatttgagtgttagctatgtgggggtgctttatctttctctcactgttttttcacatttgaaattttctctaattaaaaaataatttctatatattttgaaaaataccccatttgcacatgaatcatgaatcaagggatggagattaagaaagcacacagagctcagtgaataatggaaccgttaaatatcagcacttggggaagcagtaacagaagatcttacaggtaaatatataatcataagtccttgtactaagaaagacggactgaaaattaataagccaaatgtccaactgaaactaagcagcatactggacccaaagaagggcagaaatcatgaaatacaaaataatgaggaaatagagaggaacacaaccaaggcttgctatttgaaaaagattaataaagtagagaaactgcttctgagactacttaagcacaaaaaagcacaaataaacaatgtttgggatgtcaaaggaacataatgataaatacaaccatgactgtaaacataagacaatactaaaacaaatttatgtgaataaatttgacagcttacaagaaatcacaattcctagaaaaaatgtagttttcgtaatcaattcaagaagtgtagagcctgaccagttatgctactcttaaatacattgaattattaattctaaatgttttcacaagtaaaaataccatatggtttcaaaagtgagttcttctaaagctgttagatcatttcaatcttacataaactcttcaaaaggatcaaatatgaatgaatggtcatcaaatcattctttggagcctggataattttgatattcaacacagagaaagacagaagagaaaactatgggccagcctcatactgaacatagatgcaaaaatccaaaacaacctgtgagtaaaccaaatgcagctgccagccagcccttcctctgggtgcaaatccgtcaatacattaaaaagacaaactgtcaggaccaaa

SEQ ID NO: 7084 - DNA, 1266 bp, Homo sapiens
ctgcataaatggaggatgcacaggatattgtgaaggtgaccgtttgccacaaattgatccataaatttaatgaaattacaataaaaatctttgcataatttttaaaagactgttatgaactgaacagtgtctccctcaaattcatgcattgaattcccaacccctaatactgcaggggtgggtgcatttggaaataggaccttaaagaggtgactaaggttaaatgaggtgaggtgagcttgatgtcgttaacaagaggaactcaggacccagacacccactgtgggatggctctgtgaagacatagggagaagatggtgtctacaagccaagaagagaggatgcagaagaaaccaaccctgccaaactgtgagaaaacaaatttttgttgtttaagccaccctgtctgtggcactttgttatgatagtaacaaaatagcacagaacccaaaagtttctaaagtctatatggaaaaataaatgcctaaaatagctattaataaaataattttgaaaaagaagatcaaagaagagtaactcaccatgtcatattaagacgttgtagaaagccatagtaataaaacaaccaagtctttgcaaggattagacagagaccaacacgagaacaaggataccattaagaagctcatgtaggaacctgtccatgtctacaggaataaaagaagattgagaattttggaagagactgggaaactaaaaggacaaaaaggaaagtctagaatcaaaaaatacattttaaaacacagaagattagacatggctagagagagaattagtaacatggaagatcaaaatatccagaaaaaaaaaaaggaggcagagggtacactataaaaaggcctgacatgccatgtaatagaagcaatggaagaagataatgaggtaggtgtaatatttaaggaaataatcaccaatcagttccaaaaactgatgaaagaaattaaatcatgaattctagaggcattacaaactccaagtgcaataaatacaaaaaaaagcatacctaggtaagacagctttaaaccaaacaacttccagaagcaggggaaactcaaattacctgcaaaagagtaaaagtaagactggcagctggcttctcaacagaaagaggcagtgggtgacaaagcagaaatgcagtttgtcaagtccctgtcccagcatcacagagctgactgtgaagggtggttagaagctaagaggcagcagattaataattggcatagataaaaaagttaccatgcaaat

SEQ ID NO: 7085 - DNA, 1039 bp, Homo sapiens
gtccatttatggacggtgcagttgaatggtggtcaaagttagagcctggaagcctttagtaaatgcgctgaagttgtctgagggccatcagagttgttgcttatattggattagattatttattgagagtagaacaagcactctgatggtcctctctccatttgggactttctgtaaggggagaaatttctctggccctggatggtgtgaagtcccactttgagtaactgcagctgggctggtctctattgtacctggcaaaggccgatagaaaggagcataaggaggaggtgaaacaagcttagattctacagaagactctgatagtgtggggatgctggggattctaaaggaggtgtggacccctgagtgcccctgtctggagctggtgttgggctgtggggtctggggtcccttccccttaataagagatgatcttccaattgttctgaggggctttctggcttactaggctttagcccacaggtgctgcatagagctggattttgttgtcaggccagaacggcttgcacatagggtacttcagaccattttccctgattgctacagaaaagatctagctgtaggatggagttaaagctcacagtctcattctccagccatgttttgtcagctaatctgtaggcaggctaaatagtattacaaaagaagataaggttttcttttttctaagttcatttagccaaaagctgttctaatttttagatatacatcccaggtgtgtttcagtgacagtagaggaagcggctcccatggtgccgagagaatcctgcaatgacagaacatttactgaagtccaggaggctgcgggcgtcctcatgagccaagtgaaaacaccaaggggtccagcgcatcccctcgaaaccccattaactgaagctctaggaggtcataggcatttgctatacgccgtcctagctcccccagcggtggacatctccagccctacggagatgacccccactgcgggctggggggcagatgtttggctgacaagccttgctctaattcactggtt

SEQ ID NO: 7086 - DNA, 1059 bp, Homo sapiens
cctgtaccctacagttgagtcaatctagtgacatgcaccggatgccgtactccatgccctgtaccctacagttatgagtcaacctagtgacatacattggacaccgtactccatgccctgtaccctacagttatgagtcaacctagtgacatacattggacaccgtactccatgccctgtaccctacagttatgagtcaacctagtgacatacactggacaccgtaccccatgccctgtaccctacagctgtgagtcaacctagtaacatgcaccagacaccttaccccataccttgtaccctacagttatgagtcaacctagtgacatacactggacactgtaccccatgccatgtaccctccagttatgaatcaacctagtgacatccactggactccataccccatgccctgaaccctacaggtatgagtcagcctaatgatgccacaccagatgctgttactggcatcctataggttaataatgtacagccaatcactcggcactgttgtttctgtaaaccgacaagaattcctgacagtcaacttgctgtcagcccactcctcatcctcttcttttgcctttaaaaacccacttgtggccaggcgtggtggctcacacctgtaatcccagcactttgggaggccgagttgggcggatcacctgaggtcaggagttcaagaccagcttggccaacatgatgaaaccctatctctactaaaaatacaaaagttagccaggcatagtggcatgtgcctgtaatcccagccacctgggaggctgagtcaggagcattgcttgaacccaggaattggaggtttcagtgagccgagattgcgccactgtactctagcctgggtgacagagtgagactccatctcaaaatcaacaacaaaaaaataaaaaaataaccccacttgtaactgctgcttctcagagcatatattatcagagcatatactcagggcaacttgaatctctgctcccagctgcaatcctcaagcttggcccaaataaactgcctacttatattaactttgcctcggattcttccttt

SEQ ID NO: 7087 - DNA, 1100 bp, Homo sapiens
tgaccaaagcatcgctatcctgggacctcagggatgctgatttttaaatttttttttagagatggcgtcttgccatgttgcccaggctggttttgaactcctgggctcaagctatcctcccacctcagcctcccaaagtgttggaattataggcatgaaccaccacacctagcctacaaaaacattttttttttagttagccgggtgtagtggtgtgcgcctgtggtcccaactacttgggaggctgaggtggaggatcacttgagcctgggtggttgaggttgcagtaagctgagatcacgccactgcactcaagcctgggtgacagagcgagaccctgtctcaagaataaagattgcaacaggttgtaacactttgagtaaaataggaaattttccaactattcagatacacagatgaacaaatggaaagcttgatgagaagtgaggatttctatagtagccatccacgaaatagttaaaggaaagagagtcttcatggtggaaaagcctgaaccagctggtccaggcaaacctcagtgatggtgaagcctgtagcacacagcgggtgggatgaagagagccgcatccgcgatactcctgccgaagatgcctgtcctggatctccccatgtggaagcaccagcccccaagttaggggactgattggacaatgcacctgcctagaatcttcccaaagcctggtgtcgtgagagtcacggaaacatccagaaactcgctctgggcagcgggaagctgagagccgaccactttcttgcagtgtgcctgtgcaaactgggtaattggggatggctagagaaacttgaacagggtctgagctgggacaggaggaatgcgttggttttctgattttgatggcttaggtgtttatggaggaaaatagacttgtttgttggaaatcccccctgaagtgtctgggattacgcatcaggtcagtgattcaccattagataatccaaggagagagaattattttaaacgtacttgtacattttctataactttgtgattgtttgaaagttaagtaacacaaataatttgtgtcctcatcctaaagctttcttctgtcatagaggattgt

SEQ ID NO: 7088 - DNA, 1050 bp, Homo sapiens
gacgtgtttatatgaatgaaaacgatggcactttaccactttttatcgcttttgataaatttgttttatcagcattgttctgaccttataaccagtgtttaaaagaataagcatgctttaaaaaggatcctttttgttacttttctcacttttactgtgaaaagtggatcattattgaacgtgcacttgtgtgcgtgaagggccttgcctggggaagccaagtggagcccctttacagccccttggcctgggctacacgtggccaggtacgaaccctcgcctggggaagccaactagagcccctttacggctcctcggcctgggctagatgtggccaggtatgaacctgtgagaactcgagcacacgtgtatgtaacgatctcagtggcacaagcaagtatgcatgtggtgtacacagatgcgtgtgtaatgtgcgtgcatggggcgtgtgcacagatgtgctgtgtaatgaagggctcagacacacgttcagtgctgcaactcagaactcttatctttttaccaagtaggtcctggccttagaagtagcacaacatttaagttatatgtaagaaaatataaattgtttggggatacatttcctaaatgtttagaacttttggttgttgttgagacagggtcttgctctgtcactcaggctggagggcagtggcacgttcacagctcactgcagcttcaaactcctgggctcaagccatcttcctgcctcagcctccgagtcactgggagtacaggcgtgtgccaccacacctgaataattaaaaaaaaaattcttgtgtacatatggggtctcatgctgttgtccaggctgatctcaaactcctggcctcaagcaatcctcccatcttagcctcctaaagtgccgggattacaggcatgagccactgttgctggtctaaatgttgagaactttggatgtggctgaacagatgttacagtacctgtctatgatagctttcttgagtgtgaattcaactttctaaaatatccctcgaaactgagctggatacaaatctaaataaaaactcc

SEQ ID NO: 7089 - DNA, 1028 bp, Homo sapiens
ggttgtgctgtttgcttctaagtttttataaaaagaagagagcagtagactgattcactcagtgtcctgggatcagaggcaaagaccagggaggggcgggcactcaggtcagcaggggctatgctctgggtctgagtcctgccgagccccaccacccacttgggcagtgaagtcaacctttctgtgcccgaatcttctcatctgaaagtgaggaataatagccataggcttatggtgagttttaagcgagtccctatgcatgaaagagtcagaaccatttggcacacggagggtacccctggggcactggtttgccatctggagggggaggcatcagcaccaccaggtcagaagttaaggggtggccccaaacaccacgtctgtggggaggtggggctgtgaggctgccagtgtgtcaggagtacccgcgcttctgtgcctgcctgtgtgccgggagctcccgcgcttctgtgcccacctgtgtgtcgggagcacccgtgcttctgtgcccgcctgtgtgttgggacctcctgcgcttctgtgcctggctgtgtgtcgggacctcctgcgcttctgtgcctggctgtatgccagtgtcttgcacatctgcaaggaaagaatcccggggccgtgcgttttctccgactagcaagggaatctatcaaatatgaataaatgtacagtggaaggttaaattaatgaaggttaacgtggctaatatgaacatattcagcctcctggaactatcattgtataagcataactgaaaagttcctatagcaaacacaatttgtaatcttaacatattcaattattaaatgtgcaggtcttatttctcgttaactgtgtttaaacatagaaaagaggatcttggccaggcacagtagctcacgcctgtaattccaacaccttgggaagccgaggagggcagatcactcgaggtcaggagttcgaggccagcctggcccacatggtgaaaccccgtctctactaatagcaaaaaaattaactggctgtggtggcggcgc

SEQ ID NO: 7090 - DNA, 1046 bp, Homo sapiens
gatcccgtttttggtaacaaaaaattaagtatctgtaaatagtatattcagtgcaaaaaaaaaaaaaaaactgcgctgcacagggtgggtgaggcagtaaagatgggcagctcactttccgtgctgtgcagcttgtaaaatgggctgtttttagtgggcatgcattgctcctgttagagaaaaggaagaatattacattaaatcaactcataacttaatatattggctgcttttacattgtatcttttcctattaaaaatcgcaatctcacttatctgttgtgtttttgaaagtctgtgtcacgctaaacatcgaaaaaggtacatgcacatttttcactgaatttcccctcgcggtgcgtgtttcctgaaaatattatttctgctgaaatgagttcacaagcttaactgctcctgtcctttaaagggcatttttaccagtactgtgaatttattagttcattctgctgctgtgaaaaagagtggcccagagaggaaagaaagcagaggagatgttctgtgttctgtgtgcgttgtgtggctgccccggcaccttcatcagggctgatttacgtccatctaaaagagaaacctttggtggtgaatggtgattcaagaccagagtagctgccctgtttaaaaaaaaaaaaaaaaagacacttcctcggggttctggctgccagttcagaagggaagaccccccctcccaaccccactctcaaacaggcttcctggtaacttcgcattttgtctggaaccggaatgcgtgttcccaaagaagcaacgttgtgcaggtgcttcgacgccagcacagggaacgtcgtgtgtgggatgagcaccacctcattcttgctctgtgccggctccgtcgggggccgaggtgggcctgggtccttctccctgccggctccgtcgggggccgaggtgggcctgggtccttctccctgccggctctgtcgggggccgaggtcggcctgggtccccatctcgctgctctcgcgcctgctttgtcatgtgggcagggcttcaccttgaggattcctcgtc

SEQ ID NO: 7091 - DNA, 1034 bp, Homo sapiens
tgcccgtcttgaagactgcctatggtgttgaggatgaggagctaaggaagacaggaggagggaacatgaataaatgtgtgtctagcaattaagtgctcaagaatatgctagaatgcacaccgtaactttgtattttattacagcttgcctgcgacatcagtaaaatgaagaaacatttgctgagcacgtagtatgaccgggaagtgtcctaggaaccagaacaatcaaagataatcattctcttcacgttctcattagcaaggggataaatactgtggtagataaataataataacactaatctaaggaactctcattctgatatgaaattaattcagggtgttttaatttgcactgtgttgtaaacgacaaaatctgatttagtgtttggatttaaaagagggaaaagattaaaacagtgatggtactgaaatagaaaacagttaagatagctgttacctttattacactattacagcattatcacgtcttctaacaccttgactactgagacgctctggcagctgaagcctctgagactaggttgtaaaaggccattgtgtatttaagaactcattttaggctttaaagtcattgttatttgatctcagactgttacatttaccattatctttatctgaatccaaggattgtgattaaaaaccctaaaaccctgaggttaggaaagtttgaaggtgagaaacacagggcttgtgagtttggagcctctcgaggcagttttctgctctgtgttgctcacattcacgtgagaccggctgtggatgagggacgtcaccgggagtgactttgtggcagtgacaccgttgcggtggccccagaggactttcctccctacaaccttccccgcggtttctgtgctgaccttgctgcaggcacttcatgcactaagaggggatttgttttgtgccggccttgttccagtgtccaggcagctctgactgttggagtcattgcttttactcctcttgactccagggactcaggatgagtttgaagctttgatctgctaggag

SEQ ID NO: 7092 - DNA, 1035 bp, Homo sapiens
gggactggggcgggggctccaagaggacttccaggaaaattgaacagattctcaccaggttgtcagtgtttgatcgtgggcaggaaggtatgggaaagagtttttcagttctgctggagaattgtgaaaggattggcaataggtacattgtaagccaagatagtggaaaatagataaaatattaactccagaatcattgaaaagcgtaagatagaacggtatttgtagcacactgcggacgctgatgttgatgaccacagtggcgtaaggggtggtgtctaaaaaggacaattcaggaagtcatgtggtaagtccatgtttatgaatgtaagtgccaggtagctactgtttttcatgtgagacttgataatactctttgatttcctaaaatgcatctgtttgataaaaaggtaattgaagatcatttttaaaagatcagttgtagatgatgactggaagaggttggagcagcagacagttcagtcctcaggaactgatggtgatttggatgccctgaaagaaaagcacatgaaacttagcaaaatgacggtgtaggagccatgcttaacttagttctgaattcgccagcctgatacatgagacccacacacgcaccatcaaaagctgatgttcagaaaccaccagagtaaggaatatgaagtccacagactctacaactctcataagagcccatcatggaaaaccagggactaaatatttcttttgttaacttaaaacttttatttctggtttactttcaatcagatattactgatccatttctgaagaagcatctattagtgattggtgctcactcttagagcagttcttcatggaactgtggggacgacgtaggatgacgtccttcctgtggtatcagagccgttcacggagctgtggggacggcgtaggatgacgtcctttctgtggtatcagagccgttcacagaactgtggggatgacataggatgacgtccttcctgtggtatcagagccgttcacggagctgtgggggtgacgtcctttctgtgatat

SEQ ID NO: 7093 - DNA, 1069 bp, Homo sapiens
gtatatccttgtagagggactagagacactgctgggaagttagtgactctgtgttgatgaggtgccggttattagtctgttgccttaaaacatcagcaattggaattgctcctcggaacatgactggacccgttgccgttttctgtacagttttcttttggggagatgcacacggttccgggaagggtgctgggctgcagtaatatgggtgtggacacaggtcccatcagaatagtatcccttggagggcagggtggggatcccgcgggttcacggcggttttgctgaatgaatgaatgaatgaatgaacgaacctagcactgagagtcacatgagctcatatggaaacagcttggagtgttgagaaatggagattgaagagctcacctcttctctgagtatgacggggtcagcaccgctggagctgagggtttgacatgcaatgaaagccgtgatgcagccatagtgcgatttggtttatatagctattgccttctgttatgaagctgaaaagaaccaggttagcggccacctgctactcaggccttatgctttcttaggaaacagtaagatgtactaaatttttagtgttaaagtgacagaacatgggaacacgggaagcgtctcatcttgtcacttgtgacttggacacggagcccgtgggtgcttctctccatggtcagacttggtcatggagccgtgggtgcttctctgcatggtcagacttggtcacggagccgtgggtgcttctctgcatggtcatcttgcagcttctgagtcccatcctcgctctcccggcctaaggtggctgtgctagggatcacacctgcaggtctgacggcaacattgtgtgctgggtttctctcccaggacttccaggtagttcgtgcctggaatagttccatggtagcagggtatcagcgggtggccagcctcggcacgcctgcatggatttgccgtctcgggggtgggagccccatggcagacggctgtttcccttgcgtgcctcttccagcgtggcctttattctccacagggcgttggaactgatttttgcacaacagtgatt

SEQ ID NO: 7094 - DNA, 1039 bp, Homo sapiens
aaactacaaatacatgagataatttaaatgtaagttgaacccttcagaatatcctggatttggtcttgatcttctgaccttgaaaatgtgattcttttttttttttttttgaaattgtgattgtcttaaactgtgtgtctagaccatctcctctgaattgctttggaaacatctgcacgggcatcttcctgttcttgagtatagagaggtggacatcattacgctttaaaatagcgaaagtcctgtagagcagtttttcttaatcagtgatggtatttaaaaatgaactccctaatgcttaaactaatgagctattattgttggaagtattcaaggtagcaagttatagaatctctcagtgaaagtgatttgaaataagaaattgcgagagtgcaatgcattctttgtttttaaaataaaacgctaatacttagagaatgttttgtttgcaagaatgtaagatgttatgtctttgtatagaatttaaggatagtaatttgcttctgagatctttgagatttgaaatctcaactatggtttatcgtccatgttttatacatttgcacatatacacatatatatgtaaggtatataaaagtagaggaaaataagcatgtatatatttacatgtatatacacttctataatgtgtatacttccagtcacatataggtctgagtgactgattttacttgatgaccatgaaggtaattaaataattttcctgctgttagccttgctttttgcatctgagcagggaccctgtgaagtgtgcctcccgcgttccaggcctcacacagtctgtaccagggtttggaagcaggggtttttctgcagccacttcaagaagcaggtggttgccaggattgcctggagctccaggctgcctccagttccagcctccctggggtagaagctgccccactaggggccttgacatggacgttagggcctggagccagggactccttcctgaaggggtgctccagtcacggctgggcgtgagaactgagggcgggaggtggaaccagcctcgggc

SEQ ID NO: 7095 - DNA, 1026 bp, Homo sapiens
attatagaaaatgtcttgctactggaacttcacgatgctttccttttaaacatcaggtagaaagtatggatagtaaatctcagattagttgccattcttggtcttggtagagctgccatcgacagcctccgtcagttacaacagagtgtgtctctccagcaacccagcttagattgcagactgagtctggctcacccaggattcagtgcaacgtcttccgaagctgtagccaccactctcagaagagacttgagaagccctccctttgatgcctgcatgtggctgttctcagatcacaacagctatagcagcgtctcagaggatgctggcaggggtgtcctgggtgtgacaccacggcaggggcctgcagcatctgaacgaaatgggccgtgacattgagcggcctaggggagtccacagccgcatttcaaaggtgcagtggcccgaggttgaaccccagagcctggctctgaggagcctggagttgacctgtcacaactccattgagagagctggctgaattctgtacctgtgtgggcaagatggctgtgtttgctcttggacccttcccaagccagggctagggagattgtctgcacagctagtgggagcttgactgttcacactcggggctgagtccctcacctttctctgagcccagggaagatggacatgctgctgtgacacagccagcctggcaggagggaaggcacttgtgggtttgtgcaccgaggcctccttcctcttgagccaggaagggcttttgggatcctgcttccagctgctttcccttgctaggttattggcctcgggggccaggagaagccgagtgcagacctgcagcctggaccccttccacagcctccgtggcacctgtggtaagcgggacgtggcctttggaactccaagccctaccctggcatgcctgccccttggggtgtctcaggcacctgctgtatgccaggctccatggcggggtgggcggcagccagggctgtggggaggagggggcatggtacgtggacg

SEQ ID NO: 7096 - DNA, 1045 bp, Homo sapiens
tgttcgccactcttacagttacaagctgtacgttttttcctatgaggtatatttcttgcctgttcgccactcttacagttacaagcgtatacgttttttctatgaggtatcatttcttgcctgttcaccactgttacagttacaagcgtataccttttttctatgaggtatatttcttgcctgttcactgttagttacaagcgtatacgttttttcctatgaggtatatttcttgcctgttcgccactcttacagttacaagcggtataccttttctcctatgaggtatatttcttgcctgtttgccgctgttacagttacaagctataccttttctcctatgatgtatatttcttgcttgttcgccactcttaaagttacaagctatataccttttcttctatgatgtatgtttcttgaaggcatggactaaatcctaattccacagtattcaatgcacatactcaagagatacttgtttgaatgattgggttaatggaaaatagaagtggtgacttaactttcagttcattatgccaaacttcaagtgtttacacgcaaaattttatggtcctttggataaactgggcttctgtgcagggtggttagagattgtgggagtgcagcaaatggctctgtggctctaggctcacgaagggcttgagggacttagtggcggcacctgtgttgaaaactcaattctgcaaatccttcttgagtgaccaggcgccacacacgcagccctgcttcccagctgatttctgcagaggctttttctgaatgccccaggtgaacatgaattcagccagcactgctgggcttgcacagcaagccaggtgcagggacgagggagaagaggggcaggacccagctcttcctgggccccagtgcccatgtggggatgctgcctggcctggctcttcttagggaggtcaggaaaacagtggcatggagggtctgttggcacgagcctcttggtgaaacatggatcccaggtctgtgtgggaggcaaaatagaaatttatgtggatatcctcagtaaaat

SEQ ID NO: 7097 - DNA, 1030 bp, Homo sapiens
gcctgggagcctgtctgcatccactgtctgttgctgtgtgacaagtgactccaaaacctagtggcttaaggcaacacacacgtatgactgtacagcttctacaggttgcaaatttagggcagctctgctgagtggttctggccctgtccccctgagtcacggtgaagattctgtccagggctgtggctatctgtaggttcagctgggctggaggttctgctccaggatgctgtgctgacgtgtctgctggcggaggcctggtcctccacaccggtccctctgtggggctgccaggcacatccctgcccagggctgctcctttctgcagagacataggagtgctggtcttacgcccagtgtcaaggtggccggtctcctggccgtgtcccgtgggccacactgaccagctttgagctctgcaggagggagcacacagccgtgtgggaccatcgagggctggctcctgggccatctgagaagccctggctgttgtcttaaagctgaggaaaatggcagaatctggctgtgagctggagagagagaggagagagtgcatgtaggtttgatgggctgtgaaggtcaggacagggctacgaaggactcaggtgcacagatcccttccagggtcggggctcacagcatgttcctctctgtgactcaaggcacacacttgtttagggtggttttctgtctttcgcttgatgcatcaagaaaaaacgttgttttcaatgtggtaggtgttgggggtgagtctggggctgttgattccagcagaatatcctgaaatggaagtgtggacaggatgcagggccaggccccagtgggcagggtggcaacattgtggagggaaaggggtttgtttcatgtgtctatagcagatggtgacacgttggagtgactgggtctgtgagggaggagctgtgttcagtctaaggctgttgagtttgctgaggaacctccaaaatgtcctggtagagtcaggtggccgctgccagggcgtgtggatccccctcttgggaaggtgtgggtg

SEQ ID NO: 7098 - DNA, 1098 bp, Homo sapiens
ttctggtgagtttggaatccgcccctctctgtcagggttctgacagtgtctgaatgccggcctttgcaggagtccaaggtgctgcctccagcaggagagtgggtgacgtggatctgaaacagcaaatcaaagccgggagcccacatggccctgcctgcttcccaacgtgtgaagtgctggtcagtggtttccttccacccttggactcagttattaggctgttacatacctcggagaagggcgccagcctgagagggtaactcctgctttagtctccttgctgcgctcgactccgttacgcgactgtaagcacatatttttatgcttgggttttgggcaactgcaggagtttgaaatttaagtgcatttgatgatatacctttaaaaatgaagcttacatgtagcaaacgggaaacacaccattttacatccttattcctttagcatgtgtgaattccatggttttaaattctaggtgaagttgggttagtagtctgtggaaaatgcctctcttacgattggaaaaactgattgttcatcatatgccttgtttaaaaagagctaagatggaaaaagggatcttctgggctgactgtagttgctgacagtttcactgcatgtgagatgtgtggttttgaaagtttgactctgcattatggggttgtgtgtgtttgtctaggtctttttttttttttttttagaatgcaggtactgtttcatatttttaggagtcacatggtttcctcagctgaatttaaacttgtggaagggcggtactcttaaggttcttaaatgctgtgtatgtacaaatgccagcatgatgctttgtacagagaggacattcacgcttagtctattgatggaatggacgtgttctcttgcctgtgctcactcgaggccctgatactgactaggggtggtccaggctccatggaaagcttcctaaccaattaggggagtgatggaaccgccctctcctacagcacctggtttgccattgaatagaggaagggaaattgctggtagcaaaggggaccagaaaagtgtttactcttcatcttcaccaggtttccagtagatgttaaactcactgagttc

SEQ ID NO: 7099 - DNA, 1177 bp, Homo sapiens
actcttgaacggctctgagatggctcattgcaggtagacatttgcagaaacgatcaggcagagccacagccatcttgcagatcaagtgaaggtttttttttttttttttttttttttttttttttgagacggagtttccctctgtcgcccaggctggagcgcagtggcgcgatctcgactcactgcaagctccgcctcccgggttcacgccattctcctgcctcagcctcccgagtagctgggactacaggcgcgtgccaccatgcctggctaatttttgtatttttagtagagacggggtttcaccgtgtcagccaggatggtctcgatctcctgacctcatgatccgcccgtctcggcctcccaaagtgctgggattacaggcgtgagccaccgcgcccggcctcaagtgaagttttttccgaaagcttgttacaggcttaaatttctgatccctttccttctactgatcttggatgattcgtttctttttgctctcatttgggtctatgaaacttgttgaacagcgtctcaccccacggtagaactctagctctgatttcacgcatgagtcggtatcttcactcctcatttgcaaggagaaagcactgcaggtcctgtgtggcttccatcccctccctgcacggggattgatgtgagaggtgtttgaggtgtgtgaactcgctacccctggagcctcctggttcagtccctgggccgcactcctcccttttgggggcttggtggtttctgctgtgcttgtgccaacacaacaaggctgagtggagctccagggctgtgacagctcacgcagctgtggcattagtgcagagaactgcggggatgcagctgcccttgctgtgatgcttcgagtgttgtagtcggtgtgggaagctcggtgggacgtggatgtcctgggatgggatgggagcctcccctcagcctctatcaaacacttctcggccaggcgcgattgctcacacctataatcccagtgctttggggagctggggtgggtggatcaccggaggtcaggagttcgagaccagcttggccaaaatggtgagaccctgtctcaactaaaaatcagcagggtgaggtggtgtacacctatagtcccagctactctggaggctgaggcaggaggatcccttgatcctgggaggcggaggctgca

SEQ ID NO: 7100 - DNA, 1034 bp, Homo sapiens
ggctggaatggggaccccgtgatggaaagatgcaaccctctgcctggacggagttgaatttttgtggcgctcaggatgcacagttaactgcaatataaaggcagagtgtgaaacgctgtggaggctgagagaagagatgtggttagcaagtatgagtgagatgtttggggcgtgttagcaaagcttgctgcacacatgccaggtgctgtctgcacacgtgtgatccttagaacactggcgtgtggagccatgaggctgtcgagggccccagctcccggcaggctgagggagtctcctgttaccactaggataaccgtgatcgaaggctgtcactcaatcccgagaagggtctcctttcagagaggaaaacacccctagagcctcgggcagaattcagtgattttttattataatgttgcttagatttcgcaaacatgaaaccaagaacatatttcggaatgcttatggttcttttgtaaccatggatacaaaataattcgcagttgatggacagtttttggaagctgaactgcttacattatgagcacggtgctctccctactgccctgggccttgctctggtttgctggggaagctttgcagggcctcttggctgggatacctctcccatgtcccatgttgctacccctggtcacagccatactgctgggcaccagcgccgtgaggacactgagtggacacggagcccacggggcagcagctggtcatgaggtggcatccagatggtccaaaacacgtttctgttcattaagaataatcattgcaataaaaacagagtgaaagaaaaccctctactgacctgactgagaatgtgtcagctgagttggatggggaagtgcagtgaggaaggtgagggctgaaaggagatgagggagggagaggaaaggaaagaagggaagtgaaagggggagggagaatgggagtgaaggaggggggatgcaggaggagaggaagagagagggcagtgggcaggagcctgggaaatgagccccggagccggttcccgaccctcg

SEQ ID NO: 7101 - DNA, 1091 bp, Homo sapiens
cactgataccatttataaatgctggacatgtgacattctgcttggtgccagcacatctggaatccgacagcgtagttagattcttggtcagcaaacccgtacaggagcgtgtgaactctgcatttgcttctcccggacaaaggtgagttcctggtcactgtgctggatggcaacaggtgtggcctcaggagcaggacagagactggcacccacgtgcaggagtagcatctgcaaggaggtgggggatgtgacagacacaaaaccactgaaatcctgaaagtgcgagctcagctgttaccatggaggagaggcgcaggtaagaccagattgtttctcattgttgcacgtttctgaaaatgaccctaaattgactcttctttggctccttgcgcttcctagttgggtgggaggaaactgtgcccctggctctggccctgcttgcggcgagatggaggctgctgtagcttgccctgccctccctatgacttcctctgtgctgttctcctccaggaacagttctgctgagcaagcttggactctgctcccttctgctcttggatgtcatgtctggaaggcttgtgttcttttctgggttttgatgatgctgagctatgtttttgcaaggatcacacgtgcccatagcagggagaagcccctttgcgacttcaacatcttgacactctcagcagagctcgctgtcgaagttgagagacttttgcgtttgttttggcagaagctgagtttcagtcctaggacggcctcagcacacttgatcccagctcctttctctcactgctcccctcgtgtatggcagaaatcatatgccctgaagtttaccagtcccttcatttgaaaacttcagttaatgtatatgatcctcaaatgagaattttactttttataaaagcaatcacaaagactggattttgcgataccagtgttttatgtgtagattaattgtactcacaataaactttgtcttctaagtattaataattccatgtttcagattagcatggaatcatgccctggagtagttttgcttttccgctgtttttggcgaaggtaaagttgagaacgttgtgatatta

SEQ ID NO: 7102 - DNA, 1062 bp, Homo sapiens
cattacaagctagtgaaatttggcaggttagtagatgctttgcaatgatttaggaaccaatcacttccttgatgtgtgtgttcctgacatcataaacagctctgtgaggtgtgtttcatccccagatgagagaaacgaaacaacagggacttggtgatttcagtgaggtagaactaatatagcagctgtctagctttccatatcacaactttgtcagccctcagctcaataaatgagaagtcgccactcatcaggaaacgtgttcattttctactgttctttattcgtggagtatttactgccttgtgttcttcatgatgtagcaaaatccctcctagtgttgtgaatataaacagttcatgacaaatgcagtatcttctttgttaacgttgaaaatgatatgtaagttcatcttcaggtactgtttggaaggatgagaaagaagatatttaggataaaagaagaatagagagctttcgagtaaacagggaaaataaggactttgtgcaaaacatttccaaatgtggaatttgagaataatctcaaatctaagattgtagttatttggatttttaaaattagtacttagttttccacacctttgggaatttcacccttgatggaggattgcaagaataatctgatttttcagaacagaaggacagtctgtctcaaaggtaaattccaggttctaccatggagaaatagaaattgctcccaactttccaaaaggttcttaagttctttcttcttttgtggttaaaaaaaaaaaaacacaaaaaaacaaaagaaacaaaacaaaacatctctgggtttagtctcagccaagttcctcttactaggttgccttacatttctcccaggtgttcagagtcttcatcattactagttatttagcttgttaaaagcaaaaccttgtattagttagatctgagcaccttgaaggcagggctttgttttatactttaaataagcagcaggctgatggcagggctggggcccttcatcccatcatgcgttcctctgagcattcagagttctcactgcgtgctgagtgtggtg

SEQ ID NO: 7103 - DNA, 1032 bp, Homo sapiens
ctgcctgtattttgtcaacagtggccactgtttgaccatcatacttgccatctctcatttagaaagttgggtgtggatgtattaactttttagacatacaaacacatgggctgtttttgttgttttttccccagctgaattcaagaaagggaaacaagtagactagagtaagtatcagaaagcgtctaagtggccaggtgggggatgtccactttgtggtggggaatcctactttggtgttggattgcattctgccagacatcgctcctagaaaagctgaccctgaagggcttggtgttgccctcaccctgggacattggtctctctcaccagaaaatgaataatctgccagaatactgtgagtcaaattgtcagaactcgattaaataagaggctttgtctcaaacgccaaaacatgaggacacacttctaattttttaaggagtgcttcatcgtgagtcagtcctgacgtgtactatgttaggaaacctctgaactccacagtcaagccagagctctgacagaaagtggttgcgcccttctcactgtgtttttgtcactagctttattcatgaaaattatttccttaaaaccctctttgtatgacttctattacagtttggaaaaaaaaattatgtggaactggaagcctttctgcagcgttaatattcatggcctgttctgggtctcggtatatgtgtactatacaaatgtgtacttgtatgtggtgtatgcgtactatgtattgccattgtacatgtatttacaatgtataggtatgtacactacatgtgtcctacatgtgtgcatgctatgggcatgcatgtacatgtgtacatatgtgcataactatgggcactattatatccacactatttggacatgtatctgtactgcatatgtgtacatacatgcatgtatttaacgccatatatgtacctgtgtacatacaccatatgggtatttgcacatttgtgtacttatatatatacatgtgtgcacactgtaagcatgcatgtacactacgcacac

SEQ ID NO: 7104 - DNA, 1099 bp, Homo sapiens
tcaaccgtcagaatcttgatacggtgatttatgtaacttatcacacgcttctcagcagttcttatgaatttcattctgttgtgaaattattgcagttttaatggctacattggtctcatgttgtggcccttggtaactaccttgaaatgaattgccttcccccttgtgtgttaaggtttcacctgggagcctttgaggcctcacctctgcatagggcagtgcctctactctcctgacaagaggaagaatctcattagagtatttctagtgtggtttttgcttccagacagaattacttttttcacaaagagacatccactgaagtcgtaaattatgctcaggagggacacacgggttagctgacagagtggagtccagaagacccaaagatgcaaaagcaggtcagtggaatttgagtcttttcaacaaatggtgctggaattatcggacagccatatgcaaaagagtgaaaacaaggagaaattcctgtatgaaaattaaggtggaccataaccctgaatgtaaaatgccaaactagaaaacctgtagaagaaatggaaatcgtcgagaccttgggtcttgacctagggttagagctcttagccatgataaccaatgatccatagggaagaaaacaaggagacaagacttcatcaaaattaaacttttaatataaaagacacccctagggaattgaagagacacattttctgcagacagggagaagatgtctacaaatcatgcagctggcaaaggacttgtgtccagaatgcatacaggactcccaaagctcatgactgagagaacaaaccacctgacttaaaagcgggcagagacctgaacaggtgctccatcgagaaggacggggagggtggcctgaaagcatctgaaatgaccttcagtgcgactggtttcagcgagatgtgcattgcagctgcggtgaatttttttacacccctgctggagcggctgatggaaggtcttcagcaccaggtggtggtgaggacagaggcagccgggactcctgtgtgatgctgcggttcagcatggtgcagacggctcagcagtttcttacaaaactgaactcacacaaacgtgg

SEQ ID NO: 7105 - DNA, 1052 bp, Homo sapiens
cacgccactccactccaccctgggtgacagagcagagactccatctaaaaaaaacaaaacaaaaaaaaccagtaatggaaacctgactgttatctgtgatggaggtggcggcttctttcattttttagtgacaggatgaattggatgtgtgtttgcagtgttgatcttgacaagggaaatggtcagaaccaatgtgccacccagcttgggccttgccaccggcagaagaacctggtgggggacagactggaggctcggagaccgaggggggaattctcacgccatgaagctggtgcagtcactgctcctggactcctgctggagggaggcggccccttcacctcgcaggctctggtgcggtggagaccttaggacgacctgcctaggtcatcagaatggtggctgtaagatatttgagtttcaatagcgtttctgggttccttctatttttaatctgctttctagcactaggtaagtgaagatatgtaaagtaaaaacccgtctaacttgtagagatatagtgttgtgtaggagcagactatggcctctggctctgtttaaagattgtagtaaactctcatctggcatggtcagggtgcaaattatcttgttgaatcgaaatgtgaatgagtcaaagctggcacctgcatcgttgatgaaacacctgattttaaaggaacatgtcgatatgccgtaagataccagcaagttcctcactgaggttcggcgtgggttcgcaggaactgggccttgtgtcaccagggtcacctctgggagaagatgctcagtgtgggcgttagtcatttagcctttccagagccaaggaacagcttgctgtggtttttttagaagctgtattttgagtcagtttgtcccacttgactcgaaggtgctgtgctatttcagacctttgccttgcaccatgtactcattttcttgtcccctgataactaccttggttgcccctggcctgacattcgagcctcgtcgttcatggacgcagaggctcagtggtggggctcaggccgtgactccggttttcacagttccgt

SEQ ID NO: 7106 - DNA, 1050 bp, Homo sapiens
gccttttccccgcacccttgggctgagttttatcagaggctggtgtgtgggaagcaccatagccacttctgacagaaactcgggtgcccagccgaggtcagagtggaaatttgtgcttttccttcgctccagtatggtctggcttctccctgcttggccagaagaaaatcatgcttatccaagtcataggcaaaccccctaaattaaacatttgtcttttttctttaatatacccatttagtttatatgggacaatagattgacaaatgtcttttaggggaaaattaatttaattagagaactttttggataaaaactataatcaagagaagctgttttgtaataagatctagttaaatactaaagttgaaagctccttatatttgatcttaaacttgggcccagggtgcgtgtccgcacgcttgcgctcatgacgccaggctcagctgtgaactacaggcacactgtacttactttctggttgcttttttgaaagtcttattgcttggcctctccgactcagatgttgagttacattgattctgttccgaatgtgttcatccctccatctagggtccactcgtctttcagggagcaactgccttcctcatctttgtctcctatggtattgtatatttaatagtcaaatatttataggttgcatgggtgactgatgtgttcattaggaggaaaacaatgccaatttttacgtcattataatggacttgttaaatgcttgttagtgtaatgaagtttacatggcaaaagaggctttggagatgtgactgcgtaacagacagtgagatgggggaggaccctggattgtccaggtgggtccagtgtcctcacacacatgccttgatgagagggagtacgagggtctgcctcagaggagacctgaggatgaggtagaggccagagggggtgtggggctgagggcagggctggggggtggggtggtgttgtggggctgatgagggagctggggccggaggggcttggggccaagggtggggcagtggttggaggggtgccgggccggaggggtgt

SEQ ID NO: 7107 - DNA, 1026 bp, Homo sapiens
ggacgtgagccactttgatgttctcaagcagcctgtccccaaagccctcggtggaatgccgcattcctttgtgcccctcgcttccactaggaagaaccgctgggaaggggctttgagtgaacgcttgggtttctgtctctaattggtacccggctgcactgaccaagcaggggtcccagtgaccctggacattgcctcacataagatccaaagatgcagttaggttctttttaacttcttaaaaaatgcttttgacctggttaacctatagcattatcagttagtgtttttgatattggaaaggtgatgtattttattttctaagaaggaaagaaacacaagttatcctgttaaatactctaaccacagactaaatcacatcaaggaaagaggaactattttggggggaaattagcccttcatgtcaaagataaaggagatgacttacattgttttttaattgagttaattatgaaatcttaagtgggtttgagaagatgagctgtggatgctgaaaggagagactgatgctgattgaatgttagtcagccctgataggatgtggctagtatttcaagcttgctccagtattgtttgatagattgtaagtgaatgtaaagatctatttgatgcttttattttacaaaatactattgagaaaaagtttctgacagccagggaacagccttcaaccaatttcttcctaatttccatcaccagaaaaaacttgtcctgttaattccagaatttacttttggaaagttcctgtaaggagagcagaggtattggtggttgaatggtgacttgaatttaggtgaagatcattaaatatttttgtagtcatgtttgtcttggtggttttagcaatttcatattaaatttagaactgcgagtcataaaaaccaaacgtggtcttaccctttgcttttgtgatactccttttgtttatatgactatactggtaaagtgatgacaaaatcatgcttatagggttttcttctgtgtagatattaggatttttagggg

SEQ ID NO: 7108 - DNA, 1047 bp, Homo sapiens
aagggtgataaatgtggaaaaatgcagcactgagtttgtctatggtctgagcttctcatgtggtcattaatgtgagcgggctgtatctgtggagcctccctacaggcacaaaggaatcaggctagagtaagacggccggcaaactctggcatctgggctgcgtgtcgtttcctaaagcccttttgggtgaagtgacacaggcgcaatgtctgtttggaggagtgtaatctcacgcatgagacgcagattttaaacactaaagtcaagaagcttggtgggagtggctgtcttccaagtgggtttctgtgttgccatggatgaggcatggatgtgtcatctgtcggtgaaatgcgctggtgaagaggctaagcaaaccctgtgtgtgtgtgtggggcgggtgtgtgtgtgtatatgaacctacatctcttctggcatccgaagtaaatagacgttttgtaaaactggtgaatttgatgactctgaccctaaccctgagagttgaagtctggtgcagtgtcttgagccctcttctgcattgagggtgagtgactgtaaatgactgattcctcagtggcgaaagttcaaatttagcgtccctgaggaagccagacctcatagtcacctgtgtctccattgtaaacaccgtggcccctatgcgggtggctgcgagtttccaggccctccttgcagaagcagccatgcagtgcttggtgatttgataacatcagccaccttctgtcttctgtctaatcacggtacaaatgattttcctacagggaaacagatctcatttcttccccgatcgttgggagaagcagcccgcctagggaccgcaccgtcctctgcactttcacagtgaagcctgtgtctctctccgagaagtgtcacgtgtgtcgtgggaatcacgggaattgcttccttaattctcctttcttaatgagggcttgggacagcgctgcctgtttcacatgggacgagcagctggtggtttctggctggcgtgggaccagcgcttcggctgtgtcatcacatctggtggcctgtcca

SEQ ID NO: 7109 - DNA, 1088 bp, Homo sapiens
gagcggctggtgacacaggtccagatgctgggatgctgatggggggttttggagagggaggtgtcgggagggtttcccgacccacagcagccctgggcccttgtccggccttcttgcccggggcatgacgcctggagggaaagcagcttcgggggcctgagggccacaaggcagagtcctggtgtgtggggcaggcctgggccaggctccttggaggatgttacagagccactgcgtgtgcggggaccacccatctctgagccccacgcggattttcctccatagccgagcgaaatcctggtacggcgagcgaggcagtcagaggcaccttttgtggaaggaggacaaagctggagggaaggaggttttcctaaaaggcacaaggcactgatactgcgttaggagtaattcctaggagcgtggtagctggtgggtggaaaactgtagccaaagaataaatgggaatggcccttcttggtatttaactgattcgttcacgaatggtccaaacagttgtagtgaaaaaaacattttggacaccgatgttttcatcctgcctgacgatcggcgtgaccgtggggtgttccatccttcctgggcaacagtgagagggcctgacaatcggcgtgaccgtggggtgttccatccttcctgggcaacagtgagaggggctcaggcccttctggccccatgcaggcatttccccagggtgtgtcccccgtcctgaataggccggaatgcctctgggtgcagctgagcctcttgaaaagggaagagtcatgtgacatgctctcggtgaacaggaaaatgagggaggacaaggagaggggcctggaggtgaggaggatggtgaccaacaccagggatgggatggagggtaaccccggggacgggggacggagggtaactccggggacggggggacggagggtaacaccgaggatgggggatggagggtaacaccacttctccaggtgcctttgggggatgctgccgcccctcccaccccagagtgaagtcaacaggattctgtccccaggagccccagagcctggcagctgggattggcccagtatgaaccactgttc

SEQ ID NO: 7110 - DNA, 1006 bp, Homo sapiens
agtctgggttcacaccggtgcccgcgtggtctccagttacggtgctggccgtcgggtctgagttcacaccggtgcccgcatggtctccagttacggtgctggccgtggagtctgggttcacaccggtgcccgcatggtctccagttacggtgctggctgtcgggtctgagttcacgctggtgcccgcgtggtttccagttacagtgctggccgcttgtacctttctgggaagttagaaggaggatcatttcatcgcctccctgtcctcccacaccttgacctatactgggccaccgcgaattcttccttttaactgtttctctcttcacaggcaacactggcgttttgtggtccacgtttgcctcttctgaaaacggattctgtgttgctttatagaatcacatggtctcttttatgaatttcgcttttctttcataaaataatcgtgcttttatctcttcaatctcaactctgttccctggcacaggctcttcccagctcaaaaattaaaagtaatctttgattacgcttaatactttctaaagttttgaagtttatcagcatgtgggttacagaacattgactatttatttaatggaaaattacattctaagtagagtattaaagtgaaagggatcttttgattttattaaaatattcaggtaaacatatgaaaatgccttcgccaaacttcatgcttgtatatcatgaaaacattaagctgctaagctctctctgctcccgggaatgcattattagagtatgtgtttgaaggtgtcattccagtcttagttttaggtattttttaaaggggttggctggagaagtgacatttagcattgagtgaatgtttgataaagatttgtctctatataaaaatatttaaaaacaatctttagcgtttcctttcagggttcacccattaaagaatggtcttgtaaaaaaaaaacatgttaagagtgttggcgcccagaggtgctaccctgcccacagtttcatcatccgc

SEQ ID NO: 7111 - DNA, 1022 bp, Homo sapiens
aggacgttgttcagtaagtactaattggtggcctgccgttgaactaatttcagtgtagtactgacatcatcagccacggcagaaacttacttggcatccctggaagagagggcagggaagcatagcaacctgaaaccacctcattctccagcgctacttccaactctgagctgatggtcattacgagtggatctgccctggacaagtagtttagtgtagctgccttggacgggcaggtgaaaagtaacaaaccgccagaaaactcagctaataaaatgttaggagagacttggggcaccaggaaggggtgaggcctgtctgtgtgccatctgtgtggagcctcagtatctaggggacagcgttgacgctgagccccaggtttttattagtgtttccctgaataaaacgccactcctgagctgtggactgggaggctctttctgatgattaggcttcataatgcgggatcactaggcaaggtggatgtgagggccataggatctggagactgtccaggactgctttctggaaggcggccagcctgctggagggggacaacaggcttgtcccttcagcagtgaagccaccaaagagagtctttttgagaataaaagagagaagcttttaaggaaaaaaagcagtttctgtctctgtttgggagttgagtgcattttcctgcatttattcagagatgttcgtcagttcccactgtgtgccggggccccgctatggggtagggtcaccccaccgcgtacctaacccaggaaaactcgtctgcagttatttcagaggctgtttgcatttcttgtgcttcaatgggtggagggagtttttcctcctactgtttttagtcagttttcttaatctagcctgttactgggataagttccagagccgagcagttttaaaaacaatctttgcaccttgcatggagagcagtccatctgtgggtggtttgttcctggaggtgctgcagtggccttgggtgacgcgagggccccctggctcaggatgggccgaga

SEQ ID NO: 7112 - DNA, 1009 bp, Homo sapiens
attaatgtacgttatagccaagtgttataaaattaatttaacagcaaagtaaaactaaagctgcattgatttctcactgtacttgtgcttaaagacggctccatgaggcaggccctgtgatcctgcaggccggcaggagcaggtgctacctggctggtgcggtcgccacccgtcccctcttgctgccaggcagctttgcagtttccaggctatgggggagtcgaggcgggtggtcagtaagagacagtggggagttgggtggtgcaggttggcgtggggtggaaggaggcgtggagtgtgggtgtggagagcctgggggaggctggacagcagctccagtacctgcacagggggacagggtgcggggggcacggggcagtgagtcgctcctggaaacagcccttggggtttttatagatgggcctgtcgtcagctctgcaccacattcctgctggggctgggtggagagtggaggcctcgagcatgcgtttctccaggtgagggcccagctgacacagccagtgtttcctggaggcccctcacctgggaacgtgcccctgctcttctcagaacaaaataaatcttaaactctacacatcacctttccagaaagtgtttaagtctgtgtgcctgttaactcacctaaatttaaagagtaatgatacaatatgcttctttttaggggagaaaacttagctgatttaaaagataaaatcagaggtcgggggacgcagcattttgggggagacagggtttatgtcctagtggtcagcagtgtttcctgaactattgtgtttgctctattattacattacagaagtgacacgtcaaacctagggaaataggcaaaatagccccccccattcagagataaacgttatcaacatattcatgcacttccttctgtttttgctgtttgctttttaagaccacgttcataggatgggtatataattgtttacagtgactttaaaagcacctttcttgttaaaaagagtattttttcatt

SEQ ID NO: 7113 - DNA, 1033 bp, Homo sapiens
ggaacagggaacagccctccccgtgtggcctccccagcaccacccaccccgcaggacctccagtgttgactctgctggggtcttctctctcctggggggtccttgtcccaacgggaggactccatgggccgcaggaggtgtcaagctattttctctcctggaactgggttgctggcagctcccagatgcaggaggaaaggctcagaattgccttcctaataaggaattgttgatgtgaactttggacggcaaacactgcttacatttccttttccgttttgatgtgttaatggtgtgcggcaacgccgtgacgcacggggacgcaggtgacgggcacccccccacaaggggaccatgcacctgtttgataataaggcatgcttctcttactgcaaataaaaacttcaatggttttctgccagaaagaccctgtcttttatgtaggatacatagaggatcatttggcaagtgattggggattttgggttaaactaaaaataaattaatttcattttatagcactctgaacacatttgagttaattattcatcgagaatttgaatagcacacactgttctgacttccgacttcccccaatgaatggcatttgctgtaacgtgacaaaaccctgagtcttagaattattgggtaatgtgaaaaaaggaaaagttggttctctgttgttttgctttaaggaaattatattattttacagtcacttagttttctcctttccaataagaaaaattgctttcttactacctgaaaattcgtgaaggtcaaggggacacaccctgcagtgcattaaaagccaccatcaaatgtggacctggactcagtttccctctgttccctcccaccctcaaatgtggacgtggactcagtttccctgttctctcccaccatccaatgtggacgtggactcagtttccctctgttctctcccaccctcaaatgttgacgtggactcagttttcctctgttctcgcccaccatcaaatgtggacgtggactcagtttccctctgttctct

SEQ ID NO: 7114 - DNA, 1024 bp, Homo sapiens
gtgttgagttgcatgtgttgtatgttgtatgtgttatatgttgtatgttgtatgagtgtgttgtacgtgcatattgtgttgtgagttgcatgtgttgtatgagtgtgttgtatgtgtatgttgtgttgtgagttgcatgtattatgtgtatgcaatacacatatatgttgtatgagtgttgtgttgtatatgttgtatgttgtgttgtgcatgttgtgttgtgcgtgagttgcatgtgttgtgtgtgttgtatgagtgtgttgtatgtgtatgttgtgttgtgagttgcatgtgttgtctgtatgttgtatgagtgttgtgttgtatgagtgttgtacatgcatgttgtgttgtgagttgcgtgtgttgtgtgtggtacgtgtatgtcgtgttgaatgtgagttgcatgtgttgtacatgtgctgtatgagtgtgttgtatgtgtatgttgtgagttgcatgtatgttgtatgtgttgtgttgtatgagtgcattgtatgtgcatgttgtgagttgtgtatgttgttttgtatgagtgttgtgtgttgtatgtgcatgttatgagttgtgtgtgctgtatgagtgcattgtacatgtgtgttgtgttgtatgtgttacgtgtgctgtatgtgtgtatgtgttgtacgtacgtgttgtgttgtgagttgcatgcattgggtatgtgttgtatgagtgtgttataaatgcatattgtgttgtgagtagcatatattgggtatgtgttgtataggttgcatgtgttgtgtgtgttgtgtgttgtcagtgttgtatatgttgtatgagtacattgtacatgcatgttgtgttgtatgtgagttgcatgttgtcagtgtgtgcgttgtgagaggcgggggcatccacgtgactgctcctcagcaagtcctgccgtgcagccccttctgagcgtgcgtcctcccgagtagcctagaagcagcagcatgtttgcctctgcccctccccaggaggcctcagccaggtcctgtgctcagcctgccgtgggcca

SEQ ID NO: 7115 - DNA, 1028 bp, Homo sapiens
gtggattatatcagttttattttctgtggctgaatcatcactctacattgtgaattaatgttatttttcggctcatcttcataatgcagggaggttctccagtgttgagtgcaggttcagtgaaagcgctaacactgttaccacgggcttaaacggacttgttttctgaggcgataaccctggagtcaggcattcagtgtctgcccatcacttggttccgagttctcggtcccctcttgctctcctccccccgcacccccttgcttctgtcttgtcttctttttgactaacaggccctctgcagatggtgtgttgggggccggggtctgctgtgagtctttgataaccttgggaaagaactttttctttggagcaagacccctctcaataaactttcagtagcccaactattgtccgttgtgtgaactatttgtggaaaatgctcagcatttttccttggattctggctgatctttctccacctgccaatttctcctcagtttgccgtgtctgtaccgtcaccaaccccgttccagccgcggttacatgtaaagtaattgaagcagagctctgcagatgagagagtgtgtgtcgccccccgagttcccttcctggcctctgagtgtgagttgtgttttgttccgagggatgactgaggctcctggcccctgttttggagcaccccacaccaaagtgggtgtaaaatgaaaaaagggtttatgctatattattgtaattcatggagcagatgataaacatgcttgaatctgaacagcagctgaaaatgaggacatgttaccagtttggatgttggatgaccttcttgaaaaaagcttttgtcatactttagaaactgtgcatgtgctgttttctatttcatacttagaatctgtacagtatgtgttgtatgaatgtgttgtatgagcgtgttgtgttgtatgtgagtggcatgggttgtatgtgtgttgtatgtgcatgttgtgttgagttgcattcattgtatgtttgagtgttatgtgttgtatgag

SEQ ID NO: 7116 - DNA, 1035 bp, Homo sapiens
gcgtttcctccgtccgtgcgtctgtgacgtttcctccgtccgtgcgtctgtggcgtttcctccgtccgtgcgtctgtggcgtttcctccgtcggtgcgtctgtgacgtttcctccgtccgtgcgtctgtgacgtttcctccgtccgtgcgtctgtggcgtttcctccgtcggtgcgtctgtgacgtttcctccgtccgtgcgtctgtgacgtttcctccgtccgtgcgtctgtggcctgtttcctccgtccgtgcgtctgtggcctgtttcctccgtccgtgcgtctgtggcgtttcctccgtccgtgcgcctgtggtctgtttcctccgtccgtgcgtctgtgacgtttcctccgtccgtgcgtctgtgacgtttcctccgtccgtgcgtctgtggcctgtttcctccgtccgtgcgtctgtggcgtttcctccgtccgtgcgtctgtggcgtttcctccgtctgtggatctgtggtgtttcctctgtctgtgagcctgtggcctgttttctccgtccacgctggaggccgtcgcttctctctagtcaccacttactgatcgctgtgtgctgagcctgtgtcaggcgtgtggcatgtgtcccctgtgtggcaggggtttgcgtgacacacagggacacacgctcggggagccgcagggatggggtcatagccacgtagcggagccctcggtctgaggggcttggtgcccacccagctcttcctgaagcggcctcggggcagatcccagctctgcttcctctcctggaggcacctcatgaagtaaattaagcaaatccaaggtaggaaacggttttgaaatgagacctggtttcaggtgtgtgtggtcatttctctctacatgtttacttcatataccctgaatgatatacttttccacctggtataacaattaattaccagccattactggtacaaaattccatgaagaatatttgaggaagacatagtctcaaaaacatgcttcattttcacagctgtgatttgcatggtaaagctgtcaggactgtgacttt

SEQ ID NO: 7117 - DNA, 1065 bp, Homo sapiens
gaacaaggtggagtgtccgtttcaagcagtacatcatgctggattcttaagtgaacattatcaggctttcaacacattttctctttttatttactttggagaatataatggatactcagaagctgttgggatttagtaacaggaagtcatccttaaggagctatttaagcaagggggcagttggagtaaatgtaagttatgaacacacacctattccaaaccagagaaataaaggcttcaattgtgctggggttgaaacttggtggctagtgtgtctttcctgcccacagtgactgtggcagtgctgtgggcaggaaattctggaaacaagacttggtgccagtggtagtttttgtggtgattcatttgctttcagctcaagtgactatagtcttccttgcaagtggttaggtctccaccaatggaccacaacattgacataggacaaatgagaaatagcacttgggtttttaacaattattctttttaatggacacattatagtacatatctatgggatacagcgtgatatttcaatacatgtttgtcatgtgtaattagcaagtcagggtaattagcatgtccatcatctcaaacatttgttatttcttaatggtgggaatcttcaaaatcctctcttctagctgcttgaaaatatacaataagttgtaaactatagtcaccctacaaggctatagaacactaaacctcatttttcctatctagatgtaattttgtatccattagttaacctctccctttctcccttcccgccaccctttcctgtctctagaatccactattctaccctcagagggtagaatattattttcctcatagagatctttaaccctcttggttagatttcttctgaggtatttttatttttattttatatttttgtagctaaatgggattgctttcttgatttctttttccactggctcattgttggtctatagaaatgctactgatttttatatgttcattttgtattctgtaagtttactgaatttgtttatcagttcaaagagatttttgctggagtcttttttttttttaata

SEQ ID NO: 7118 - DNA, 1030 bp, Homo sapiens
caggcctgtgggcttggctgctgccctcctgaggagctgaggatgaggagggcatggctaggaggcgggagctgccgtgtgcagggttcggatgtaaactggtaagtagattgtgcagtgcagacagctcgtttggtgggtaaggagtgtatcatttgcaaaaggcccaccctggttatctgattgtgtcagccttgggtaggtttcccggcttgcgtctcggcccaggtgcacccctgcctgcagcaccctccgtgttcgctgtctcaggacaggggcttctgtgctgcctgcatcacactgatgtgaagtgtcagtgccccatccaggtcagcagagcgtagcgcccctgagctcagcagggcgagccccatctgagggttcccccacccactgctagcccagaagttggacccacatttgttcccagagtctgggatgtctatgggaatgggtgtcctgtgttgggcattgtggccttttgaggtgacgacacttgcctgtcagttgctcttggagggtgagtgatactgtcttgctgcccagatgatggcaaagccactttcgacgaaggtgtgctcagccgaattccctgtgaacaccttgcgtctgtacaggttttttaaaaagggcttaatgagttagtttcttattgagagaccaggcagagaaaggggtgtgtgtgtttgcatgcaggaagcctaattatatttttccttccacatgaatcttgctgagatctgagctacacatttaagaagaaagggtgagagggttgctccgtggctctattcagcctctctgcaccctccggcctgtgctggccccactgcctcatctgtttgctggatggtctttaactttgctgtgaagtgtgggtttgcccaggttgagtttatgggggtagtgctgtaaggtcatttggaattctctgtctcataaccacataaaacagttttacaggcttaaattagatgaatcaacttgttttccagtattgcttaatagaaatccaagaattgaaggatca

SEQ ID NO: 7119 - DNA, 1030 bp, Homo sapiens
cagggtcataaagttaatagtgtgtgtgtatgtgtgcgtgtgtgtgtgtgtgtgcgtgcacacgcacacacacacacacacgcttttaatccagctgggcctaatcgtgtgtgtggtgtgcgtgcttaggcaggaacccagttttactttatgccatgtggaaagtttctttttccagtatcaccagtgagttcactgtctctccactggtctgcagtgctgcttctgttacttgcagacttcccacgtgtgcatggatctccacctggggtctctagggtctctattctacactgcctatttccctttctgtcctaacaccatagcatttaactcacccgtcatcctgtgttgctgagaatttccttcatagaactcatcaaagtatgattaactgtgctccctgagggcaggaattatgccatctggatcaccagcctctcccttgtccttagcacgccatctgcaaattagcagatactcggtaaatgtgtattaactcgaagtatattttgtgtcttctctgtgcacagcactgccctgggaagaactaggatgaggtattgacttgctgttgccacataacaaaccctgccagaactccctggatggaagtgaccaccgtgtatctgtggattgtctgcagggctctgctggggtcagcaggtcccacaagagagccagggctcggtctcctcatggctgtcagaggtttacgtattccgcctccacccaccaaagtctgaagttgttgtattccattccttgctatatccacatcttttaataatgctaaaatcccgtgtttctctaaagcattggattgaaccaactgaagaaggaccacgtgtgttgctgggcctgcttgggcacaagccgtttccgatccaagtcaactgctggtctgcttagacgaaggtgtgtgggtgtctccaccacggagaggagggacagcaggtgagaccataggccaggaaggaagggcacagcctaagcgtgcagtggcttagccagagaccctcgtgcacca

SEQ ID NO: 7120 - DNA, 1071 bp, Homo sapiens
atctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtgctgcacttctgaagaacaaggatgcactaaagttagcaagtttataataaagttaaatataaattattttgttttaaaatgcctcaaatttttctttattctaagcagcaaacattaaaataagaatatttcctgctaaatgtaaccatacactttattccacaaaatgttatttaacaagactgagggttttttttaagaaaaaattatttccatccaatatttaaagacttgaattttatttaaacttgaaaatgactttgccttaacttttgtataagacagcttagagtccatggagcccggccctgggttggcgtgagtgggtcagagttactcagttactgcgtggatctcctgtcgctagttttactgagtaagcatactgtagtacaagagctagtagtagtttttgtaatataccttaaagatcttcaacagttgatcttttttcagaatgttggaaaatcctgtaaatgcaaatagtcaatactgtattaaatacgtgcacttggagtgtgcttcgcttgtacagttgtaaataatcagaacatatgaaaaaggtaccctacagagaaaattctgatacagattattgatatattataaatgttgctgttgagcgggatgtagataaactaaatgttgtggtttgaatattattttgatttgttgagattttcttttttctcttacatcggtgtgttgaactgattctgcctctttgctgcaaaagggaattggaaagtcttattaaaagcctccagatgttttcatactcttttaaaatgtatgtaaatgcatactaatcatatctaatgtgaaagagttttaaagtatatagagagcaaaaactggcaggatcgtaagtgaaggtgactagtaatctaatttaaatcacctgcagctaagca

SEQ ID NO: 7121 - DNA, 1049 bp, Homo sapiens
cccacgaagatgggagggatgcctccatgggcttgcagatgtggaattccatacaaggaatgctggaggagacctggacaaatcctggtccagcccctcaagccatcacacaggtgctttctcatcacaaaagatacaatctctgtttagaactcagaaattgtgcctttcatgaggtcggcttagtctagtttttgtttaactagttggtaaggcagtttttaccagttaattgcaattggaattagtgaattcctgtgaccatttggactaacaagtcaagcatctaaacacagggcactgttgtgcctgccgtgatgttttcccacagccatttctcttccgttctgttttgccttgcattcctgatgcatgtgttcatgactgtgacctgctttgaagcttcggcttgtggcccagtgttgtattgattacagagcatacgcccatcgtcttatgtacgtgctctcaggacctcagaaaggtccagacgctttttctgtaaaagtgtgtgagcctcgggcctaaccacgcccatgggacctgagcagtactcagacctcacccagaggtgctcagatcctagaggattttaacactgccttccaagtcaagtcccatctgtgggtgatgtcattttgtaactcccacatctgggcagttgttgcctgcctcttttgcttctacaagttgagatttaaatacatttttggggaaggctgtctctctaataatgcttatcttctgaaaagctgtgttcacctcagaaacgtgcagatgtttaaaaccgctttgccatcatagtggccatgtgtaacttagagctttgcaggatcattttgagcatcatattcacaatactaggttacagagagcatacaacagccagctgctcagtaggtaacaagcttactgccaaggacacctaactgggaaaagctaagctaaaattaggcacctgtcgcgtggagcagagaagcaagcggaatgcccaacacagactggactggggtttgtgtcagcctgaattcattttcatcctttgacct

SEQ ID NO: 7122 - DNA, 1062 bp, Homo sapiens
ttcagcttagctattccatgtcagtatgcatgttatgtaatgccttgatcattttataactcaacacataaaaccatttttatttacaggaatcctagtaaatctcatctgcggcatgcgattcctagtgcagagaggggacctgggttattagaaagtccttcaatatttaacttcactgcagatcgattaattaatggtgtccggagtccacaaacaaggcaagcaggtcaaactagaacacggattcaaaacccttcagcatatgccaagagagaggctgggcctgggcgtgtggagccaggcagtctcgaatcctctcctggtttagggaggggaaggtgagttgttgagcagttactgtgtaacatcataaactaatattttaaaaattatttaatttagatatgttttgtaattgtctttaaatatgtcacagaaaatctaactgaaggctataaacataagggttttatataattgctaagacttaaatggcttcatcttttttggaatatgaaatggttcagtgagaactgtagttgttttagatcattatttgtagaaacactggagctcaatagccatagactccatcccatgtgcctgcagtctcctcttggcagcacccctggctcaccaggcccctctgcaagggcggtgtccaggctctgccccatggctgctggcctggcgccctccagctgggtgtgcaccaggcactgcaggtggagcctggagcgggtaaccaggcagatcagcattgcagtctcatctcattggagggttgagactagccaggacgggtcttagctgtgcttcctgcccaccatttttggttttgtttaacatttttttggcatcaatcctgtagtaggtttttgtttgtttgtttgtttgtttgtttgtttttaagacagggtctcactccgttgcccaggctggggtacgttggcatgatcatggctcactacagccttgaacttctgggttcaagcaatcctattgcctcagcatgctgagaagctaggacttcaaatgcacaccaccatgcctggctag

SEQ ID NO: 7123 - DNA, 1053 bp, Homo sapiens
ctatcctcttttaaccaacccatttgtgttttcatatttaaagtggatttcttgtgagcagtgtgtaattgggtcttgcttttcttatccaatctgaaaatttctgtcttttttttttttttttttgaggtggcatcttgctctgttgccaggctggagtgcagtggtgtgatctcagctcactgcaacctctgcctcccgggttcaagtggttctccttcctcagcctcccgagtagctaggactacaggcatgcgccaccatgccaagctaattttgtacttttagtagagacagagtttcacaatgttggccaggatggtcttgatcttttgacctcgtgatccgtcctcctcggcctcccaaagtgctgggattacaggcgtgagccaccgcaccgggcccaatttctgtcttttaattgggagtgtagcccatctacatttaagaggttaatgatgtaatgatgtgattaaatttaaatttatcatcttgctgtttgttttctgttttgtctcttctttattttctttccctttcccctccttttgtttgggattaaatgtgtatttttatctccttttttggcatattaggtataactctgtgtttctgttttttagtggtgctttagggcatgcttcttcagcccgtgggcggcatgccgcccaggacggctttgtatgcagctcaacacaaatgcgtaaactttcttcaaacattttgaggtttttttttttttttttttttttttttttttttttaaagctcatcagctatcgttagtgttagtgtattttatgtgtggcccaagacaattcttctacttccattgtgtcccagggaagccaaaatattggaccccctttctttagggtttttagctgaccctctaactttactagagtccgtgtaattcacagagcaccatgcctctttaccttacagccatgctctcccatttacagccatgctctcccattctccacttctagcctgtgctgttgtcacacattctaattctacacagtcataagcctcacaatacatcgt

SEQ ID NO: 7124 - DNA, 1046 bp, Homo sapiens
gaaatgagtctcaaccagacagccaggaagacccccgagaagtacttaaaaaaacattggaattctgcttatctaggtaaggctggtggtggtttttctagtacctgatatttctagtattgtgcaaatagttaaagtatatacaaatgtgatattttatgaaggagtatctactcatatccatatatatgtatatgaagacgtggaatattgagtaatgacagtcttttgacatttgagcatggaacgtaaccttcatgtctgtggtccccagtggtctcggtggtcactgtctggaatgcgtctaaagtgccccgcccgccctgtgctgccgagtcagacttcctcacactgaagttggagaacaagtgtgccacgttgtttctgaaagcacaccagacactgagatagcaagttgttttatttatataacactcatttttaatcatttttctttcccctgaataatacccttttcttagtaaaacctttaaagttccaatggcagaactggacataaaggaggatgggattgggtttgatgtaatttctctgagtatgacaacaaccgatgggccgtgtataaggttttctgtcgatgatgattttccaggtgttttctctggagccctgaggattccacacaggtgtctgctaggggctccttgaagcctgtggggtgtatgaggtggaggtgtgaggggctctgctggcctcctccccatgcccatgctgttccacgattggagtctgagaataccgcaccatgacatggtagacgcaaaaggtgcaggggcaccagtggaacgccctagtggagcacaagtgtgagctctctgccactcacatccatgtgtagccccatggggccagaatcagctacacctggaagatggccgagatgagggtggagcagggcctcctcctgcatggcctccgtttgatcggcagtcatgggccttcaccgagggacactgagcagaggccccaggaacccagcactgtgctcagttttgaaatgtttcttagggccttgttcactacat

SEQ ID NO: 7125 - DNA, 1057 bp, Homo sapiens
acaacagacgtgtgatagaatttgacagtgtgtactgtttttgtctgacttaggttactatttttgagactgattcatgttgtaacatgaattaatcatttatttttattgctgagaagtattcatgatatggatagatcacagtttgtttttctattcccctattcatggattttgggattgttttcaaaatgtggctttgccaataaaaagtgttcataaaagtgaacatttgtcagcaagatttcatataaacatatgttttcatttctcttgggtaaaatacctaggaatggagtagctggatcatctggtaggcatgtttatccttttaagaaatggtaaggcagttttccaaagtggtggtaccattttctattctcaaccagtggtggattaaagcaccacatccttatgacccttatgacctcagggtcagtctttaattttagctgctgtaaaagggagacagtagaatcttactgtggctttaatttatgtttccctaaggactaatgctatcaaacatcctttttaaaaaaaagactgttttttttagagcactttcaggttcacagcgagttttagtggaaggtatagagatctcccatatactcccctcccccccacccccacacatgcatggccttcttcactattcacactccctcaccagagggtgcctttgtataattgatgatcctatattggcacatcattattacctggagtctacagtttacatgagggctcactcttggtgttgtacgttctgtgggtttggagaaatgtataatgacatgtaccctccattgtagcatcagagagagtagtttccctgccctaaaagtcatctgtgttctgcctactcacccctccctccccccaacccctagcatccattggttttttcactgtctccatagttttaccttttccagaatgtcatagggttggaatcctgcaggatgtagccttcttagataggtttctttcatttagtaacgtacatttaagcttcctccatgtcttcaaggcttgataactcatttctttt

SEQ ID NO: 7126 - DNA, 1034 bp, Homo sapiens
taacaaagcagatagtatccttcctgttggtctagatagaattgatttaagtcctaagaggcctatcactgcagtaagatttggaagtgggtgtctctcaggtcacgctaattcaagagaagcagccccaagccagcttgatgactgctgggagccggaacctgtccccagacaagtcaggaaggcacagcgcagaggggactgcagcctggaggccagaagtcccctgctgccagacagaggtgaggtgtctctgcaatctgaaaatagtgccttttaccaagaagaggacagaattggcgtttggaaggctgagggtcatggtgtaagggcttttgagtcaaaatcttggtgtcaagcagatgaggctgcaacacagacctgtgaccaaacttgtgtggagcgtgtggtggacacgcaggggacggtgcagaggacagatggcctaaagcttagcatggcacaaggagtgccccccgatggcaagtctcccagtcactccagatctcttcacagtaactgtgtttcctccgcatttattttcacctgcacagaggaagaagagagggaaacaagcccaggtgacaaaacagagggtgaaatatgtgtgaagagttcagtcagtgtgtcacgagaccagctgagtgaccctcaaaggttagaaggtagtgaaaaagaatcactgcaagcaaagtatagtgagacaagtgaagatgacatagagactgtcaagtcagattctaaaacaacctatgagtgggaaacaggtacacaaagacatgaggcagtgccaagtcaggatgtactctcctgtgttagttctagtgcaacagagaacgctgattttgaaactaatcaaatagaaaaaagttatgaaacacaccgagtatacgactgcaaatataatgttcttagtgtgttaccacatttcagtccaagtgttaatccagttatacagaagtcagaaatagtagagaattctgttagtggtggtaaaagcccaaaatggaagggaatttcctctgaatcaattg

SEQ ID NO: 7127 - DNA, 1029 bp, Homo sapiens
agacttgtcacaggagcagagccactgcagagagcctgtactcgggcaatggcaagcagaaatttggagttgaacctgctgcagagaagcccccaccagggcattgcctagtagagtcatgggagtggcctgggagccttaaactgtggagctgccagcttgcagcatcagcctgggagagctgtgggcaggagactccaacccctgacagctgctgggtggactgagcccagcaaagccatcgggtggggctgcttgaggccctggggagccaaccctgttccactgtgcccagagggttgggacatggagtcaaaggagatgattctccagagaggcttaatatttaatattgtctgccctgttgggtcttgaacttgggacctcttgcttcttcttgcctatttctcccttttggaaatagatttttttttcttttcttttttctgagacggagttttgctcttgttgcccaggctggagtgcgatggtgtgatatctgctcactgcagcctctgacccgctgggttcaagcgattctcctgcctcagcctctcaagtagctgggattacaggcatgcaccaccacacccggctaattttttgtattagtagagacggggtttctccatgttggtcaggctggtctcgaacttttgatctcaggtgatccgcctgctttggcctccctaagtgttgggattacaggcgtgagccatcgcacctggtcgggaatttttttgtgtgtgtgcctgtcccaccattgtattttggaaacacataacttgttactttcaacactcagggctggagaggaattgatcttggggtgaattgtgccttgagtctcaccctatctgattcagatgagactctggacttttaagttgatgctgaaatgagttaagactattggaggtattgggatggaatgagtattttttgcattataagaaggacatgaattgtgggagctggaatggaatgctgtgtttttcatgtgtcccccaaagttcatgtgttggaaaa

SEQ ID NO: 7128 - DNA, 1412 bp, Homo sapiens
tcgtgctgagacggagtagatcctttttaatgtaggatatttctttttgatgacatagtattgtaacattttgattgtagcattttggccactgacagaaggaatgccttctataacacatacccgtgatcttttcagctccaaggcatatttaaaaatagagggatttcttcattctctgtttggcttactattcttagttgtatccttgtgtaaatgatttacatgctgctaaaacttctcttgttgtggaagtgtgacagatgtaatagtagtctttcaaggcactgggatcagtaaaaacatctctcaacttagaacattttgtaatttctttaaaaaaattagtaattttattgcttagtatttgcatcatttagaatatgacaaatagtttttttgcaaactctttttcattttaggattcagtttaattgctattaaggcattttgttcaatagtagatttataaatcaactttgtgtggcagtaccatgcaaacagttgtactgagagaatagtcacatcactgggaggaagcgacagatgtgtcggagtccgctgcctggcaactggctgccttcctaggccccggtgtccttacatgtgtgtggaaatacaacacatacagctatgtgcacagatcgtaaaagtacaactcagtgtatttctgcaaaataaacacacgtaggtaatccactgccagatcctgaaacagcaattttcagttttggcagcaattcgaagacatgtcacaattatagaaattgtgaaagtaggagaaacgtgtatcttcaaatcagggaacttgtgtagatgagatacatgagtcacgcaggggtgtcagagtttctgagatggtcaggctgcttcattttttgtttggacttctcatctcatggagccagtgcttctcacctggacagctgcagtcactcctcactggtgtccccaacccacccttcctttctaacacagtggccagaggatcccttcgagaaggccaagtcagaacctgccactcctgtgctcaacatcacagttagcctgagttctggcaggtccctagccttcgtagtctggcacctgtcctctctgactctgctgcccactggctctcctctggcacgctgctccagccccagtgggctcttgacccttgaccattccagcatcaccttaccgcagggctctctgcctcaattggttctggtgtgcccctttcccagaagtctttgaggcttatgctcttacctttctcagtctcggcctcaccttctcagcgagccccatctatccgcatccgtctcctcacttctggcttgcctcagaccctttacgtgtagcagttagcaccttctaacaatgttaggtatttgttagatttagtgtttgtctccctggactagaat

SEQ ID NO: 7129 - DNA, 1080 bp, Homo sapiens
ctgacatatagttgtttatttgagatggtgttgtatttttaagattgtcttgtgtgtctagaaagaccataataactgtttaatcatgcaataaacatttctggtgtacatgaaaagaaatttttagaaactgatttaagagagttatggtctcccaagtgttgaacaaggttgataaaacttcttttttagactgtagctttgacagatgaggttaaaaatgtgttactagcatagaggccacagataggaagggagaacacttggacttatcctctctgctttttacataaagagacattaaataaaatcctcctgtccaattcagtaaggcctgcgagtggtgtaaggcactggcgagtgcggagcccgccttcaactccttggtcggctgtgtggaagtactttgctttggctggaggattcttttctcccattgaatatttccctttacaatctagagatctgcttttaggccatgccgggaggcaatagttgatatattttaaatctcaaaatattttaggtctcttgaaccagtaacaaaatatttgttatttattgaaacagctgtcaatacttgtatcattctttaaatctcattttagattcacacattaggtaagttaaaaaagcattaaaatgatacgttattaactgtttaaatgaggtgactatcagtaatcccttctgttggaaaactttataagccttttttgaaaaactgtcagattagtaattaagagatatattggtgtaaaggttactttttttaataggtaggatgcagagtgttcaaatcgggatcactgtgttgtgctgagactgtggcatggttacttttttaaccttttattatagaaaatttcaaatgtacaaaggtagacagaatagtatagtgaacttccttctctcaggtggaagaataacgatgaacctcagggtctctgccccacatagtactttgaggaagatttcacacattgtattattttccctgtaaatatttcaatatacatctctaaaagatagggtttcctttttattaaacataaccacatcgttatcacatctgagaaa

SEQ ID NO: 7130 - DNA, 1572 bp, Homo sapiens
attatattgaatctgtagcttaatttggggtttgttggcattgtaaaaataccatgtcttcccatctgtaaacatgggatgtcttcctcttcataaacatggatgtctttccatccatgaacatgggcatctgtccttgagaactgggttttaagggtttgtattagtggagtggttctcaagcttttggtctaaggacgtctttatgctgttaaacattactgaagatgcctaaaagcttgagtttattatatggtttgtctccatctgtggtttatctctgtctgtatttactatgttaagtatcaagaatcaattaatattataaatatacatttttaataataacaaacccattaggtaatataaataacattgtttatgaaaggtagtagtattttccaaaacaaaaaataattcagtgggaagagtggcattgttttttcatgttttgtaaatctctttaatgtctgacttaatagaatcttggctggattcttgtctgcttttgcatttcatctcttagtactgtgttattttggttgaagtgtgtgaaggaaatctggcctcaggtaatttattttattattttggtagtcatttcatataaatgaatattgaatattctttgatgctataccaaaactccactgtggttttgtgaggagagaataagagtgaaaaaagcaaagaacatctttgcattattttgagaatggtttgactttgtggccccactggaagtgtttctgggactctggactatgcctacaccacacattgagaaccattatcttagtgaacaggactgagcagtgtagtttcacaagaaaatttgctcactgaattgcacttgattaatctgtattgaaaaacaactgcaaagtgacttagatgcttctcctgcatgggcagcttctcctgcgtgggcagcagtgccctttctgtgggaaagatggcaggggaccttggactcagcaactgatggaatcagcaagctggatgttttatgaagacgtgtaataaaaataatatgttatttaaaaaactgagactctgggagatgaagtcaataagttaatcacacattgttagtcttttggcatattttcttctagtttcttgtttttacgtacttataaaatttgaatttttataaatatattgcaactttagtatctacagttttgtcttttttttaaatctttatgcagtttttgtgagtattttaagtaattgtaacatactgcattcgtttctacttttcttttctttttttttttttttgagatggactcttgctctgttgcccaggctggagtatagtggtgcgctttcagctcactgcaatctccacctcctggattcaagtgattctcatgcttcagcctcccgagtagctgggaatttttgtatttattttagtagacacatggtttcaccagcctggttaggcaggttggacttgaactgacttcatgtgatctccctaccttgtctcccaaagtgttgggattacaggcatgagcctactttctgcgtttttatttccatgggatttttttttttcta

SEQ ID NO: 7131 - DNA, 1055 bp, Homo sapiens
cggtggttgttttgtattatgttttagtaagaatcctagctaaaatggtcttttcaaaagattgtactctccagaagataatgtcgtagacccagtcacaggctttaacggtggaggggaccgttgtcctttttttgtgtgtcgacttagtagacacgttctaaatttaaaatcaggaagattttgaaagtatattatttggtggtcttctcatgtaggtactttttcaatcagatcttgctaacaaataagtttttgtatcttgtgtctgattatgtcctccttaggaggagaaccaactcaaactataaataaaactcacattttctcactgctgtttttttcagtagaagcaccgatgtacacatataaaggacattttacaaaattagtcttgaaatttattggcaacatctccttaggaatactccagtgctgagtgccagtttaaatgtataaacaactactctactgagattggacgcatttcttttatccgtcagtatctttgagtgacacacttactataagaacatgaaacgaaaagaatggaatatcatagagatactgaatcttgaaaaaaacaaaagactaaaataacagttttgttggaagcagcagtctgttgctctgtaaatgttcccactattcaagcttacagattcacttgagtatatgatgtgtataaggtacatggaaggaacataaaataatctgccctaaggtgctctcacattattctattgtaagataaaaatgtgcatttcaaatattacagagtggtgctggcagccgtgagataaaccatatcatccaactaacagcacaaggcagatggatgaggaactagaattcctattgtattttattttctgcacttctctatttagatatgcacgtgggaatcataatgaaaatttctgttaagaaatatatccttctgctgggtgcggtggctcactcctgtaatcccagcactttgggaggccgaggcgggtggatcaggaggtcaggagttcgaaaccaggccaacatggtgaaacctcgtctctact

SEQ ID NO: 7132 - DNA, 1056 bp, Homo sapiens
ggtcactgtacactgtgttttatgtatttttattttatttcattttatttatttatttttattttatttttatttttatttttattttgagacagtcttcctctgttgcccaggctggagtgcagtggcatgatctcggcttaatgcccccccaaccctccgccccccaggctcaagtgagcctcttaatttagcctcccaagttcctgggactacaggcacatgtcaccacacttgactaatttttgtattttttatagagacagggtttcactgtgttgcccaggctggtctcaaactcctgagctcaagtgatctccctttcttggcctcccaaagtgctgggattacaggtgtgagccactgcacccggcctattttatttatcttttaggggacagagtgtcgctatgctgcccatattggttttgaactcctgagctcaagtaatcctttagcctcagcttcctaagtagctaggactgcaggtatgcatcattgtgcttggattgtgtttaattttcgtaggtgagaagaaacatcagaatttttcacttgtgatgtcatgttggtgctcaaaaagttttagattttggaggatttcagatttcagattttcagattagtgctgctcagcttgtattctgtcagtgttgcgtgtcaaggtttttttttaacaaaatcaatttatgtatcatttcatggttctctgactcattgttagggacaaatatgccttcccatttgagccgcacaggattaaagcagctccgagctgcttcccagctctgacattttgccattctaaaaaatgagtttactcaccacttccccatcttactctttgagtattatgtattttcaattgaaaactgtagttttgtgatgatgaattggaaagctcaatagaacatgatctgtattccttgaagaaatgcaggatccactggaaatgaggtggagagagaccttttccacccatcagagtgaagcggtgtactctacaaggtgcattcctgacgaggaaggccctgtgtgctgtgctgccaattctgg

SEQ ID NO: 7133 - DNA, 1057 bp, Homo sapiens
cctcccgggtctcggttcaagcaattctcttgcctcagcctctcgagtggctgggattacaggcatgcgccaccatgcccagctaatttttgtgtttttagtagagatggggtttcaccatgttggtcaggttggtcttgaactcctgacctcatgatccacccaccttggcctcccaaagtgctgggattacgggtgcgagccaccacgcctcactcgacttttttttttttttggctgagtcttcctctgtagcccaggctggagtgcagtggcgtgatctcggctcactgcaacctacctttcttttttatattggcattttaccttaagagaaaaacttactttcctttcccccttatcattttgaccatacaaagatctctgtgtacaagggaaaaacaattagtctcttttcaactttccttacatcttttaaaatatgctctgtatataaaattgtttcttatacctaatagttttaattacgtatattaactacaattttaactcttagtaactcgaatttccagtgaaaaacccaggaagtaattttgaactgttttataccacatgacaacaatttctgaatatttcctcaatttttgtttataacctaaatatattttgtttataacctaaatatatttaacttttctgtaccctataaatgagatagatattttatgattacctgttaattaacataacatggctttaagattaaatttttgaaaagggtttgtgaaactatgaaaagtttgtttataaatatcttatttacattcatctaatttattcttcgttatttttatttttttttgagacccagccttactgtgtcacccaggctggagtgcagtggcttgatctcaactcactgcaacgtcagcctcctgggtttaagtgatactcccacctcagcgtcccaagtagctgggactacaggcgtgcgctgccatgctcagctaatttttgtatttttggtagagagggggtttcactgtattggcctggctggtctcgaactcctagtgatgggattacaggcgtgagc

SEQ ID NO: 7134 - DNA, 1056 bp, Homo sapiens
ctcccgagtagctgggactacaggcacgtgccaccacacctggttaatttttgtatttttttgtagagatgggttttcatcttgttgcacaggctggtctcaaactcctgggctcaagcaatcctcctgccttggccttcaaaagcactgggattacaggcatgtgccatcatccccggcctgtctgaaactctttttgtgatgttagtgttgacctaaaatgaagaagctgagtgaagagtttatttgggccaagcatgatgattgcaacccaggagcatagaccaagttgctcagcggcagttacaagtggatttttatgatgggatgatgtatgacggtgctgggaaggctcattctcagccctcagtcaagtcactgatttatgtaactgtcattgcttgttaaatcttctgtagtctttgaatttcatgcttttggttttcttagaggtaaaacaataaaatacatagtaaaaatcctattacattggagattcaatccaaattgtaggaaaacaataaaaactcaaacacaatggttaaggctggaatctaataacatgggtactatagttttcttatgaagcataattttttctctctccagtccccatttttactgaagatataaatcttaggaggaccagcttacttgcaaaataagttttagtattatacttgggctgattatttgcataaaatgcaacaagaataatgattggccatataggttctttaagttgtctttgctggaactttcataaggaattttggattcaactataaagcctcaaggctaggaagccaagccaaggactatgctggtaatacttacatgaattgggtgaattcctctcttcttgaggtcgcaaaatatcttgaggttcctgggcttgtcagaaagtaagattgttttacttgctgcacatcaggaaccttgtaaaggagccatgtaaacaaggtaccaggctagtctttccaacaggctttttattggctctacatagtcaacctctgttctttaaaccagtctggtcatatcttaaaatacgcc

SEQ ID NO: 7135 - DNA, 1033 bp, Homo sapiens
gatgagacttgatctttgctgaaagtgttctttatgaagtctgatgtgcataaatttgcccaataaaatgctcttttatttacacaaatcattttagtcgcactgtagccagagtgtggcatagcctgatggctggcctcttttcagaaactcatcaggactgccctaggcctcgccctgtgtgtgcttccacttctgtgtcttccttcttgccctgccccaccttttaatcaggaccacgcctccctctcctaccttggtgttgcaaacgttgtagccattgctgttggtagattctttgactgaaattgaatgtccacctcctttaaaaaaatttttaaaatatttacttagctccttaaaccatccttaaaaagatattttaggagtcctccagactgctttgcattaacttctgagattatgcttctctgtttctgtagcaactaagtgtacctttgtgttacttagcacataattaatgtaagctccttgtgagtgagattctctttttatgcttgtcacctctgcccagcccagggactggtaaactgtagatgtttagtgaaagtaattcaagtaaagagataagaatgctcaaagacatctcccacctgtgttccagagaaattgtttgctgattgtatacttgcacatttctgtaaacaaataggaaaatctttactcaaaaagcatacattagaaagtttcttatagagtataaaagttatatttacaagtttttaactgacttttcatagctacatttagcgcataaagtattttcagatagagtaatttagccacatgacctttaaattatactgtttctcagtctttaaaaacgtgccctctttcggccaggcactttgattcacgcctgtaatcccagcactctgggaggccgaggcgggtggatcacctgaggttaggagttcgagaccagcctggccaacatggtgaaaacctgtctgtactaaaaatacaaaaattagccaggcgtggtggtgcgtgctcgtaatcccagctactt

SEQ ID NO: 7136 - DNA, 1072 bp, Homo sapiens
gggagaagacatgaacactgaagtcatgtttttggaaaataccttgttaaaaacagacactgctgtaagggtttccttgcttatgctcttttgtagaactttattgatgtgaagagttctcctttttctgtaaaagcttattttagagtacgaagtaaatgaggcactcagagagttaacctcatcaggtctgagtttagttcagtttaaactttttgctcttatgctggttgatatctttgtaactactctacttctagagttattttgattggaaaatgaattccttttttagaacatggaattgtaaggtagaaaactgctaggttctcaaaagaagggagataaattccaacttgaaagttttttcccctaacgttctaatgctttgtttttcctgtgtgtaaatgccttccttaggaacaaggaaaattattaactcagctgtgtttccttcccttctctttctcactgcccccccgccaccccataccttaataccttttgtcccttcaatgcctttataaactctgtcttctcatagtttttctggtgaagctgtcatggctcctatttcaaccataaaggatttgcagttcagtgatgctactggttttacatcttctttcccatcaaccccattgccctggttaggagacctagaccatggagtacattgcaatattgaaagtatttcatgtttaacacaatttttttttttttttttgagaccgagtctcgttctgttgcccaggctggagcgcactggcacgatcacggctcactgcaacctctgcctccagggtttaagcgattcccctgcctcagcctcctgagtagctgggactacatacaggtgcgtgccaccacgcccggctaatttttgtactttagtacaaattgggtttcactgtgttggccaggctggtcttgaacttctgacctcaagtgacccatctgccttggcctcccagagtgctgggattacaggcgtgagccactgcgcccggccatgtttaacacaaatttgaaagcgtactgcttagttttttagggggagtatgataatcat

SEQ ID NO: 7137 - DNA, 1050 bp, Homo sapiens
tttgtttttgtttttgtttttttgttttgttttttttggcttgtttacacatgtatctgggcagagaaaacagcttctgagcacagaatgcatatttggagaaagcagttccactctttttgagtaggaaccagacagaaaaaaagataacatgggtactattctgtagaagagtagctgaaattaagtggcagcaaattcagggagaaatgtaatttggtttaatgttcgggaagattgccatttttaaaagtgagatttaaagaatttattgaatttaatgcaatttccataagtaagcacaagttttgacaagtatatatttaaggtgtttttatgaagcagtcttcacattatcttaaaatgtagttctaaaatacgtgcaggctgggtgaggtggctcattcctgtaatcccagcactttgggaggcctaggtgagtttaggagcccaggagttcaccagcctgggcaacatagagagacctcatctctaccaaaaaatcaaaaaattagccaggcatggtggctcacacctgtagtccagctgttggagaagctgaagtgggaagatcgcttgagcttgggaggttgaggctgcagtgagccatgatcctgccactgcactccatcctggacaacagtgagaccttgtctccccccacccccaaaacatgcaaattgggacatcaaattgttaatggtgtttacaatgaacagtgccttcaggtagctgcagctactctacatagatttgcaagtttttgtagtgataggctatggtagatgttaccagccaaggagtggctgacaaactcctttcactgttatttcattgtcatgttaaaattcatattttccgtcaaaatagtgatagctaggattataatctaggtcttctaatcttagtaacgtgttgtctatgttagggcctctcaaagttgtaaaaaagctgtatagatgtgttaccatcaatcgatttcatttgtttttatcctagtgttaaaggtacaagtttttttttttttttctttcctgaggcggactttca

SEQ ID NO: 7138 - DNA, 1049 bp, Homo sapiens
gcaggggaaggccggggccgggttgaggaggaccggggctagggcacgggaagggccagggctgaggaggaccggggtcagggccaggaaaaagccggggctgaggaggaccggggccggggcaggggaaaactggggctgaggatggccgaggccggggcaggggaaggccggggccggggcttaggaggacccgttgaggcgaggcgggagtcgacggagctgggtgcccggaagaccgggccggggtcagggtcgggaggccggggttgggcgaaggccggcgaggacgggggtcgggcagggcctgggcggggccggggtcgcgggccgcgagcgcccccaggccgggcgggcgccggcacccgcagtgcggcgccagccttgccactcgctcctcggtcccgccggagcccggataggcggccgtgcgggtgcggggcgggacgggtcatcagggcatcgcattcctttagaaccaggaagttgggatcctgttgctcggtgtgtgtttggaacgctcctgttttcctgttgatagacttgagcagaggtggatctgaaggagttaaaaaaataaagtcagatgtgaagattgcctgtgttggtcttggggctgggatacatgggcggcagagaagccatcggaaagctgctgcacctgcctctcagggtgcgcttgggaacgtgaagagtctttccgtttcagtgccgttgtgcgtcgaaacttcatgcgaatgtaattttgcttttccccttatttttacgtaaaacgttcttaaaacttggctgagatgaaacttgagaaacctagctgtagaaaactacctcctatctggctttcgtttgagattctctaagtggatgcccaataacttgtcttaatagtaaattggaagtttgaagttttggataactgagaaaacaggaaggttttccttgacagggcagtggagtttgtaagtataaacagtatgcgtgaggcctttttctagagatgagagcaactccaaggtgaacattgaaggggacagacaagttattttccc

SEQ ID NO: 7139 - DNA, 1023 bp, Homo sapiens
ctccagcttgggtgacagcaagactccgtctcacaaaaaaaaaaaaaagaagaaaaagaagaatgtcacatttctagtttgagtgactgcccctttttttaacattaaaaaaaaaaaaacttatctgatcgggaaaaaaacgcaaacacttgaaactaatgatgtaatcatttttccatatataatattaagatttccatataccattgataggagattaatgctttaaccaagttctaatcctaaaactatactgctgttcgagatatcgctgtaatacagtgagctaattttagattttttttgttacggtggccgatgttttaattacttttttttttttaatgtcttaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtttttagtaggctgtgataaacat

SEQ ID NO: 7140 - DNA, 1033 bp, Homo sapiens
ggagcatgactgtgataaaaggccagctgtgaaacctgtaggagaaatgatgacccagatagtgctgagcagccggctggcagcgttcttggggtccctgtggggatgcagagtggtacaactgcagatggggaagcagcatcattattaacctgtgtttatatgacattcagaaaaatatatgatggcctttctttctcttttcctttaatattagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggtgctgctttgaaacagtctttcttgtaaagcgatttgtgtaggcatttccgatttgctgagaagagcactctgttcaaggaagtgcagtcttcagtaataccgtattttctcgttggttccagttcgttaaatagtgtggtcattagcatctgctttgctgtcttcctgttacagcgatttctcttcacttcatgcctgttactcggcttcttcagagttattctggattcatagaagagggactagccctgacatacagcagcagcctagcctctaatatttctagagagtggagagaggcgggcaccatgcagggaagcatgtgccttcaccactttccgagaactgaatgtccttgatagggaacttgactgccggaaaggggccaccagcatcaccatttccttcactcgacggccaacttccttgcccagtgcagagctcttcctcaccatagccatgcagagactatgcatgtggataaaccatgggaaaaagcaaaagcagcagcaagttactaatgttattctgaactgcagggagagaatttggcaaataactggtacttaaggctaaaataattgttatttcttttgctttcaggattattgcatcgagcttttagtgtcttcttattcaac

SEQ ID NO: 7141 - DNA, 1068 bp, Homo sapiens
ataaactctgttacttcttatatatttcaagtgagttctggatttttctcttttctcttggaaacttgattttcagaaacctgtgcccagcagctctggtggagatgcccacgttccccatggctcccaggtcattaggaagctggtcatggtaagaaccacagcccatccgggttgccagcgggtgggtgcttccctgcatggctgtgtctgccactgatgttcgaatgttcctccgtccgcctgtctgtggggctggcgtgtccctagagttgcgagttcagtgcatcctttgtcactgccaccctgagccttttctctctcagacagtactgagtgaaggccctggtgggggtgtgtcctcctgtgccgaggagggccctggtatggggtgcgtcttccctgtgcccaggaagagggctactgctctgggtggtctcctcccgggcaactcacccttctttgaacgtagctcccgagctgagtcgatgccagtggagcggtctgacagatcctttccgcgactcagcctggtgctgatgctgtttggtttggttccttgtggagtagagtgatttaacacattcctatgatataatatgatatgaaatataaatatgtaactgtgatataaacggcgtagaatgaaatgtttttaattgaacagtatacgttaaggcatcacgtcaagattggaggacttcatgtcagttttacagtgagaaattgtgtggagtgacggaactgcagtgccttgctctcgcgccccagcacctggctgcagagtgtcacggagatgggacccctgagatggctccagtcccagtgccgtgggcagtgcgtgggagcacagccgcctctgacccctgagtgggtccagtcccagtgccgtgggcggtgcatggcagcacagccgcctctgaccataccgtgtccctcaggaacccaccttcaagccctggcagatgaagactcacttcctgatgcccttcccggtgaattacgtgggtgaatgcatccgaactgtcccctacacggacccagatcatgccaggtaggagggtgtag

SEQ ID NO: 7142 - DNA, 1077 bp, Homo sapiens
tgaattcttttgatgcttgcgcgtttgttttctcagatttttaggcagttgtgcttggttgcctgttctttgctttgtactcattactatggtagaacttttaaaaagggttcccgtggtgggagagactgttgtctgctgtgaagggaaactctccagtaggttccattgttttagacatgagatatgatttaataatttgacctgcagtttctctcagctgttgtaagttattttccatgaactttctggtgtcttctagttatctcacctgtttgtagtattttatatgggagcattttgtgcatgtgtagttttttaattgttgaaacaaggaaaggacatgaaatcacctaatgttcatttttatattaacgtcaacatgtattttgttctaataacttacgaagtattgaatgggaaatgtagttctagccttttagagcttaatagtagaatgaacgctagacaaaaaatagaattctatattatcttcaattagactaaaatccaagatctgtagtacttgaaagtgcaaacctttttacaactaagatgtaatgaaaatgtttagtattgatatgtttaagacttaatgaccataataataataacagtagaataacagcatatatgaattctgtgcttactacataggcaggtatggtggtaagcattttataaggcttgtgtacttgcatcagcaaaacaactcttgaggtgcgttctattattactatttttaaagtgggaaagtggaaccacaggaccaagaacacaccagcagaagcttgttgagtgttaggatatagtaagatcttgttttcacttggcttttgttgttgctgtgattgctgcagaataaccagcataagctgactttatcgatgaggccagatgacaagtatcacgagaagcaggcacaggtggaagccacgaagctcaagcagaaggtcgaggctctgtcccccggagacaggcagcagatctacgagaaaggtcagaggcttccttccgagctggcgagtccctaacctgcactcgggcctagtggacttgttagtgagttagtagttg

SEQ ID NO: 7143 - DNA, 1031 bp, Homo sapiens
attgtgccattgcactccagcctggggggacggggcgagactccatctcaaaaaaaaaaaccccccaccaaaaccaagtgtggtggtgtagtcctggtagtcccggctactgaggaggctgaggctggaggattgcttgaggctgcagtgagctgtgacggtgccactgcactccagcagatgcctgaagccaggaatagcaccatgccctgtgaatgaacgttgaatttataaattaggcacagcgagaggttaacaacaataactaataataaaatagaacaattataacaatatactgtaataagttacatgaattttggtctctcgaagtaccgtgatatttttggaccttggttgagtaagggtgactgaaaccgaaaggcgagaccttgggtaaggggcactcctgtgctgtgtttcagtgaaacagacagcacttgatctcacatcttttaaactaaaacagactaattatattcccttaaaattttaggttcttcacgtacggtaattttccattagaacagcatctgaaacaaattcacgaggaagcactgagcaaattccagaaaattgaaccaagcaccgtggtgccagctcagacaccctgggacaagcctgtgagtgccccaccgtgtttgtgtccttcctggtaaatatgttgacatgaggacttggactgggtattgatgatgggatttcagatgctgtcatgtttggtacagagtatgggagagcttttcaagctgaaagaatggtaatttgtttgaaaggaaagttaacttagtggaaagcctgtttcgctccatttcgtgtatccagataacctagagtagttgacaaccgtcagacactgtgcctactcacaacgtcacgtcattttacagagggaattccagataacatgtggcccggattcatttgctacagatccctctaaacaaacaaccatcagcgttagcttcctcttaccggagtaagtatatgctgtcaaagctcatacaagacaaaaacatgaggaaaatgtt

SEQ ID NO: 7144 - DNA, 1050 bp, Homo sapiens
agacgctacagagatttgcaaaaaaggcaacacagcaccactctaatcagttttttactttgttatgagaagtatttttcaaaaatatttatatcaacatgtaatgatggcttaccttaatgaataagtattttttaaatgtctcagctttaatttagaatatagaaaaattatataaacacacacaggcacctacacaggcaaaaacgcccacataatcaaaagctgtttgggtcctcattaaaacgcatttatgcctagtgttccattattggcaccctaagcttgtgggagttatttatgtcctacagctcaaggtcatcgccaaggtctgattttttacaaaaaaattgcaacctcaggcataaatgggttaatttttcagagtgtaaaggattcttgagaccattttggattaagagctgctgtcctgggcccatgtcttcatgtccctttgtgacttggacaacctgtctgtcctggtgtccctgaggctcatgggtggcctgctctctgattcccgtagctcctctcggctggtgaactatttcttaccttttcattctcaatttggtggtcttttcttccaaggagtcttcttgaactcaagttggggtgacagcttctccccacttccctcacggctggtgggcagaccgactgatccatcccgatttacagccctcagctatgcgtttgttgcaccacacatcaaaaaatccattgttcttctcaatccttgggtcctgtgcgtgggtgatgaatgattgaataccgtgttaaacaatgcctgcgtgggtgttttttttttttttttaaaccattagaacagctttatttgcaaagtattacaggtgtatgcaccagaatgtgatcaattggctatattgtaagtaatgtaacgtgtgtattattttacatgtatacttatgatttatttattttacgtttcaagacagacaatgagaggatattctcccagcaccttcagaacagacttcttcctgaccacacgtactcagtggtctccgggggtgacccactgtgcat

SEQ ID NO: 7145 - DNA, 1052 bp, Homo sapiens
tcccaggctggtttgatccccctcctcagcctctcgcattgcggggttacaggtgtgagccatctcattcaggtgagaataattattagaaataggttgggcgcggtggctcacacctgtaatcccagcatgttgggaggccaaggcgggcagaccacttgaggtcaggagttcaagaccagcctggccgacatggtgaaactgtctctactaaaaatacaaaaattagctgggcgtagtagtgagcacttgtagtcccagccactcaggaggctgagacagaattgcttgaacccgggaggtggaggttgcagtgagtcgagattgcaccgctgcactccagcctgggcaacagagtgagatctgtctcaaaaaagaaaattagtgtccctgtgaccaagttgaagattcccctaactgctcgtaactctctccctccctcttagattatcacggtcataacatacagaaatgtccttgctttttttttttttaatattttaccatttttatgcgttctgacaatgtcttgttacctatttgaataatacctgtttaggataatactgtatcatgtgtatcttttgtttcacgttatgtgacccatatctttgttacatgccactgtaggcccttatattggtaaggtttttttttttttttttttttttttttttttttttttaattgaacgattagtccgcactttatccattctctgtcgatacacctccgggtgagttgagtttgggactgtcagggttcgtgctgacatttttgtctgtgagtgctggggccgcagtgtaaggtgtggacgatagagaccaagaggtgaatggatttccaatcttcagcatttttttcttttttttccgacagtcttgctctgtcacccaggctggagtgcagtggcgtgatctcggcccactgcagcctccacttcccgggttcaagcgattctcctgcctcagcctcccaagtatctgggactacaggcacctgccaccacatcaggctaatttttggccaggctggtctcgaactcctgacct

SEQ ID NO: 7146 - DNA, 1028 bp, Homo sapiens
caacactttaggcaacttgactgtcagtgttaaaatggaaaacaggaaaatggaaaaatctgaccaattctgccaccttgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaatgtttagctagaaaattccacagcctgtgaagaaatatttcaaaatggccataaaggaggtaaaaatgaaaaccataacctaacttttatagaggctttatctttaatttaacgatgtgcggaggactttcttgcttgaatctgttccgggctgtctgctctgtccatcaaatgggcaggtctggaatggggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggttttttttttatctgggctgatgaatacatttacctaagaaactcatttcgttttacttaa

SEQ ID NO: 7147 - DNA, 1045 bp, Homo sapiens
ttttttaaaattgttgtttaatttttaaaaaattttttaattataattttttaaatttaattttttttttcaatttctcttgtggtaacaagcacctattgagctatttgtgtttatgttccaggattgtgccagtcttggcgtgctaaggtcttaggcggtcccgtcacgtcactggccacgggttctctgaatccactttaatcctattttgtgttgaaagcaggattttggtaatgagcctgtgttgaccccttttctctgaagcacgaagttcagagcttttaattccctgcttgtttcctggctccctgtctttgtctctctctgtctctgtgtctctgtctctgcctcagtctttctcttgcctctcagttcaaggtatgttaccatccttgcttcacacaaagttactttctttccctctcctaccctctttctctcttccttctttcctctgtatctgttcccttctttctttcttttttttctgagatggagtctcgttctgtcacccaggctggagtgcagtggtgtgatctctgctcactgcagcctccatctccctggttcaagcgattctcatgcctgagcctcctgagtagctgggattatagatgtgcaccaccacgcccaggtaatttttggatttttagtagagacgaggtttcaccatattggctaggctggtcttgaactcctgacctcaggtgatctgcccgcctcaggctctcaaagtgctgggattacaggcatgagccaccgtgtctggccctgttttcctctaacgagtacctgtttatgttctctttctcactatgggcctcactctgtcatccaggctggagtgcagtggtacgatcgtggcttgctgcagcctcaacctcccgggctcaagtgatcctcctacctcagcctccagagtaggtgggaccacagatgtgtgccatcacgccccccgggtaatttttaaatttttgtagagctagggtctcactatgttgcgcaggctggtctcgatttcctgggcccaagagatccgctc

SEQ ID NO: 7148 - DNA, 1030 bp, Homo sapiens
gatgaagtccagtatatcaaagaaaaaatttttttaatgtttatagctttttgggtcctattttagaagtcttttttttttttttttttggagacagagtctgggtgttttgcccaggccggattgcagtggcactgtctcggctcactgcaagctctgcctcctgggttcacgccattctcctgcctcagcctcctgagtagctgggactacaggcgcctgccaccgcgcccggctaattttttgtatttttagtagagacggggtttcactgttagccgggatggtgtcgatctgctgacttcatgatccgcctgccttggcctcccaaagtgctgggattacaagcgtgagccactgcgcctggccctattttagaagtcttttacttgcccccaagggcacagaaatactctcctattgtctttttttttttttttttagaagttttataattttatctgtgcatttaaatctgattcatcttgagacagtgttggtgtgtgggatgaggtaagacttgaggttcttttttttttttacatacgaatatttagttgttttagctgcatttgttggaaagacttccttttctaggtagtcgtggtgcctttgtgggagatcagttggctacatatgagtttgttttgggactcagttttgtttcagtgatttgtatttcctatgccagtactacactgtctggataattatagttttatattaagtcttgaagtaggtgataacactttcgccaactttttcttcagaatttgttttgggtgttcgcatttccatatacgtttttaaaatcaggttgtcaatttctagaaaacatgcttgttgggattttgatattgagttaaatttgtagatgagtttggagaaaatgatcatcttaattatgctgagtctgccagtccataaatatgattgttctccatgtggttttcttctcagcagtgttttacagctttcactgtagagatctatcacatttttgttcaatctctttgtactgatgccgctg

SEQ ID NO: 7149 - DNA, 1160 bp, Homo sapiens
tacttgtaattgtatggtagaattgaagactttataagtaacctgttataatcgtgtcagtttaaggtgttgtgaaactggaagccatgctgtccaaactcccatatcttaaattgcatcctgcattttaggcgcggtggctcatgcctgtaatctcagcactttgggaggccgtggtgggcggatcacctgaggtcaggagtttgagaccagcctaacatggtgaaaccttgtttctaccaaaagtacaaaaattagctgggcgtaatggcggttgcctataatcccagctactcgggaggctgagacaggagaatcgcttgaacacgggaggcagaggttgcagtgagctgagattgcgtcattgcactccagtctaggcgacagagcaagactctgtctcaaaaaaaaaaaaaaaaaaaaaaattgcatcctgcattccgcagttgataacaaggcatgtttaaactttgctctcatacttcgttctcctcaatgtctgattgtgagtgtgctttttgaaaaattcttttttatttaggcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgagtaagtattttggtttttagatttgtatttttcttgaaattctcactaaatttcccaagtcttccaagtggaaattctaacaaaacaaatacttagccatattgcactatgaatgaagaggttctagttgaaattagtgttgggaccttttaagtgatttaaatataaaggtagtgggccaggtgtggtggctcacgcctgtgatcccagcactttgggaggccaagttgggtggatcatttgaggtcaggagttcaagaccagcctggccaacatggtgaaaccccctctctactaaaaatgcaaaaattagttgggcggtagtggtgcgtccctgtaattccagccacttgggaggctgaggcagaagaatcacttgagcctgggaggtggaagttgtggggagccgagattgcacca

SEQ ID NO: 7150 - DNA, 1051 bp, Homo sapiens
tggtataattttctctttattctcttatttatttttctggagacagaatcttgctctgccgcccaggctggagtgcagtggcacagtctcgcctccctatggcttccaccttctgggttcaggtgattcttctgcctcagcctcccaagtagctgggattaaaggcgtgcaccaccatgcctggctaatttttgtatttttagtagagacggggttccaccatgatggccaggctggtctggaacccctgacctcatgtgatctgtctgccttggcctcccaaactgctgggattacaggcatgagccaccacgcccgagcgctttattctttgttgttgttgtttgtttttaagagacagggccttgccctgttgcccaggctgaagtgcagcagtgcgatcgtagcttgctgtagccttgaactcctgggctcaaacgatcctcctgtatcagcctcctaagtagcggggctaaagatgcataccacctgcctggcttattttattttttgtagagatggggtctctctgtgttgcccaggctggtctcaaactcctggcctcaagtgatcctcctaccttggtttcccaaagtgttgggattataggtgagagccaccatgcctgggcacctctttattttcttaatctacaaatctcctcacaatttttttcttttcttaattttgttttattttatttttatttttatttttttgagacagtcttgctctgttgtccaagctgatgtgtagtggtgcagtctcggctcactgcaacctccatctcttgggttcaagtgattttcatgctcagccttctgagtagctgggattacaggtgtggaccaccatgcctggctaattttttgtatttttagtagagatggggatttcttcttgttggccatgctggtctcgaactcctcaaatgatctgcctgccttggccttccaaagtgctgcggttacaggtgtgagcctctgtgcctggcctagtatatttcttagctgatcttcaatacaatgagtaagatttcttttcttttttt

SEQ ID NO: 7151 - DNA, 1063 bp, Homo sapiens
taaattgttttagtcagtattagggttgatttttgtagttgttaaaataccttcatttccttttatgaagacataatgaagaaagtgaaaaggcaggccacagaatggaagaagataattgcagtacatgtaactaataaaggatttatatatagtatataaagtacttttataaagcagcgagaaaaagcccatttaaaaaatggggaaaaattttgaataggcacttatcataagtgccttatcacttagcttgatcatcagtaaacgtttttttgtttttttttttttaaattttcttttgtagagatgggggtctcactgtgttacctgggcttaagcgattctcccaccttggcctcccaaagggctgagattataggcatgagccaccatgcccggtccctaatcattaatcaactatttaaaaagtgttcaaccttatttgtcctcaggaaatgcaaattaaatcacttcttaactagaatggctaaaattaaaaaggcaacagtgtaagtggtcaaggatttgaaacagtggggactcactgcggacaaaagtgtaaattggtacaaccgtttttggaaagctgtttggtaatatctgttgaagttgaatgtatttatactcttcttgatatataacagaaatgcacacttagaagacacatgcgagaatgttgatagagcattatttgtaatagtgaaaaactggaaactatccaaatatccaccaggagtaaaatggagaagtaaattgtggtatagtcattcagtggaatcgtctacagctgtgttacccaaagtgtgctgcatagatcagctgcatctgcaacacctgagaatttaccagaaatgcggaagtttaggccccaactcggatattacacagaatcagaatctacagtttaacaggatctccaggttattcttatatataataaaatttgcaaacacagctttagtaattcttgaaattggtcctggaccagcatcatcagtatcacctcatcagcatcagtggtggctgacacctgtaatcccagcactttgggaggacaagg

SEQ ID NO: 7152 - DNA, 1065 bp, Homo sapiens
tcactatggacttggaaataaattcacgagtcttgttagacatagtagattaaaacaataagagtaactagttccacagctgtttgtgcttcccagaggtttttttcttcccattttttgttctacacagtaagaatttatgaatagaaatatatactttagtgatgtataccagatgattctcagcatcatatgtttaaaaacttgctttacatcccagatacttttcctcatttctctttatcagaattttgtgatttcagattcagagaaggttttatacttgattttaaaattctgaactaaaattcagattgcctcttggatttgcttaatctttgatttgctctttgagagttcttgcttatagctgtgttagagttctgtagacaaaggactttctattcactacagtagtgagcataggatcaatatttgcaaatgctgttacacttgggagctgtgttgtaggcagtttaaaccagcgttaagcatcctggccaaaagaaaatataagtgaaattagacatattttagcatgtagagatgacaatagtgtgacattggtttttaaagaccactggtagatgttcacatgcgtgatacactgcaattacctctgtcttccctcccatggtacctgattggagactcttactggagtaatagtttcagtttcagttatttaaacccagtgactattgtgatcagttatgggcagtaaaaaggtaaacacagaacctgtctataagtagcttgttctcgtgttggagagtaactaataagaattagtatgagaaagcattaagtcccctaagaggtgcacttatatgagttcagtcagggaatcaggaaaaccttcgtaaagaaggagatatttagctggctttaaaaaaatattggcaaggtttgaatggaggaatgattttttaggcagagagcagtcagtgtaagtcaatgctaagtcaaggatgtatgtagggaatggggagtggtttgttttgcttgaaacagaagctttggagagagattctaggctaagaaatgtgaaaattatcttcaagg

SEQ ID NO: 7153 - DNA, 1031 bp, Homo sapiens
ctgatgtaaatcttgtgtatcctatgtactctgacttcaaattcctgagtcatttaatgtagacttccacttcaaattttttgaaatttattataatctctcagggtcaaaccaatttttttttttttttttacaggtaacatcccaaaataacacttttagatgtctctaggcaagagaaaaccttcgaacttttatttggctaattttttaggaaaggtttgtgaagaattagaatcgtgtttttctggtctgtcatttttctgtttatagttatatgcaattattagagaatattcattctgaatacttcgttatgtttgaccaatccaggaataatcctgtgtctgtctttgaaaagctggaagactgttggatgcctaaatgaataggccctacccactgcaggttttgtgcttttttttttttttttttaagtgcctaattgggattccaagctgagcttagtagtttgtggtggattttgcctgttggaatgggtagtgttgctgccagcgtgttttaagagccggttagttccaccgtttttctatggttgttgctggtctttcagatttgctcacaattgaggtcagttaagcatgcacgagtgagtgcaaatccaccatcatgcaggcttccacaagcctcgttcacatcactttgtatcaaagatggtgaaagtgtttttatataacaagttaagataatgagctttgtttaaattttcattcggattgtgaactctttgatgaatggtagatgcatacttaactagaaatcagacctgtttctgctgtcattttgtagctgtgataactttaatctctgtgagccttcctaagttttctgagatgttctttgataattatatcaattcaggacaatcacattattaccatcattgataggagtagtgatgacaggatgattttgataatgagaaatcatatatccttatttttagtgttaccaggaattagatgattaaaaattagaagaagagaaaaccaaagttagcactcagaatt

SEQ ID NO: 7154 - DNA, 1080 bp, Homo sapiens
gaggaaccatctatggtcctgtcctgaaggagttcctcctaggtctggttggacctttgtatggtaattagttaagagttagatcccctgttaggaaacctgctgggttaaggatttttgataggaaggctatgggttgtcagtggcctcagtactttcaggctacgcccttgcttacactgataacaaggtggtattggagtgttatagggtaacagagaagaccttcaattatcaattataggttttaaatttaccctggcttttaaaggaatagggtacactgttttttctttactatttccatctctctttctttctctttgacttcttctttgtctttctctctccttctgactccctctttgtctctccctctctttctttgactttctgtttctctctctctgactcttctttgtctgtctcttcctctctctccttctctctttgactttcagcctctctgtctcttcctctctctgtctccctctttgactcctttgtctctgtctcttcctctctttctctctgtctgtctctttctctccttcctttctgctggtctttccctgcctctgccagccacttacgctgctgttctcccctctccttcccctttttgatggcttcggcggtgtaagactgccacctccttgggtttttgcactgcgtgcaataactccatgatttccttgtgatatttaatgtggttccccagaggttaggaaccccctttctttccatattgcagcatgggcatgtaggattagataagcatacttgctatctgtatacacatttattctcctttcctttcccagttctaaggctcgggtaagtgccactagttctgctaactgggcactggtccctggggaagagacttactttcaagtactgttacatcactaacaatggcataacctgcccttcgtatccaattctccaccacaaatgaactttcatcagtatatagattaaggtcaggattaactaaggggacttctaagaattcatctcgggcagcataagtctggactataacttgttggcagtcatgctcgatcggttccccat

SEQ ID NO: 7155 - DNA, 1038 bp, Homo sapiens
gtggctgggcagccccagagagctgggcctgtaggtccagggtggactctaggaatttgcatttcctttgttcttttcctttttgtaatggttttactgaggtataattggtacacaaagctgcacatccttgatatatacagtttgattaattcagacatatttgtgctcccaggaaactatcaccacggccaaggcaataaacacatccctcgcctccaaaagcagggtatctaatcttttgtctcccttgggccacattggaagaagaatgattgtcttgggccacacataaactacactatcactaaagatagctgatgagctttaaaaaaaaaaatcgcaaaacatctcaatgttttaagaaaatttacaaatttgtgttgggccacattcaaagccacctgggccacaggttggacaaacttgtccaaaagtttcttcccgcacctttgctttctttgtctttttgtggtattgtgtccagaatttattccttctggtgggttcttggtcttgctgacttcaagaatgaagccacagaccttgcggtgagtgttatgatcttaaagatggtacattcagagttgtttgttcctcctggtgggttcgtggtcttgctgacttaaggaatgaagccgcagaccctcgcagtgaatgttacagctcttaagggtggcgtgggcccaaagagtgagtagcagcaagatttgttatgaagagcaaaagaacaaagcttccacagcgtggaaggggacccgagtgggttgccgctgctggctgggggtggccagcttttattcccttacttgtccccacccacatcctgctgattggtccattttacagagtgctgattggtgtgtttacaatcctttagctagacacagagcgctgattggtgcatttttatagagtgctgattggtgcatttacagtcctttagctagacagaaaagttctccaagtccccacttgatccaggaaatccagctggcttcacctctcaacccaccctctaaacggaacaccccaact

SEQ ID NO: 7156 - DNA, 1040 bp, Homo sapiens
ggctcggtttggcacagagcaagaatttcccgttcgtcttaattattcccagatggcatcagcggattcctgtttctaaccaccaaatcagtgttctggtagaaacactcctgtcttgtgacctctaaattacacactctccatctgcactgatttgagatgtagttaccacttttctgttcctccagagatgcctgcgtcaatgccctctaggtctgaagatggtcctgttgtgcggctatttcacgtgtacaggtgggactgaaagatcagtctgggactgccctctttcccctcagcacacacatgagcagctttgtgtttgcagcagctgcgtgcacgatcagcttccacttggctttgcttctgcccttacaaaccagctgatgatgatgacacagcatgttacactgttgtccccggttttcctagattccacgcacctttgtaatagaaaccgtggttactggatgccactgctgaaactactaaacacccagagatggcagtgattataagaacattaatcgtgggctgggcgcggtggctcatgcctgtaatcccaacactttgggaggctgaggtgggtggatcacctgaggtcaggagttcaagacctgcctggccaacatggtgaaacccagtttcttctaaaaatacaacaattagcccggcgtggtggcatgcgcctgtaatcccagctacttgggaggctgaggcaggagaatcgctttaactccggaggcggaggttgcagtgagccgagatcgtgccactgtactccagcctgggtgacagagcaagactccatctcaaaacaaaacaaaacaaaaaaattagcctggcatggtggcaggcgcctgtaatcccagttacttgagaggctaaggcaggagaatcgcttgaatctgggaggcagaggttgcagtgagccgagattgcactactgcactccagcctgggtgacagaatgagactctgtctcaaaaaaaaaaaaaaaaagaacattaattgcagcaaagagagtagcaataatagaa

SEQ ID NO: 7157 - DNA, 1049 bp, Homo sapiens
atttcattactttcctttcatttgctcttcaacctgtagccctcaactcttgcaagactccaataatcattatttaaggattcgagttatggagaaattcacctggcacacaagaggtgggtcaggaagctcagttaatgagtctgagagagaaagaaaagaattgccaagtttcaggcagtgagctggagacagtctgtactttttgggaactccaaaaggaagtgtgttgacttggctgacatttcagcggggaaaataaggaaggaaggtgatgggtgactgtgaggccagaggcctttgccttttccgtacaccagctccacagtgagcatcctgagggcaggaaccatatctgacacatctctgaatcctaccacccttagctcgtgcaggcatttgaaaggtgctgtaagcgaggggaatgttggagtccattctgactctgctcacaggattgggagccacgctaacccgacaacctctgaactctggatatggaaccaggccgaggctgccagctcttattagactctgtaaaccaacctgatagataaggaagtgtgattcacaggttctgggaaacagaaagaggtgtggcctcatacactattttggtgacttcatttaaatgatcgttaggacttgttgtatatgttttttggctacttcagagttttgaaagtcctagagccataagtttactccaatttccattacttcataattccattatatgtattcagaaaatatctatcgtataccagccgtaggaaagtgagagtaccacagaactgtgaaatatacataccatctgcaaggagcttataatattgtaaacaaggtgagacttgtttacattgaataactagggaacaatgttatgagagaatatatagaaagtataattcaagtatctaaagatgtgattaaggcatgtggaaatgaagttattgcttcaattaaatgtattatctctggaggacggcttgagttcaggagtttgagaccaggctgggcaacatggtgagaccccatctctaggaaaa

SEQ ID NO: 7158 - DNA, 1041 bp, Homo sapiens
cgactgtttctgaatttcccaagtgagtatcttgcccagacttcttgctttagtccagtctttgatgttggctcatatgaagcattctgcccttccagaatatcccgtacttcctccctatctacataaattctacccaagggaactctaatgaatcccattgcagcatgcccaactccatactgctttctccatgatacagtcagaagccaacccagggcacttggattcctcttgccttaaggacccaggacacttattttgtgtacaactagatgttcattacttatatggccccatgtactgcttcttaagttttcagagctgttccatcgctcccattagaatgtaagcccttggaaaacagaggtcctaataacacaacatggcttatacgtgcctgcctcagagctttggcatatggctgtcacacaataagactggtgaatgaatggataaatggatcatggatggatcaatgtggtctttcactgtagctgagctggatgcattaagaattaagtataacatcttctttttttattttattattattatactttaagttttagggtacatgtgcaccatgtgcagtttgttacatatgtatacgtgtgccatgttggtgtgctgcacccattaactggtcatttagcattagttatatctcctaaagctatccctcccccctccccccaccccacaacagtccccagagtgtgatgttccccttcctatgtccatgtgttctcattgttcaattcccacctatgagtgagaacatgcagtgtttggttttttgttcttgccatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcct

SEQ ID NO: 7159 - DNA, 1073 bp, Homo sapiens
gaagcacacctgttacacttcagggccacgatgtggggaaacctgtttaaaatacctccaacagcagcagctgctctagctagttcccaagtcaggaacaaaggctggcacttcacctctgggtggaggggcctttcggcatcagaatggagtgcccagggtggagacagcgcctctttcctggacggctttagtgccacctgggttcttgtcaggaggagggcacagtcctcagtttcctttgaagtctgggtttccagaaattccttccccgcatctcccctgactgcgctgtgtcttgctcccacgtcccctctataggacacctctgtgatgttttaaaatatttaatcagtgtttcaggtctcccctagccccatgggtggtgtgagatcagcagaaagggccactggcaccaccattacagaaacactgggggacactgtctcgtgtctgcttggacgtgccccttgtatttctcctcttttctctaatcagagatgcttcgttcataagcaggcccaaggtttcctgaactagggatgcaagagcgactgtcactgtgcctgccttcttccatctgaaggcacatgagtcattgcagggggcatcatcactgagccaagaactttctcagggactgagagtgtgtgcagctttttcaggtgcccagtgagggagcaaagggaggcagtggcttccggccaggaacggccgaggcctggagagtgctggagaggacccagccagctgactgtgccgcagctgagctcctcctgccctttctctgcaggacacgaaacaggaggaggaggagagactggttctggagagcaacccgttggagtggacggtcaccgacgtggtgaggttcattaagctgacagactgtgcccccttggccaagatatttcaggagcaggtacggtggttgccgcgtgtcgattgtttgatgtgctgagactctgcatctgaaatgaacctcgtgtcctagccggcttcctcgtgacacctgcgagggggttcttcggcgctgctcggcaggtgtgcgagacccttctccctccaaggcc

SEQ ID NO: 7160 - DNA, 1681 bp, Homo sapiens
gaccagcctgggcaacatggtgaaaccccatctctacacaatatacaaaaattagtcgggcgtggtggcatgcgcatgttatcccagctacatgggaggctgaagcaggagaatcacttgaacccgggaggcggaggttgcagtgagctgagattgtgccactgcactccagtctgggagacagagcgagacttcatctcagagaaggaaggaagggagggaggaagagagggaggcaggggagggagggaaggagggagggagggaaggagggagggagggagatctcagcattaaaaaagaaatcaaaacataaaattaaaatctcagcattaaaaaaacaaaacaaaaacaaatcatgttccacgaaatcctgttgctcacaaacctgaaatgtcaaggtttgctgcttgttgaaagtgatcacggactaggcttaatgtctacacatgttttatgtaagtttttttttttttttttttcctcttttttaaaatgtccgtcttttcagattgtttgatccaggcactaacctgctactgtatactgttttctaactaaacaaatagagaataaagatataaggaacttgaggaataagcccaagagagcactgtggtctggggatacggttggcatccagggtttctgcttttttataggcagctaattcttttctgctgaattgatcgctgtttcatgtcatgcttctcaggagtgtatgtagctgacgggtgaggtgcggctgggcagtgactccctagtgcttcctgcttatttccgttttatttgaagccaaggaggagtttgtttttgatgtgagtcatatgcccaggacactaattccaatccattctcttatcacctccctgaccagttcctaatcagaatctgtacctcatggaggttacagggatccaaggtcatgataactgaggcttgtactgcatctggactcagaacagagcaaatgtgtgcctggtctaagtacttccgtaaaatacccagtgtcttggtgtccttctgcagcacagtctctgtcgtctttgacataagtatcgagattatacacacatcactgataagggataaaaggcaccctggaaatccgtaaataaaggactagcagtcacggcagtgcactgcattgagtctggtttggttgggtctgaaactgtacctgaaatggtttctttaagtatcttgctttctctatttctcgatgtttaataaaggaagggacacggacatgtagagaaggctaaaataagaaatgctgtgtgaggccatttttccccacacaaaccaagaaagaaataaagaccttccctgcatggacaccctctctactaagagtgttcatgctgctcatagcactgaagattccacatccagtgctttttttcagtgttttcttagctttcaatgatgtacctgtcagtgtgattatagatttaacccttaggagggaatctctcctacattttagcatcggagacctagattaaaggctgaggagagaagattaaatgtggccaagagagagaagcttttctttctcattccgtctggtacagccaaaggggtaaggaagacgcgggcttctcttacgatagattgtgaggctgcagtttctatggtgactggtttctttttcccttattcagcagctaaatgcagc

SEQ ID NO: 7161 - DNA, 1024 bp, Homo sapiens
atcactgttgatcatcactgtttctcagcaggcagacttttttctagtttctttcattacggtaaaaggaatatgtgtttgaattcagcagtgagtcatctgagatgcgtgttgttatggaaaattgccatagcgttcagctgttacgagacagaagtcaaagctaagcacatttaatggccggagatgagcggtatttccaagaagttctttttattatttttacactttagatgaaatgggtatttggatgggatgagtcccattatgctgcggttgctcacgttggggggatgtgttcacacgtctgtgtggttgtcggtgtctgtgcatgcaatgtgattgagctcctgggtaggtgttcctttctgtcttgaatacaaactggaacagtatgagaacaagctcatgattattatttctactgttatttatctttgatttaagagatcactgtgaatagctttggatgccatactttactgggaattctgacttaccttatttggcaaatacagatcatttccaaaatgtacattcagttgaaggataaatagttgatgaaataggtttaaaaaaactcaaaggacattaaaagcctcattttattgaaaaataaataatgactttttttttcttgaagacgaaccctgttatttagaggcctaaaagatttgccaaaactatccatatactatccatgtctataacaagtctgtagaggtgactgcactgtatatcaccgtggctctcagtggattttaatttagagcagatgtctctgcatcacacagctgggtgagtctcagcttttggaacacaaagaaatcttccttttaaaaatcaacttaagatatgtttagaaagtagataaaggccaggtgcggtggcttatgcctgtaatcgcagcactttgggaggccgaggtgggtgaatcacctgaggtcaggagtttgagaccagcctggccaacatggcgaaaccctttctctattaaaaatacaaaaattagctgggcgtggtg

SEQ ID NO: 7162 - DNA, 1077 bp, Homo sapiens
tgataagcagtgtcttcctgagtgcccccttctcactgtggacatcagaggccccattctttcagtctccacagaagtgtgtgttgaggcccattgagtgttcccaattacgttagctactactaagaagaatttagaaaggccaaactagaagaaaaaagttcagcagacaggaaacactagaaaggattatagacaatgcacacacgcagaggatgtgtggttgtgaattaccctttgtgtgtctttgtgtaagtaacaatgacttcgggcagtgcaccgatggcttggctagttctggcaggatctgatacttactgtaattatgactgaataaactgcggaaacaggggcttaaagctcaaggtgagttcaaaagctatgaggatcaaaatagatcgcttcatgctaaaaagcagacatgcaagaaattaaaaatacagtcccaaaggtttactgttgctttttaactgtgcttaatttcatattcatatcctaagcgtctgtctgaagtagcctgggttgatatattgaaggcataaacatatctacttccagtgagggcttctgcaaatcctattttgataaggtcttaaatctgttgagatcaggccataaaattctcctgcagtttcagcaataggtaaaaacagtgctcaacgtttttttttttccttttaattttgcattcagactgtgtaacctccatctgtaaatcttgccccccctcccactgcctggggaaaaatatgggcaacatgtggtgtgttaagcaacatttcaagtgtaaatattaaacttggtaaattttaatttaccttttaataattttctgacttacagggactatttttagcagatgagagcttagagatttagtgaaaatatgttgtcataactgcaaatgccagactagagtcgtttgtagtttagaaatgtatcagataataagttcctcatcagtgggcattgctttcctaggtgataggtggaattttggcccatggatgactgaaggtttttgctaatgtgattaataccattaaattacttacagaatgccaactaaatgcatac

SEQ ID NO: 7163 - DNA, 1097 bp, Homo sapiens
ctaataaagcatttgtgggatttgggtccatctttaaatgtcctcaagaagcatatgtgtgtgtaactcaaactcagaacttgagttctgaaacccaagttcatgattccttccttcactgtgatgtgggcacttctccaaagtgaggtattagtggaatggaacttggatttttaaaaggtgtagtggaatgcttatataatattataactaagtaaaaccttgaaaaaatgttcatgagaatgtggtagaagtttctttcttttttttttttttgtttcttatgactttctaggagtttgccttaatgagttgaaagcatgagcgatgattaccaagttgtgtgtaaaccttcctccacctgaaattgcagagtgtttttctccctgatcatttctttcctgtcgtagcgttcatctttgatgccgtagttgggcgcagggcaggttttgagtttcctgatgtttcatgtgtggattggtccttcaatttgaagaataagataatgatcatagacaaggatttggcttacagctgagagtgctgagttggagtcttggaagagagacgtgctgcagaataaagtttatagttttaaaatttctagttagaagtttaaatggtcacactgagcaatgccaattagcttccattgcagtgaattctaaggacttgcaaggcaacttttatttaccagaatttaactgaattaatcagtggttaaggtaactccatggtctaggaattgtaaattggttatacttagtttttattttatagcaatatttattgtaataggtttatggtacatttgaatattagagctttgagagctaaatgttaactgatatagtttttcttataaaattagcaagattcttgagaacgtttcttttctactttttaacctaaagtggtctgtatacgtttatggctttatagatacgtctaccatggagagcaattcatttaggtagtctgtggctcataaaagattgcttgagtcttgtgcagacacatataaaggaaagctataggacctctgggaacttgaggctcgcaagatgtaaatgtcagagccgtccctagagctccct

SEQ ID NO: 7164 - DNA, 1134 bp, Homo sapiens
gggaacctgaatgaatgtgggttcagtacctccagctgggctctgtcctagctcactgctccagaggactcctggggtccctttgggacgtacctcctattgtactatgagatgtggccatgtccagcgaggaagtgatgtctgtgatatacatcactgatacacatcagcgtaactgatgagatggaaattgttcatctttgcttacgttctttccctctttccatgggctgggatgtgctgaaccatctgtttccctgccctcacttagagcagagtgacaggattgaaagaccctgggttcctaacatatcttgggaagcagagctctgtgtcaccctatatcacctgccttggatgagagagagagagagggagagaaagagagagagagaaagagaaagagagaggaactttgactgtgcttgcacctctgtggctgtgtttttgggtctctttattatgcagtctagctgtgatgcagtatctcatagtcatcttaatgatcttaacgactatgagggccagtggagcttgcccttggtatttgcatcccttgaatctgcctcatctcagtaaagggcaactccattcttcaagtgcttgggccagaaagcctcagggacatttctgtgttctacttctcttgtagcccatcagcgaatcccattagctttaccttcacattaaaaaaaaatactttgaccaggcacagtggctcacacttgtaatcccagcactttgggaggccgaggcaggcagatcacctgaagtcaggagttcaagaccagcctggccaacatggtgaaacccggtgtcttctaaaaatacaaaaattagctggatgtggtagggcgtgcctgtagtcccagctactcgggaagctgaggctggagatggtggtgggtgcctgtaatcccagctgcttgggaggctgaggtaggagaatcgcttgaacccaggaggtggaggttgcagtgagtcgagatcgcgccactgcattccagacagagtgagactcctttcaccctaatgtcatcactgtgatagggctgtgtcatttgcttccaacaattcttagataatgtctttgttaaatcctattctttttttttgagacggagccttgctctg

SEQ ID NO: 7165 - DNA, 1063 bp, Homo sapiens
tgttctcaatcttcaactcccacttacgagtgagaacatgtgatgtttggttttctgtttctgtgttagttttctgaggatgatgacttccagcttcatccatgtccctgcaaaggatatgatcttattccttttcatggctgcatagtattcattcctttttatggctgcatggtgtatatgtgccacattttccttattgagtctaccattgatgggtatttgggttggctccatgtcttcgctatagtaaatactgctgcaataaacatatgtgtgcatgtgtctttaaagtagaatgatttatattccttagtagaatgatttatattcctttgggtatataaatcattctactataaagacacatgcacacatatgtttaatatataaataaatgggattgctgggtcaaatgatatttctggttctagatctttgaggaatcgccatactgtcttccacaatggttgaactaatttacactcccaccaacagcgtaaaagcgttcctgtttctccacagcctcgccagcatctattgtttcctgactttttaataatcaccattctgactggcatgagatggtatctcattatggttttgatttgcatttctctgatgatcagcgatgttgagcttttttaaatatctttgttggccacgtaaatgtctgcttttgagaagtgtctgttcatatcctttgccaactttttgatggggttgtttttttcttgtaaatatgtttacgttccttataaattctggatattagccctttgtcagacgggtagattgcaaaaattttctcccattttgtaggttgcctctttactcttatgatagtttattttgctgtgcagaagctctttagtttaattagaacctatttgtcaattttggctttcgttgcaattgcttttggcttttttgtcatgaagtccttgcccatacctgtgtcttgaatagtattgcctaggttttcttccggggtttttatggttttagaataagtgtcatgtggcactgagaagaatgtatattctgttgatttgggctaatt

SEQ ID NO: 7166 - DNA, 1026 bp, Homo sapiens
gccgatggctgagtgtgcagatacagcccaggccccttcaggcctgtgggcctccgtgcctggactttgttctagtccctcccgggtttcctccgctgtctcatgagttcgggctttcttcattcctcacttgatgattggaagagctgcttgacccatcagcgtttctgtggcatctctcctttcaaaacgatccctgtagagggactggcaactagtccatagtgtcttgctagttactagtgtctcacgctgatttgcacatgacataaagacgctaataactgcctcatgctgatttgcacatgacgttctttatgctgactattcccttccccgagactttcagtgaaggaacttctgttcgttgcaggcatggttctcaactgcctccatcgggaagcatcctggccctggtgccagggcttccacggtatctggggtttactccttccttcactgagttacctgcttacattcctgttttccatatgaaactccttgaacataaggactgtgtcttaatgatctttattttctctccaatatctggacttttgtacgacacaaaggaaaacagtcagcctgtgtgttttcagtagaagcaatttatcatctttctaactgtataatgctaaattccaaacagtctaagcagctctcttggagtttgcagctaatgacagaaatagtacagaaagtcatttaacctttaatccagtgctctaactcactaaatataaaacattcttaaaaatacatttgtgcatttgccaattgtttattagatttctgctcagtgccagagacgatgctgggcctggaggagaaagtttgaacaagagtaatgcttttccatcctcacagaatgcagtgggctgtcagaagcggtagggaacagctgggcagatactgtgatgtgtgacatacaccacatgggagggaaattcccgggctgggtgggcaggggttgaggaggatgttctaaagtatgtgtgaagggggcagtgtgaactgcaggcacac

SEQ ID NO: 7167 - DNA, 1044 bp, Homo sapiens
cctcttccacatggatagcaaaaatgtattctatattcttgttctccaacagctttgtagttttgcctttcccatgtaagtccttagttcaactggaattgattttcaggcagtgcatatagcagaagactaatttcttttttctccatacggataaaccagttgtcctagaactatttatcagagagtctgttctccccctactgatgtatggagccagttctaaccattaattggatttgtctatttgtttgacttctctatttcatttcactagtttgtctagtctctttatctatactgtatctttaaagttgtttatgtatgactgcttttgtcatctgtatggcagggtccctagtttgttggtgttcttgaagagtgttttggctctccttgggacactttacttccatataatttttagaattgggttatctagttctacaaaagaaatctgttgggatttggattggaatagggtcgactaaatcgttttaaggaaaatgtacatctttataatactgagttctctaatccatgaacatggtatgtatttcctttgtttacatcttcttttatgtatttttataaaacattgtagttttctgtgtaatagttttctaccttttagaagatttattcttatatattctatgtgttttgaagcttatgtaaatggtatcttttaaaatttatatttttctaagtgctgtttgcatgaatatttttgtatcaatagtgagacttaaaggacattttgccctaaggtatgccatattttctaccccatggttatcagggatgctttggcatgaggatggtggcttggtaattttagctgtttcctctctccccatatgcaatgtaaatgacatgcatttttaacttcagccagtatagtaacacacttattgataatctagaagttgctagcattgcacagagcatcctggagtagggacaatgttttctcttttcctctttgtcatttgtcatatcattttctctttccttcctcttttttttccccccttttcttgg

SEQ ID NO: 7168 - DNA, 1024 bp, Homo sapiens
ttttacattaagacttctagcaagcctgtgaggtggggactgttcttgtccctgtggaaaccgaggatcagagaggaaaagtaacttgctgaaggtcatacagctcttaactggtgtatctgggacttgaataatctgggttagtagcagattgaaattatttggcatatggactagtcagggttctccaggaacacaaaacctgtaggatggtgatattgagagatttgttccaaggagttggctcctgtgatgatggaggctgacaagtccctagatctgcagttggcaggctggagatccaggagagctgatggtggaagatggtgtaatttccagtcctagcctgaggcctgagaactggaactggtggaatagttcttgtctgaaggcctccaagctcgagacccaggaagagccaatatttcagatagagttggaaggtgggaaaaagccatcatcccccaaaggcagtgaggcaggagggattctccctcacttgggggtggatcagactcttgttctatacaggcctgcgatggatgggatgtggcccacccatagcatctgctctactcaatctgctgattcaaatgctaatgtcagccagaaacaccccaagaaacacccagaataatgtttgaccaaatatctgagcatcatggccaggcacattgacacacacaatggaccctcacaggggatcgtgacgttttactcttgtgctgccggattggctggcttgcttgcttgctttttctttctttctttctttctttctttctttctttctttctttctttctttctttctttctttctttctttctctttctttctttctctctcttttctttctttctttcttttctttctttctttctctttctccctctctctctctctcttttctttctctctttctctttctctctctctctctttctgtttctctttctctttctctctttctcactctgttgcccaggctgaagtgcagtgacacgatctcggctcactgcaac

SEQ ID NO: 7169 - DNA, 1034 bp, Homo sapiens
gataagctcattttttccaatcctagagaatcagcatctctgccctggttctcttgtctgaattggagaacaagtggctgtaaccctctgaccctccggcttgtttcatttataccgcggggcaagatggtagagaacacttaccacatgattggaagtactttgaggaagaactagataaaagtgagtcattaattaattgttaagagtcagcagctgcacactcaggcgtctcgtttgatgggaaagggaagcaacttgagtgaatttaaatcacttcgcatgtatgacagtgtattaaagtaatgagccatgcatctggccaagttggcgttgtcaagctttgactttctctgtctgtctctctctctctgtctctgtctctctctgtctctatgtctctctctctgtctctgtctgtctttgtctctctctttctctttctgtctctctccttctctgtctccctctctgtctctctctctgtgtctctctgtcttcatctctctctgtctctctcagtctctgtgtctctctcagtctctctgtctctctctcttagtctctctctgtctctctgtctctctccctctctgtctccctctgtgtctctctctgtctctctgtcttcctctctgtctctctctgtctctctctcagtctctgtctgtctgtctctccctctctctctctctgtgtctctctctgtctctctctctctgtctctctatcttcctctctctctgtctctttcagtctatctctgtctctcagtctctcagtctttgtctctctctgtctctctctctctctctgtctctctctttggtagcacctagtttaattcctgtagcttacatgctacaaaaagattttacaaaatccagcaataaacaaaatgaaacttcctgatataccataactgatacctgtgactctgggaatttcttaagacatccggaaataagtgtacctttgtacgtgaaggacgtttgttttccccaagatctaggtcaaattaagaacagacttgt

SEQ ID NO: 7170 - DNA, 1048 bp, Homo sapiens
ccgcctcccttctctgcctgagcacacaaagaggtcatgtgaacacgtagcaagatggcggccacctacaaaccaggaggagaggcctccgagtgaaactgaccatgctgcccccttgatctggggcttcccagcctccagaactgtgagatacgtttctgtttaagacacccagtctatgcttttctgatggagtagcccaagcaaactaatacaagtttcttctagctggtaagaacaaccattcccttgggaccatagtggaagtgagtacagccatatctgcctttgagtaaactctgactatgaggagtaactcagggaactcagattggggtggagttcacaagatcctcggctgcagtttgggctctacctcttggtttttggagctcccctgcctggtctcctccgcgtcttctctttttacttctggctcttcactctgcaccatcacctcttactccttattccattatttttcaacgttgcattgttgctgaaccgcagtgtttagcaaacctttattttctcataagctgaatatgcggtggagagaagggtttcccacaaacatactagaaaaaatgtgtgtgtgtgtgattatagtaattattcacacttatagcaaaacattcatttgattcaggaaaggacaaaaggtaaataaagtgttcagaaatctcactattgtagagctagaatcattttgggactacctagacaactttgtgtgtgcataggcaatatatttacacaggcatgtacttttacattcatagagtcctactatattcactaaactgctttataacagtttttgttgatgtttttggcaataaatacagatgaaatataacattttaaatagccatatagaattccattttatgtatgtattatgatggttgtaacttgagggtctttgggatatatctctgtctctgcctatgtctctgtctctataactctatcatctgtatcatttccctaatattacataatataaaatgcaaattttgttaaaaagaaacctttttaagcaaag

SEQ ID NO: 7171 - DNA, 1053 bp, Homo sapiens
ttctcttatggtcaaagaaattttttaaaaagttgaattatatactgcctactttttgttgttgttgcagagaaattggataggataaacaatacgagactgttgggataagagtctggggcatataggctgctgttaaagtagtacttatgtatatttttatttatttatttttttgttttatttatatttttttttttttggagagggagtctcgctctgtcacccaggctggagtgcagtagcgtgatctcggctcactgcaacctccaactcccgggttcgagcgattctcctgcctcagcctcccaagtagctgagattacacgcacgcaccaccacacccagctaattttttgtatatttagtagagaaagggtttcactatgttgcacaggctggtctcgaactgctgacctcaggtgatccgcctacctcggcctcccaaagtgctgggattataggcatgagccactgtgcctggcctattatgtataattttaaatgtaggatggaaggtatcagatcatttactgaatatatttatgggagtaatataggagttttattccaaatgtcagagttgcagtacacaggaaattacatcctttgtgatgattgaaatgaatgaaacatttctcaacgccaaattgaaaatgcatgatgggaggacatgagttcttcaagattcttgtatggggggtatatgaacaagaaagcttgaggaccagttttcacaaatggtactcaaccatagcccttctcatttacccattaagatgttttttttttttttctttatgatttagatgcttagatgttcttagggctttggaaggatttatcataattgagcatttgctgagtttctgtttccgtcattggattcctttggtaatatatttgcaagtctttctctgagttctttgctaataggaaaacaagagctgacaggaagatcttgggtggatgggtaaaaatggctactggctgttgatttggtccactgtatcaccacattactgttgacatagtaatggaaacactttaata

SEQ ID NO: 7172 - DNA, 1029 bp, Homo sapiens
tagaagtagcctcaaaccctgatctgctcaacaccaaaacctaagctgcctaccatcattctactatacaaagtatagtagcagtgaccgaaggagtgaggagaaggtacagagagttaaagacagcatgggttaaatgctcacacagtgctgataggtacagagagttaaagatagcacgggttaaatgctcacacagtgctgatggttctgtaagagatgtggacagggactccatggttttcactaatctcctgtaaattactatgtcacacatttattctatattgtgaattttgcacatcgtaaagcattcgtctgtgtatggttcttggtaacaagcatggttctcctgttcatcagtactctgggaccgagtgcactgaagacgataggaagttcagcatcagtgaaacgaaaagaatcttcccagagctcaactcagtctaaagaaaagaagaaaaagaaatctgcactggatgaaatcatggaggtacagtttatggattgcgtgtggacaccttagaacccaaggaaaattaaatcatttcaccatttattagattaatagaaaattaggaaaattatcatgtacggactagggaatagtgacctagctacatacagttccccgaactggagttggagcccccctaaataggtttatttatttatttgttttttatttttttgagatggagtctcactctgttgcccaggctggagtgcagtggcacaatctcagctcactgcaacctccgcttcccaggttcaaatgattctcctggctcagcctcccaagtagctgggattgcaggcgcttgccaccatacctggctaatttttgtatttttagtagagatggggtttcaccatgtttgccaggctgatctcaaactcctgacctcaagtcatccacccaccttggactcccaaatgctgggattacaggcatgagccaccatgccccacctaaataggtttcttttaatgcctcaggtgctgtctttgaaactccctgcgcttgtt

SEQ ID NO: 7173 - DNA, 1023 bp, Homo sapiens
ctggcatagcatgtggtcaggtagttctacctactttctacattatcttctcttgcaatttttatgtattctttcaccaaatctttattcactatttctgacatgcagtacattcagttttgttatggaggttaaaaaagatgagtaagacaagagagtcaagtaccagtatctactggaatttgcttttaagccagatgatattttctattttacttagtactttacatgttgtttttttaagatctaagtttttcgggtttgtttgtaggtcattgtttatttacactattgaataagtggctaggagtatggaaggagataggtaggctgaatcagcaatatagatcaactttaaaatgatttgccagatgtcttaactttgatcaaaataatgtttcaaaattaacacctacattagatatcatcaagaagttggttatttgggttctacatctgggtacattccagaagaattgtctaacattggcatgatatgacctggaagatcggctcaaatataacacacatgccttatacttttagaactttatgcatttctgtctgttcttttgaagtatgtgttattcctagatgtagatggatgttaaaattggttccagtgttccccaattgacctcccttgtattagttttctatggtcgctgtaacagattaccacaaactgggtggcttaaaacaacagaaatatgttgaggtcatattctagaggccagattctgaatcagtatcactggcttgaaatcaaggagcctgctggctgtgctctggggaagaatctgagctccggggaagaatctgtcccttgccttttccagctctgttggccgcaggcgttacttggctcatggttgcatctctccagtatttaagacgagcatcttcaaatgtctctttgccccatcctcacatcaccttttcctccaggtgtcaaatctccctccaccttgctcttacaagaaaagggatgattgtagttagggtccaccttgataatccagg

SEQ ID NO: 7174 - DNA, 1026 bp, Homo sapiens
acatacagtatctaaatttcattaaatataaatatggaaaatcccatttgctgcatgaatttgtgtatttgaatgtgttttagtgtatttggtgttttgttttgttttgtttttgagactgagtctcgctctgttgccaggctgaagtgcagtggtaggatcttggctcactgcaacctctgcctcctgggttcaagtgattctcctgcctcagcctcctgagtagctgggattacaggtgtgcaccaccacgcccagctaatttttgtatttttagtagagatgggattcaccatgttggccaggctggtcttgagctcctgacctcaagtgatccacctgtgttggcctcctaaagtgctgagattacaggtgtaagccactgcgctcggcctgatttgtgtgtgtttgaatgaataaatatgcagaggtgaaacacattcatatttatgttttgctttgattgtatgctaatttatggcagtggctgtttttttaaggcttgtgcaaagtggacgagacaccaaaaggctggtatattcagtacatagacagggacccagaaactatccgccggcaactggaactggagaaaaagaaaaagcaggaccttgatgatgaagaaaaaactgccaaatttattgaagagcaagtgagaagaggcctggaagggaaggaacaggtgggtaagcaacatcatcctgagaagcaacgtccagaggtctaaagaagcacaatggcttggtttttcttttttgtttttgttgttgttgttgttttggagatggagtcttgctctgccgcccaggctggagtgcagtagcgcaatctcagctcactgcaacctctgccacccaggttcaagcagttctcctgcctcagcctcctgagtacctggaactacaggcgcccgccaccacgcccagataatttttgtattgttagtagagacagggtttcaccatgttggtcaggccggtctccaactcctgacctcgtgatccggccgcctcggcctcccaaagt

SEQ ID NO: 7175 - DNA, 1048 bp, Homo sapiens
aacatggtgaaaccccatccctacgaaaaatacgaaacaaaattagccaggcgtggtggtggacccctgtaatcctggctacttgggaggctgaggcaagagaatcacttgaacctgggaagtggaggttgcaatgagctgagatcacactattgcactccagcttgggtgacgagaacgagactctgtctcaaaaaaaacaaaaacaaaaaactgtactactgcttaaatttcaaaaagatgatgctatatgtttgtagaaattaccttaatgctttcctttctttctttattagggaattccgaaatgactttctagaacttctcaggagacgctttggtaaacattttaaatattgtgcaaataacagctttataaatggcataatcttctgatgatcatcagtgtcatattttgttctcaggcactaaaagggtccacaacaacattgtctacaacgaatacatcagccaccgagagcacatccacatgaatgccactcagtgggaaactctgactgattttactaagtggctgggcagagaaggtaagaatgagattttaaagttgctttttctttcccacttctaatcttcataggatgagatgtttgggataagaaaagagaaaaaaaattgggtcagtgttttgctttttcatcgtgttagttgattccattttgggagcataatttctgccttaagttaatagaacatcatataactgttggacattaaatacttagatagaactgaataaatactatgcaaggtaatacagttgtctctcagtatccgtgggggattgggtccaggaccccttgctgataaccaaaattcacagatactcaagtcccttatataaaataaaatgatgtagcacttgcatgtaacctatatacatcctcccacatactttaaatcatctcgagatttcttataatatttaatacaatgtaaatagtttttatactctattgttagggaaaaatgggaaggaaaaaatgtctgtgcatgttcagtacagatgcaaccatccgtttttctt

SEQ ID NO: 7176 - DNA, 1022 bp, Homo sapiens
cgctcaaactaggaaaagttaaaaaggggtttttaaagggacatctcataggaaggaagcactagttgggcctcaccggaattggagctggaaggtgggaagcgtctggtgagaaggaaagctgcaccttccatctctcccattctgggggccactcagtatctcagatgatctctgtgaactgttcagttcactgtttctctctccagattgcttcctttgcctactggccagttatactgcggctcagattgcacccacagattcattgtgagcattctgttccagtacgtacccccatctgattacagtctctggctttgttcacatttcatagagacagtgtctgatgagtcagtgcaaccaaataactgttcccctggggtcagctgtcctcttctggtccattagctgtggttcctgtggcacaagcatgaatccttaaggccacatcataagcagggactatggggagagtgggtatttcttagagaggaggcatagactgtgcatgggcatcccaagatgtgtctgcttaagggttcagaaatctagaggagacaagacagcatactgggtgttgtagaaggggagactttgccagcaactgagcaaagaagaggaatagtgagctaagaatcatacataaagtgaaataaatattatcactctttaaagaaagtgtgacagtattgaagaccgagtccaataaaaatatgtagcaatttagactttgtacctgtgcatttattttttagcacaattttattctcttatgtggcataatactgtaaagagtatagtatttgtctctagaatggaccattaaatgatgtgtgtaggcattttctggtttttatagagtagctttttctctgtacatatgcatgtaattcgactgaactccccagcttctgtgttcccctttgctccccaggaagtcgggtattgtcaggggatgagccagatcacagctttactcctcatgtatatgaacgaggaagatgccttctgggccctgg

SEQ ID NO: 7177 - DNA, 1032 bp, Homo sapiens
aaaatgttattgtctgtatcaataagtatgaagtgcttttcaaatacataaatgatcaattaaagtaattagatgatcaatgttaggacgtggttgcatggaaaatggactaacacctaattatagctgcttgtttgccacatggtgttaatggagagatttgtggtatcactttgagagttcgtgggaaacagcagcagaattcagtttaaccaacacctgctgtgtatgattcttttcttctagcatgaaaaaaaagatgactttgccccaagattattagggtatctctaggttttattatttattaataaaaagttaaacttttgactgagtaataatttttttcttaaattaggtgctttaaatgtatctccttgtcatctcgtagctataccctttctgaacctaaattttctattaacctttgaaaggagtaagagatttacatctaagaatcttagacccatagattttgaaatatgttccttagaaaatatgtacaaaaaaattaatgtggaataaatgggaaaaaataaaaattgctgttttttttttcttcaacttttattttaagttcaggggtacacatgtgcaggacgtgcagatttgttacataggtaaatgtgtgccatgccatggtggtttgctgcatagatcatcccatcacctaggtattaagccttagcactcattggctattcttcctgatgctctccctcccacctccaccccttgctgacaggccccactatgttttgttcctcatcatgtgcccgtatagtctcattattcagctcccacttataagtgagaacatgcattatttggttttctgttcttgcgttagtttgctgaggataatggcttccaactccatccatgtcctggcaaaggacatgatgtctgagagaacataatatgaaatataaccccagcacctagtacagtgtgcctagcatatggtaggtgctctgttagtatttgtttaaataatgaaagtagaaaatgaaagaaaaagcactttattta

SEQ ID NO: 7178 - DNA, 1034 bp, Homo sapiens
tatatgttcgtggtttatttcaagttaatttttgaatactgttgaggtaaaggccaaggtttaatatagatatagataccatatagatacctagttatttcagcaccatttgttgacaagactgtctctccccacttcaattatgttggcaactttgagcctatgaaatcttgctatcatttgcaaccatcttttttcagcaagaatctaaggccgacaacagagcttattcaaatataaataaatccgttttgtaatctcactcttgagtactatataatttaggaggttgtggcaataaagaagggaactgcctttcagggctaattctaactaataaagaagtacgtgttggtaaagtagaagagatggtaacttcctagaatttctacttgtaaaggaaaaacattgttcatacccagttagtgatatgtgatttactttaggaaaatgaattagaaacatattaaatgtgggcttgattaccacagactgaaaggaaaattggatcaatataagaaaaatctacagtgactacttatactcatgagaaagaaaagataaagaactatacataaaataaagtagctgcttagggtgctctttgagttcacatttaaaaagagtttgggtgaaaggtgggagaaaaggcttatcaccaatagggagtgaaaaaagtagtagatacttaaacatagcatcaggaaaagtaaaaactgaatgagttgatatctgtgaacagtgtggagtctgatagaacaccttcaaaaacttattttggattctacagatcaataataactagataggcctgctgtttggaacatatcatataatgtaaacataaagaaagcatgtatgtcctggactcttttgcttccatctgtttttgttgttgttgttctttttatcgtaaaattatctttgaacagaaaagagaatggacagaaatgagaggtcattgaggctcaaggtcggttaggagataataaaccatttaaatttaggtctttaggattagatgagctgttgtc

SEQ ID NO: 7179 - DNA, 1026 bp, Homo sapiens
tgtgcatgtgaatttagacttctattcatggactgggatgtcagaggtgtatatgtgaggaggaggacaaggaatttataggatatttttgaggcaccatatcttttatgcaaatctgggagcttagagttagcaagatagattttatttttatccacattttattttccgtttcaaatacaaggtttttgagaaattggaaaaaagtattaaggctttcgacagtgcagggtattttggttgactacttaaaaacttgcacatagcatctgtgatgcactgtgaaaatttatagcagagcactttattttttctgtcatggcttttgtgagaaaatgttttcactttgcttagtgatttacagaagattacccacattttgttttgttttgtttataactagttaaggctgtgcatagtaatacattttggactttgaggatggggctttcacacgtgctgaaatcactttgaatccatcatttcaagaagatacagcctatcctttcgttgtttcttattaactgcttcagagccttcatggatagctaggcaaagcattcatttctctgaagttgaactgtgttcgtgcttgagctttctgaaagcagaaatgagcttctggtgatgaaacctgttggatttctagaggaagcagctggagtctttggcttgttaactagcaatgattcaagtcttgcagattgtaaaggagctggtgacaccatcaaggcaaaaagcagccacagtgaaggaaggtaggattagcagaatgaacaatcaagcactttcagggcactcagattttgctaagtatggacccaaggatgtgctataaaaaggggttttgagtttccgtgtatgcttttgcatttctgatatattatggtatctgaaaaggatcaggtaatggcataattgttaacatgcctcattattactgtttttgaacaaaaattagggggatattattaagaggtacagagtaaggggaggttattgcattgctgctgtaatagtactttt

SEQ ID NO: 7180 - DNA, 1033 bp, Homo sapiens
cgccaccaggcccagctaatttttttttgtatttttagtagagacggggtttcaccgtgttagtcaggatggtctcgatctcctgaccttgtgatccgcccgcctcagcctcccaaaatgctgggattacaggcgtgagccaccgcgcccggccaagaaagagcttttgttatttcagctccaatcatgacattttgtgagaaagtttatctaatgtaaagtgctaactctagtgaagatggtaattagttcacaaaaattaaaagaaatggcaagcattttaacttaaaaacgcttacatttttggaaagtgaaataaattttcttctactttgcaatttttgggttctgttaggatcagtgttgcagatgtaagtttttttgacggcaggtagcctgtgcctttcatgtttgaatttcggtgtttgatggtgtcttgtatactgcttaccctagaaaacaaagatcaaagtcttgcgaggatgaaggcagaggggaggaatggcttgccaagcaactaatagtgtttgaaccacataacatttttcacctttaaattgtaatatttatatttcatttgcaagatttttaactggttctttatatccactaatccactaattctttttcatgtccacttaaaacaattggttctgttattttatctctttgtggatcttttacatgcttattttaaagtctttttcagatcatttgataattttaaaattttgtcttcagggaatttatgttttgattgttgatattttcatcatgttctgtaatttgcaggcacattctgatggaagtttttttgctcttatgtctctctctttctttttgtgatttttgtttttttcatgctggtctagcagattcatatttgtctctgcctggctttggagttcccagatcagaatcaggtctgtgttagtgggtcagagccctggccccatggtgacgttgagaacatcacagattcagtcactgagtcagctggcattaggtcagcaacctcttataagctgtagcc

SEQ ID NO: 7181 - DNA, 1033 bp, Homo sapiens
gagagcaagggtcacattttaagcttttttcagaatgtttgacagcttagcgtcattctgaacatgtagctgattagtagatgttttagtagccagacatcaggggacattggggagtgactgcatgctccatgtgggcaggagtttttctctgctgtactcacaggtatattcctggtgcttagaacaatacctagcacatagtaggaattcaataaaagtagaatgaaaagatgaatgaatgagaaagtagaagtctgttttcatctagaggtagcaaaactgattcatactagttagagttttcatcctcccaaataagatatgacatcaagtatcagtaagacatttctgtgttcaatgcataaattaggagattagagactataagagatgaagctgagaaataccatactttcaatttaagtatacattcctgaactcaggttttattggcttttgttttttatttacgagaattttatttgatttgcgaaaacacaaaagaaggctggtatagtgaacttggatttacctatcactcaacttcagttattaatattttgtcagttttatttagctaaggtttggtttctcttcttttttattcttccaattttgccttttaccagttactggccattttcctttgttgtgtttcattttttggttttctctaacccttcacattgaaatgataaggatattttcctaattggtctttctacatctacccttttctgactttctaattgattttatatattgctgctaagttaattttcacatcagatcccttttaaatattatcccttgcataaaggagaaagtctcaactcctcatctgggagtttgagacgctttttaatgtgagtccactttaatcagccttttttccccctcatctttagcatagatagatcctcacgccatgtaagtcctcatccacacaatctctctccatccagtcatccatccatctcttcagttaacaaatggtatacataatcagagaagatatagccttcgttct

SEQ ID NO: 7182 - DNA, 1022 bp, Homo sapiens
atgtatcttggaacttaaaaaaaaaaatttacatgccactaagtgtatgagaatgaatgtttcttttttttttttttttttttttgaggtggtgtcttgctctgtcacccaggctggagtacagtggtgcgatctaagctcactgcaagctccgcctcccgggttcaagcgattctcctgcctcagcctcctgagcagctgggactacaggcatgtgtcaccatgcctggctaattttttgtatttttagtagagatagggtttcactatgttagccaggatggtctcaatctcctgacctcgtgatctgcccacctcggcctccccaggtgctaggattacaggtatgagccactgcgcctggcctgagaatgactgtttctttacactcttaccacattgcagttcttaatttttaaatttgaagtcaggttttagcatctttaagtttattggctgttttataaatgtattattttccctgtgaaattcctatttgaatcttttatacccccaccccctgtcctttttccccttgtatctttttaaaaaattgatttataaaagcacttgggaggctgaggtgagtggagcacttgaggtcaggagttctagaccagcctggccaacatggtgaaaccccatccctacaaaaaatacaaaagttagctgggtattgtggagtgcgcctgtaatcccagctacttgggagactgaagtgagacaattgcttgaacccaggaggcagaggttgcagtgagctgagattgcactccagcctgggtgacagagcgagactccatgtcagagagaaaaaaaaaaagcactttgtatattaaggaaattattattattattattattattattattattattactttgagacggcgccttgctgtgttgcccaggctggagtgcagtggcgcgttcacagctcactgcaagctctgctccccgggttcacaccattttcctgcctcagtctcctgagtagctgggactacaggtgcctgccacca

SEQ ID NO: 7183 - DNA, 1028 bp, Homo sapiens
gtgtgctttaacgttctctctataacaggtttgctttcattgttttgtattttaagttctttatgtcactgttgctcttcttaagaaaatgagtcattaattaccagtggtatttcagattagagttttgggaaataatgcacaaaattagctgtgaaaaaatttcttaaatgcaactacaaaactcatttgtaggagtcttcttcctgggggcattcatttaaaattctaaaggaggaatgtactgtgcctgtggtaattggtgaaaagacctgactttggggccaattttggttgttaaaaggtatggtagactactgtgtagtatttgtacctgaggagcaacaagaagctagaagttgatggagttgctaggcattaggtcaatttctatggaggatggatttggaggggggctgagggagtgtagcaaagaggtaatagccatagcacgtggctgagtattaaactattttaatatttctacaactatttatattgcatggttgagaatctgaaattactgttgatcagaaatttgtataggaggagatccttttctagtttcataagtctgtggtaggggaggagtggtttaagtagttaccactagaagatgattgaccagaagattgaacaggagtagtgtatgccagtagtacagttagggcagggtcaaggtagagactgtggttaaatctttgtggctgaaggtcactcagaggtgagaatttaagacggcaaaggtgttatcaatagttcttttaggaaaaaggaaaaggcttatccttgttttgtgttttgatttgcgaggactggtttaaactttgaagaggcaacctgagagtgtacttgtaccatcagtaatggactaaaaaggattatggtggtgctttattcatacttctcacttacttagggcttaattatgatttccatatgctttgtcaatttcatagtcctttgctcgtacatcctacctaatacatcataactgatttgtgagtatgctaatagtatgctaatga

SEQ ID NO: 7184 - DNA, 1024 bp, Homo sapiens
gtagatttgccattagctttttcgtaaaataaaagcacagaacagatgtggtggtggtatggaattgtaattacaggtaggttgtgaccttcctttaaatttgttataactccagctaaaattaacaaagaatataaatgcaagtatgtttactccaatttttttaaagctcaacagcagttaactacagctcagttacttttctagtccagtctggtagacaggggtatttgtatagagaaatagacctgagttctcaattaggtcatttccactctcaacccccaatataaaattctaagctgggtatgcaaataaccatgtactccgttagtgtttaaaacagcgttaaaaagaaaaaaaaggctttttggcctcttctaattgaatttttactatgcaaaatttatctagggtagttgaatccaactagggtagggttcgatagaatcctctactagttttcagttcatctatttactgaggctgaaccagcttttaagtaaggaaaacggttgactccattcactacaccaaggctaggagactaatgaaaattcaggtccatcccgcaagcatctgcacgtgcttgaggatctcttttcctattcttacctcaaagagtacttgaagtttctgaaaacaaatctgtaagactgacatgtttggggcagtaatatcttgatgttaaaccatgaacagaaccagcaagatcagccagtacctgaaacccaatacagagtagttcacagcaagaagtacagattgatctggttcccatgcctgaaaccctgtcatctagcagttctaccagtgttcctgggccattttcttagcttcttgagtgagtttagctctttttgtgttgacttttagggcctccagcagctccatgattttccaggactttccagtctggcccccacggaattctcaggatgattctcatccagccctaagtcatgtttctagcctggctccagcgggtaagccaggccctgagaaccatatgaaagggctctcc

SEQ ID NO: 7185 - DNA, 1023 bp, Homo sapiens
gatacaatagtttatctggtgcgtatttggagaaaggcatgacaatcaatacgaggcagcgcagctcggagtcacaggcccgactcggtttgaggctccgcggaccataattagctatcacatcaaacaggttctgtagcctctctcggcttttttcataaaacaggaacaataacagcccctccctctgaggaggtgcgtggaaagcagggtgacgtaggcaagtgtgaaatgccgtgcggggttatcttttagtagaagagtatcctttttgtaaaatgtcttccttctcccttccaccttcttaacttcacttttggtcttagaaaagggagaaaaaaatagaataagtgaggggaggtggagagagggctactatggctataaaggaggaggggtaaaagaaccaagttgcctagctttagcagaatcaaaatacagtaatcaaaccgtttattcaaccagcaacatttgagaagtcggaaggaaagtattacattttaagatcagtttgctggccgggtgcggtggctcacgcctgtaatcccagcactttgggaggccgaggtaggctgatcacttgaggtcaggagctccagaccagcctggccaacatagtaaaaccccatctctactaaaaatacaaaaattagccaggcatggtggtacatgccggtagtcccagctactcaggaggctggggcaggagaatcgcttgaacccgggaggcgcaggttgcagtgagccaagatcgtggcactgcactgcagcctggcgacaaagtgagactccatctcaaaaacataaaaaaaaaattaaaaaaagatcagtttgctacaaagagtagcatctgccagttaccaagcacctgctgtgcccaggtgagtaggacatgcttcctgcctgcaaatgtccccaggcttgttcccaaacaagcggctaggaaaacaagaggctgattttacatctggcaacctccatctgagtgaaacaaattttaatgaaagcctgtggtaataaggt

SEQ ID NO: 7186 - DNA, 1026 bp, Homo sapiens
ttttaaagggggtatttatatgtgcaccacagtaaatcagtatcagtgatattctttaacttcttaccctcttcagttgttcatatttatgtttcagtatcccactgcaactaattttaagtcttattttttgccgggcgtggtggctcatgcctgtaatcccagcactttggaaggttgaggtgggtggatcacttgaggtcaggagctcgagatcagcctggccaacatggtgaaaccctgactctactaaaaatacaaaaattagccaggcatggtggtgcgcacctgtaatcccagctactcgggaagctgagacacaagaatcacttgaacccaggaggcggaggttgcagtgagtcaagatcacaccactgcactccagcccgggcaacagactgagaccctgtctccaaaaaataaataaataaataaataaataaataaataaataaataaataaataaaataaatcttaatttttgaactgcacatatacatatgagacactgtggaaaagtttggcagttcctcagcatattagatacagaattattatatgatctggcatttcatctcctaagtctacacccagaagaagtgaaacagggactcatatacttgcgtgcctgtgttcatggccgcctctgtggaaacaacccaggtgtctgccagcagatgaatgcatccacaaagtgtggtatacacacaaacacacatacacgctgaaacatgcgataacatgatgggcaaatactctgattctacgtatctgggtgcccagaatagacaaactgatagaggaagacagtagagtaagcgctactagggatggggaattagtgttgagtggatcccgagtttctgttgggtgtcatgaaaagttctggagatggatactggtggtggttgtgcacctttttgaatgttatttaatgctactgaattgtaccttcatagtggttaaaaggtaagtttttatatgttctgtatattttacataatacgcagattcatatctataaa

SEQ ID NO: 7187 - DNA, 1048 bp, Homo sapiens
tagtgttgtgtctattgacattcaagacagtgccgaagtcaccctctgaccctcccgcctcttgtgttggtgaactagagggaggaaggccaacaggcttttccataacaaagaagactaggaataggatgatctcactggaagcagaatcctaaagctagaagaggttttggagaaaacatactcattcctgctttttacaaaggagggaagagcctcagggaggctggagctctgggcttagctggcgggcaagtagagacgaagagctgacttccagtcagctgtgcatctcacaggccctttgaagttgttggagctctcactgggcaatcttattccgagatttcttatcaatgcgtttctgttttattgctggtgatttatggctcgttactgcttgtttccttcaccttaaccacgataatgatgctcctctttttgtttcccttattcctagtgtttgggatgggaccttcagtgcttttcccagcactgtcttcttcagtctttaggactaaccttaggaggcagcagagagagctatgccaaaaggtgttcatctcttgcaatctgtatgatttacttaccagcattgcttgttggtcagctccttgctactaacaggaatgttgggctgctgtgagttgtcatagaagtctgtttgattttcctgtgttcattttgacatatttggccttcggaatttgggtacaatgctgaaagacctacaatttccagacagtctttttgttttgttttttaaaaagcaaattaaatatttgaacaattttaatgaaaatatgacaaggtccaaattttaaggacagccggataggaagcatgagcaggagggttccgaggaggatatcttgcagctcttactatcgagatgcaggtggtaactcctttttatcccaagccccagagccacccacatgtttcacttcctttaaaagagatcctaaaattgtttgcttctccactctggtctcttaccactgcttttttctgttgtagggagaagagagtgaagggagaatgttcc

SEQ ID NO: 7188 - DNA, 1042 bp, Homo sapiens
gaatctctagtgtaaaagacatcaacgtgcttagcctttatttcagaaaaaaatcagggtggttcccagctccccagtccaggacaaccattagtcctgatgagtgagctgacgctggtgctggaacctgctggcacctcactggccacatctttggaaggggatggtggccttgcatccaagatgcctgaaaatcagcacgtgcagggcctccctatccagccagcattttccttccagctgaggcaggtgaagacttcataagctcatcacaggggagggaattaggagcagggcagcaggtaattaaacaagataaattatacctgatttccaacaccagctacaaagagttgaagatgatacctatgggtcgcgttaacacagggggcaactgccttgatcggcctgccatgggtcatcagactgcttcctaaattgagagaaactgagcaatctctcagccactgctatagtctaacttcttgtttgctgagtaattgtttctaatgtctctgaactcaaagtgaggtgctccaagacgctgtgaacttctgcaaagacacctccttacctactgggatcacgtgacctgacctcactcccagccaggctcccaaagggctcattccagccattccaatctcttcttctttatgcaaacacttttcccccacaacaagccttgtttgttccgataggaatacgtgtacgtcagtgcacttgtccttacgtcagttccttacaccaccaaagcacttcacctttctggaaataaaacttttaagacactactataagtaaaaatgagagtattcactagacttattgctcaggcacatttgagtgggtcccagctgtgtgattaagaagtcaactgggtggccttttctgggttatcttctgatcatggcctttcaacccaacaagggcccttccctgctcttccaccagtaaaggctcctggcctctcatcaggatctgccccccagagaccccccccagacactgcagggcctggtgatgctgtcctctgtaccgg

SEQ ID NO: 7189 - DNA, 1047 bp, Homo sapiens
ttacaaatgttatcagctagagatgtgtgctaaagtatttacaggtggtatctgacatgtccttaaaaatgctatagcaaaaagtagttggggaagggccagcagatagatgaaatgagaggcggaagtgctagaattcttgtagtagtggtgaggctacatggaggctcactatactcatctctctacttttatgtgtgttcggaaatttccattttaaaaataatttctttttggcaggggagatggaaaacaggaactggtaaatatcacgttggctgatatcaggatcttggggcctctttcttggttgctaatatactactctaaaaatgttaacatccctttttttccaaaatggaaattgttttggagtaataactatattttattcatctttctagtgctaaataaatgctctgagtttatgtattttttgtttttaggggtatacacatttatgattataatgtctttatgagttgacctccaatgaaatatcctgttatctctagtaatacttaatgttgttctgaagtctactttgcctgatatcaatatagccctacaagctttcttatgcttagtgtttgcatgatatacctatataactttttctgtccttttgctttcaacctatttgtgcctgtatatgtaaacagcatgttgttgggtcttgctttaatctctgtacacttattagtgtttagtccatttatatttagttgtttagtctaccatcttaatattttgtatttgtcccatctcttaattgaccttttttcctgcccaatagaacaacaggatacacagcaaggaaagcaagccctctccataaggacagatgtagaaatctaggaaatgccattctttgtgctccctggggcacaaatctaatacatcataaataaggcactctagagtgggcaccatgccagccctgactgtttgtctctggccctcatagctaaggcccctattgcctgccatgcttaagttcagctcaaccagttcttggcctatatgaggaatatataattgggttat

SEQ ID NO: 7190 - DNA, 1013 bp, Homo sapiens
gtgttgacttgtcccaacctttggctctaagggagggtcccgcagccttgagctctctggccatcttccacatttctcgcctctcccgactgcaccctgccccacctcgtgttttgtttctgcgtaatttgtcactgtggtgggaaagcttctagagcctactacgaaagtactggaggcacgtccagcatcttgggcttcggtctgtttacccaacactgctcagggctggaatgtcaccttataaatctccctgcctggcagctgctttctgtggccaacaggcagataagccttgaacccagggtgggggagttcccatcctcaggggcaccaggactcagactgtctctctcccgcctccgtctttctctgtcctggcttttctccccatctctcccaaacacacacagacgacacactcaaagataatgaaataatgactccagagttctgtaaagctgcaggataaaaacacaaaagatactcaaaagtctgtctatgctttttgttgcttttgctttcaaggacagtacagttatgctgagaaaacctttgtgtgtgtgtgtgtgtgtgtgttgtgtgtgtgtgtgtgaaatggagtcttggtctgtggcccaggctggaatgcagtggcacgatctcggctcactgcaacctctgcctcccaggttcaagtgattcttctgcctcagcctcccaagtagctgggattccaggcatgtgcgaccacgcctggctaatttttgtatttttagtagagacggggtttcgccatgttggccaggctggtcttgaattcttgacctcaaattatccgcttgcttcagcctcccaaggtgctgggattacaggtgtgagccactgtgtctggccaggaaaccccttaaaaaggagagaaaattgttattttccttgggcctcacttgtgagtgttttgggtgccatgggacgcaatggtaagggctgagcttggaagaggctctggctttgaccagccatgagatccaggc

SEQ ID NO: 7191 - DNA, 1119 bp, Homo sapiens
ccaaatgaatcttggtttgtttccatgggagggcagtgggggtgtctgggtggagggaggactgagcacctcctcgctcagtgttgtgaaatgggcagaggcgtcaaagaccctacacagaagacatttgttagagcaaggagccgggtcagggtcttgggaagagcttgtgaaggaggatctgagcccacaacactaatttaaacctagaatggaaccagccagaaaaccctacctagtgactagagcggcgtgagtttggcatggacgagactcctggctttgccagctgtttcagcatctcgaaatctcctaacctcagtgtttctgagtctttatttgtcacgtgacatgtgaggtgggcataattcctacctcgcaggggttaggaatgtgtatgtgtagaaaacaccaggtactgtgagtctctaatgcatagtgggttctcaaaaaatattagtaacgttcaacgatgaaaccagaggaatatatcactggggagactgtgctgccatgaaatccaaaggcgatccaaatctggtgatgaaacctttgtctgtggctgggattcaagaatttggcagtggatgtgctctaagaagacccaaggaagaatgaatgatccgggggtgtcatgttggccggggaggatacagcccagcctgggtcttcctggctgtgggctcagccctcggccccatggtgactcagaacttgaattcagtcagtcctgtgctccacacctctgcttcccagcacctaccccacacatcccctgccttcagaaggctgaaaggaggctgagtttaggtggatagaacagacacacgtacaatttctaaactccatataattgatatcacttaaatatcacagtcaacccgcagtcagccccatcctctgctcctggagataacaactgtgaaaacagggtgggagcaaaacaggacagggataaggtcagtccctgccagcaggacagcggaaacctctggcctgcaccaggctgccccgtgcctatgctctgttgatgacgacttggccaggttcagaaagcggccccctcctagatggaaactccaggcaggaagttcgcacatctggctctgtcttctgcat

SEQ ID NO: 7192 - DNA, 1094 bp, Homo sapiens
aggtcaggagttcaagaccagcttagccaacatggtgaaactctgtctctactaaaaatacaaaaattagccaggcatagtggcacatacctataatcccagctactcaggaggctgaggcagaatcgcttagaccttggaggccgagattgcagtgagctgagattgcactactgtactccagcctgggcgacaagaacgagactctgtctcaaaaaaaaaaggtaataggaattggaagccactttaggttgaagagatgacttttaaactgaaatctgaaggacacagaaccagccatacaaagatcaggcagaaaagcatgccaggcagaccaagaagccattgcaattggccccaaggtgaaaatggcttggccttctcgaggggtggaaaaataggaatgagcattggcggtggggagagaatggaacaagctgggtttggagaggtgagcatgggctggatcatgtggacatttctgagcatgtgggggaagattagatctttgtgatttggggagccattgaacggcgtggtgagacgtgatgagcctttcagaaaaggaacactctggcagctgagtgaaccacagattgctgaggggcaaaagcggaagcagggagaccagttgggaaaccactggaactgtctaggcaagactggaggcttggactagtgggtagcagtggctctgggaagaaatggctggctctgggatatgtctggaaggggcgctctcctgtgttcttccaatttgtctttgatcacagaccactgctgtcactactttttaagacatttgctctgtgtcatcttcctccagcacctcgaccacccccagggtattggccaatgtcatgctttgtgctgcaaaatattacacttcctttgggaatatttgtacctgaattaattaataacatacctagttgaaaatagttttaaggcagaaatttgcatctcgatagatgcaagaatagacaggtccttgataggttttaaaatagagttctgggttctaactgggtgtcacttgaccattctgaggttagttgctttatctgaaaattggttataatatacctactgtg

SEQ ID NO: 7193 - DNA, 1053 bp, Homo sapiens
cgcctcggcctcccaaagtgctggtattacaggcgtgagccactgtgcccggcccagtgaagatattcttaaattaaactggcatttttttttttctgcttgcacatggcactgaagaatgcaatgactgctagaatcatctggtcccactatcttgatttgcgctatgaggctggcagtttaacttgccttgctgttgcaccagcagcgcaaatgacaaacagtgaaaaagacaaataaataacatcttagtagtattccgaaaatagttttgatctcatggactgcctaaaagggtgctggggccaggtgcagtggctcacgcctgtaatcccaacactttgggagactgaggtgggctgatcacttgagatcaggagttagagaccagcctggccaacatggtgaaaccctgtctctacctaaaatacaaaaattagccaggtgtggtggcacgtgcctgtaatcccagctactcaggaggctgaggcatgagagtcgcttgaacccgggaggtggagtttgcagtgagctgagatcgtgccattacactccagcttgggcgacagagagagactttgtctaaataagtaagtaaaatgaatgaatgagtgagtaatgaatgaatgaatgggtcctggggccccctaggattctgcagacttggggaactgctgctctggactaagtcagtggtggaccatggtagaagggaggtattgactgagccgagggcttaaggaatgggggatttaatggtctgagtgaagggaggtttgtgacctcagtatgtggcccagaatttcaggagaccttgagtgaacattgagcttggaatgatttcaggagctgggcttctagccctgctgaataatgggcagctgcatgggcagcgttgggccagattgtagggggctatgaagacctttgtaaagattccagggctgagactcaggagactctggattgagggggctcgatctggactttggagagtgactaagcatatactgttttcagaaagcttttgagctatttataatcgtgctactc

SEQ ID NO: 7194 - DNA, 1024 bp, Homo sapiens
tgttttcagtaaacatggggtttcaccatgttggtcaggttcgtctcagactcctgacctcaggcgatccacctgcctcggcctcccaaagtgctgggattataggcatgagcccccacgcctagcctcaggttcttgatacatatttttaggatgtaatttaaattttttttttttttttgagacagggtctcactctgtcgcccatgctggagtggagtggcacaaccagtattttttgtagagacagggtttcatcatgttgcctgggctagtctcaaactcctgacctcaagtgatccacttgcctcggcccgctaaagtgctagtattagaggtgtgagccattgtgcctagcctgtaatttaaaaatgtaacttattttgggattctttttctcctttaggtatactctggataataacgttctaaccctggaacagagaaaattttatgaagaaaatgggtttctagtaatcaaaaatcttgtacctgatgccgatattcaacgctttcggtacagtaacactatttgttattttacaatagtatgtattgtgtgcatgtaatgagaatacaaggtggattcgctcctggctttacagatgttttttaatgatttggtttgttgggaagtgtttagaagcatgggctctggtgccagactggctttttattttttatagagaaaggttctcactctgttgtgtaggctgagtgcagtggtgcgatcatagcttactgcggcctcaagttcctgggctcaagcaatcctcttgcctcagcctcctgagtagctgggaccacagttgtgcaccaccatacccagctaattttttatttctttgtttttagagacagggagtctcactatgttgcccaggctggtcttgaactcctggcctcaccctcctgagttgctgggattacagtcgggagccaccatgcctgggcttcagtctcagctccaccacttaatatcatgtgtcctggggcaatttacttcacatcccatgcctctgtt

SEQ ID NO: 7195 - DNA, 1022 bp, Homo sapiens
tcacaatagctaagacttggaaccaactcaaatgtccatcaatgatagactggattaagaaaatgtggcacatacacaccgtggaatactacgcagccgtaaaaaaggatgagttcatgtactttgcagggagatggatgaagctggaaaccatcattctaagcaaactatcaaaaggacagaaaaccaaacgccgcatgttctcactcataggtgggagttgaacaatgagaacacttggacacagggcgggtaacatcacacaccagggcctgtcgggggtagggggctgggggagggatagcattaggagatatacctaatgtaaaggacgggttgatgggtacagcaaaccaacatggcacatgtatacctatgtatcaaacctgcatgttgtgtacatgtaccctagaacttaaagtataattttaaaaaatttaaaaaaaaagaacatcaactttatggtacaactgagtctgaattcgaagacatttatgtcttcaggtctggtttttggaaaacaagtttcttgcgtagtcacagaattctatttttcaaagctgagagtggatacaaatggtataggttgagctggggagctgggtgttggtattgaagtctgtggccctggctttgttttcatcgacttgggtgagtacctgaggaggccagcatcggggaatggaacgattcaggagctcagctgctgaagctgcgaaaggcacaactctcagacctgcttcctggtagtgtgaatgcaagtctggtagatgtttcattcgggcaccagttgtcatcttttagaggtgcctttttagtattgccttctgtctctaagacagggaccaccaaggcgtctgggtgccaggtaggaaactcaccatcagtcagtctgagtttgagaacctggaggcagaaatcaccaagacattagacccacagattgcctgcaaatccaccaaacccctgggccgaaaaatccgtcctgagtctctagcatatcagtgatcataaagaagcac

SEQ ID NO: 7196 - DNA, 1137 bp, Homo sapiens
cagtgtttctttgatggtctgcgatccaatcagtgagtcaaaaactggatttctcgcctcccatgttgcctatttattttttattattactttttttgcttttatagatttgaggaatacacatgcagttttgttacatgaatatattacataatggtgaagactaggcttttagtgtagccatcacccaaatagtgtacatcgtaccccctttatttttttttaatttttgtgggaaggattagaagagcaatcaatgttatgattgctatgttatgttcttgtaacttatgtagagaaagtacttgaaacgcatcaagaggggtactcttgacagtttttaaatcatggagtatgcaattgagattgttattacagtaaaaactttttaatttttattttcaatttaattgaattgaattttctgttagctgaagattaagcagaaatactttattcccttttcctaaaaggactcctaaaatgctcacattcccttcattgccctaggaaaggcggttccagccttagggttcttgtgctgtacttggatggcagtgactgtgtcaggagggcattggggttctctgcagggtgcatcgggcgaaaagcgtgttacggtgaggaggtgggactgctccagacccaggactggatggatctgttcttgaccccaggatgtcatctggaaccagggcaatgtctttttctttactacattcctgatgtcatgagtgatttcacttttcccaaacacagagcttagaaacaaattctgggctcctgggatattgtttattcatgtttcttgtgcagtttattaagtacacagtacaagactgtgatcacttttcttgtgttcgacgcatagtttcggaggtttggatgttcgataattactgtgtgacttgatcagttttcttcctttttttttgaaatggattctcactctgtcacccaggctggagtgcagtggcgtgatcttggctcactgcaacctctgcctcctgggttcatgcgattcttctgcctcagcctcttgagtagctgggattataggcccctgccacatgcccggctaatttttgtatttttagtagagatgggagttttaccatgttggccaggctgttctcg

SEQ ID NO: 7197 - DNA, 1049 bp, Homo sapiens
tcgaccctagcatcctcctatcagccctaccccttggatgacagagtaaatccaatcttcgttattttaagcaccttcctctcaacacctcttgatcactgcagataccattttgaatccacttagccaggtacaactacctgggggcaaatcccaattagaaatgaaggcaggacagtggagaccaagatgtatatataggatattcaggtctcctgcagggcatggggcctgtgctggcctctttctgaagagtcagcggtagccctgcttacccacacagcagtcatcttggcggtggcatgggccacctaaccctgatacccccttgcaactacattatttttagcagaggcatcaactaactcttcaagtttgaaagctcagaaacaccttgaatgcctttttttctttgcaactcaccctgctcaattacctggccctatcaactccttttgtccctcctctctcattcagtgccctttggcttctttgacaccatcctggtccagctgtgcatcactctgtccttgaaattctgcaaaaacactcttgaaatgtcctgcctaaccctcctttctccttccagttcctaatgtatcctaacagcctagtaacacccagaaaaccaaatctcgtgacatcgttttcctacttacttccccttggcctattcagtccgaactctggccttttccaagactccgtaacttgaatttctctctccttgtgaacatatttcccggtgcttcctcccgggtgagccagcaacactgttcctcaagcaccactcgttcattgtggactctgtgttatgctgttctccacagggccgtggtgcccttctctccccgctctttatagacaagcctgacttgttcttcctggtttaccccaagtctcatcccctgtaccatgagactttttcagatgccctaacctgtactgattgcccctttctctgagtgccagtaccacttactgcctttagactgcttagcagggcatcttaactctccgccttgctattgatgacttctatggaggat

SEQ ID NO: 7198 - DNA, 1533 bp, Homo sapiens
gaggccgagatgagtggattgcttgaggccaggagttcgagaccagcctggccaacatggcgaaaccccatcactactaaaaaatacaaaaattagccgggcgtggtagcgcatgcatgtagtcccagctacttggggggctgaggcatgagaagcgcttgagcctgggaggcaggggttgcagtgaaccaagatcataccagtgcactccagcctgtgcagcagagcgagaccctgtctcaaaaaaaaaaaaaaaaaaaaaagaaaaagaaatatattacatataactgtgactactttggtatttcattgggattatttataattttaaagttgtaacattacaattttgctacaattttgaatgtaaataattgtaccactacaatcactaagttatcctgaagtatttcatggttttgctctggtgaatttttctatagtattcctaaataatgcatattacaggatttaaggtatataaagtataataaaacatataattggaacaaaaccatggaacttaccttgctggcctgtgagacaatgtgagcgctggaagtctctaaactgctccattttatggtggtcaggtgaacaggtgctggagggaacccactgtaagagcaatgtccaaatgtcccattttattctaaggacaatagaagatacttgcttacctatgagagaaacagaataagataggtttaccaaggaaaaggcattaaatttaaacagtgcaaaagaggctgtggcaagggaaagataagacatgggaatggagaaaagaggtagagagattttctttgtgaagctgaagaaaagccagccagcccaccaataccctcgaacgcatccaattcgaatatatcctcccatccctgctcctctgtgcttccccaccccaaacgccacacccagagagtattctaaaagttttcatgtgtgcacagttctttgtttttgaaataatgtgcttaatatcaaaactattttcaatagaactcatataatttttaatatgaactcttaaacacagctaccaaattttttttgcaaggctgtcctcagggctccttttttgtgtgaactagcatgagtgtgtttcgagtgagtttttgaggtgttgttatttgagatgaacagctctgacaatagggaggcctgctgtgcccactcattgtgtgtgtgtgtgcatgcgggctcccgcaccgcgccacagcacgcacgttacagtatggaagcctggataattagataaagtcagacccccagatttaggttgtgataattagtgggtacgttttccttaggcacagcttcatcataattgcacatgcttcaaaatcctgccaagatactttcttttttctctccacctctttatgatttttttttttttttttggtttgtttggagtatgtcattcttttctttcatgctcaggagaacttccagtggtgaattcatcagctggatcaaactgctgtacttgtaactgccagtcaacgttgcaggccattctacaagaac

SEQ ID NO: 7199 - DNA, 1284 bp, Homo sapiens
tcatgaaaaatgtattttttgctgtgaaccatggtcagaaaagtttggaagacactgatttaagttactgttgccttagccccagagatttcccacgagactcactcagggaaggctgccattctccaggtcccttggggcccaagttatccaaatcccttgagatccttggaagaaaaagccattgtgaatgtgatctgtttgtcatcattattaataatatgtacattgaaaatgaaattgtgcaatagcatgtgtgtttaactcagaatattttaaaaatttaaatgactgaagaaatataatccagatcgtacttaatgatgttcatacttaactgatccatgaggtagatgtggaattaacatctcaggaaggaggggagatttgcatttctgtgtcaagactctcttagaagttttctgtacaggagagcagaggatcagcatttcaacttacattgaaaagggcgtctctttgcaaatagtaaattgtgaacattttcttgttgaatgaaggcaagacttgtgttactgtaggaattcagaagcagctcttaatctacagtcttgttctatttttcctaggtgtattgtcagcctttggagacttttgctgtgtgtttcatagaatcgtgaacacagacttttatttcgcttttctgaagttttcatctttggcttttgtagaactaacaggcttcacatggaccaagtttccagtttgtttttttctaagagacaggatctcgctatgttgtccaggctggagtgcagaggctgttaacaggcgtggttgtagcatactgcagccttaaacttctgggctcaagtgatcctcctgcctcagcctcccaagtacaaatttccaacttaaaaggaaatagcctcattcttcttaatttggagcagtgcaactaagtcagaatctgtaaagatggtttggtccagtgatttccttgtttccaccctgtgtgctaacattcctaggtagttaaggtaccagctagttcacacggcacccacgtcttgttgtgacagctccctggacaccggcttgatagtctcatgaatggagtccttcctgccattcagctagttccttgagcagcttagtagaggagtgtagcacagggacccagaagcctgatgcatccaatgcagatctctcacctcacagtctctgcatctcctgggtaaaatgtatacgccagtgctcgaacctcttagcttggtgtcaggattcaatgtaggcagggtgcttaccagaggcctggtacatact

SEQ ID NO: 7200 - DNA, 1024 bp, Homo sapiens
actgcaaacggctccctgtgtgtaatatgtgccagcatgtgtactgtccctgcaagacagtccacggcaggagcaatgaaggaagctaggctttgagggatcgtctttagtctctccatgttgtccctcattccatgtaggatgcagagggtcactcacacaggctgctcaggctctctgtgactaccgttaatcctctgtgctcacactgcagctcaaaccctgccactgactctctaaatcacatcacgagagccaagcgcctatggggactgcaagtacaaagagtccctgacttacagatgaaatggtgactgactgacttgagtagtgactgctgcaatcgaatccctggccccctaacttaataggcatctcctcctagcaaaactggaagtctggcctccaatagcatccctgcatgaaaaactcctggatgggaagccttacagaagccttggccactagagctagttgatgctgccgaaaaggaaaacaatccactgagaatcacatctggaagtgagcccatcaagagagtgttctctacttcctacaccctaaaaactgcccgtgggagagcctgaagcctcctctccttggggaagcaaccaggccatctcaaaatcatctacacttgaaaaaagacaaagggccctcacgtaagtcttctacatgtaaatatgtcacagctcaggaaattagcgtatcatcttctcattaagctctaccacatgaaagcaactggtagataggaagatcctcttcccatttctttcccactgcttcctacttttcacctcttcatctatcaatctgtttatctgccctttcattgtgccaaaaaaggtgattccgaacatttaattattagagaacacaaagtgaacaccccactcctggtagaaagtattacaaacagccagctctttattttcccaggataccatttcaaaaaggctctatgtaaaactctctaaaaagaggaatatgaagtcaccactgatgagggccagcaggcaga

SEQ ID NO: 7201 - DNA, 1027 bp, Homo sapiens
tgggagagaacgggaaaggggacttgagttacagggtgacccagaaagacgattcagctgtgtccagcctgccacccatacgtaggccaaccaagcacttcatgaagaggaggcctcgtggcatattcagtttacacctgaaatattccttgatgggacagcttgtggggatggctatgggggaaggggaggttgagaaaggaagttctcgacaccagaaatgcatcggaggaccacaatcagttctatgctgccaaagattaaaaataaataaaaacataaaaaattaagaggggccaagaggaagacattctttctgcaaggaaatttcttttaaattctgaactgctactacacacaagtgaaagtcaaccctatgtaaactggtgtcctctctctagccctctcccttactggcccacttctctctccgtagagagcctgaaaaactgccccaatgccacggtaaaggcgaggaagtcttggctggcgttgctgactcacagtcgccatccatctggacacaaagagagacctgtgggagtcgtagagggtactgttagccccggtccatgcagggggttcagccgagcccaagactcaaagctgctttcctttcaggatttgtagtaacgtaaggtgataatggccaaaagtggttctctctcattaaaccaaccagtaaaagcgtatcctatttttttgcacaaggtgtttcattttcgtttttatgggaaaccaagggaaaagcacattgcgatccattcagtgtttaactgtcgtggctcattttctgttcgttagcacttgtgtgacaaaagagctcagatccgacttctcctatgtgtcacttattccaagaacccaactatgcccttaggtagaaagatttgactcgtgtgtctactagccaacaggcagagcagggttgaaaaaaatatcagctcccaaagggcccatgtgtctacatcatcagttactgtcatgcaccacatttgtgtgcagataccaaaagaggaggaaagaa

SEQ ID NO: 7202 - DNA, 1012 bp, Homo sapiens
tcctacttgaaggacagactaccaatctgtcacagccatcactcattcattcgctcaaaaaaacagttattgtggccgggcgcagtggctcacgcctgtaatcccagcactttgggaggccgaggcgggtggatcacttgagttcaggagttcgagaccagcctggccaaaatggtgaaactccgtctctactaaaaatacaaaattagctggccatggtggcacatgcctgtaatcccagctactggggaagctgaggcaggagaatcacttgaacctggaaggcagaggttgcagtaagctgagatcgcaccactgcgctccagcctgggtgacagagccagattccatctcaaaaataaataaataaataaataaataaataaataaataaataaataaatagaaaaagaagaagaaaaaaaagttattgcatacctattaggtgccaagcacatcactgggcactgagatgagacataaatcctgtcctccaagatgtgtgataatccagccagtgtctgagtggtgtaataggaatctgtgtgagggtcggggatgattcaagaaggcaggcgtcaactgggtgtaaggagaagagaagtccccacagaggaagcagagagtgagtggggtcttcaagggtgcaaagaattttgcagacggaggaatggggcggggaggcatgcaggggagaggccagtgtgcctgaaatcacagtgacaggggtaggggacacagtgcccttcattctggaacatcaagtgaaaagagaggagttggtgagggggctggggcctgcaggctcctggaggcttgaaggctctgcgaagaggacttcctcctctatagggagtgttagccgcggtctatttgaagctgaggagtatagtgtcagatttccattgtcgtagaagcactctccggaaactgcttggaggctggataggaaaaacccaggacaagactgagaaaccaggacatgatgagggtagggcgggcaacacctggc

SEQ ID NO: 7203 - DNA, 1034 bp, Homo sapiens
gtaaaatgtttggatactggcatatctgaaaaagtctttattctagctttgtatctaatgaatagtttgactggatatagaaatatacaaaaaaaaaatttctctcagaataccaaaggcgttgctctggaaaagcccaccatcctatccattgtatgtgacacccccttgggctccccaacaatgggatcctttgggaactcctttttgctccttctgatctaaaatttcaggatgggtgccctgatgtgggtctttgtaaatccattgtactctgtgttcgatgggcacttttagtctggagacgtgacatgcattcttttttagttgtgaggttctttttggattgtttctttgacatcttctcccctcttgcctgtgtcctctctttccagaattcctatttatcaaatgctgggcatggcctcccactcctatacttgtctctccagctgtctatctctgtctttttattctactttctgggaggctttgtcagtatttactttaatctcttctctggactttctaacctttgccattatggttttgttttttgttgtttttttttttcttaaatttctaagagtttctttatattatctgattttttaatattatgctattattgtttcaggaacataatatcctctcttatcactctgataatattagttatcattattattctatgtttccttccagctctttttttccagtttatttgtgttggtctctctttcctgtacgaggcttcctcagttgtctgctggccctggtctgttgcttcacacttagaaactaagcagatgctccatttcagggtgggatggtcccccagtgggtgtccctgtgacgtgatcccgtcgcaagctggttctttccctggggaaccccgaatatcagtgtcttggtatctggacatctttcctctctggctctccattctctccagaaaaaacccttcccttcctgcctgggacatgtcctcccacatccagggatcgggagggaacagtctccacactgggtat

SEQ ID NO: 7204 - DNA, 1026 bp, Homo sapiens
ctagcctggccactgaccagctgtgtgatcattggttgacacaaccactctggcccatggtttaccggagggttggactaggaaatcgtaaagacatttctgagctgtaaccttccatgaatctatagataagaaaacagtattgggctgcttggaaagataaaatggaagctctatcaagatgctgttgtccacccaaggacatcttctcttgacattctcatcccatcactacccgggtcagcctcaattcctcaatcctttcagaatccacttagtaagagagttaaccttgtgtgaagaagcagtgatagcgccattcctgttgcaggctcatagcacggaggttgagatggagaaataccctcaggcctatacataggcattattcagaaatctaattttaatacaagaccatatttttaataggacaagaaataacatgtatggcatccaattaaatgtagactcctgtcttttgagtatgaaatcaacacaacattgactgctgtcctctcatggaagtagacagtaggaaagacctcacattctagccccttacactgcaacagttgacatattcctaaatggagagtgaggaaaggtgaggagggctggatttgaccacaggccttgaagaagttgactgcccatgggaaaagccaatctgtgaccttgaagaagtcaacccatgaccttggcctcagttgacgctgctctgagtgaagcattgtcagacccccaaggaagcacgtactgagaaacatgacttcactccatgagtacttggggaaactgaaagggtttgtgcccttcagtttccccaagtactcatgggctgtagcaatgtttctcacttcctaacccataaagccaaatggctcatggtggaccggacttcaacaagtattaagttgttttctcacatttatttcaatcaaagagctgcgctgtttgcatggccaaataattggaaacaaataccttaatacaccttacaaatgtgtatccctttgcactttagaa

SEQ ID NO: 7205 - DNA, 1035 bp, Homo sapiens
ctcaacctgatcacactgaactccccatgaagagggccacaccacagggttcccatcaggctatgtctggcaaagactcagctattccgtgttcttcattggaaggataagaagttgctttctatctgacactgtgtgcacagacagagaaggcacgtatcattagaatgtattttttaagcctttcttttttacggaaggaactttcagaatgataagtcagcaaatgaggcagcattagtatgcagaaatagctacaaatatataacagaagagttttctatctaatgtcagggaaaacaccttgaatcttatgcagacctgtcatgttctgttgaagggtgtatggtcccagtggtccccaacttttttggcaccggggacctgattcatggaagacaatttttccaaggactgaggttgggggatggtttcaggatgatttaagcacattacatttatttctattattattacattgaaatatataatgaaataattctacaactcaacataatgtagaatcagtgggaaccctgaatttgttttcctgctactagatggtcccacctgagggtgatgggagacagtgacaaatcatcaggcattgaattctcataaggagcatgcagcctacatccctggcaagcacagttcacgaacagggttcgtgctcctgtgagaatctaatgccactgctaatctgatgggaggtggagcccaggtggtaatgtgagcaatggggagtggctgtaaatacagatgaagcttcactctctcacggctcgcctcctgctgtgcagccagtctgtggcccaggggttggggatccctgctacataagatccccaagaaataaagagacagctctgatggtttaggtattcacctgcccaaagacagacctggacagatggtctcttttggtttgtccaactctttaattctgttgtctctgaatggtaggaacatatcgagtgcccttactgatggccggagttatttatagtctcatcttttacgctgtcaccttga

SEQ ID NO: 7206 - DNA, 1023 bp, Homo sapiens
tttataatggaatcatctgggggttttactaaatgcagatgcagtctgcattcctccaagttcccgtgtagttgctgaggctggagcctataaagggcattttgaggtcgaggatctaaagtatcctctctgacgtccatgctcataggttatttttctttttcatctttgtttcaggtaggtaggtaggtaggtagatagatagatagacggatggataggcagatagatctctatagaaatctacatagagatctctctgttcatccatctatctatccatccatctgttcaactatagagacctatctatctatcgatctatcggtatctatccatcggtatctatccaccaattcatccatccatgtacccatccattcatctatctatgtatatatgtagatatctgtctatccatccatccatccattaattatctttcccacagctattttatgcaaacacttagacaaaattagtagtgactgtacaacccactcaaagagaaacaaaatcctcctggtggaggtgatcataagagagaaaggaagggactaaacacattgaaatgtccctgtctgaaagcattcctttcttgggcactggggatacttaaaaatacaatccactctaaaaggatctcttcctctgtgacatcctaccaaggtcgaagagtccactatgagaatttcacatttgccaaattgcgaagtcctacagacctgagcagtcctgggccttaaaaactctgtaactcctacatgaccaaatgggagtctttacggttgtgtataatactaaagaagtgttctgcatggatacgaggcatattgtagcctttagatatgaagtacattattttcactcctctgttttgtgtaactattaaataagtgggcctgagacactgcttttgcctactgtctgatcagattttttttattttctagcgtatatcaaatgtgcttgtttctgttaaattgagagtcccctcttttaaaaaagaaaaactgaagtgtt

SEQ ID NO: 7207 - DNA, 1029 bp, Homo sapiens
ataggagagagaaactccaaatcacttaatagtcatctatcaaatgttatttgataagtgtaatttatcaattttaaggccaatgagtttaaggcaatcagttattaaagaaatccattaattgggcaggatttccattgcttagaagtttttgcagattaatgtgctgcatattaatgaactaattatttcatgggaatatttatgcaagccagtgtactaatatatctatttctcaccagacaaaagtctaagttatctttctttggcaaaagactcactgttgatacacagcaattaatgttacggagttttagtgaggatttttttgagccatcttaaaagcacgtctgttggttagagaaatgggtatttggttctctgtactggtatgtgttaagaagattatgtcttactatttctgagctctttcaagatcaaatgaagacagaattgttcaaagcgtgggttgacctcccctactcagtttttggctccttttggaaatctgatgtctgcccttctaagcgtaaggtgagcattatctggtcagtttcagctgaccactatgtgactgagatgtttctgaggttaagaattgagtgcgagtcaggccctccctttgtggggttaacatgagaaagaagacaacttcaaatttaattttaatagaatcagacttcagtatcctacaagaggtattaatggagtcctgcaggagtgtaaaggggaaacactgaggaggagccagggaagacttggtggggtgagttccttcatttgggtactctaaaccgcccgtattatcctgttcattcaatacttttttttttttttttttttgagatggagtctcactgcattgcccaggctggagtgaagtggcgcgaccttggctcactgcagcctctgcctcctgcgttcaagcgattctcgtgcctcagcctcctaagtagctgggactacacacatgcaccacgatgcctggctcatttttgtattattattattatttttttaagtagagat

SEQ ID NO: 7208 - DNA, 1082 bp, Homo sapiens
gatttaaatctccctggtatggtttccattagaatggaagctctttggcaggtctgccaggaccatttatcaccttgtccctggtactcagacctcggtgctggcaaagctgggctcatgaaggctggctgcgcaggtgggtggctggctcacgcgcttggtcctggaggtgggggagaagagatggtccaccaaatggttcttgcagttctccccgtcctgccctctggacatggctgtgttgtggcacaggccgtgttgtacttgtggctgatcttgatcgattctcttctctgctccctgtgctggagctagacaccaggtgttttttttttgttttttttttttttttttgaagttccacaggtgattttgatgtgtgagccgtggttgaaagccacagctggactgcgttggaagggaaatggaggtcagcttaggccagttggttcacatggaaatcaacaaaaccagcgtggctttgaaggatgtataattctgttactctttgttggacccacacaactcagcagttgaaatttattattagtttttttttctcctgcgttttcatctcctaatttgggctccccttcatatagagcttttggaagcaagtaagaattcaagttcatcaggcacattttcactacacctggcagaacatattaaggtgttgtgttttataaaatccagccagaaactataggtggtctccagctccacacacttagcaaggcccctgctcaactccccacccaaccccagttttccagtccttcctgcgttcaccagaggcacagtcaggatcaccttagacgctgagttcagaaatggagaaggaatacagttaaaaaaaaaaatcaagatcaggtgagcagtagccagatggcttctccacacaactctctttctggatgcttctggaaattgccatccaattttggtcattcttttggctgtataataattcaaacggtgctttgtgaataagttaccttttaaaagttatgcattttagcatctataggaaggtcaaggaattattttacacctcagggtgaaataatttaattaggtat

SEQ ID NO: 7209 - DNA, 1050 bp, Homo sapiens
ctgacaaccaccattccactcttcaagtctatgagtttagctacttagatgcttcatctaagaggagtcacatggtatttgtccttctgtgcctggcttctttcacttggtcctccaggttcatgcatgctcgtgcttgtggcggaactgcttcttttctaaggctgcctggtattccactgtatgtatattaccacatgtgtttacccattcatctgtccttgatggttaagctggttccacaaaactcctagaagaaaacataggggaagaggttcaggacactggtcttggcagtaattacgcggctgccacgctaaaagcacagtcaacaaacccaaaactaaaccagattgcatcgaactaaaaagcttctgcacagcaaaggaaacagtcaacggagtgaaaaggcaacctgtggaatggggaaaaatgttggcaaactacatatccaataaggggttaatatctgagaagtttaagggatttccgcaaatcaacagtaaaaaaatgaagaacccaactaaaaaatgggctaaggacttagacatttcaactcggagtttttttttattattttgtctttttgagacagagtctcactctgtcacccaggctggagtgcagtggtgccatctcggctcactgcaacctccacctcctgggttcaagcgattctcctgcctcagcctcctgagtagctgggattacaggcatgtgccaccacgcctggctcacttttgtatttttagtagaaatggggtttcaccatattggccaggctggtcttgaactcctgacctcaaatgatccgcctgccaatcctctcccaaagtgctgggattacaggtgtgagccaccgtgcctggcctcaactcagagtgttagtaatgcagccggcagtgatgtcaagatgcggacacagggacacttggaggatgggagctttgtcccttgtccccacctgctcctcagtatctcttcatgccttcaggagagttttaaagataactgggttttcatattagaaatagcctgttttattccatt

SEQ ID NO: 7210 - DNA, 1081 bp, Homo sapiens
gcagcttgttttaccgtttagatcagaggtactcgacacagatttccaattcatgttactaacaggcgcccttaaagtgctccattccccttgcttggtactccaaaaaaccatcctggtcccattatcatgtcctttcaaagaagcataatggctagccattttggacttctagagagagctcttcggagatttttcttctagaagattaagaagtcttttaagaattacaggttcagacatacactcatcacaacagtctagattgcttcgaaatacgaaatgaagctgaaattaatttttacatttaattttataccttaaatttctttatcattgaggtgccaatgttttaatggaaaagtagaaaacagtataaaattcagtatcacctatttgtctcaaatacaagtacagtgagtattaaacaggaatgacaatagagtagcaaaaacagaactgtagatttgcccaaattaactgtttctccgaatttgaggtgtatggcaagttgaatctttgatctctcagcagttgttaattacattatcagcttaacgctttcaaacactacgggaggcatttctctgttcacatagacttaagtacacatatactaagctgtaaatagtctgccttccattagtttggtctctaagcactataaatatgtcgacttcatatcagtctatgagacccagtgacccccttttcagaggcatcggtaatacatttggcaaatgtcttgaaacatgaattgtaaattaacataggtagaaccttgataataagagtcccaaatatgtatttttaaaaatgttaacattaggaaaaaaatattataatcatcagctctatttcctgaaaaagttcagttgaggtaacctctgcaagtcacagctccacatttacatactgttctgaccctctttttggctgggctgtggtcaatagaatctgaagatatatctccagaacctgaagacacagaaaaagaaatataggagaaagagagttaagacaatttagaataaatttcaaattttctattatattagctttattatcagtgatagagggt

SEQ ID NO: 7211 - DNA, 1129 bp, Homo sapiens
cgtcagctaccgtgtccagccgaaacatgaagtttcaaaatgccaagatgtatcacagaagacactcagcagtcagccacatttatcttggagaagagttccaggacttaaatgtttgaatagtataaactagttttttaaaaagtctgcctgaagccgaagattaaatactttaaaaagttcactgggtgatcttggcatgttgacattatcttaacagtctaagcttgttaccttacaccaacctgacaggttcattagaagcacatgaatacatataaaaggcataaaagactgggtcaatgaatatgagctctgaattctaaaattcctttgcatttctaggcagtacttaccatagtatgtttacgtacctggtgagtgacaatgctcaaaaatttctgaagtattcatccacattatgctagcgaaatgtcaaattgtcctttaatattcaaatgcatgaaccatcactccttggccttttggccaagatcaagtgtagtatcaaatgcatgaaccatgaaagctatcttaaaaggaaagtaacatttaaaggaattgaatataaaccttcggttaatcttgctagcacgtagtcaatacatcagtatttttctgccccttttatagtcttactggaaatgactgtaaaacagaaacaaagctaagccatggtaaatagaacattaaatgcccaacctaatttattttgctaagagaaactgatgaactaaaagagaaacaactattgtctacattttagatatgggggaaaaaaccctgagattactaattatgtatcaccatcctcttaatgtagatcctgaaaatgatggtatcaatataatacatacagtggattcaccttttaaactggatctattacctttgatatttgtcttacactgaaaaattctgacatcttcaggaaaccaatatgatggataagctaaatgttgacttaaaatagttaaaccccttaataacatcctttagtttctattatttcactgcttaagttcagcatctgaataacaaaggtaacataagtagtacttaagatcccaaaggcccattacattctatcaataaagacaaaacaaaactacatgtttactgaaaatag

SEQ ID NO: 7212 - DNA, 1082 bp, Homo sapiens
ctcttgtcaaacgctgagtacaagactttcattttgaatttgctttaaaaaatattgtttcaattaaaattattaaggctaattagtgatctttaaatgtagtggtttgagtgatcattatttttctctaaattttaaaataccttagcattaaatcctgtgtaatttttaaagtaaacattgcatttattcatttagatcactattattgtagtaataatggttccattagccaaaagcctagttgcctagcccttacgataaagcataatttcaaacaagagagaattctgatccacagcatggaatgttttcctgtaggccacggtgagagctgcagtgtaaattatttttgctgattggtaagctgcatattctatgttgcattcagggatttatttcttcactttgtgtgcatgtatgcacatataaatacacatatatattcacatatacagacacgtccagtggattcttggatggataaaaatgtatacataaaacgtaaaccggccgggtgtggtggctcatgcctgtaatgctagtgctttaagaggccgaggcgtgtggatcacttgaggtcagcagttcgaaaccagtctgctcagtgtggcaaaaccccgtctctagtaaaaataaaaaaattagctgggcatggtggtgtgtgcctgtagccctagctactagggaggctgaggcatgagaatcacttgaacctaggaggcggaggttgcagtgagccaagatgtcaccactgcactccagtctgggtgacagagcaagactctgcctcaaaaaaaacaaacaaaacccataaacttagtggctcacatctgtaatcccagcactttgggaggccaaggcaggtggatcgcttgagtctaggagttcgagaccagcctgggtaacgtggtgaaaccccgtcactacaaaaaatacaaaaaaaaaaaaaaaaaaaaaaaaaaggtgctgagtgtggtggtgcatgcctggagtcccagatacttacgaagctgaggtgggagaattgcttgagtttgggaggtggaggttgcagtaagccaagattgtaccactgcact

SEQ ID NO: 7213 - DNA, 1049 bp, Homo sapiens
aaaaaagaaaaaaccttgtttctgttacttacgtgcaacttctaacaatgttcagatctgcccttatgatgggactacattgtttcacaaattccttggcttcagcaaaatgcttgggggtgcctccaaattccataaggtaatgacttatttgttcttctgacaattcatcatctttgggaatgcgatgccaggcctttgacttgaaacatgaacaacaacacaggcctgatatttcatataacacacttggctcataaactgaaaactgttgatctaagggaaaagtcattaaaccaaggctgggaagtagactgctttatctataggcttcaggaaagaactatgtcgttttgaaagtagggagaagaaggctcatcagtaataactacagcatcataatgccaccaaaatggctttgtagatttagaatcctgggacaggcaggatctttctccagatgaagtgggaaagaccaaagaggtaggaggaagagcagcaggagcaacagcaccaggtttaaaaagccatggtagtcctaagaacttgacatcactgtccccttttaacatttcaaggagtctttcctggttctgatccagttactttgctcaaagttggttaagttcccagctgacccacaatgaaggaaaaagcactatggtcagcattagctcagagacgccaggaatagtaccagtaggaaacagctgaagtgcatttcagggaaacagagaatgatattgaaagagatttaagggacttttcaacagcaagtattaggttggtgcaaaatcaattgtggtttttgccgttgcaagtaatggcaggctgggtgtgctggctcacacctgtaatcccagcactttgggaggctgaggtgggtggatcacctgaggtcaggagttcaagaccagcctggccaacatggtgaaaccccatctctactaaaaatacaaaattagctggctgtggtggtgctcgcctgtagtcccagctactcaggaggctgagacaggagaatctcttgaacccagtaagcagaggtt

SEQ ID NO: 7214 - DNA, 1090 bp, Homo sapiens
atgatgaaaatggggtggggaacctaatcaggttctgcaggtgcctgcagtaattcagcgtatgagatggatatgagaaattcttagaagaatctaaaatccttattaaacctgaaggttgaattcatctccaatactgagctgctaatatagagcagtagggaatcactgtagattaacccctttagtttcttgctggctgaagaaaggtctaatgactcggaagcctttgaaaaccaaagcatacatccttctggaatttccttttctgctgaaagaaatactagcagtggcatgtgtgtggtccagcctcttcagccgcacgattcaaacacatcatattctaaaagtcagcaaggccaccacagctaattacaacaacccgaacaatactggctaatttcttgtattggaagctttgccagtgatgatgaaatgaatgtcatccattgtatcccttatttttgatagctgcaaaattctccagttgttcacatgtgtatattttggtgcagtagtaagacctttcacaagcttgcgaactcttccaaacagcttccagactctacccaaccttacttaggcctgatataattctttctgtgtgctaagacagtgtgagatagtacacagtatcttttagttggagaaggcagccctctaatccttaaagcttttatttctgcaaaaacaatgaatctgcttttatcactgttcccttagtctaaagaattgactcatttgtcagcctgagggaagctttccttttaggacattctgcttctatctttctttcttttttttttttttttttttttttttgagtctcatcctgtcgcccaggctggagtgcagtgacacaatcttggctcactgcaacctccgcctctggggttcaagcgattctccagcctcagcctcccaagtagctgggattacaggtgtgcgccaccacacctggctaagttttcatatctttagtagagatggggtttcaccatgttggtcaggctggtctcgaactcctgacctcatgatccacacgcctcatcctcccaaagtgctgggattacaggcatgacattctgct

SEQ ID NO: 7215 - DNA, 1022 bp, Homo sapiens
aaactattttacttcagttataaaatgtggtttatctctgcaatcttcctgcttcgtgacttctaagcacctgcaggatgactgagcgggggctggtattcttctgcattgcctgttaccgtcttcactccactaccttttattcctcacctacatcctaacacagttattttctactgcatgtaacagctgtgttttttgaaatgattaattgtatgcaattcaatttcatttaatgatttttgtttgttggttggtttcaccatctttgcatttcctgcagaagtcctggagggtatttgggagccaaaaagaaaaagaagaaacagaagagaaaaaaggagaaaccaaattccggaggcaccaagtcagactcggcatctgattcccaggagattaaaattcagcagccttcgaaagtgagagctctgttttattttttcctctgtgtggtttctcgtgcatgagtgggtttacgcagtttagcgcgctgctgcatcagatgtgtagggactttgttgtgactgtgtgttgaatgccactagtaactggaagctcttgacagcctccttaaaatggactttggcacccaaataacgaaggggtacactgtgcttttgtgtgtgtgtggatacctgctgtgtttttcccttttctcagtgaatttgtatttagattgtcgttctagaagaaagtctcagtgtgagcttgttaggtttttttgaaattacactttaatatttgattacttttcgttcagaagatattcacattgtaatttttctgggtgtctgtctaattacctgaatagcacaacaccatctggcagcagatttcagcgggagcagccatgggtaagtctctcgttgactttgaattaaaccagtttgcagcggtcgttcttcattctaatgccaagggtgggaaatagttcctgacattctcctagtttaaaccaaaccagaagttgtccagctgggccccgtgttggcagatggtggccaagaagagggttgattgta

SEQ ID NO: 7216 - DNA, 1026 bp, Homo sapiens
agctctgcctcccaggttcacgccattctcttgcctcagcttccggagtagctgggactacagtaggcgcccgccaccacgcctggctaatttttttgtatttttagtagagacggggtttcaccatgttagccaggatggtctccatctcctgaccttgtgatccgcccgcctcggcctcccaaagtgctgggattacaggcgtgagccaccgtccccggcctaagacgtttttaagagttctttttcttagaaagattgaagatctggtattggacaaagatgaaaactttggaattcttttaacaaagaacataatctgtcttctaccatccccaatttagggggtaaaaaaaggaagttcttctttgggcactatgttgttgtatctgacttcatatgtctgttgttgaaattgagttgggaacttcccctttgtcagctgtgtggtatcagtgggaaaatgcagaaacattatgacttgcaataagtttttcttatggaaaatttagggataactcaaagctgccctttctgaaatttgatctgttatcaactgtataaatctaaatggaaaaatagattaacgacagtctttgcctgagggacctcctcaaatcaagaactactgtttgaaatgatcaagtgtctgctaagacttgcatctgaatgggtgatgtcaccctttggcccagaacaaattttttccagggttgtctaaatataggacacatactttgccatctttgtttgttagtgcaaatgtacgttatacatctatactagttaaaatcactttattttaacagaaccaagttctactccaagttcaagaaattgattgttgttttctttgaaaacatgttaatgacgttttaaaaatacgcttattcaaaaatcaaacaatagggccaggtgtggtggctcatgcctgtcatcccagtgctttgggaagccaaggtggaggatcgcttgaggccaagaattcaagatcaacctggggaacatagcaagaccctatctcga

SEQ ID NO: 7217 - DNA, 1978 bp, Homo sapiens
aggtttttcccttaaaggcaagaaaatctatggaaagagaaggctacgagtcctcgggcaatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatgtatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttcgttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgta

SEQ ID NO: 7218 - DNA, 1032 bp, Homo sapiens
ttttaagcttctttgttcatatgatagttcgggagaggaacagagattcagatagagagacagcggaagacacagaaagagacaaagagagaaatgccttctcctctcttgagttccgtgaatacaaacactttccctactcctctttgcagtcgtagacccgttgcagggagattctcagtgccagttgtctggattttgtgaaggtgctcagggtatatagtgcagtggttcagaattgggggtgactttgccccccctccccagagacatttagtgaggtctggagaaattttgggggctgctacagacatctagtgggtagaggtcaggggtgctattaaacatgctgcaatgcatgggacacccccaaacaaagaactacctggcccaaaatgtaaatggtgctgaaatggaggacccctgatctagttggaatggagacagagcattactggaacatagtgagttgccaggtttaactcatcttcacataagtaccattgagcaccaactgtatacagaacatagtgccatgcatttcacagaacgcctggtttaaggagcttcagtctataatgggaagaggaaatgggaaagcagtgcttatccaggagacactgttggacaccatccatatgtgttctgaaccaacatcacaacagccatattatgagacaggcatgattcatacccattttaaagataacctgaagcccaaatcactcaactataaggtggtagaggaaagatttaaacctggagctaagtgattccaccacccatgttctcatgatgctcttgattaggcagatgaacaaatatacaaataattatgatacaggacatagtaagagcagtgctacaagagagatgcaaatagagcttagagcttagggtgggattaacagactacatagaagaggtggcttttgacatgcattttgggtgagctgtaggatgaggggaagaagtttcagacatggagatgcatgaatgtatatacacagagaggccaggcgtggtggttca

SEQ ID NO: 7219 - DNA, 1109 bp, Homo sapiens
tttgtttgagacagagtctctgttgcccaggctggagtgcagtggcgtgatcttggctcactgcaatatccgcctcccaggtccaagtgattttcatgcatcagcctccccagtagctgggattacaggcaagcaccaccacacctggctgatttttgtatttttagtagagatggggtttcactatgttggccaggcttgtctcaaactcctgacctcaggtgatgcatccacctcggcctcccaaagtgttgggattacaggcaccatgcctggcccaactttctttctttctatctcttggtcccttcttcttgggaggctccagtgcctgtgctgggcccacatttcttctttctggtcctaaacatctcatctaggcctctggcttccaatgctctaattactcctgattccgtctctccagcccagaccctccccactgaaatggggccttggatgacgcctctgcttggaggcctgtcaggcacctccaactcagtatggacacatagagcttgatatttttggccttcccgtgatcaatggtataaacgtctacctaagttgataccactataaactcaggccaaaactcgaggaattgtccttgattcttctctcctcgaatctcattcttttgatgaggttggtgtctccatctgcattgccacctcacaaatccaggataccaccatgtcccctcaggcactgcagtaggtttttaacgggttatcccatttcactcttgccaaaccagtaatcaagtgtttacaaagtgagggtgaccaaatcaccttgcttggatcttcaatggttttcccattgtacttggaataaaatccaaccccttccactcagggctggacaatcccctggccctgggcctctggtggcttctgtggttgtccaggtcctccctggtaaggaagggacgaggctacagcatttatacacacagggcttcccacacagccggctgcctgcaccccttcttctgccagacgtggcttttaggcccacgtgctcactgtcggcctcttgtcttctccttcacagccaccttcaacatccactgtccccacctttccctttactaagatgctgaa

SEQ ID NO: 7220 - DNA, 1049 bp, Homo sapiens
gcttgcaaataccatggcccactgtgcccttactgtggtagcccaaacaccattgaaagagtattgttgtctgggcacggtggggcacacctgtaacctcagcactctgggagcctgaggcgggcagatcgcttgagcctcaggagtttgaaaccagcctttgcaacatggcaaaaccccatctctacaaaaattagctcagtgtggtggcacacacctgtagtcccagctactcaggaggctgaggtgggaggatcagttgagcccaggagatcgagactgcagtgagccatcatcacgcacctgtactccagcctgtgcaacagagtgagactgtttcaaaacacacacacacacacacacacgaagtattgcattggttgcccaatgtttaaaagtatagaatttttctcttgatcatttgttgatttgagcaggcagtagtaaagaagaaagcagtttgggtcaggctgtggttttgaagaaaatgggaaattgtgtgaagtaaaaagtagacctgtaaggagaaaatgtctctggtaaaaactgcatattttgagtgtcaaccttgatgtccttacagagccctccttccacttcccatcacagtcataccagagttgctatgaatgtttcccattgacagtagctgttctttgtgctttctctacctccagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctggtaaggcgttcctcatctttctttaacacagagggcattggctggtgggaggatcgcataaggccaggagtctgaaaccagcttgggcaacatagtgagactgcatctctacaaaaaaatttaaaattagccaggcatcatagt

SEQ ID NO: 7221 - DNA, 1047 bp, Homo sapiens
agtcatatatgcatgcatgtgtgtgaaaacatgctgtaggccgggtgcggtggctcacacctgtaatcccagcgctttgggaggccaaggcagtggatcacttgaggtcaggagtttgagaccagcctggccaacatagtgaaaccctgtttctaccaaaaatacaaaaattagccaggcgtggtggcgtgcgcctgtaatcccagctacttgggagactgaggcaggagaattgcttgaacccaggaggcagaggttgcagtgagccgagatcatgccactacactccagcctgggcaatgcagtgaggactccatctcaaaaaaaaaataaaataaaaaattagccaggtgtggtggcacatgactttaatcccagctactcgggaggctgaggcaggagaattgctcaaacctgggaggtggaggttacagtgagccaagattgtgccactgcactccagcctgggtgacagagtgaggctccatctcaaaaaaaaaaaaaaaaaaaaaagaagaagaagaaaaaaatatgcttcagaggcttcaaaactgcctgggtgttcaggagtgctttttaggccatagtagaaaaggtgagtaagaggctgcctgtgggtaacatttacgtttgtgtcagaaataaactgaacagctttcaattggttgcacaacacttattattagggcaatcttattaataaaggccgaaagaagttctgtgctaatctatgaaatctgagtatctgtcatctctctgcccttgactgtcacatctgctttttctcttctacttgcatttacctattccatgactcccaaagaaatgcatttgtttacctttaaaaatatgagaggatcatgattttgacactgtggtaaaataattcagaaaaagtcttggtctgttgcccaggctggggtgcagtggtgcaatcttggctcactgcaacctccacctgccgggttcaggcgattctcctgcttcttccctagtagctgggattacaggcgtgcaccaccatgccaggctaatttttgtattttt

SEQ ID NO: 7222 - DNA, 1031 bp, Homo sapiens
ctatcccccgtccagacctccctcctgaccaccggcctgtgcagtggctgttgtctggatatcctcactgatgacatatatcctcactccccggccaccctgcctttatacaggtcactcttctagggtgtttttgcttaatggagtcattttcactcttcctaaagcatcaggtgttgtcccctttgggtgtcatcccctctcgttctgccatcccaggtctgtgtgcttagctttgctatttaatcagaaaatatttatggaacggcacagtgatccaagccctgttctaggcactgagggtccggacacttcccgccccagattgcaattgctggtgcacatcttcatgtctgtctctccttagggccagaactgccactcactcatctggtcctgcgcagtgttttctgaaaaagtcaatgtgatcgtaccaatttccttcgttctcttctctccttaagttctactgtgtgtcttcccctcacctcccacagaagcaaaaaataggaagtggaacttcatagttacaagattaaacagatcaaatttcatcatcatttctggcttctacagatagctgaagttttgtgcgtgtatgacgcaaggtgtgagttgaatgcttcctttgttccatcgatttgctcagctgtgtttcctttctgctgtgtcctttgttcagggctgaagaactccgctctgaaaagtaactgtgagacgaatattctgcctattcttaggtggcccctatgcctatgaatatcaaagcattttgttgggaaacaaacatgagattcgcaaatgtttttatccagtaatactgtcatccttttccactgagacaaagtaacaaagtctgaaacacaggacaacatagctagacaatttattttggggctgttatccctagggttgccagttataatacaggacaccaattgtatttgcatttcagataagcaacaaataaaattttaatataaagatattccaaattttgcatgagacatatttacacaaaattatttgtt

SEQ ID NO: 7223 - DNA, 1044 bp, Homo sapiens
tgattggtttttagatgcctcctttagaacagggtttttcacttctcaccctcttctctttgttacctaccatctgctggacatgtttttgaatgtgcgataaggcatatggctaaggaatagaaaagttaatgcatgcaactggtgtaagtggaagacacagtggctgcagtctggtcaagtttgtagcccatctgccggagcacagagcgcccttttaaaatgcggctttgctatccaggccctgcatctaccgattgtccaaatgttgctggtagcaaaattaagtgtctcctccctcagtgacttcatgtgcacacagcgcatatgctcagtgcatagttttatggatacgtttgcttccctttactctaaacctaaagattacatggtgaaagtaaactccaagagtgagccttttagcccattcacctcttggcagagcgaaccattcaagtggcttttaacacacactttgtattctctttagaattgattcttgtgctgtaacttgtgtttttagttggatttgaaatagacaaaagactttcgttgtgtactttccccacaactttttgaaacaattttcttcacctacttgaacctcatttgcctttatttaaaacttaaaatcactgcctgtactgttagaatgtttctttctgcgtcttgatggaaatctgttagatgccgcattaaatattaaacttaggcattctaaatcaatacatgttaaagtgcttcataaatgccaagtaaacatgagggaggagctactagcttttggacccttggtattttttatgtgcactcattagacaacgttttattaattgggtgaggcccattcctgtttcacattcttatttctgaactttgacttcttagagtccatgagagaatggactaacaatacttgaagttagatacttgtcaaccctttccttctgttttttaatttttattttaatttaattagtatatttattttgagtcagggtcctgttctgttgcccaggctggagtgcagtggcgtgatttcgg

SEQ ID NO: 7224 - DNA, 1059 bp, Homo sapiens
tctcctttgacattagaaggtcagtcccaactcactgagttcttcaaagcatcttaatgttcacttgctgtagtatgacgtagttttaaaattcatgtgttctctgctttcctggatcatgtacacgatgaagacaaatgctgcatctgatttcactttgcatttcccacagtgggttgtaggttgttatgcatacagttggtgctcagatggtgctgagtaggtaagcatcaaccatagctaatacctacaccataacgcaacctttagtgatcatcattggcttgcattttaagaagaaaagttcaatgtttaccttccccaaaagctaatttgtaagaatcttgcttttatgtagaatctgttgtttgaatcattctttgaacaagcattgcacatacatattatgcaccaacaggatttggcaattactttggtaaaactgcttagagacctcaaacagacggaaatcatatactgtagtagtccaactagattgctagaactaaatgacacctttttgattaaatgagtctttatgtcatctgatgaaactagcatctgcagaatttcttggcattactttgctttttatatattcaagataaaattggaggcttggcttcagactctcttcccgtagctgcttcgaattggcaaagtgatttccaatgccacagtcagttgtcacggtaagggttggctttgtttatcatgaatttgaactagctctagactatgactatttttattaagtgtttcctctcagttgctctggagcatttatagtatcgaatctattttctgggaatttttcaaaattgttgttcaaaagtattgacccattttgattttcttcacctcttttgcaaaactgtaatgaggctgggttcaatagagagagctgtcctggaggagcagtaagctgtgcagatgtactctttagggatgtgtttttgaagcccagcactcttatttatgtgccaaaaggaaggtcagagctaggttaagaacttcatgctcagacatcttattggatgatgtttattttgtcgctgg

SEQ ID NO: 7225 - DNA, 1014 bp, Homo sapiens
ctgttaaaatgacagtaatatacagcagctataaagcaaagtatggatgtcattaagtcacagaaatatgttttgaagttaatcaggagctaaaattataagctgcatagcaaggtcctgttagaaaggaaacagacaaaaggagaatgctggcaaagtgagatggagtctgagccgccaggcatccgagcctgattgaggccatggaggtgggtcatggcaccttgcccaagcacttctgctctaatgacatgagtacatgaagttctttgtgaaaaatagggccgattgtatttaacttaataacttgaattatattctttgtgtataacttttcagagaaggcagttttgctttggggactgaaaagcccgagttgtagtttcaatgtcaatttatttcatcaacactagaaactaatatattaactaaaataaagatgccaaaaaatgtatttcacgttacaatgtatctttagcactttcttaggaatgagtagattcatgacacaagattatctgatctagtaatatattctattcctatatttaatgtgttttagaggcaactaccatttaaggataataaagttgtttcttttggctccttaaatagcttatggcttttattttggaagaacataattacactcatgtgtatcagccagtgaatgtgtaaaaataattttatacactttggaagaagacagtcgtctgtatctgtttcttttaaattatacagcatcagaatttctcttggtacaaaaaagaaattaaccaccaaggagtgccttaatgtccacagtgagcccttggtaatgagttagggtttttgttgatatgtccaaaatactttttaagtatgtttcattgtaaattaatcagaataaaatttttcttgctattcacctgccagtatatatttctgtgatcactgccactgcatatacagtatctggttagtttgatctttcaacgtctcttttacttttctttctgtcctgacatccttttt

SEQ ID NO: 7226 - DNA, 1090 bp, Homo sapiens
gaggtctccacctcccatcccctgtctctaaagtggctacattctcacagcctatctttctgtaggagctgaagctccagttgccagcagctgtcttcccttaattccagttggaaaaaattctaaggagggccatgtgcctgtttgtatccatcggatatggccaggaagacaagggggatctatccaggcagactcagccaggggccctgagggaaatcactgggagccaggcctgtaatggccttgaacgccaggttaagagggttgaacgtgatctttagctaattgaaaagcaaggttaagatagtgggaataacatgacccatttttctacaagcttactctgttagtgatatataggatatcctttctttattgaatattactgaaatcgccttaagcattataagtatgttttcatttctcacagtgctcttttcactaattaatggttgacaatattcaaatattggatattttttggaaaagaaaccactaattaaacatcgtgggccaaattggaagtattggtacatactggaagtgtatttagtctgagtaaaagtgatgctactgcttttctcaattcattgagaggaacaaattatttacatagaaaaggagatatactttagcaaatgttttagaagcttgtcttttgaaaaaagttatagtgatacatgcacataattaaaaaaaaaataagttagttctgaagagcttataatggaaatcaaccttccctactttccagcatcttcttcagaggcaacactttcaacttcagggctttctggtagttacaactccataaacctaagttccttcttttgtcaaatgagtccccagtcaaaggataaggatttgagaaacatgcattttactttcagttgattagaaattgcctgatataaatataatttaaagtgttaatagtcctttatttataatagggctccagtggtccagaatcttttactgtctaccactacaatggattgaagcagtcaaattataatgaaaaggtatgataattcacgtagtcgtcggtgttcaactgggttgatgaaataattatgtgagtatg

SEQ ID NO: 7227 - DNA, 1022 bp, Homo sapiens
ttatcaaaccatcctttgctggcattaagttctccacctttagctcctttacttttgttttgctttagcttgtataatgactgcactttttcttaaatcatattagaatctaaaggtgtgcctttcctatagcaaccctgcacttacatacaagttgcattttttgtacaaggaggtattttgcaaaaagcggaaggtttgtatggctgcagcaatggcttcaggaatttccttttctttctttacgatatttatgctggattcatttatcttgacatagtgagcaaccacagcagcagacctcaatccatggtgcatatcaagcaattccactttttcttacgtcctgactttggtttcttgggagaacttccggcatcactagtggcacttcatatgggttccatggttttttttcaagagttacagtattgcactaaacatgatgaaaagtatgtgagaactgcttaagatcactttttactgtgatgtggaactcactggagtgatgggctgcacatgcggagatgattagcgccatacttgtgctctgagcagatacaacacaagctcaccacaatagcatcaggagatggtgatgaaattattccagtagtacagtatgcactaaagttaattttatgctgttgtgatctgatactgcatctttacattcgtttacatctcttgactgtgagtggtgccaggtacagtccgtatgcccctgttttgatacattttaactttttataatagatttgtggcatttcatggtagtagaaaaaatagactagtatctacatatattttatgcatgcatggcatacttaattttttcttaacttttgaaaatatctctaggctgcacagtttgcgagtttttcaaattgtcacaaatttccaagaaaaatttcttccaagaaaaatttccaatatatttattgagaaaaaattcacatataagtggacccatgcagttcatatccatgttgtttgaggatcaactgtactcgcttcttagt

SEQ ID NO: 7228 - DNA, 1067 bp, Homo sapiens
tataaatgttcttgcctccttaagccaagtgaacatcagttacccttatgtactctttgccttatgcagctgtatttgtatattctggtttttgtgatttccctgaattttctttttcttttacttattacttctcagtcatcagtgatgtcagccttcctggaagaagtctctcttttccactgaatttttctttttctcttacaatagtatccaaataattgtctaaagataaaatactgatggaagggcctagaagtattctgttaggaatgaagcctatgagttttaattaagagtcagtatcattaagcccacacccctagctatctgttcagaattgatagaaaaaaatcatagccagtagagttgatagcagagtacaaaaaaaggtcttgtatggttaatagatgaccgccactaagtcttactaagtttaatttgggggattattgtgtgtgtttgcacatgctttgcttatgttatcctctgcccagaatacgcttatcaaagtcttgctcagcattcctggtccaaccttccaccattcgtattgtgtccgctgattctcctactctcttgttgctcctgttctttcttccaacttccttccttcttgtggcactaactgatttcccacactacctactgtcacacacattcagtattgtggtaagtactgttggaacgtaaggattaataatacatggtaatagtttactgtgagtgtttactgaatgttgtctgtatgttaggcagtatgctaattaatcatctcaggagcattcctcatttaatcctcaaaccaaccctgtgagctgcgtgccgttttcatctgcatgttacagtctggggccagtgagaaaaatgacatctccaaagttagatactagtgagtaccaaggcaggatttaaactccagtcttctgacttctgagctatgcatttaactacttccctcccttaagaaaacaactcattctgctagagtagagtagaccctggaagagggaagaagtaggtgtagaaaagattatacttgaatgaaaggacatggtaactttgag

SEQ ID NO: 7229 - DNA, 1048 bp, Homo sapiens
taagtttcgtgaatgtaattatgtcttactgtatttacttttattgtgttggcaaaagtccagataggggttatagagcaagatacataattgccttttctcaagcacggaaagctttaaaattaaatgctaaaagtacagagttactgatacattgcatttagtttgaaagcttttgctatttatttccttcctgaagtagagagaggaagttaaaaagcacaatgtgaactacaaaaactgacaattactaattcctgagtgaggatttcattttataaattaccataaaagaaaattaattctgacttacacacaaaaatgtattttcaaaccaatttttaatcatgtttgtctgcaaccttattctttaaggaaaactaattatatgaaactaaaagtgttgaatataaaagatgacaatattttaaatcttaaattttataattgatgtttaagaaatgattttgttgtcagaacagtaggagagatttcacagaaggtataatacaaggaacagtgtcgaatgagctgtgagtctgaggacattatctgaaaaagttagtgatgttgagggagttcccaagagtgaaataggcccttctttttatgagtacactcttcctacctgtcctgatacttttgtggttcccatagcactcgcccattgtgctgtcgcatgtgtcaaacagcacacagtttctaattcccatactgttttctgcgtgtcccatggcagccagtgaactttgtctagggcaggggctgtctctcgcccacctttttattcatagatccctgtcatgtgcaataacgtgttgaattagagacatggagttaagagaaaaacacaaaaactcctgccatgtgggtgtagaactcttgaattttatactaattgttactgttttgagacttacctgtgtagtctcaggatctagtatatagtctggcacactaggggtggggggaattattagttgaatgaataaaacttttgtacaaatttcccgcatttgggttccagtgacgtttatatcccctaaga

SEQ ID NO: 7230 - DNA, 1089 bp, Homo sapiens
ggctggtctgagaaataaagggacagagtacaaaagagagaagttttaaagctgggtgtcggggggagacatcacatgtcagcaggttccatgatgccccctgagccgcaaaaccagcaagtttttattagctgagatcacatgctttaagggcaataaaatatcacaaggcaaatgggggcagagtgagatcacaggaccagggcaaaattagaattgctgatgaagtttcatgttgtactgggccggcattgtcattgataacatcttatcaggagacagggtttgagagcagacaaccggtctgactaaaatttactaggcaggaatttcctaatcctaataagcctgggggcgctacaggagaccagggcttatttcgtcccttatctacaactgtataagacactccccgagcggccattttagagacctcccccctgagaatgcattctctttctcagggctgttccttgctgagaaaaagaattcagcaatatttcttctatttgcttttgcaagaagagaaatatgactctgttctgcccagctcccagacagtcagacctaatgatcatctcccttgttccctgaacactgcagccatcctgttgcttttgggtgcccaaatttcatattgttcaaacacacatgctctacaagcaatttatgcagataacacaatcatcacaggatcctgaggcgacatacatgctcagcttacgaagatgacgggattaagagattaaagacaggcataggaaattataagagtattgattggggaagtgataaatgtccatgaaatcttcacagtttatgttcagagattgcagtaaagacaggcgtaagaaattataaaagtattaatttggggaactgataaatgtccatgaaatcttcacgatttatattcttctgtcacagcttcagcaggtccctccattcagggtccctaacttcccgcaacattcactcatgggttgaaaaccagattagtgagggttaagtaaattgtgtggtaagaaaattgaaacagggcatatatagatgactagctggactttgggaggacaagagtgatggagt

SEQ ID NO: 7231 - DNA, 1046 bp, Homo sapiens
agaggaatgaacttcccttcttaagccctgttataagcgcaccgaatacctttcacaggggtttaggtgtgcttgtaaacatcatgacttaatcacctcctgaaggccccccgctcaagatgctttcgttgataattaagtttgaacttgaattgtagagggaacagaagcattcagaacctaacacttcagagtatctgttcctttctcatttaatagataattcgtctaggtataaaaatctcgagtcaccttttcttttactggaatcttgtagatactgtctttgggcattgaatttccttaatgtgatactgggggctaacttgagttgcccacttaatgatgacttgctttctctgctaggatgtacataggattatttatttttatttattcatattctctctctcttctcccatctctactatatttattaaagcatcgtacatgtacacaaaagcgcatataacataagcttatagttcagcgaatgatcaacatgccaaaactcacgacaactattcaggtgaagaaatagaacaccactggagtttcagagtttcctctgatctcctttcagtcattaggcaggccttcctctctgctcaaaggtagctacttcttcagcttctaatatcattgacttttgctgttttgggattctacatgaacggaaccattcagtatgctttctggcttctttcactcaacattgcttcttgagattgatcccgattgttgcatagagcagtatttcattcattttccttgctcccatgatatgtgaattatctgtgtgtcagccctagttctcgtttgagctacttactggcttaagcaacagccttgtcacttttgagtcattccccactttgggactggcagtgaaatagaggctgtcagtgggttgatgagtgagcactatgtcccctccctcgttcctgtcacctccttctcggacagtaaagtcactgttcgtgattcccccttctgctcctcttctgccacgtgctgttagcagggtttctctggggatacccact

SEQ ID NO: 7232 - DNA, 1046 bp, Homo sapiens
gtatatgtacgtaacaaacctgcaagttctgcataggtatcctggaacttaaaataatttttttttaaaaagtacatttcttctgagttagtctgtattgtccccatttttattgttaatttatgttttccatttttcccccctttgattgattggtccaaatagctgattgtagtttcactgagttattttattctttgttttgtatttcaatgatttgcttttcttcttctgagtacagctggctgtgatttttctagcttgtttaggtgaaagcttacgtgattgattttcagtttttcttctttttttttgagacagagtcttgctctttcacacaggccagagtccagtggcgctatctcggctcactgcatgctccgcctcctgggttcacgtcattctcctgcctcagcctcctgagtagctgggactacaggtggctgccaccgggcccagctaattttttgtattttttttttagtagagacggagtttcactctgttagccaggatggtctcgatctgctgacatcatgatccgcctgttttggcctcccaaagtgctgggattacaggcgtgagccaccgtgcccggcctcttcttttttagtgtaagcatttcaagttagaagtttttctccgttgttttagcagcatctcacacattctgtaatttcattatcattcagtttcaaatattttcttttgtaagacctggggcctgttatttagaaattgagaatttgtttgttttcaagtattcggagatatccgaaacattttgttactgatttctaatttaaattatgtcctgatcaaaattcatagtctatataattctagtccttcacaatttgttgatttgttttatgggcctgcgtattctctagttggtgaattttacatgcacacttaaaagttttatgtgccccatcagtgttccataaatgttaggttacattagttgatatgttataactcccagtaatattgtttttttttttccttaagttagttttcttaaataactttagagaggagga

SEQ ID NO: 7233 - DNA, 1052 bp, Homo sapiens
ctgccaatgaattaaaagttttctgagccaaaagagggttcccagaccagcaacatcggcatcccctgggaagttgttggaaattcagagtctcaggctttaccctaaacctgctaaatcagaaactccgggatacccctccatctgtgttttagcaagccatctggtgattctgacgtctctgtggtttgagacccactgccatcgggtagggctgtgtaataaaacattttgcggtgatggaaacggtcagtatccctgccatgcagtagtggagccactggtcaccacatgtggctgtcaagctcttgaaatggggctgctgtgaccaacaatagcattcatcattttatttaattttgattaatctagatttaaattcaaacagctgcatataactagtggctgtccaacagaaagcccagcccagaacataccctgctaattattattgtataaactcctaaaatgctttgagttgttggttgtggaattattaattttagatcatagaacagaatcttccttactctattcaacagaattgaaactgcgattgttacaacaggtgattttgattcttcctatggaggggagacagtttgtgggctgctgaccagttgggggaagcctattcttgagctgattgattgttgattttgtgaatgtgcatcagtggtgcagtaccggctggcacatgcctgttgcaggtattaccgatggccgtagatacatgtccttttaggagtaaagctgttgctcaggaaggggctgtgtcagtatttcacgcagatggactttggtttctccagcctgtccagcaaagtggaggtgcttctggccaaagagaagttaatgaacccttcaggcactttgggctgcttgtggaaccttccagaaactgctgggggagatgggagtgctgaattgccaagtctgggctggcacgtcagatggacaaaactcttgaatcacattcagttcttcagtttaggaggacctgaaggaaagaaggtcatgccgggtgtgttaggcggaactgctgctgcaaa

SEQ ID NO: 7234 - DNA, 1098 bp, Homo sapiens
gtgatagagatggtggggggaagcctatttgcttgaagaatgaatgaatggccgggagtgatggctcatacctgtaattccagcactttgggaggccgagacaggagaattgtttgagctcaggagtttgacaccagcctggaccccatctctgcaaaaaaattaaaaaattagcctggccaagtggcacatacctgtattcccagtaactcaggaggttgaggtgggaggatggcttgagcatgggaggtcgaggctgcggtgagctgtgatcacaccactgtactccagcctgggtgacagcatgaccctgtttcaaaaaaaaaaaaaattgtgaatgatgaggccattaactgagtaaagggagtagatgatagtgagtttgacttgtaaacttttgggtttaaatattatatagtttgacataagagttcagagcttgggataggatctgagctagacatatacaattgaggataatttctgtatattgggtggttattaaagttgtgggagtaggtatgatcacttttaggagtattttaccaagagaaaggggccaagccaactcctggggaaacactgccatgtaacgggtggatgaaagatcagaggagaggaggctgaggaggtgcgctgagtgcttggtggagaaccagaagagagtggtagcattcaaaccacgagggaagctgaatttcaagggtgggtgatcaaaggtatcaaatcccatgcaggatgccaacgagcgtgaggattgcaacaaagcccctggattccgtctttaataacctgcaaggagcaggattgtggcgggtggtggtggaagactcaaggtcacagtggttaggaggtgcaggagcttctgagcttttccccagagttacggaaatgagtggcataaggagaaaatgggcagtaaccaatgggttaaccaaaatcagtggagagttggttttttaaaaaaaatggagaaatataagttgtgtgaagagggcaggtggaaaaagagcagctgaatgtgagagccaggcgaacagtagagaaaatcatgttttcaggacagagacaccaagaagcgccagattggttctatga

SEQ ID NO: 7235 - DNA, 1087 bp, Homo sapiens
catggaattaggcttatctgatatgtgaaataatcaaagatgaaaggaagacacctaacgtatagctaatgattataactgtgaaattattcatctaaaaatagattggaataaaataatgatagcagttatgttagagtaatagcattttaatttttcttgtttatatttttcaattgaatgtgatcttttttgttgtttttgttttcatcaatgtggcataatattagttttatcatttaaaatgttctttctttcaaaacactcagtttcaagtctttactgtagagtctgttcattgtaagcttgtaagttgctacctcatttgcatcttgatgctatgtaatataatcccctcccctgctgacttttttcctccagagcagaagctacatcttgcccatttgtgtatcctcagtacctttctcagatgctgacagatagtgggtacctaataaataattgtccaattaactgacttagatatgagtatgctgagtatggtaatagaattgtaggttctttcatggcttgggggattgtttgaataattctgtcagccaaaaagaaaagaagtgctgggcatggtgcctcacacctgtaatcccagcactttgggaggtcgaagtgaacggaccatgaggtcaggagttcaagaccagcctggccatgataaaaccctatctctactaaaggtacaaaaaaaaaaaaaaaatagctggatgtggtggcatgtgcctgtaatctcagctattcaggaggctgaggcaggagactcactggaacctgggaggcggaggttgcagtgagccgaggtcgtgccattgcatcattccagcctgggtgacagggcaagactctgtctcaaaaaaaaaaaaaaaaaaaaaaaaaagcacactagatgttactggaagaatatttaatgccaaaattgtgtataactcctagggtattgtttatgtctcttctaaacatagtctaggaattgttgacaaagcttgatttagcagtacttccgtaacaaatatggtccaagtcactataaagaaagcatacaaaggtgttgttttttatagatcttagaata

SEQ ID NO: 7236 - DNA, 1076 bp, Homo sapiens
ctattctagaatcttcatgctgggacatttttaacttggatatcttgctattcaagttgtatcggatttgcatcaaatttagcatgcttgcaacctaagcacactccattctatagtcagttccactcttgactttaatatttatggtacggttagtctccacatcttccaagttcaagcttcataaccaaagatcatcttcaccttccttctcactctgcattccattggtcagcttctgttaaaatggccttcctaaggcaggcctctgaacgatcatttatttttaggaaaacttataaaaagtcactgagatttaaaaacacccacacatatatttgcaatcatatttgtgtgcttggttaaacatgtcaacatttaacagatttgagccttctaaatttaatccagcatgaatgtcgtttttactaaaatatttgctattttactcacttagctggttccttacacaagtccagttaaatttcacatgtgaaaaaaatgactgaaaacactgaatggaatgtgatactccttgtgtagtagaaatgagttgactttcatatttaagagctgatcctatgaatgagtagacaataagctgaatagctgttacgatctgagttttaaaaatggaaaatgtttcatgttttagagaatgtaaacttccacaagggcagagattgttaatacgttgtccccccagtgacttaaaacagtactggcacatagtaagcactcaataaatagttgttgaatgagtgaatgtaggaaccatactggaatcaatattgaagctacatagaaagcaccacactgtggagttcaaacaatgtctttaagttgttctcttgaaaactatttaatttgtctgttactgccacttcttccatgcccagaggaacagccaaagttactcaagtctggaacacatgatttaaaaaataattctgggataggcttttggcttttggaaagtagcgcaaataaaactttttaaaatactgtattctgacttctggtcttgacaagagagtgtagatttatttctccctgctcctccctgaaaagtgtaa

SEQ ID NO: 7237 - DNA, 1035 bp, Homo sapiens
ctctggtagaatttggctgtgaatctgtctggtcctggacttttttttggttggtaagctattaattattgcctcaatttcaaagcctgttgttggtctattcagagattcaacttcttcctggtttagtcttgggagggtgtatgtgtcgaggaatttatccatttcttctagattttctagtttatttgtgtagaggtgtttatagtattctgtgatggtagtttgtatttctgtggggtcggtggtgatatcccctttatcattttttattgcatctatttgattcttctctcttctttattagtcttgctagcggtctatcaattttgttgatcttttcaaaaaaccagctcctggattcattgattttttgaagggttttttgtgtctctatttccttcagttctactctgatcttagttatttcttgccttctcctagcttttgaatgtgtttgctcttgcttctctagttcttttaattgtgatgttagggtgtaaattttagatctttcctgttttctcttgtgggcttttagtgctataaatttccctctatacacatgcttttgaaccctggtcctctgttcctgctgctcaggctcaattcaagtcttcatttctgcttgatcctctattcctgctgctcgggctcaattcaagtcttcatttctgccttatctttggtcatgttgtgaatctttcttgtaggatctatttgctagcccaagtactgcctgtttacatgacttgttttgaccctggttactctaaccaagttgcacctcctgcttatagaatctagacttcagcttaagtctctcctatttactttggacaaaattgtgttagttttacctactgctttgattggcttagattggccaccagtgccattagcttcgggttgctactccattcagcagttcgttcctctgaactctggttacatcaccaaggggaaagcaaaaagtgtagtcagccagcacatgtgtgtgtgttttcctaaacatagtgattttaagagagcagt

SEQ ID NO: 7238 - DNA, 1068 bp, Homo sapiens
aagaatgcaaatgttccaagagcctgactgctggcctggttgcctgagatcttgactacacacacacacacacacacacacacacacatctaaatccagtaacataccaaatggtgaaactttaaaagtattctcattaaaataataaaaagacaaggatgtccaccattagcactatgacttgatatagttgtggatctgttagctaatgtacttacacagagaaatatcatataaatagaaatatttaaaaatgtgattgagtatgccggaaaataccaacaagttaagcaaaaataatatatgaggaacaattagtgctttaataaggacgctggctacaaaaatatgataacctacagcatacaatatacaatatgtctactagaagacataataggagaaagttcctatttttagtaacaacacaagaatctgtataacaagaaatctatataactcacatgggagttaaagagatttgaaaaatgatgaaagcgtactgtggtcttggataggatggctgaatattgtaaaaatattggctctgtttcactataacttcaataaaatagtcaaaagttgttgttttctaatctaccaagttcttcctaaagttcaaatgaaaattcagtttaagaatagccagaaaactttctgagaaaataggcaataaggcaggcagagggacaaatacacctgccagtcaatacaggatgaacagtgttagcccactgacttgatctaatattatctgaaagcaaaagtattttccttaacttgtatagtcatataaggtaaaaaatcaatttcctttggctttaaaatatttagtcattaaaaataacctgtgtatttccatgactactttatttaatccaaatacactttcattgacctagaataccaggttaaataagttgtgaagggttcaatttagtgatgaatttttgcctaactgccttatcagttggcctacactattaaaaaaatcactattttcaagaatctgttaaagctgtaatttttttagtggctagctgtattagagacattgactctgtttac

SEQ ID NO: 7239 - DNA, 1029 bp, Homo sapiens
acttcttttgagaagtatctgttcatgtcctttgcctagtttttaagtggggttgtttgttttttgcttgttcagttgtttaagtttcttttagattctggatactagacctttcccagatgcatagtttgcaaatattttctcccattctgtgagttgtctgtttactctgttgatagtttctttagctgtgccgaaggtctgtagtttaattaggtcccacttgtcaatttttgtttttgttgcaatcgtttatgaagacttagtcataaattcttttccaaggccaatgtccagagtggtgtttcctaggttttcttctagaattcttattgtttgaggtcttacgttcaagtctttaatccatcttgagttaatttttgtatatggtgaaaggtaggggtctagtttcattctcctgcatatggctagccagctatcctagcaccgtttattaaatagtgagtcctttccccattttttttgtctactttgttgaagatcagatgactgtaggtgtgtgcctttatttctgggttatctattctgtttcgtttgtctgatatgtctgttttgtaccagtaccatgctgtcttggttaccgtagtcttatagtatagtttgaagtccattaatgtgatacctctggccttgttctttttgcttaggattgctttggctattcaggcttttatatggttccatatgagttttagaatagtttgttccaattttatgaaaaaatgatgctagtagtttgacaggaatagcactgaatctgtagattgcttcaggcagtactaccattttaacaacattgattttttgaatccataagcatgggatgtttttccatttgtttgtcacctgtatgatgtctcttagcagtattttgtcattctccttgcagagatctttcacctccttggttagatgtattcctaggtatttttatatgttttttgtggctgttataaagaagatcacattcttgatttgactctcagtttgaacattatttgtgtatag

SEQ ID NO: 7240 - DNA, 1027 bp, Homo sapiens
cctgagctggttttcctgcaactatatggtcccatctggggatgatgggagacaatgacggatcatcaggcgttatgttctcgtaaagagcgcacaacctggatccctggtatgcacagttcacagtggggttcacgctcctacaagaatctaatacccaccgaccactatcagaccatagcccagggtctacagcatttctaagcacttctaatctcttcccttaaaggaataaagtagatggtcttttattgtcatttagctgctttgagtgtgttagtcttgttcccatagctagtataaaatcatgaacatcacgattctctaaaacagtgtttaaaacatcagaagggaaagaaaaaccttaaagacactttctgggaggtatctttgaacatttgagggggaaaacatagctaacaattccctgtagactataagtgattttttaacttcatcaatgtctaattcacagtctatgacagaggaaagagaaggtggtaagtatgtagggggaacacaagagtttaattaacaaatggaggagaaatctagtgcaaaaataagttccagctgatgttggacaaagaattaaagccagattttcagtattagttcacttgatcaaaaaacagtaacaaccaaaaacaaacaaaaaacccatcaatccagttataaaaacctcatgtcacttgaaagagccctgaatgacatcatcccagtttagttactggctgagttagactaccataagaaaactagcaggtatttgcccagtggcctataatgttgtttttccttttttttttttttttttttttttttttgtagacagaaaaagattatgccacagctagaaaatttgccaagtgcaattggcgtcttgggaatttactctgcctactttgaggaggtcatgtagttccccagtggtagaattttttttctcaagatatttaggtaagggacctaataataattttgtttaatagcacaattttcttttttaacttttattttaggttca

SEQ ID NO: 7241 - DNA, 1034 bp, Homo sapiens
aacaattgcaataaaataatgagataagtgctaagcagatgtgtcagaggacagacaggtagggagaattagagaaagttttctgtgagagatcacagcatttaaactgagcggtgaaggacttaagtaggcataagtggggaaacagcatgagttagaggacagagatctgaaattgcaagacatctgttgaggcatcaagaagagggcttgggccgggcgcggtggctcatgcctgtaatcccagcacttgaggctgaagcaggcggatcacgaggtcaggagatcgagaccatcctggctaacacagtgaaaccctgtctctactaaaaatacaaaaaattagctgggtgtggtggcgtgcacctgtagtcccagctactcgggagactgaggcaggagaatctcttgaacccgggaggcagaggttgcagtgatccgagaccatgccactgcactccagcctgggcaacagagcgagactgtctcaaaaaaaaaaaaaaaaaaaaagaagaggacctgaagtgtagagtgggaaatgaaggcggacaggtagcttggggcattgcactgggcctcagatgctttgctaacatgtttggattttagtctgtacacaatacacaaaggtgttgtttaaaggttgtgtctcattcctttgtagctgggtaacctcagataagctacttaacctctctgactcttagttttctcatctgtaaagttggaacagcacaactacttagctagattataaaggaataaagagataatggatatgaagttcttagcaggatgcctgatgcacagtggatgtttacaaatgttcatttttattcctagtggtttatttaaaattgtacttttttttttttttgagacagagtctggctctggagtgcagtagcaccagctcagctcactgctcagcctcccaggctcaagtgatcctcccacctcagcctcccgagtagctgggactacagtcacgtgccaccacacctggctaatttttaaattttttgtagaaacaa

SEQ ID NO: 7242 - DNA, 1085 bp, Homo sapiens
gcacaggcctgtaatctcagctgcttggaaggctgaggcacgataatcgcttgaacccaggaggctgagagatcgtgccactgcactccagtctgcactctgtctcacacaaaaaaataaaacaataataataataatttctgtaaagacaggtttttgctatattgcccaggatgttctcaagtgatcctcccacaatggcttcccaaagtgctgggattacaggtgtgagccaccgtgcccagccagtgaacattttgaaatatctgccttgtgttaactgggtgtctgtcctttctcttttcagttgactctctgtcttgaaagccaactgatatttcaaaaatgaacatcaatgcatagctccagtttaaagacttcagtgactccctgccacctccaccctgatctaagggattcaggctatctgccattcaaggctttttgcaatctgctcccgattcccctttccagtcaacttgcatttgatatctctgactcactcgtccctcaaagcaccatgtattttcacagcgctctgcttctgtgctcaggtttttcacttttgtataatgttctcctgttattcccatgacttctaatcaaatctacctctttgaagttttccgggtctcctgccttacctggtgcagaattaaatgctttctccattctgtccctctgacccttccccggcaaatcagggcttgttctaaacttgtctccttctgcctctactgagaagtttccttgtcatatttacaaaaataagggatattgaaatggaataatctctgtaactgactcttcagatgctttctagaggcggtgagatttgaagaaggaataagatttgcatacatagagagtagacatttcaggtgatataaattctggaaataggcatgatatgcaagcctgatgtattctcttgattgaactggagggtgctgttggggaatagtggtaaataaggttgaagaagttgtagtgttgaaatcgggacaagaacttacacgttttatagggtggacagcagaagactagttgaggctctttttgttcatttaacttatttctctgtt

SEQ ID NO: 7243 - DNA, 1024 bp, Homo sapiens
ctaagccatgaaactatatcaatttaaaaattcttgactatcatgtctcctcaaattctctatacatcataaaggctattacaatagcctaattatagaaagcagaacataaaatacattttaggaaagtttgattatagagcaaacagtagcagtcctacttaccttaggagaagaaatctttacatatactataataggggccaaggaggttttactgagttgagctggatgattaattgtatccgcgtcaaggaccaccaactgcaatgttcttgcaagttcaaaaatcctttcgatttcactctgaacttccgctgtaaagggcgaaacaattcagttaaagtgcagtatttttaagataaagtaaaatggtatactgtttcttcaacagaaaggtgagtaggtcagccattatgttaatgcttacaggcaatagaattgataaaaatttacaacagtaatttatccttttggaaagggctgtttctccacacatcattaggatttaaggaatttttctgtcaaccggctacagaatttacttttagtataatacttggattgtggaaatttttagctctctgctgacattctttgtgcttgcagtctatgaaatcatttcataaaactgctgtaaaataagaaccttgacatatcttccgtgtgttcattgcagaccactttgcattagcaaccatgacaggttttcctttcagtgcacgggctgatctatgtttacatgtcacctgtatgccgtctagatgtttattaacaagatgaaatacaaaataaaacagcaaagacgtgaatggcaccagaaagaaacttatccaaaaacacacctcatattttccaaccaaagtagtcatgttttaaaagggcagttttcagaggcagcactacagaaatctaaagtataaaatttatagaaacttatcacaaaacattagaatatctagttgaactccgagaaaatggcattcagttcatctgttctgtgatctccaaagactcaaaaacc

SEQ ID NO: 7244 - DNA, 1073 bp, Homo sapiens
ggaatagaatatggaatggaatggagaatggaatggagagtagaatggaatggaatgcagtggtgaatagaatggaatggagaatggaatagaatgaaatataatggaggctggaatggagaatggagtggaatggagaatagaatggacaatggaaaggaatggagaatggaatgaatggaatggagaatgggaaagagtggaatggaatggagaatggaatggaatgaaaaatggtatggaatggagaattgaagggaatgggtaatggaatggaatgcagaatcgaatggagcatcgaatggaatggagcatggaatggaatgaaatggagaatggagtggagaatggtgtggaatggaacagaaaatggagcattcaatggaatggagaatagaatggaatgggaaatggaatggaatagaatggagaatggaagggactggagaatggaatggaatggagagtagaatgcaatagaatggaatggaatggagaatggaatggattggacaggaatgtagaatggagtggaatagaatggagaatggaatggaatggagaatggaatggaatggagaatggaatggaatgcagaatggaatggattgctgaacggaatggattgtggaatggaatagaatgaagaagaatggagaatggaatggagaatggaatggaatgtggagtggaatggattgcggaatggaatggattgtggaatggaatagaatgaaaaagaatggagaatggaatagaatgggatggagaatggaatggaatggagaacggaatggaatgtggaatggaatggattgcggaatggaatggattacagaatggaatagaatgaagaatggagaatggaatagaatggaatggagaatggaatggaatggagaatggaatggaatgtggaatggaatgaaatgtggaatggaatggattgtggaatggaatagaataaagaatggagaatggaatagagtagaatggagaatggaatagagtggaatggagaatggaatggaatagagaatggaatggggattgtaatggaatggggaatggta

SEQ ID NO: 7245 - DNA, 1056 bp, Homo sapiens
tccccatgcccttattccagaagtcatgtcaatctcatttaacacaaaattgttcctaaattacacaccacctcaaagtaatacagtttcagagatccctaggtgtagttacaggtgcgaaaggaaaataaatcttgggaccccaaatcactaagctaaagggaaaagtcaagctgggaacgggttagggcaaacctgcttcccattcttttcaaagttatccctctgctcacctgagacaaatgcacatatgattgccttctctcccctattgtttatgtaaaaatgcagatttattgaggcagactaaattgtgtattcagtggaaggctgatcaagactcaaaagaatgcaaccctctgtctcttagctactcctaacctggaagccccacttccaccttaccggagaaccagtgtacattttacacatattgattgatgtctcatgtctccctaaaatgcataaaagcaaactgtacccccaaccacctggggcacatgtctcaggactttctgaggctgtgtcatggacgcattcttaaccttggtaaaataaactatctaaattgactgaaacctggttcagatattttgcattcacacaggactatatattatgtgaaaaagcgtttaatgaataaaaatatgaggccgggcgacgtggctcacgcatgtaatcccagcactttgggaggctgaggcgggtggatcacgacgtcaggagatcaacaccatcctggctaacacggtgaaaccctgtctctactaaaaatacaaaaaattagctggatgtggtggcgggcgcctatagtcccagctactcaggaggctgaggcaggagaatggcatgaacgggaggcagagcttgcagtgagccgagatcgctccactgcactccagcctgggtgacagagcgagactccgtctcaaaaaaaaaatagtaataaaaaagttaaaatatgagtattcttaaactataaataattcttagcatatatctcatgcctttctaattttgaataaaagaaacttcactcacgccaggtatgtctgg

SEQ ID NO: 7246 - DNA, 1129 bp, Homo sapiens
tgaccgctgagaccaaaattttgtacattttttgggaaaaaagtccagagtggtcctgcaattttagaggtctctggcttccagaatattgagaaccattgggattcagaaaaggaaataatatgggttatttatttatttattttttgctggtacccagaaaatactgataaggcaattgagttcagttgacttgaaaattgtgtcatgtatatttttgcgcaggtggtttgtgtgtaagtcctgggagatcgtaggatattctaggaaattgtgaatttcctaacctgagtatatttataaaaattgtcctcttagcagacgtgaggatgctgtagtggattacccccaaagggttctttatattctctggttctcaaattaaaaatgctttaggattattgataatcgattacatttttttccttatagaatttgccatctgccttagtaagtcatgtactaaatcctcaacctggagagaagattctagacttgtgtgcagcacctggagggaaaacaacacacattgcagcactaatgcatgatcaggtgagactgtcttcacagcaaatccactctcaaagtagtgtatatttcacaatgtgtaatttctgaaacatagagccattcacagtctcatttagttcagattcagccaaaatgaaaactattcagttatgtcagtcactacatattaagctcagtagacaatgatcatttatgaagactgtctcaagaccgtcttgaattttacaatttgcttatatgattatagacttaatctgttaagaaattaaatttaatacatttagattatttcattttcttataagatttcatagttgtttaaactattaaaatatattctgccattaaaaactaatttcacagtatattatcaaagtgtgaaatatgtatatgttaaaatatataaacatagttgtataatacataaacatatacacatacatatagaatatttactatttgaagttatcattttggtctaagaaagatctccaataaaaaaggatattttttaaatactgagaatgagaatcaaaaaagagaaaaggatatttgttgtttacattttgaggaatgtaatactcattagagaggatat

SEQ ID NO: 7247 - DNA, 1031 bp, Homo sapiens
ttctgtattctcttttataaagacagcaggactttgtgtgctgtgtttctggcacagatattacctgcatcagagattcccaagacagccctcaggtttagtgattggctaagactcacagaacctagcatacggtcacaccaatggctatggtttattacatgaaagcatacagaagcaaaaccagcaagggaaaagaggcatggggtgaagtttggaagaaaccaaacacaggctgtctcagtgaggtcccataggacatgcttaattcctccagcacctaattgtgacatgtaaaatagttgtctagaagaaaagctcatcagaggcttggtgcccaagggttttattgggctggtcacataggcaccctctgcgtagcatgtaccgaaattcccagactcccgaaaggaaagcaggtgctccgaataaacatgtgtttgtaccttgcttgtacagagtttaggaattgtgagccactcttatttatcattagggaaggttttatgtcactgctgggaactcattccagtttctagctgcttagctagccaagacccatcctctcaagcaaccctttctaagaaccgcagtctcaagcctgttactttaattttttttttctgttaacatattcttcaactccattcactgatctttttcttccgcattcgttctttttttttttttttttgagacagagtctcgctctgtctcccaggctgaagttcagtgccaggagctctcactgcaagctctacatcccgggtctacgccattctcctgcctcagcctccctagtaggctacaggtacctgccaccatgcccggctaattttttttttgtatttttttagccaggatggtctcaatctcctgacctagtgatccaccctcctcagcctcccaaagtgctgggattataggcatgagccaccgcacccagcccatttgttgttaggcctgtcttggtcactttggctctgtttcaaagtggctctcttgtcaatagtataggagataagttttat

SEQ ID NO: 7248 - DNA, 1051 bp, Homo sapiens
gaaggatcatttgagcctgggaggtggaggctgcagtgagccatgattgtgctactgcagtccagcctgggagacagagcgggaccttgtctcaaaaaaaaaaaaaaggaaaaataagttttcatagtataatgattataatggagttttattcctatggagcattttaaaattcctaattatagtctaaagtctttttaaactcctaagaattataataaatatagaaatgcttttgttaaaattgaagtttgttaaaacttcaatttagtgggcagcaatagagcagtggtttaataaactatgatttgtccatgcaatgggatagtatatggcctttaatatgggagaattctacttaccaatcagagaagatgtttatgatcagtttttaagtatcaaaagcaaattgctatacttgggataattactttttttgcagttaataaaagtacacaactgtggatttatgtatatttatttacatgtaaaaaaacatctggaagctgtaacatacccaccttttaatagtggttaactctgaggaaattagattgggagagaggggggaaataaaaggaaattttcatgtgtaatatttttgttttttttttttttactataagaatgtatttttgcaattaaagttgatttgtataggctcattctatttagtttaatttttaaagtttttcatcttgtattcagttgtttaaaggtgaaagttacatacagtgaaacgaagagatcttaaatgtttagtttgttgggttttgacaaatatgtacaactgtgcagccaagacccaccccagtcaagatagagcatttccattatcccagaaacatctcttgtactcagctaccctaccaggaagctgctcttctgatttctatcatctcttagttttggaccagttagctgctactataatagaccataatcacagatctttggaggttactacactccttatgaggatgcaaaattgtacttatttaggttcaaactttggccatttcttattctgttaaacactttttctttattc

SEQ ID NO: 7249 - DNA, 1030 bp, Homo sapiens
gaccattagcccaactttcaaaaatatgaaccctatgaacttcacaactgaagtcagatctgtatgcctgagagaggtaaaatcatgtcatgaaatcaaacggtggctgatgcgcccaaattctggcctcatcctctaactggaggacatctggcaggacagcaactgggctgtgccttttttcagtccagcaacatcttccactcaacccacgccatttggctgtttccccattgcccctggcacctagccctccggtaccgggaactaaatatctttgaccatcccgcccgcggggtctgcctacttaacctgaggcaggtgaaagagcctcacgcagggttaggaacctccgggggcgtggcgtagcgtaacgcagtgttggggaaacttgcggctgtggattgggggaccggaaagggaggggtgggccgcaggcgccggacgtgacgtaagccggaagcgactttccgccgagaaatagggggcgcgtgtttggaaattgatagaaaagataaagggaccgagctgctgtcagcctggcttactgatctgcgtccgtttcaccacggattcagttactaagcatttttttctttttttggttctttgcaacgtgagtggcattggctcagtgatttccatgagcatctctaccagaaaacattgcctcgatgaggtgtggtggaagcccggcagccccttctaatcggctaggcttgagaaagcgtgtacctctgcatttccgaaattaactcagcgtgatcggcaagattttcctcagcatctggtgtcaagacactcgtcactattaattcggaaagaaaaaaaaaaacaaaacaccgttttccagcatttctcttggtggagaactaaacaacaggaaaaatgtctattttccctaagatatctttgagacctgaggttgaaaactatcttaaggaaggctttatgaataaggaggtaggtcaagtaaagatgttagttgatattttgcaaaaactcaaatattcgcacactcgagagaaat

SEQ ID NO: 7250 - DNA, 1044 bp, Homo sapiens
ataagaattgtgaatacctccaacacaggcacaactttgtagataaaacaacaagacttctgaattctggaaggagttatgaggctagcaagtcatttgggaacaaaatgcactgtccctgtcacttgctgactggacctgaagggaatggacatttctatcacacatctgactctccaagtatactaagaactggagtcaattatgaagctgacatatccagtttgtctggaattctttgagaacatcaagaataataaagtcattgttaccctcactttacccactggaattctctagcattcttgatattcttctaggggcttgtagtgaaactcagaaggttgttgcaagattatctagtgttactgatcatccccagattgaagcaattgctccttcttctgaatgtttattactattacttctaagtgactcatttagttaatgtaatcttaagtacatttaatatctttttcaattttctccacttgaactctccattgggttgtattacttaagctttcttatgtctatgcttcatatagctgacaaaattatagttacgatgatgcccaagatctcggtcttacactttctaaaatgccctttgcttatggcctttcaatttcaaacaacttgatgttattttaattgtttctattgggagacttttgtctcagaggctttttaacacaatgattgtagagatctaaaccccaaattttatttgggctgctagtctgtgtagggtttaatgtgagggcatcccaagtaggatgagggcagtaagcatcctgggtgctggcactgaaaatggagttgaaaagcatcaatgcacacttgttcctcctcaactaggacagctctgtccattgtgtagaggatagataggctaatccagtggagaggagttctctccaggacaactggctgaggatgaggtggacagaatgcacaacctctctaagtgccttttctgtcactctgctgtagcatggtcccggagctgagctgtagttgagagaggctcagaggggaggc

SEQ ID NO: 7251 - DNA, 1044 bp, Homo sapiens
tttgtgttaggcattctgctaaggattttgttttccagatacatataatacataaaacaattccgtgatagggcactatcattatttccatcctacaaatggggaaactgagacttagggtgttattacctggctcaaggtcaaatatttaataagtggtggaggagattctggatccagaagacagccttcttgtcagctgtgcaaatctaaatgacttttagaaagtttgtttttaacatgcgtgttgctagtatagcaaacacattatgtgcttttatactgtgatgatttaatgttcaagacaaatagtaaagtatttgcttatacatttttttatctcttaaaatgtaaaaaagtcatattttttgtcaggagctttttaaatgtgagcatgcaactccctctcccgtaagtttattcgttatcaatgccagatacctaaatggttactcccttgctctgtcattcaaattcccattagggaggtaatgaaatcaagtagagggcggagctacgaagacttgttctctggtgcttgatgactctgaatccagttccctttctttctttgtcctgatggcaaatttatcttttatttcctggaagaatttgcagccagatgtattactctaacatttatgcttctatggcaggcttcttacagtggagaaggtttggggaggtgaaggaaaaaaactaaataaccaaagaaacacttctacaaagagagaatgatactttttgctttgcttttaaaatctacctttattcattaaaataatgcatttcgacaattcgtggttatgtataactgttggctgaaggaatattcaacttcttcattcacatttttatggctggagcagtttttgctctctgggaagtagaaactctcttgggtggaagcagccgagtgaggctgcctttcttattgtctctatgagggagatccagtgggccctatctatggtgtttgcccacaaatcatgattttggcctgaagtcactgtgagtaagaagagtgaggagttttactagcca

SEQ ID NO: 7252 - DNA, 1050 bp, Homo sapiens
agcaaacactctagcctctgagatccaaagaaaatagacttgtcttcacaccataagtcctaaaacatcagtgtccttgaaatatctctgaagattttttgttctttctttctctgtttctctctttctctcttctttttttattttttattttttttgcagaggaacattggaagagggaagagattgttttctgtgatctctgctgctctgagctttactttactgaactatctccatctctgaatggtcttgccaagtttgcatgttctttttcttctgccttgtgcacatacagccccattctatgtcttcaaaatgcaacaaatacaaaattgtaaatgcagcacaattttaatgacattttatagcaatggggtagtctcttataatactgtttctaggtggttgaaaatagaatattaaccttcctcttagaagtcatcatgcattttgtcactgagaatttctccctggctagtttttctagcatctaacctctgatcacgttcctcagttttcacttgtcttttttctcattttccccattcctccttttaccgccaaattcctgtcaatcctttattcacagcaggttagatttctgtttgttttgctgatttcttctagaccattgcttttcaagttgcaggtagtaaccaattagtggattgagaagtttgttccatgatgccttagtccctttgggctgctataaaaatagtgctaacctgggtggcttattaacaacagaaatttgtttctcattgtacaggagcctggaaagttcaagatccaaggtgctgacagattccatgtctggcaagggcctgcttccttcatagactgagatcttcttgctgtgtgctcacatggtggaaggggctgggagcttccttcccccagccccctgtcctctctctttctctctctctgtctctctcaggtccctctttaaagggcagtagtcccatcataagcattctaccttcataacctaattatctcccaaggattctacctccagacaccatcccattggggattcag

SEQ ID NO: 7253 - DNA, 1036 bp, Homo sapiens
ttggggaagaaattattttcttttccctcaccgacaatcctgcttatatttgtggtttgaattatagttacaacttgcagagtttatcctaagagagataaaatgagaaacaaatctgagggaaaaaaatggaagtggcaattcgaatctaaatgtagaagtaaatgggctagattattctgaagtaaaatagcagaaattctaaaatctaaagctatctagttgtatttaaaccatattatggtttagctcagttctgtcagaacatttgcagactaattttttctagagaaaaagcagttggcttcaaaatcaaaatgtactgattttcttggtttgtgaggctaattaagtttaactggtggaaaattaaaaatacaactaatgttgtgtgttttttcaatatttaggaactgcagagtccccaagataatattttagagaagtttttttttttttttttttttttttttcttgttttagactgagtttcactcttgtcaccccaggctggagtgcaatggtgcaatctcggctcactgcaacctctgcctcctgggttcaagcgattctcctcagcctcctgagaagctgggataacgggcgcccaccactacgccctgctaatttttgtattttagtagaggtgtgatttcactgtgttggccaggctggtctcgaactcctgacctcaaatgatccgcccgcctcagcctcccaaaatgctgggattggaggcatgagccaccgtgcccagcctagaagttctcatttgagacaactaagtcaaatatatcaatgaagtgctgaaatgtaatgtctgcatatgtagtttaaaaagtacaaagtatgtatgtttccttttgcagttcacaggcaataaagaatctttaatccattaatatttaaggaatattataaacctggttatttatatttggggaagaaaatggttaaaaatctcatggaattaattgtattttcaactaaatctttcatatattggtgacagcattgcttattctaatactgatgg

SEQ ID NO: 7254 - DNA, 1541 bp, Homo sapiens
tttgaaaatacacctttggtaaacttaattaaaacataattttaaaaattaattcattatttataataaaaatttaaacccttaataaaatacatttccacactgaagacttatttagacaggtctggaaattaaaatcaggttgtagactttattgcttgcttattaagaccctgagatcattatcttaaatgtaattttaaaggttttttccatgcttaaggtatatatgatcaaattgaaaaatagccaattatttccagtcttatagcattactatagagctatactgtccaacatggtcaccactatctacatctgaccattgaacacttaaaatgtggctagttggaattgagttgtgctgtaactgtgaagttcaaatacacaggattttaaagacttagtaggaaaaaatataacatgtctcattgtagtgcgtagtatgaagtagataatcatagatatttcataaatgaatgtatgattgaaataggagagaaagttagagatttttgttggttttgttcgttgactggagagattaacatgaggcctggcccatagaatgcacacgagaaacatttgtgaacttattaacaagtaaaatttgttgaattatatttgttataattcattcatgtccatcttcattcattggtataacaaatgagtgaatgattgaatgaacatagacacacccacacccccaacacacaccctcacacaaataataaagaagataaagtcctcagagagaaatcaccccaatatacgttaaactagttctcactcttcagagagtaccagttattttaaagcatcattaacttcatagctgttttaatgatatatttactttaattataattttattttgatattatcttatagtttaagttaaacatggaaaagctccatggaaataattggaataaggctcataaattagtgttttaaaagtgccaaacttctgagcatcagtagtattgttttccctggcttaaagtgggatgaaatcatgatttcaggaagaaggattcctcagtgaacataggtgttagtaacttgatgcttaaggtttgagaaggaacattgacatcacttgtttagtaaataatagaaaaaagaggtgcattttaataataaagctgtaattatagaaatgtaaaagtgtgaaatgtataaacacatttaacataaattttatttcagggtctacataatacgaatgaatttcccttaaatatttttcttccaaagattcataaatctggaaacactttcttcactaagaattttcataaagtccacatacacaaagagtattctgaagggcaaacaataacctgaagaaggaaaaattatgttcaaggcacataaagggaatagagaagctgtggtagtgctgcttccacagttaattgactaggaattgttataactgcaaaggcttcatggttcaaactgacttcagctttttgtgttaggataagtgatttctatacatttccgtcatgtagctctcccctgacatcctg

SEQ ID NO: 7255 - DNA, 1035 bp, Homo sapiens
tctcttaaccaaatggtaatttacagtacacactcttttgtactttgctttttcctctattgctgtatcctggactccttagcggtatgcagaaatctgccttatacattttgacagctccagtgtgtcgctggactacaatttctttaactagtcccttgttgatgggcatttgggttatttccagtcttttgctattgctagtattgtaatgaatagtcttgtatatttatcatctcatattttttaccagtacccctgagggttggttgttataagagtgactgatgggttaaaaagtgaatgcatatgtcattttgctagatattgccaaattctcctccactggggttgaaccagttatgtttccaacagtaatatatgacagggcctgtttttccacagtccaacagaatacgttgttaaactttggagtttttgctaatttgaaaggtataaaatgtcatgttcttttaatttatatttctcttatcaccagtaagaagcttgggcgtcctctcttacactaaggaccatttgtatctgttttctgtgaactattcatcttttgtccatattgggttgttgattttttttctcaatttttagatacttcttttatattaggactcttagcccttcatgatgcaatttccccctgctaccttgcttttgcttgcagtggtggttttctttttctgtgtacattttagattattattcatttttattttcatgtagtcaaacttatttttatgtagttgttatttttcctgtaggttccggattttgagttaggaatggtttcccactcccaggttgtaaagcaattcccctatgttttgttccacggtttcatattctgcatttggatctcatttggaatttatcttggtgtgaggcatgagaaatggatccaattatatgcttttcctgtgttgttgtaacattatttattaaggggttgtccttttctcccttttcttggatgacgtttgtcctgtggacatgggtctatctctggactgtttatct

SEQ ID NO: 7256 - DNA, 1048 bp, Homo sapiens
ccttacagtttcttgcaaggttttcctaaaatgcacatctgatcatgtcacatcctcttttaaaatctgttaagtctctctgctgcctttaggataaaatgtaaaatcttttgcctggaatgtgaggctgtccctggcttagtgctagctgagacctctagcctgggaggccctcttgcaatctgaacccatccatttcacacttctgcctgcaagtcccttcatacctctccccatccacactggctcagaggctaccattgagacagccagatgggagggggtccccggaaaaactccaaccagcctgcccactagggtagagccttgggaagtttgtgctgtttgcagagggggcggggtggtggtgggggagccaggccccctcctcttcctgtgtgaaacctggaattcgaactatgaggcaggaagctctctagcaggggactctggccttgcagggagtccctgtttcccccttttcttcctttcacccagcaaaaccctgtcttactcattcaaattgtctgcgagcctgaattttcattgccgtgggacaaaggaccccatctttagctgaactaaggaaaagtcctgcaacaccatctttccctagctgctctgacagtcagcttctatagctgcattatgagttttcctaccctcagactgaactctatgaagaaatgggctgtgtctttttttctatacagacccagggcctagcccactgccatatttaataaacaaatgtatcgaccatttgtgtcaacaaatatttttattttttactttgatgagtgaatctcctggccttgtgtgaatttcatcttacagtgaagattattactaggagttctaatctctttcaaggtctacatatccattgcacatcaattttcttcttgaaagctcccagattttttttctattgtgtcattgtctagcacaaagtagttatcaaataaatatctattcagtaaatagctggattattttatgggattactttctctatatccagggtgttttttctttcttttttttt

SEQ ID NO: 7257 - DNA, 1073 bp, Homo sapiens
ggctgttaagtgctctgaggtctggtgaatttattattcatttataagactgcaacttcatgaactttttcccttacctcactaggttttccatattactcaaggatctttttctataagaaacttgggttgatccaaaaagtagtactttggcaagtccagttttccatattactttaatctaaacccactgaacagtattggctaaaacccaaacagatattttttgacagtggctggattgtgtctgttatgagaggaaacaggtgagaaagtgtctagactggaaagaccccagaatcttccggctagagatgctgggaaattataatcctgaaaattatagatcctgaaaattattaggggtatgaaatttgtgagtcttgcatttgagtgccaagtttaatataggttaatataggtaggttaactaagatcggcagtctttgctgtctttatgtttccctgtgtttcattttctcctatttgtttctagtttatctctgaatattgtgtggctctttcttagctgcctttaatctctcttgtataaagacataaagcagtgaatttaatgacaactcctaagtgttttgggtaatatgttacggatgaatgggaatttttgattgcttatgtctatgtcaatgttttgaaattttttcagctcttctcatgtttgtttattgaggatttgaaatcatttggaaatgaccactcagtctgcatgttactgaggtgtgggataaaatacaaccgtaaatttcaaattgagtgtgatgaacgaggtgagagtgggtgaacttgccttttctgggtagctgtaatgacaacatattgaacatgggagatttgttaaatactgcaatttataattcttctgctatgttacccacttagtgtagccacagaacaaaacaagaaaagaggcagtatttcagaattgactaaatggctgggaagaaaaagaacttggcttctaaaataaagcaaaattatttttttccccatgaaattccagaagatgtcttcatctcattgaatatattaatattcagatggggtttggttgc

SEQ ID NO: 7258 - DNA, 1083 bp, Homo sapiens
cgggttcaagcaattctcctgcctcagcctcccgagtagctgagactacaggtgcgcactgccatgcccagctaatttttttttgtatttttagtagagacagggtttcaccatgttggccaggatggtcttgatctcctgacctcatgatccgcccaccttggccttccaaagtgctgggattacaggcatgagccactgcacctggcctatattgatttttaaatttgtatttctttttctcttttgctgtttacagagtttttttcttcttttttcagttttgtagagtggaagaattatgtcttgttatagaaaaacagttggtgtttgcctgatcaataatgccattgcaggtatgagagggaggttaggaacaattttaatgacattatcaatctacatatctagaaacattgaggaataatctgtcacttttatcagctgtgacgagactttgagatttaggacaggttattttcactttcatgactgttttgtgttagttcactttgtttatatttgcttgattctgggtttatcctgtttctttaagctagttaggatgtagcttttcttttctgaatgactcatttcctaattagttattttctaactggaaattacttatttcgtaatactttataattcagaatatgtacacaggactattccctgttgtgatttcttattctctccttattttaaccttgtgtggtaccttctggttcaaagtaatttcaataatattctattctatggctgggcgtggtggctcacgcctgtaatcccagcactttgggaggccgaggcaggcggatcacgaggtcaggagatcgagaccatcctggctaatgcagtgaaaccttgtctctactgaaaatacaaaaaattagctgggtgtggtggtgggcgcctatagtcccagctactagggaggctgaggcaggagaatggcgtgaagccgggaggcagagcttgcattgagccgagattgcgccactgcacaccagcctgggtgacagagtgagactccatctcaaaaaaaaaaaaaaaaaaattctagggttgggggagggggga

SEQ ID NO: 7259 - DNA, 1035 bp, Homo sapiens
tcaaatccccttaacctaaagggatatgtttttaaactttttaattcttgcacaaataattttataacaacaataatgaaaataaaaatctgaactcacctgtaggcccattctctaagaatctaatgcatcaacatttttattttcctgctggtccttttatatagagatgcacactggttttttttaaaaacataattttcgttatagctttcacttacctttttagacagagctactctccatcctgaatattgtatgttcagtatagctgcatactagtagattgtgggaaataaataaatagtatttatttatttatttcaactaaaacagtagagtgttttcactactaatagatgtttctgactgcctgaaatgagtagcaggattcaaggagcaatgtgactggtttgtcggatatttaattagcagcttagattgagatttcatggtaatgagtttttttgatccatgttctggtattttatatgaagataatcttattagaatgttagagactctgaataatatgaagataatcttattagaatgttagagactctgactaaaaaatattttttgaacaaaattttttgtgagtgggtaaaggaggtttccttgaccacctagcctatgaggttagagttgctgtgatccatttgaggttgaagggcatggggatagagttgctgtgatctgtttgagattgaagggcattacagatgtggggcattttcttcaccatagcggtcaccaacctttttggcaccagggaccaattttgtggaagacagtttttccatggatggggcacaggatggtttcaggataattcaagtacattacatttattgtacactttatgtctattattacattgtaatacataattaaataattatacaactcagcatcatgtagaatcagtgagtgccccgagcttattttcctgcaactaggcagccccatctggggatgataggagacagtgacaaatcatcatgagagcatcagactctcataagaggcaag

SEQ ID NO: 7260 - DNA, 1060 bp, Homo sapiens
gatggggtctacctatgttgcccaggctggtctcgaactcttgggctcaagcgatccccccatcttgaccttgcaaacttctgggattacaggtgcaagccactgtgcctggccagataatggttttaaaacagatttgcttatgtacattttaaattttactgttttacttcttcacagtcagtaacactgaggctttaccattcaggctgctggggactaatctggccaatttgaccagctgggggtctccctgctgatttcttagatgggtattctgtgacttattgctctaaaggcattaggtcttttagcaaatgtttattggatgtctattttatgtcatatactaggccttgtgctccttaaagaactaaggtgtgagtgtgtgtgtgtgtctgcacaagtcagggactgttaacagctgcaattgaactttctgtcctcaatttggtatttgtctgtttatttggttgtgagcgtgcaaaatggagggcataaggtgttactctcaggccagtaagaacctaagaatttgtttgggtgaggtcttgatttccttttttgcctctattaaatggcctacccttaattcaccagtttctccatagaaatgcctaaagaccttgagaggttaatactgaaagggttttagaggaaaaagaaaggtgagatgctttctgtgagtcagtgtttctccaaatagtcttttcctgcctacctgtatgcatcacagttacctagcgaatatggtgagaatgctcattcatgggcctggccccagacccactgacagggaggcccagaaatctgcattgttaattctccaggtgattctttttttttttgagatgagtctcgctttgtgccccaggctggagtgcagtggtgcaatctcgactcactgcaagctccacctcccgggttcacaccattctcctgcctcagcctcccgagtagctgggactacaggcacctgccaccatgcctggctgattttttgtatttttagtagagatggggtttcactgtgttagccagggtggtctcgatctcctga

SEQ ID NO: 7261 - DNA, 1038 bp, Homo sapiens
ggcttgaggccaggagtttgagaccaggctgggcaacatagcaaaaccctgttcttgcaaaaaaaaaaaaaaattaaaaaattcgctgggcatggtagcacacacctgtagtcccacctactcaggagactgatgtaggaggatcgcttgagcccagaaggtcgaggttgtagtgagctgtgattgtgccactgcactccagcctggtcgacagagctataccttgtctcaaaacaaaatgaaacaaaacaaaaacaaaagcaaacaaacaaaaaccatatatctcaattcagcatgtctctgtgatcccttatacagaggagctgatctaaagcaatcccatttcattaaattaacaggctcattagggaactattccttaatacccttaatcaacactcttaatttcctaacaatgtattttttgaaaggaggacactacttagacactactgtctcgtaatggccttaaacaacaaaaccaaatttataggacaatatagaattcagaaaaggcctcttggagataactctaggggtaaccagcagcctgcggtagcccttattgtgccctgaatgtttaaactctcatgaagtacatatatgtgtgcttaaaaattatatattttaagcagaaattatctagcctacttgtcattttcctttacctcagaactttgtttagagcacccattagcttcagaaggaccttcccaccggaattctctgggggccttgcaaaaggataaaaacaggctcaagaaattctgtagagaaaagatgactatgttaacatcattctttgaaaaagcttccgtttgggacaattgtattgtattctgaaatgagatacttgggcttccaaaatatgggttgtgctttgtaaaatggagtttttctcattacaaaatgttggaagagagcaattagaatttccttctctgcctccttccctctctcttgatttttggtgaagtcaagggtcaggatgatgctaaatcagaaattaaggcaacacaaatttgatcccaactggta

SEQ ID NO: 7262 - DNA, 1056 bp, Homo sapiens
ttttcttttctttctttttttttttttttcggagacaaagtctcgctcttgttgccaggctggagtgcagtggtgcaatcttgactcactgcaacctctgcctcccaggttcaagtgattctcctgcctcagcctcccgagtagctgggactacaggtgcacaccgccatgcctggctaatttttgtatgtttagtagagatgggacaattttcaataagagatttctgttctacatggatgaattttgagagtgacagagatttaagttttaatatttgtgatatattcttataagtgggaactaaacatttacacatttatgtacatctacacatggtcttttcttaaaaatagaattattttatggttttcccccatctttaggctttaaataattatttttgttcatattgcacatttgctataggtatgatacttatttattatctttatcaaaggaatcgaatgtgatccttcttgtgcttctaatgttctgttttcttataaactttgttttgatatttttcagagtatactcatatcttagatactcgagtcccaaatctgcgtgtgtttctcttggctgtaatcaacagtgccggttggtgttcctgggcacaaatcacagggctgctcgatgtcacacatttccttgtttgtgtattcccgtgatcaatatcagcaacagcacagggaatagactctcttccactagctcatatttttcttaaacaatatgtaggtgtgtgtgtgtgtgtattaatttctcaccttttacaccataattcaaaatctaggtgacatgtttcaatagccgataagcatttcatagtagggtaggtcaggtttaccgtataatccctttgataatgccttcttttataaatacatgagagaagttacaattgagtcctgctgaggaagtagatcaataggtggcaagctgtttgacccttcgagccagaaagagaatttggtaaattgttagacaggttattgactgccctttagagagccaggggtttggattctgtaactcctttcagctggggct

SEQ ID NO: 7263 - DNA, 1154 bp, Homo sapiens
atatttaccacaattgagaagagtcaaaaatatatgtctcatgcacggaatgcaatatcaaaagaggaattttcacagagttttgagcagtctcaagatcacagaatatggatatcatatccaaagtatctatttagaaagtgatgacatgcttttgttgtatctatgtgttgtgctgttaagaaatcgctttcattactttatggtcagccatattttatatgcattataaattatgtgcttattacaaaatcacagccaccagaaccgtctctctatgctttacagttcacctgtgaagatttatgttctgagttagctgagacatcatagaattctcttcttaccaggaaaggatcataatacatgctgttcaaagcaatagcgtaagacttattgatatacagtatctatactccgcccctctctgaggattctatattggtcattgttcaaggcttctagtgattttcttttattatatgaaaaaggagagttcaatgtaggacagaggtggagctaccttgggtggtggggcagagtacaaagaacaaataatgatcttatatgtctgtgcacgtccttcctccaaatgtttctataactgcgatcttttgaaaattaacagccttggccatctcaaaggaggaaaaataaataaaggaatatgcagctcaatctgtgtgtttacggggcagataggtgaagatgagaaccatagatcttattgagagggaagctgcccacttttgtccttctatttgggtgagaagttgttgagcctccctatgtttatactgggagccctatttttataaagccctctgaaggctgtgtggtgttgccaacttggagaaaaggttgaagctccagtcctggatccacaaattctgtgtgcccactcttgagcaagttacttaagccctgtgagcctgagttttctcacttccaaaacaaggtcctcacacaggtgtgctgggaggtttagatgaaagcacctgccaaataaatcacagaaatgagagcctaccaaagatttgtgctccctgcattttatcttgtatttttttaaaatctcaagatggtggtactactgcctcttcacctcctcattttctttctttttctggtcttgccctgttatcccctccacc

SEQ ID NO: 7264 - DNA, 1045 bp, Homo sapiens
ttagaacacttatagtatgtgatgttaaaccttattatacagctctggtaatcaggacagtgtggtaatatcatacaggtagaagatatacagggcgatgtagagcagtgattttccacaaagacaccaagttaattcagctgggtgaggagaattctttcaacaaggggtgcaggaacaattttatatccagaagcatgaaaagaaaacaaaacaaaacctgagcacttacctcacagctcatggaagaattaacttgaaacatatcataaacttaaatgtaagagttcaggcaattaaacttctagaaaaaaatgtagactgtcttagtgactttgggctaggcaaacattttaagaatatgtctcaaaaagtataactataaatgaaaaaaatggatacattgactttatgaaaatgaaaacctttttcttttcaaaagatactaataatcgcatgtcatgactagggagccagagaataggagaaaatatttgcaaaatatgtatcacacatatataaagaactcttgaaactcagcaggaagaagacaaaaacccaattagaaatgggcagaagagttgaaggagcctctttttgtcaacatcattagtcattaagtagatacaaagtaaaaccacttttgttaggatggctaagatggaaaaggctgaccttatcaagagttgaaaaaggcctggtgcggtggctcatgcctgtaatcccagaactttgggaggccaaggtgggcggatcaggaggtgaggagatggagaccatactggctaacatggtgaaaccccatctctacgagaaatacaaaaaattagccgggcatggtggcgggtgcctgtagttccagctactggggaggctgaggcaggagaatggcatgaacccggaaggcggagcttgcagtgggccgagattgcagccactgcactccagcctgggcaacagagtgagactccatctcaaaaaaaaaaaaaaaggagttgaaaaatgtttggagtaactggaactctcatatgctcctgtacataca

SEQ ID NO: 7265 - DNA, 1032 bp, Homo sapiens
aatagcatgacgatatatttaaactcaatcattttaatagccacattaaatgtaaatggtctaaactctgtcaattaaaagacaggctctgtcagactggattaaaaaaaaaaagcaggacccaactttccactggctaaaagaaatctattaaatatgaagacacagatagggtaaaagttaaaggacggaaaaagatacagcatgccagcgttaatcaaagaaaggtggagtagctgtatgcatatgggacaacgtatatttctgagcaaggaatattactaggaataaagagggtaatttcaaaatgataaaggaatcattttctcaagaaaacatagcaatcctaaatgtggttgaagtttctaatcctaaactgaaagaagaaatagccagaccaccatttaggtggagatttcaacaccttactcttgataattggtagaacaaatagacagaaaatcagtaagaatacagaataattgaacaacactataatcaacatgatcaaattgacatttatagaacgtcctatctcacaacagcagaatgcagattcttttcaagtgcacacagaacatttaccaagatagaccatattttgggccataaaacaaatcttaatcaatttaaaaagatttaagtcattcagggtatgttttctgaccacagtgggattaaattagaaattaataacagaaagatatctggataatccccaaatatttggaaaccacacaacacacttgaataacttgaatcaatacaagaaaaaatcacaagtgaaattagaaaatattttgaagtaaatgaaaattaaaacaacatattaaaacccacaacaacaatttgtgagttaccaataaacaatgcttaaagggaaattaatagcattaaaagtgtattatattagaaaactagaaggttctaaaaccaatgacttaagcttcaaccataagaaactagaaaaagaagagcaagttaaagcaaaagtaagcagaagaaaggaaataataaactataggagcagaa

SEQ ID NO: 7266 - DNA, 1075 bp, Homo sapiens
aatataactatatatgttatattaagtatattacaaatatttgctttatacctgcacatatacacgtttgtgtatgtatataaagcaaatatgccaaaatgttggtgattggtgaatctagatgaagggtatcttcatcacactagttttgaagctgttctgcaggtttgaaatttttcaaaataaaaagttaggaagaaagaactttgtgttagagatgaggtagtggagaaaaatgttgagctgttaaattcaggttcatgagaaaatgacatgttattattgtcgaataaagcaaagctagaagacatagtatccacaaaaataaactgtaaagtgagattgatttagatcatccagaattaactatttttggagtagagaaaggattgctgttgggcatcttagtctctctcttcttttgtttccatgatattagctttctcatgttgcaagtccttagctcacaagattgttgtaagaatgattgagaagatgtgtatgaatgtgccctgtaagcggtgaaagtaatgtctctaagcttctttgtgtttaggatgtcacttgtgctgaactgtaacacccaatgttgtattttgggttgtaacttgtgctgaagtacaacatccagtgtttgtattttctataaatgactatgcattcataggaaagagaaacttaatcagtggctttattaagactcatttcgcacatatgtaatttagaaaaagaaaactgactctgtttcactgagattaatatagttctgcccatggcatatctaaaacagtgtctaaatacatctaacaaataatagttttttttttcagtaaagaaacaaaatttcacttatttttaatgctcatttagccagttgcatttatggaaaatctttccccagaggttggaaaactagcaaacagcagctttaatataagtcaatagaacattaagtagagaaaagctcggagttacatactgtgctattatcttgtgataatttcaatttaggtttctttttaagtatgcgttcaggattttactgttagactaaatgtaaaatggagtcaatgtc

SEQ ID NO: 7267 - DNA, 1028 bp, Homo sapiens
attaataataattacttaattccttttaacacagttcatgttcacattttattggttatctctttcaattgcaaattgcaaagtcttttgttttgttttgttttagtagttgctcaagttaagagccaaattaagtacatttattcaattggcagctttgtctcttaaatatttttaaatttataatagtccccttccactcctttcccccttttaattccctttatttgttgcagaaatcaggtttttgccttatagcatgtcccacattctggattgggctgattgcttccttccagtatcatttaatttgtgcctctatccccatgtttcatataaactcatagatcaacaggcctgataatattctggctcaaattttcttttttttttttctaggcaagattgctgtatagttggtgctatgtactttccagtatatctcattgggagagacatagtatctgtctgtcccaacttcagtgagttaagattggtcagaagatttagctgtatacctggtccaccatttataaggttcctcatcagccatacattaccttaagtaatggtttttgcaatggacttctctagaagtcacaaactggaaattttttaattccatcattctttctgcatttagtagttggaattctttagtagggatcaatttttcatcattatgtatttgatatcttgaaatatagtttgaaaagaaaaagcaagatccatttgtcattattttctgttattgatccattttctgaataatgaattggggtcctggcagcctccctcggtggggatcaggaaattgttctctacttttttgggaagagggaaaggagtgggaggaacatcttatcaactcattataaaaccatggatgcgtttgagtgtattgaatcagttgcagtaattccttttgatattcatattgtcccatctttggccagtggagtttttttttttttttttttttttgatacagggtctccctctgtcacccaggctggagtgtagtggct

SEQ ID NO: 7268 - DNA, 1032 bp, Homo sapiens
atacaaaattaactcaaaatgggctaaagacttaaatgtgaaagctaaaacactctaagaggaaaacagagtaaatctttgtgactttggattaggcagtggttttatatataatgccaaaaaacacatgcaataaaaggaaatacaaattagacttcatcaacatttaaaaacacctgtccttcaaggacactctcaagaaagtgtaaagactacccgtagaatgtaagaaaatatttgcagatcattcttctgataaagaactagtacccagaatctataaagaatggttacaactcagttattaaaagacaagtaacccaattaaaaataggcaacagatttgaatagacatttctcccaagaagattcacggtcaataaacacatgaaagaaggcctggtatcatcactctttagggaaatacaaatcaaaaccacaatgagacacttcataactcctagaatggacatagtgaaaaaggtggacaataacaaatgttggtgagaatgtggacaaaatggaactctcacacatcgcaggtgggagtgtaaaatggtgcagctactttagaaaatagcctagcatttcctcaaaatttaaacaaagaattaccatatgatccagtaattctacttcttggtatatatccaagggaattgaaaacatacatccatacaaaaccttgtacatgaatgttcacagaagcattatgcataacagctaaaaagtggaaacaacccaaatgtccactaattgacgagtagataaacaaagtatggcacatctatacaatggaacaccattcaccccttaaaaggagtgaagcactgatcatgctgttaatataacatgatgaatcctgaaaacattaagctagataaatcagacactaaaggccacatatgatatgattccatttatatgaaatgtgcaggacaggcaaatccatagaaacagaaagtaggttagcagttaccagaggttcttggagaatagggataatggggagtgattgctaatgagtactga

SEQ ID NO: 7269 - DNA, 1045 bp, Homo sapiens
tccatattttatttatttattttgtaaataatttaaaagtgaggccttcgttatttcatacttcagtcttagtctttcaaaaataattgttgctctgattttgcaatgggagcctttatttagtttagaagtcaataataatatgctaaaaaaggaacataacttaagtagagaacctctctaaggggagagttctgagtggaaaaaacacaaactgtttttcctctgcttttaccccacagcaatcaacacagaagaattctgtgaccagatgtgtgagggattttcccacacataccaagcaagtgatcagttctgcagtggacatcagctgggtgtcctctaattcaattccaaccctatctacctggacatagcaccagatcccacaggttgagggctcagtcctacaagaccgcccccgtcacccacttccaatgccaatcgcaagctccagttggctttatctgtgcttgtgaccaacgggctattaatcagggttcccagaactctgtccttggattctgttaatttgctagagtggctcacagaactcagggagacccttgcttatgtttactggtttattagaaagacttacaggtcgggcgcgatggctcatgcctataatcccagcactttgggaagccaagagaggcggatcacttgaggtctggagtttgagacaagcctggccaacatggtgaaaccccgtatctactaaaaatataaaaattatctgggtgtggtggcaggcacctgtagtcccagctactcaggaggctgaggtgagagaatcgcttgaacccaggaggcggaggttgcagtgagctgagattgcaccactatactccagcttgggtgacagagacagactctgtctcaaaaagaaaaaaaaagaaagactattgcaaaggataccgacgacgaggtgcgtaaggtgaggaagggttacagagcttccctgccctcccctgctgcaccccctccaggaacagctgccccgaagttctcactacagtgttctcttgggcctttttgggac

SEQ ID NO: 7270 - DNA, 1771 bp, Homo sapiens
agtcattggatttctggactacagcttgactcattagtctttcttttctctccaaacagaaagttaaattactgttctgaggttcttaaattcagagtggagtttgtgcttgaaccaagtataatattacttgatgtacaattgggcagaatagttagaagtttggatgaaattttgtcctcttcctgtttctttttggcttttgttgctctggattttttttttttcttttttcttggacagggtcttgctctgtttcctaggctggagtgcagtagcataatcatagctcactgtaaccttgaactcctgggctcaggtgatcctcccacttcagtgtcctgcggatttatgctgaggtttgtcaatgttggatactattgtccttgtagcctgtgatgtgaggaatagcccaggggcattgtataactttgggaaatggaggtggggagatgctcattggatgcctttggaattcttgggactaacggatttaaaatattacactggcgtcactgtccttggggtccaatctatgagattcgttgatgatcattggaagtcaaggggtggccagacagatgagcacgaaagagaatccatcatggattgggctgtgttgggtggaagtaagctcagacttgactccgcctgcattcctcgcaggccctggaagacttgccttctctgtcccatttccggatagcggaaatgcactcactccttcatttattattcagtaatgatggaattcatttgttcatttacttaatattgaaagagcctgtcctatgaaccaggcgctgttctaagtacttggaatgtggcagtgagcaaagtagaggaaaattcctgccctcgtggagcttcttagtggaaagaggcagacaaaacccaaaaccaaacaatcagtaaaatattagaaacggatatgttctatagagaaaaatggagcaggggaagagataagtttcacttggttgggcagggggttggaggagagtttgcaattttgcataagttggtcagggaagtctagttttcacattggagcaaaacctggtataggcaagggaatagcaagggcacggagtgaacctggggcgtgtgggaaaagcaatccaggcaggaagcctgtgtggaaaggaggaaggggcctggggacggtggggaccctacaaggcctgtaaaccattacagggactgcagaatctgggcagctctgactaaggggggcagttgctggggtgttgagcagaggagtgacgtgatgtgtgatttaggttttaagttttttttcactttggctggttgtaaaaataaagcactaatgggctagaaaaggacttttgtgtgtgtgcgcttgtgctaaagggacagtcacatatttactgtaatgatatcccattgggtgtaaacaagagtgcattttgtcattaaaatgaaccaagagttatcatgaagccatggtccttgagggagttggaccccctggaagtttcaccacatgagtggtgacgcaggaggattctgtcatcatcagtgacaaagtcatgactgttgactgaagcagggtgaattacatggtgtgcgttgctatatgtgcaaagacatatcttttgtttcctgaatataattttggcctagattgctttaaatggaacttggaaaaatcctgcagaagaatcgagtcttgtttatttctccaaaaatgacttcagttcctttctttgctctccctcatttcatccttcccgtctctgcctttcag

SEQ ID NO: 7271 - DNA, 1018 bp, Homo sapiens
ttttttttttctttatacagtgatgagtatataacagggactgaataaacatgtgttgattgactgtaaaagaacctttactctgaatgggagacagcagtcgctgatctgatagcaagcttcccaagtctggcttctttctctgggtctatactggtgggtcaggaacaattgttaccgaggatttaaaaattaattccctagcaggagaaaacaggtggtaacataaaagaagtccctgaatggaggaaggatcaagtaattctcagaagagaccagcaggggaatatttatgacctcacctgtctgtaccaatgcatagccacattatgagatacgtaagatccaggagttttgccaacgtgggatggggacaggctgatgattaaattgtgacagtggagaggcttggtatgctaaaagagaaacatgtctaggaggtgaatccatgaatagaaagaatcttgaaggtgaaaagatgatggagaacatttgagtgagaaggaaaagaagggaaacaggtggccccgctgcatggcagaccatgtgcctcttgtccagattggaaatgtcatggaggctttttcaatgagttatctgctgaaggtttaagagagaataccagttggtttcttgctttgcttttgtggacaacgtcactgctttcaagctgctttgcgcttaatttggaaaagaattggtcgatggggtagcagttgtgaggactttagaacacgtagtctctgttatgttgaagttcaggagagcaaaagaaggagtcacaccacacctagccttttaagaaaaccttcaaacggtgtaggggaagaaggaaaggctgtgcttgttcaagaaatcttaggttctcagaaactctaagataaacgatgtgtgccatacccctgtgactggtctagtcattagctcacagttagcttttaataaagatttgctgaacaaacagaagaaggaataagaaaaaaaggtggctcaagtgagatagaagactttgaaaaat

SEQ ID NO: 7272 - DNA, 1063 bp, Homo sapiens
gaggctgaagcaggagaatcacttgaggtcaggagttcaagaccagcctgggcaacatagcaagaccctgtctctaataaaaaataacaaaaaataaaaataaaaataaaaaagaagcaatagacatatctttctataaggatctgtgtggcgatcctagatgttgctggccatgcttggactgataatgcacatgaacagtagcaaacacttcctctgtgtaggtgaaatattgaaatttgcagctggattacgggtcactgacatgcaatggaacaaatgatgacaagaataatgtctacaaaggtagtttataaaaatcactttgttatgactctgtttttcaaagtcctaggagtgaaccatgtgtttgagacatcagaccatatacacatttacttgcatatcatgttttttttttttttccccctggaaataagtttgatggcttcatttcctgaaactaaatttaatcagggattaatggtcaattcctgatgaataaaaggtcttaacaggctcttgtggaagaatcttcttttctcaagtgatttttcttcaatgttctgccttttctcccacatttccagaactttaaaaataactctgtaggatcagtgcttctcccccaacccaccctccccaaccccactatctctccgtttctctttctctctatttgaagtcttttctgttgccagtgacgtagttctctgattctcttaacattaaggggaattctatttaaaaatttctagatgcttaaggcacgtgataattaagggttattcctatcaggaatagaaacaccatattagaacagttcttcctcagaggctactaaagaaagaaaattctgtttagagggtttgcctctgtggtctttttttaaaacagcagttatgtaatgtcaggtttaattggctgggagtcaggaagctggcttatttgtgcgcctcttgtgtcatatatacctgcagggctgagtggcccgtaaaaagcactcaagatttgcacacgggggctgctgcccaggaagtgtcctgcagaatggcagtttggc

SEQ ID NO: 7273 - DNA, 1032 bp, Homo sapiens
tgatcaaaaataaaaggacagaaaaaggttctactgaagtagagtcattgactgcattgggatacttgaaaattatttagtgcttattgcttagttcgagttcaatctgatttaaaaagtttatgagattctggatgagttgggaagagctattttgcactttgacttgatagtgatgagtgcccagaaacgttgagatgtgggccccaaaaggaaatgattctacttatgaaaaagaaacatcccgttgttttgtttcataggtcttaaccttatttttaatactctcaacatacctgtatagaatgtttatagatttttctctctaaaatttctcatatgattccagtacattatttttagttttaagttgaattctgagggtagcaccctaggatttttgcctcattttgaacctggaagtctacttgattgagcagataaatagggggaaataggaattcatccttagtgaatgaatgtgtagacagctgatatttaaaatttagctttaggttcatgtcatatgctaactctagaaaatggagcctggcaaagttttggattctgtctgctaagagggttctgggctcaaaggtccctgctgtcagtctgtagtctgaaaaggatacgtgttgccatgtaaactggctgggcagtatggattgccctctggggatcctgactcattggctctaattcacgtggtgcatgtcaatcagctgctccctgtggttgtggccagagggccgccataatttctccgggtcaatggtagaaaattgattttcttatgtatactgctaccagaaaatgaaacatttgctttccatgtaatgcaatattttatctgtacctggtttggttcaggagtcaatgtatatacatgcttaaatgaaaacaactcttcgtcttcccctgtcactttttattgtgaaaattttcatacatgaaaaaaaagtaaaagaataatacaaggaacatctctatcccctccaccgacattcagctattattaacattttgccatgt

SEQ ID NO: 7274 - DNA, 1062 bp, Homo sapiens
atgtgagattatcttaattagttaaatatatctagggaaaaaaaacagtctaggtgaaggaggacataaggtaatacactctaagtttgagctgcttgatagaaatgtgttcccacctgatagaatttccagagaacatgcaggaccgttttcaggaaatgatgaaattgggaccgttttttcatacctaagttaaaaatcactattttatactattactttctgtcgaagtctttcatgctatgtttgaactgtcactgtcagctgagcgctccttttaaatcttctgtcatttgctcagggcgtggaaatagtgtgatgaacacagcttgcctaaacttgaaaatcatgaagataaccagaacacagttaagggacgtgatttgataaaatatcttaaagacgtcatattccctaaggagtaaagtgagggtacagtttcctggaggaaagtttgggtggcagagatccccactctgcagtgcaagcttctttctatacagaggacgtggaaccaggtaagtccccagccctttccctgacaggaggtgacagaggctgcctcaggtctcaggccgagcagacgtagggaacttacacctcatacccaactccctcatcccaaaaagagcagcggaaaagtgaaaaaacagcacattgcaagccctcttccaaaatttttgagacaagtttcagatttcgcatattttttttctgattttggaatatttacatatacataataagttggctcagggatgggacccaaatctaaacaccacgttctttgttgtttgtttgtttgtttttggagacagagtctcgctctgtcatccaggctggagtgcagtggtacgatctcggtagactgcaacctccgcctcccaggttcaagcgattctcctgcctcggtctcctgagtagctggaattacaggcacgtgccaccacacccagctaatttttgtatttttagtagagatggggttttgtcatgttacccaggctggtctcgaactcctgatctcaagtgatcctcccgccttggcctcccaaagtgctg

SEQ ID NO: 7275 - DNA, 1054 bp, Homo sapiens
agtgtgtgtttaaaaaaaaaaagagagagccctttaatagtaactttatgtgaggcatttatgagcagcactgcattttatagcaaggatgcatttcataagctttgagaatggtttctcattttaattcaaagctgaatggtcttttttaaaaaatgtctgcaaaacctggttttgcaatatttatgctttcttagttagtatacgtaggaaatgaaataggcttctagagctttgcattccagtgttaaatatgcagctcaaatctttattgaaactattagatacaatttagtattgttttttacagaaagcatattgccaataatttgcttcacagcaattatctctcaattatctttttttattcttccaattatctttttattttctcccaattatctttttttattttctttaatgttttgcaggcacctgaatggacagaagaggacctcagccaactgacaagaagtatggttaagttcccaggagggactccaggtcgatgggaaaagattgcccacgaattgggtcgatctgtgacagatgtgagttcactgagatttgcattgtatagagagagaaaccagaacaagtcagctatgtagaaggcagacatagatgggttccacagtatctttggggaggggatacaacaatccttttaggacctgaaagtgaaccattaatgcaataagtgagaagcagatgtgagccagtcccctggtccacagttaacagctgtgtgaggaattctagtgtttagagacttaagctactgtaacctaatcaaaggaaaacaatgccagtttttatgtttatagtgacccctttaactgtggaaaaaatagttctcaaactgatcagaattaggagggttgtatttcagctggatctttttaacattgaagtacagattgcgattgctatttagacaggtggttctgattaattaaatgagcaatatacccataatgcaaatggtgttggcctttttgtttcaaggatgatagcaacagttcgtttgataagtagtttaaccagaagaaac

SEQ ID NO: 7276 - DNA, 1072 bp, Homo sapiens
tctatgaatatagtatgtttcttcattaattatttatatcttcattgatttatttcttcagtcttttgtagttgttagcaaattaaatcctgtgtgtgttttgttaggtttatacctgcttctctttattttgagtggttataaatggtgttggattttaatttcagtttccgcatgttcactgtgtgtaagaaattcaattgatttttgaatgcagatatttgttttgctaacttgctgaatttacttattagtgctaagattttttaatgtagattccttggattttctgtgtagacagttatgtcatctgaccgtggggacagatttacttcttcctttacaatctatgcattttatttccttttcctgccttatagtactagctagaattttggtactatgtacaacaaagtgtggtgggagtgggcatccttgccttattccaaaccttaaggggaaagcatttagtattacaccgttaagtatgatgtaagctgtaggtgttttgtagatgctttacatcagtggtccccaacctttttgtcaccagggaacgatttcgtggaagacagtttttccatgcacctggtggcagtgggggatggttttgtaatgaaactgtagttagattcttataaagattgtgcaacttagatccttgagaatctaatgccactgctgatctgacaggaagcagggcgcaggcagtaatgcttgtcctcctgccgctcacctcctgctaggcggtctggttcctaagtccatggcccagggtgttgaggacccctgctgtacatgaagttaataaagtttccctctattcctagttttctgagcattttttaaaatcatgacggggtgttgaattttgtgaagtgttttttttcctctatcaataattgtgattatgtgatatttcatttttggtgtattaatacgatatattacattattggactttgaatattgaaccagctatgcatacttggagtaaacaccacgaggacatggtatataattcttattgctgaattctatttgctactattttgttaaagaattttacatc

SEQ ID NO: 7277 - DNA, 1051 bp, Homo sapiens
ttataggcttttacctcattaaaaagctttgataaaatcatgtgtataaatacttcagccttgagccaccgtagtttaggggtagacataaaagcactgactagaaaatttattctgaatttgattcaattaatatgtaattcacggtaacaaacagctcttatcttgatctttctcctattgagatcctcctttttgttgctgacttcaatggtagagtctttactatagactagtagacaggtagactacacgtagctcctttagtttagatgtcactccaggagtcacatctttgggtgctgtaaaaacatgagatctggtatccacagtatattactggacacttttttgaagggtgtcagtgactagagctatctacagtgctttgaatttactcgatattataatgctgggaacgtacataaacattatctattttggataatttgttttctttttcctttttgtaatataggcacaaatagttttttttgtttttattttaaactccccgtgaaaaactgttatatttgtactgtaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggtaagtgttagtaataaatcaaatgaactagcctccttaattttatatggaattttggacatttatttttcaactgatgaaaatttctgtttctctctgtatacttctcattctaatagttttatactcaatgtttgacatatttctaagtcaagaagaacccatgaaataagaaaatattcttcttttaaaaaatgtggcacttaagtttgttataaaactttgtgaaagcccaaatatctagctgggaattagaaggtagagccatgttttcattatcaccttccaaatagaaatattttttatttaagactgattttagatttttttgtgtcacaggc

SEQ ID NO: 7278 - DNA, 1029 bp, Homo sapiens
tttcctctcgtctgtagtatgtgttatacttcttaatttttcttttgttggcttagtaaaatttctattaatttggaaatttttatatgcttttctgttacatagtggttaccttctcatccttaaagatgataataaaacctatacttttctattaataaatctaaatcaaataacagcttttactttaccacttacttacccttcttggtctgcttcctcttctttttttcttttttgaaaattctaggccactattaggttgtctcttatggcatatttcttctgttttaagaatacctacagacacatatattacaaatcacaaatcataatacttttgtatttattgttcactatttatacttttttattatgaaaaacttaaaacaaacagtagtagagagaatagtttaatgaattcctatattaatcatcactcatttaataattatcattttcctatattatcctttttttgaaggattttaaaatgaatatcagacattatgacattttattcctgagtgcttcactgtgcatctctttagataaagagatattaaatacccaggatactattatcccatccaatataatgaataattccttaacagcgtctagtagcagtctttattcagatgtccctagttgtcacaaatctgcctttttactctggtttaatttgaatcaggggccatacaagttccatacatgacatttggttgttctatctgttttttttttttttttttttttttgagacagtgtcttgctctgtcgcccaggctggagtgtagtggcgcgatctcggctcactgcaagctctgcctaccgggttcccgccattctcctgcctcagcctcccgagtagctgggactacaggcacctgccaccacgcctggctaattttttttttttttttttttttttgtatttttagtagagacggagtttcaccgtgttagccaggatggtctcgatctcctgaccttgtgatccgcccgccttggcctcccaaagtgctg

SEQ ID NO: 7279 - DNA, 1034 bp, Homo sapiens
tattcccactgtaaaaccatatatggcttcatattctgcaaagtcacaccctaaaaataacagtacctatgggaaaaatagggttgaggtacagcgttcaaaatctgtggaaccttataagcactcatgaaaataataatactttaaaaaatcaattaaatctcctctagcattttaacctggcatcatagttcttaaaatcctttaaacccttgttctcatgcttccttatttgggatatagattctttagatcagttgaataaaaatacatatgattcagataagagcccttttgaaaatgaaggaaatgtctttgcagcttcttgagctgcactcagagattgatcagatagctttacatagtagaaaccatagaagttcttgaagccacaaaaccagctactacttatattaatagaaggcacgtctaatagatttctagctggttttttttaaaagatcttcatattttactaaggttttgtctttaattgcaagaaaacttatcttggatcattaaaaaaaaatgaatgtgccaggggaaaaaaaaatcaagtcgaacttacatacctaactctgcattataagaatatcattccgctgtttactaattgtatataagatcattcaaattaaaaaagtcatagaggtaattaatctgtaataatctgagtaaccgattacacctcagtgacagtgtgtttagccagagtcggtatttcctatatatgtattttttatagccttagatgtttctgataacattgtataaacatatcacttactgaatttacagactctgaataaatggtggcttcatgatacagtttttaaaagtatttttaccttaggattcttgggtcttgtatcagctcttgtgggaagtttgtgtatgtttccagtcttttccctctttttcctgtgactcattctacttcttcatctactttagtagtcactagcactgccaggttttgtggaatctttgacagaaatgtaggattcctgccttttacatacaggaaataattt

SEQ ID NO: 7280 - DNA, 1078 bp, Homo sapiens
ttcttttttttgcctgtacctctgtcatatcaaaaaatcatcaccaaatctaatatcatgaagttttttcccatatattttcttctaagagttgtatagttttaactcctatgttagtccttgatctatttttaagtcaatttatatatatgatgtgaggcgtcaaagaaaagtagagcctgacagtagttaaagcagtaaaagcaaattttaatcaggaacagttgcagtaggagaaaagagacttcgttacagaatgaagcttaattctgaatacaacatggaaagtggagatttatagccaaggaacagggtcagtggatggaagattagaggaaacatcagagttaagggggtctctggtgaaaccaatttgacaaggtttttgccaaaggcaggccaaggtaatcaggtatcgcctgggggttggtggggaatgaggaatttggtcagatatattgagggtgatcggatatcaatggtagggtttctggcttaactctcttagcagaattcttgctaaaattggacgatgcaaaggaggagatagaagttcaaaggttgaggcctagctgtgaagatggtttagaggagcctgactagagtttagtcaaggagacagtctttgttaaaggtaagggttcaattttattcttttgcatgcagatatccagttttcctggcaccgtctgctgaaaaggctgtttttgaatacacatattatctcatgtaatctttaaaacagccctacttagtaaggcattttttccccattttacaaatgaggaaattgaatttcagagacttgcccagtctcagaaaactaacaacttgtggagcttatctgttaggctcaaagatcataactgttattttgtaattgtttcttactatttaaatgttacctattcttaaaggcccagcccaaatttaatcccattattaaagattttctccattgcttgctcttccaatcagatatgactgctctcaattccatggcaaatttttaatagattcttaatttatagtacaccgcaaatggtatgtgctgaatacatgccaagtgagtaaatga

SEQ ID NO: 7281 - DNA, 1050 bp, Homo sapiens
attgtactgtatttagtacaaaacaaatagggatttcatctatgcatttagtaatacctgaatataaaaataaagcagccaaataaaattcagatgaccttgggaatactacacaagtaaatcacgagagatgagcgaacgaagcactgggcaaattgttcgaaacaaagggaaagtttctcagctcacaagatgaaagctttgattttctcataaaagaaaactaataagaaatagttattttcctgaaatacaacgttccaaatgggagttggcgggggggagcaacagtattttaatacattttgcaatctgcaatgctgcttgattttgttgtataattttgcgatatgcttaaaaggtggaaaatagaattaagagggttggaaacgtgaagtaaaatattttggttctgatagtaccaatcagaaagcagaaacagccacacactgcctttattattcttcataaaggctgaggcagaaggggaaaatgacaccgaagtctctgtggcgcaatcggttagcgcgttcggctgttaaccgaaaggttggtggttcgagcccacccagggacgcgctctccttttatgagctggtcgcgggaagttttgcagaaatcgagttcaggcctccgggataagaaggggtggatttccagggaccaagcaaagaaaccaccgacccttacactacgcggccagccggcgagcccttcgctttcggccggtgcagagcggcctcctctcccccgctgtcctctcccggctgcaggtgagcgcggccactccttccccggggtcttcacggcggtctaggcctcgccagggtgctggagcggggacgcgcagaggccgcgcgggcccgtttgccgcgcgcgcccgccgctccagctctgcgcgtccccggaggcccgcgcgtacacggggaaggcggcccgggctggtcttgctcggcttcgtgacgcgtgaaatgtaacggggccaccgaaatgcatgtatttcaacagtgtcaagttcaagctgcaaactgaaaactcctacattttgtt

SEQ ID NO: 7282 - DNA, 1044 bp, Homo sapiens
cctcacaaccctatgtttgcaaatccccctttaaagatgggaaaccaagtcacagagaggtaacttaacttgccagagtcacatagctaataattggagttgcggagctacaacccaggcagcctggatctagtgtgttcacataaccatgggcttcagtttgtctcctacgtggaaagctgagccatgcctagtcgacctggggtcgggcatcactccgtatgacagtgaagggctcattttatccgaacgggaagcaggacagccaggctgcggggggaacggcgtccctctgctgatgcctgtggctgtgtttgtgcatttacacgtcacattagcggagatgaatgccacttggaatccaacccaccgcagcagattacctcatgcaagagagaaaacagccctgcctgtgctagcctggctctgcgttgggctgtatttactcacggggcctcagctggccagggccttggagcagctctggggcccccgacccgggcaggaatcccagctcaggactagacgcacagaggaggacggggtggggaagagcagttccctcccataccctcgtcccctcccagcaagtacagagggtcgtacagcaatcgtcccgccttacttagaggctctgatctgcacaaaactggccagagctgaattcagcgcaaataaagactcggcccgccgccacttcagaaaggttgctgaccgctggctggaagccggcctcggagagtccacagctgagaagcatttctgagctgtctttagttagccctgggggtttcttccaccctctggctgtttctgcactgaactagaaaagatatcaaagacactcattaaagaaccagacccagtgactacaagcttggaaaactctaagcgcaaataatccagtgtttaaaagcaaagtgtagaatctgttgctacattaagctgtcgctgcccacagttaattttctgctgctctgcagacgtcatctttgtaggcagttttacaccaagagtttattaagttcattaaatcatagtata

SEQ ID NO: 7283 - DNA, 1048 bp, Homo sapiens
aattaaaatcttccacaagccacgggaagtttctctgcttggactctacccctaaagcctccccgtcggcctccgaggtagactcaggtcatgctagacaacccagagctctaaggcagagttttgaacaccactgcagtaagagcacaaactgctgagatcaagggccatgttttcctccactttgtacctctgcactcagcatagggcctggcacaaaagaggtacaaataactgtgtgtctttgaaggaatctccaaagtaaatggggtcagagagtggctgtgggggactgatgtatagcaagcaaggaaagagtgttcatcagtaactcttaagacgggagaaaacaatgagcattgcagaaaaaagtcagcaggtgaggatgtgcccacagaaggacgtaatgtggggaaagaggcacttaacgctcctgtggtcccactgcagccagctagtgggactctttaagataacaggactgactatttctggcagttgatacaaggagtaaagtgtggggctgatccagtgttgagtaagttactgctcaagtaagtgatggtcaggttttctaacttccagcaggtggacaagaaccacagaaacacaggtgagcaagacagagtcagggctagagaagcggccagtggccaggaatacctgcagagaggggacacaggccggacagagagccatggtcagggagggatgagaagcccattccgcatgggctgcgaagcagagtgggtgctgagctggctctctgctccgcctggagccattttcatattttctgcgtgtgaaacccaatgcctcccatgcgcatgtttttattattgccttgtgtttcagggctctacagtggctagagaagctagtgacaaagaaaaggtaagtaccttgctgtatgtctccccatgtcctgggggcatgatcacatactcccaatcacctttactctttatttctagtctcccacccctgctattgtggttcttcctgttccccattctgctgccaccagcgagaaacactgtattgaccc

SEQ ID NO: 7284 - DNA, 1048 bp, Homo sapiens
aagaagccagtcaggagagagaccagagatggagaaagacatggagtcaaagaagggtttgtgtttctttttactttttattgtaaaaatgttcaagcagacagaaaattggtagcatatacccatcacttagattgaacaattattaacattttaccacatttgcatcattttatttttgcagaaatgtttcaaaagtaaatcacagacacatttcctctgtaaatactttgatatgcttctctgaaacataaggacttctcaggttaagaaaattgccaataaattccttcctatcaccaaatatctagtgagtggcataatcaggtgtccccagttgccctcaaagtgtacgttcaagccaggatccaggcggtgccagaccgtgcatctctgcaattgagagggcgttttgtgttttgtttttgttgctttaatgagagaaacttcagcacatttaagcactgttgagaagctgctagtggagggagagaggttgaggatcctggactgagagggaggatgctcaagaacccgacaagatgcgtcgcagtgtgactggagagaccactctcagaaggggatccaccgtgcaagcactgagtgtctttgcctatttgtgttgctgtgaggaatacctgaggctgggtgattcataaggaaaagaggtttatttggcttgcaattctgcagactgtacaagaagcatggtgtcagcatctgtcgctggtgagaccctcaggaagcttctactcatgttggaaggcagtagggagctggcatggcttggcgagaggcaaggaaggagaggggaaggctcttttccataagcagttctccctatggcaccaagccatttatgagggacccacccccatgacccagtcacctcccaccgagcaccacctccaacattggggatcacattgcaacatgaggtttagaggggacaaatattcaaactgtatcactgggagatggggctaccggaagtcaagccattcccctcccatggcacccttttccacctgaagtaggataacttgca

SEQ ID NO: 7285 - DNA, 1049 bp, Homo sapiens
tgtgcgtgcgcgcgtgtgtgctcgcgcatgtgtgtaaccagtgcttctagattcagaactttttccaattcattagggcatttttaaattgcatgataggtttgtaatatgctcagggttgaatcagtgtgtcatcaaggttctgatcattgtttggccagcatgatatccatcgtcatactttaaaggtgtgtttcaggatgaatgctgcctgggaggcctgttctgtgactatagccgcagtcctgtgtctaccattaccactgcccccttaagccctgatcaccctgaggtctgggatttcatgcataattatccagtcaaagtatttgtttgtacctaccacatgtcaggctctgtgctagccgttttagggaatgcagagagaagaaagggtgaagcatcactttctttaaaaactattgcataccagattctgtattagatgctaacgagatttacagaaacccagcatcttgatttgtaatgttcttcatgaaaatctgcacccctctttccagtctcttatactcatttgatcgtctcttatgtttatacccagagagactggaaagaggggtgcagattttcatgaagaacattaaacagccctgggaagtcaaacggaggcttcagttacatttagtagctgccagagagggttgcctcccagaaaccaaaaagttatgcaggagggagctgatgctgttaaacctaaatagaccacacatttgaaagtgaggcctcttgttcactgtggaggataataccaggtttgcttttcccctactgtgactcctgaattagaatccctcattattgacatctgatgccctttcttctttgtgtttgtaacagagaattctaattttaaaataattaattttaagagctaacattttaaacttttgatattcttatttcaagtttagaaataaaattctaaagtgttaagaccttcagtgtatactaaacttgaagtggggcagcaggaattctgcctttatctctagaatatcaagtctatcctctgaaactttcacttgtag

SEQ ID NO: 7286 - DNA, 1025 bp, Homo sapiens
ttggcaactgtatttctattaaaaaaagaaaaaaaagaaagaaaaagtgtgtattcagagtcacttcagtactgcagaggtatactcttcttccctcctcagtcgtatatttctttcccagtgtctgtacctcttaaaattcttcagtagggtcagggaccctgagttccagctgaaaacaggatcgtaaatctggggctgtatcccagtcttttggctacttggtttggaagaaaggagggtcgttgtgacagctctggctccagggtcacctcgcaggcccctgtatactgcagggattcaggcggcaggcgggcaggggccaggacctggggcttcagctgcctggcacattgttactgcccagacagttcaatcctcatgcccagttcaagtaacaggtatcatttggcacatgtggcgccaaatgactaaaagcaaccttgttttcctctcctggagcttgccaatgtgcctttgctgagtagagtctcccaccggccgcctctgtcactcctgggtactggctgctgaagactgcgtatatcggaaaaaaaccaactctctttctgagcttatcaatgtgagctgctttttgaatactctttcccaactgacttggaaagtaggatcagtgacctaggctctcatagtgttttggaggacactggatagctgaaggggaacaggcattgcctgctgtgtttatttttccaaactgcttgcattttggacaagcggctctaaatcaatgtggtggttaggggctccatcgtctggtttatctcgtattcagacctttccattcagccaagtgggtaaatggtcccgacttgtcttgtttgtgtgaccacctttttgctacacctgaaaaaagtaggtattggtctgtggagaccactctgattaaagcagagcatggttaagtagtaacctatgcagttgacccctactggtgaatttaaacttcttaaaaagtttttaagataaatgaaaaggataatgaaatgaaaaatgaaaacatt

SEQ ID NO: 7287 - DNA, 1047 bp, Homo sapiens
agttcgtgtatgtgtgtatgtgtgtgtatatatatatgtgtgtgtgtgtgtgtgtgtgtatatatatatgtatatatatatatgtatatatatatgtatatatatgtatatatatatatgtatatatatatatgtgtatatatatgtatatatatatgtatatatatatatgtatatatatatgtatatatatatatgtatatatatatacgtatatatatatatgtatatatacatatgtatatatatatatatgtatatatatggagagagagagagagccttaagtgggcatacccctgaccctagtaattcttcctctaggaatttattatgatttagctaattaggaatgtctttttagaagaatgtatatacagtgatatttatcatgcaactctgttgataatggccaaaatggggggaaaattgtgaatgcacaacagtgagattaaatgatggtgtagttacacaattgagtcctatgtcattacaaatcatgtgactgtgtatttatgtggaatattaatgtagaattaatttgcaaaatagtatgtttagtgtgctttccgcttttataaaaatatttatggaacactgtatagaaaaatgtctagaagaatatatatcaaaaacatttatagtgactatccctagatgatagtcagtgatttttattttttctcttcgtattcttttagctttctgatataagccccaaacttttaatgaaatatgctacctacatacatttgtcagtttacaaatataatatataatttgttctttctgcaatgaacatgtgttacttttataattagaaaaaagttgaattggctttgttcatttgagatattaagaaaaagccaaacaaccaaccatatggaaattatacacaaaagatttctccaaagttagaggaagaggagaatcaaggtagtgaacatttattaggctctaattgtatgccagttcttggcatacattatttcaactaagcctcgatttactaccttagcaaatatatatcagatacctcttcctatg

SEQ ID NO: 7288 - DNA, 1018 bp, Homo sapiens
ggtctggtcttctttttttttttttttttttttttgctcccaagtgtcttgtctcttgtctcttctctgatcaccacagcatggttcttaggagtcacagtgtctggtatatacggaaagagtgtttttggagggagaattcaccaaaagaacatgatacaagccaaaaggggttattattagagaagaacagtgttgatatgaaggctagttaatgctttgtgaatacccaccatgcacaagacagtgtctgctggttgctggaagtccaagatgatcagtttgtgtccctgtggctaaatgtttggttgttagtctgcatgaaatagatatgacaccaaattagaaataggagaaagcagcagaagaaaagcaaaggttctgtgtataaccaagacaatggggttaaaaaaacacacacacattgctgaagaaagtaagttaagtaagttgagctttcatttgcaaaatgactttttatttggctgtaatattcctctgggatggctctgtgaattcagtaaaacaaagctaaagaaaaacctattctgtttgagggaccgtataattaaccatagaaatgagtgccatccagtgtattactgaagaaaaaggattaaatagtggtatgaataaaaatagtatccctttttattctctctaggctaaaattataaggactgtcagtcattttgttaagggtctagtttattattggctgtgttgggaatagtgctttctatcttcctattatgtaatagtccacaattacatgaatagtgggatttttattttttttattttttattttttttcctcagaagagcctggtgttgaggggctgcaggagcagaacaggaagttatggttgttttggaattgtgtgtggtgtatgtttaaattgtattagaataatttttattctttttaaactgtctttctggttgtctcatgctactttgagtttaatataccctgggcttgatgcaagaccccgggccagggccagagcacctgg

SEQ ID NO: 7289 - DNA, 1018 bp, Homo sapiens
atggtggcacacacctgtagcctgaactactcaggaggctgaggtgggaggatcatctgagtccaggaggtccaggctgcagggagccatggttgtacagtgtactgtagcttgggtgacagatggaggctcccactaaatgtgaaacaataaaaattaaaatgcagtgtctaattcagcagatctgttgggagtgctgcctgagactgtgcatttatcatactctcgggtggtactgatgctgcaggtccacaggctacatagcagtagaaggaagaactttaccactaaggattcctcccccagccccaactgtatgtgatgagcccttagaagaatggtggccccatgatagattagagaatttgggagaagaaattgtaggttggaaagggacacaagcaatttagatttaagaatgtggaattgcaggtgatggtggtgggtggatcctgcagttacagtaccatgtaggatgctggaaaggtgtgattggagctcgggagccactagggctgggatagaccattgagacctgcccgtacagaatcggtaagtcagatctccaccggaggagcagggacactggggacacttggctttgagggaaggacagaggaagaagaaacaggaggagaaaacagaggtcggcacaattagatgttcccaagtgcttgaaagtcatggctgtgcttgtggttgattgcgggtggctgtgaaagcttaaagacttaaggagtgaatgagtggaagtagaggcaattcctcttttttggaaggtaagtagaaggaaggtgaaagatgccattttgttaggaatccctggggagtttccttgaatccgtctcttcgtttccattctcacttctgtcactcctaaccagatttgtttccctctttcctagactgatattaaacccccctagcttatttccctgtgtctgcctttatcctcatttcttttcttttttgtactaggaactcctatggcagtccagtgaaggccatagactcctca

SEQ ID NO: 7290 - DNA, 1036 bp, Homo sapiens
ctaatatttttatccaactgtctttattttgagggctctgagttgacataagaaaggtctgtttcacagccttttttttcaaaatgtctattttctttactatattatttttgaaaaaagaatggaggtgtaatataaacatgaaatctaaaacccttagatgccatgtatttctggtttgatttcattttaggtgacaatgtctgatattagataaatgttttatatgaccttctgtgcaccaaagtttatagtataatgtgagaataaatatgtcagcagtcttaagaacaaacaagcatggtgttgtatacgagcatcttccacatactgtggtaaaacgctcattgaatctgcgctttaagtttttcttaaattctaactgttgaccttgggcatgttaaggtcaggttttggcatcagtgtttgcatctgtgaactgaggttgtttggatgatttccaagtctaactcaagattctgttttttcagtctactaggtgcacagtgttatactaggatttgtagaatactatataaaagttgtcttactattataaccttccaaatgcagcaacattcagggaattttcaagaccttgactacaggggaaggaaatctatggtgattttaagagactgtgaactaagggtttgttatattgaatgtagctgaactgcattgcagtctattaagccaaagtcgatttgattgaaacataacaacttgcaattaaggtgaaaatgttcaagtccattgaggtggtaatgaaaatcttgatttgggcaatggtcatagtcgggagtaagcctgccattgtgtggttaatttgatatgttactgctttgtaacttaaaatacccatcagtgaatggatcagtgccaatttttaagtattttaagcagagaatataactgaatacataaaggaaaagacttaaggcagttttgtcttgttacatttagaattaaactaaaaatgatcaaacagtaagcgtcttaagatgatattttaatagtgtggggaggatgttga

SEQ ID NO: 7291 - DNA, 1713 bp, Homo sapiens
tacaattggaaaaccatagaatattaaattgaacaaggacaaaatgtcttggtcaaaggaagcaggaggctttatttagttctccctcatatattaaaaacataaaagttatttaggttcagtgaaatatgtattatcttgttcatacatgtttgcagccaaattaatattattgtttccagtcaaatggcttctgacatcataaggtacaatgagtagaaaaatgttttttcagtcaagccaagtatttaagtgccatgtaagacactttactagatgttgttggagggtgggggaggaatggacaggctgtgtaaatataggatggttcctgcagggaacttacattttagaaatttacatttcaaaactattagaactctttcctatgttgtggtttaaaattgatccttaaagggaaactagattacaattcacctaggcaatttaagataaatttgttttattgttcttgtcgtcagataaatatgctgattttattgaagccaatcgtaaagaagatcctctagatcgtctgaaaacattaaaaagactagtaggtattattttatattttgggggatacaactaaaattcagcctctgaatccattgtgaaaataatctgtttcagattcacgatttgcctgaacatcattatgaaacacttaagttcctttcagctcatctgaagacagtggcagaaaattcagaaaaaaataaggtatgtaaaatgcttattgaagaaatgtacttttagtggctttagtttaaaagatatgcttcattacttcatgccaaatagtcaataaaaggtttgtaattcaacatcaaactgggtaagtccttcttaaaattgtttttaaaagcaaaagatcccaaaataccagttgtcaccattttaaaaggatattttaaaagatttcttttatggttattcagtaagaaaaatgaaaaagtcagaaattttacttctctcattttttagctgtatatcaatattttgaagaggtaacatatgcatacgctacaacagtcaaaaggccaaatagaatacagggaaaacagacataaacagataagtcattttcattccttttaacaccaccacattttctttgtcaaacacaacaaaatatattctttatattgtctaatattcagttcacattcagtttttcttttttttaaattatattagagacagggtctcaccatgttgcccaggctagtctcaaacttctgggctcaagcaattcacctgcctcccaaagtgctgggattataggcatgagccaccatgcgcagccccattcagtttttcttgattgtaaaagtgtctttgtagggttatttgcttaagtcaatatccaaacaaggtctacacatggtatttggttgacaggttgtagtcttaacttagttttttgatgattattgcctaaatccattatatcatcagagattttaaaatgatgattttctaactcaagggcattacttcttaaagtactgaagcagtcgttttaatttctggagaagaaaataaaagaataccacaagctcaggaatattgctgacagtcttttctgagtgatttttccttaaggtagagaaagatcagtttaagaaagatagatcagtttagtgactgtgcatgttctggaagttgtaaggattgattatgagaagagtgtcaacctctattacctgc

SEQ ID NO: 7292 - DNA, 1027 bp, Homo sapiens
tatacttctattactaaacagtaatatttcttcccaaatttgaataaaggagtcatctttaaaatattagttctagaatagcattacccaagtagatattctaattatgttaaaacctctgggaaaaaaatggcctccatggtgaataagtttatattttcctttcgaatttcacaatgtacattagtgtcgtcgtggttttgagaaatcaaaaagcttgccaagtggccctacatcattgaccatagggacctcctctcccccatcctccttttcaggtggtatataataaaactacacaaggatgttgtgggaaatgctgtaccagacagtacagtattctctcatccagacacaattttcctattgcagaaaagtattggtatgattctaatcagcatggaaaagatagacttggtgtgtcaatgcacacacccaaaatgcatgttgggattaactgtattcatgccataaaaatactatgtagacatattttattttatatggctagctttaatttgtcactgcattctagtctctgttctataatatttattataggttaacaagaattactctggaagtaatatttttatgtctatccagtagttatttttgcaaactaatacaatagtacaaaaggcacagtgttgaaagatcttaatttttgagtgaaacttacttaaaagaagtcattttcccccctgaatcttagtgtaaaggcagctgcagtctgctgacagcttgtggttatgctctgatttactggggaaggaggaggttgtactattttaaatgcataatagagcattcgtttcgtcatctggaagcagagatggaagaagctggggggaaatgagagacatcactgttgctttcgtggagggaagctttgtagcatgttatcagacagcagtgcatattgaagaaaatatctgttaggaatgcatgtcaccagatgtattttgctttcaagaatggtagacacatcaaacaagaatcagataaaagcctgagaaaaagatgt

SEQ ID NO: 7293 - DNA, 1047 bp, Homo sapiens
aactaccgtgtacctccttcttcccccacaatacttatgctgtttgtcacttagcttaaatgtcctctcatctgcgaatttttccttgacttctatttcactgaaacaactagttgttctcaaaatttaatgtgtattaggatcatctgggaaacttgttgacagagcagatttctggtcagactccaaaacatccatttttagcaaacaccttagatgttaatgccaatgatccatggaaaacagcttgtgaaattctgacttacggggttgatcatgctctcctcattgccatgactgtattttgtatttgtctctgattgttttttatactatactgttatttgtttgtatgtctttctcctcctaccagactccctgaagggaaaggaatatgtcttgttcattgttacattttaatgcttagcacaatgcagtattaagaagcagtagaggctgggcacggtggctcacgcctgtaatcccagcactttgggaggccagggcgggtgaatcacggggtcaggagttcgagaccagcctggccaatatggtgaaaccccgtctctactaaaacatacaaaaattagcaggcggggtggtgtacacctgtagtcccagctactcaggaggctgaggcaggagaatcactcgaacccgggatgtggaggttgcagtgagccaagattgcaccactgcactccagcctgggtgacagagtgagactccatctcaaaaaaacaaaacaaaacaaaacaaaacaaaaaacaaaagccatggagtgagtaccgcctgtgtaatcatctttggcacttgttagctgtttgaccttggagactttatttaatccctctaagcttcagtttcctcttttatgaatggtagtagtagtacttacttgctgtggaaattagctctgagatacagtatttagtgtggcaactgacatacggaatgtagccagtaaatggaaagcattacagtgttgtggttgtcattatgttatggaagaagcaaaataaatgtttgaattaaatgaaaacccct

SEQ ID NO: 7294 - DNA, 1048 bp, Homo sapiens
ccaaggcaggagaacagcttgaggccaggaggttgagaacagcctgggtaacatagcaagatctctatctacaaaacaaaaaaaagaaagttctttactctcacataattcattcttgaaaatacgtaagaaagaggattctgggccgggcgcagtggcttacgcctgtaattccagcactttgggaggccgaggtgggcagatcacctgaggttgggagttcgagaccagcctgaccaacatggagaaaccctatctctactaaaaatccaaaattagccgggtgtggtggcacatgcctgtaatcccagctactcgcaaggctgaggcaggagaatcgcttgaacccgggaggcggagattgcagtgagccgagatccgccatcacactccatcttgggcaacaagagtgaaattccatctcaaaaaaaagaaagaggattctgttcctttgaaaggtagataacaataaaagatccatttgtatatcttctttggacaatagtgctgctgtgaacatgcatgcacaggtgtttgtctgaattcttgttttcaatttttggaggttatacctaggaatagagttgctaggtcacatggtaatcctatgtttcatattttgaggaactgccaaaccgttttccacagtggctataccatttctatgtctccaccagcaatgaatgagggttctaatttctgtacatcctctccaacatgtgttgttttccatttttgtattatagccaacccagtgggtgtgaagtggtatctcactgtggttttcacttgtatttccttaatgcctaatgactttgggcatctttttgtgtgcttgtcgccatttgtgtatgttgtgtggagaaatttctgttcaaatccattgcctgtttttaaattgggttgttttttgttgttgaggtataagtatttttttttaatactttagggtacatgtgcacaatgtgcaggttttttacatatgtatacatgtgccatgttggtgtgctgcacccgttaactcgtcatttacattaggtatatctcc

SEQ ID NO: 7295 - DNA, 1089 bp, Homo sapiens
tgagagtcatagaattaaatgttttttactgtggacttcaaagttttatgaattccattgtctcatcttaatttgaacatgtaatggttttgttgttaattgtatgtgtttttgtggaggaatatatcattataattccaaggagagcacttaagatttttatttcaattagtaatctttctagatgaggtgattattttaggtaagaaatgctgtgtgttttatcaattgggtttattgagtcaaatattgaaaagaagagggtttgggttattcttgtagttaatgttactgttgatttaaacattaatgaacgtaaaaggacaatcaggctggagataaaattatttcttaataactgattttaaatcaacttgaatgagttaaaattcacactcaacaaaatgcacccattaaaaacttttatttctagataattttagacaacaaagttgcaaaaatagtacagagaattttcatgtatcctttattttactttccctagtgttaaaaacttacaataccatggcaggggcgggcgcagtcgctcacgcctgtaatcccagcactttgggaggctgaggcgggtggatcacaaggtcaggagatcgagactatcctggctaacacagcgaaaatcctgtctttactaaaaatacaaaatattagccgggtgtggtggcgggcgcctgtaatcccagctactcaggaggctgaggcaggagaatggcgtgaacctgggaggcagagcttgcagtgagccgagatcgctccactgcactccagcctgggggacagggcgagactccgtctcaaaaaacaaaacaaaacaaaacaaacttacaataccatggtacaatcaacaatactaagcaattagcattggtacaatactactatgtaaactacagactttatttggatgtcaccagtttttccgctagtatccttgttctcttccggaatcccacgttgtattcacttgttgtgtccctttagtctttccttgtattttattactagtactgatcagttattttttagaatgtccttcattttcagtttatctgatgttttctccctagttca

SEQ ID NO: 7296 - DNA, 1032 bp, Homo sapiens
cagacagggccccagtggggaattaatttttctcgtgaatgttacaccaaaacaactttgaatgaaatgatgctattccaggacatgcttacgcttgttaacagcatggtcattggcatcaaaagagcctgggtttgagttccatttctgcctcctgttagatctgtgaccttggataagtcgactaacacaatagtagtaccttcctcacaggctgtgtgatgattaaatgatacaatacttgtaacacacttaacatagaaattgacactgtaattgctcaataaattttagctattaatgctattatttaatacagatgttcttgtaaatagggctctgtcttgtaaattttacatggaaaatatatattggaatcttttccattttaattatgaaattttataaattcacttcaaacgaattaaaaattttaatattgtatagcttttagaaaatgtgtaattaatataacagtgtccttattttgtcacttaactggcaacctcagtctcagactagatcttataatcagaagaagaaaaaaaaaaaacattgggcagccaaaataaaggtcaaaaaattatgtaataaattatcagcccttcaccgaacgtctgtttttctttctaaggtacatggtagctccagtatggtagaggctcagcaaatatttgaaaatgtatttttagactagtttttaaaggtttcttttctaattttccagctagaggtagataacatggcagcaagacagcttggtaacaatgaaagagaccaagtagataaacttcaaaattgaatacaagaacttaaatatgtagcaatttgggaccaatccatttatatagacagctctgggtcctgtaatatcccttaaaggcacatttaagtatagtacagtaagtgatgacctgacctttccatctgtccaactgcctacttgacaacttcacttggatatctccattagaaatctcgcactcaaatgccaaaaactgaactcctgatgtcttacccctaaattggctt

SEQ ID NO: 7297 - DNA, 1073 bp, Homo sapiens
ttgctgttcataatagtttttgatgatcgtttgtatttctgtggtatcagttgtaacgtctcctttttcatatctgatttttttatttgggtcttctctcttttctttgttacaacctctatggaaaactgtgtggagatttcttaaagaagtaaaaatggaactaccatttgacctaggaatctactcaaaggaaaagaaatccacttatcaaaaagatatctgctcttgtatgtttgttgcagcactattcacagtagcaaagatatggaatcaacctaagtgtccatcagtggaggaatagacaaagacaatgtggtatatttggaatggaagactattcatggaatactattcagccataagaaagaatgaaattatatcttttgcagcaatgtggatggaactggaggacattatcttaagtgaaacaaaccaagcacagaaagttgaatattgcatgttctcgctcataagtgggtgctaaaaatttgtacacatgggtgtagagagtggaaggatagacaatggagactcagaagggtgacagagtgggagcaggtgaatgacgataaattagttaatgggtacagtgtgtgttatttgggtgataaatatacgaaaagccaacttgaccactacactatctatgcagataacaaaattgcatatgataccccataaatttgtacaaataataataatagagttgagccatgggatcagccagtattcaagaattagccaggaaatcaagaattttggttggtctagcaagtcagttaggcagagttcaattaagccagcatctatggtaattatagttttgggagttgatgaggtcattgagggagggaagagggtcaaagtccagaatctgaggaacaccaccaattaagggacggacagaggccgacaaaccagccaccaaggcgaactagttagaaacaagcttttcagtagcctcagttttcagattttgaggactttgaatttgatctttatatttagcctttggcaagcttccagcagcagcattgtttaacctagcttctctcaaatttattttgcta

SEQ ID NO: 7298 - DNA, 1048 bp, Homo sapiens
aatcaacaaagaaacaaaaatctgtccacaggagactgaatttttagggaaccaaagctgtttcaagccaaaatcaggggcatgaatgagcagagtgaagagtgatcaaaccattaacgtaatgttactcatatcattactgcagtccaaatgacaaaagtgacatagatttattttagattgttaacatttgtcccgatctgaaccttggaataaggaaactactcctataatccttataaaaagagacattgtctcctaacaccctgcattcattaatttgtagtacttccagatacccttatttttagctcattttgttatttttaaatgattcttgagtagcataaactttaacacaccaagcttttatttctaatcattgcatgttttattatagtgcatgctgtacttaagttagagctttcttaaattctgttaacttataagtttccatctagacttatttttgattcaaatcaatcatatgaatctttttagttgctgatagtccaactccaccgccaccacctccaccagatgacattcccatgtttgatgactctccacctcccccaccaccaccaccagtggattatgaagatgaggaggctgcagtagttcagtataatgatccatatgcagatggggatcctgcttgggcccccaagaattatattgagaaaggtaaggtacagtcattgagttgatgtgaaggaaaataacctaattgtagaaatttagaactataaagaacatctaatccaatgtttctcagccttttaaactgccttaccaaccaagatgatttacttaaaccttacttcctaagttttgtattattcccagtgtacagggggattctttctttgtattttaaataaaagttgcagtgttagatttgctttcaaactacatatgcgttcagctgaagattaacttgctggacggcattttatagatgaaacagctaaggcacaaaaatggagttatatgtaattagtaaagattttaaaagttctgtcaagctctattgattacctttcat

SEQ ID NO: 7299 - DNA, 1050 bp, Homo sapiens
ccagtagtcttaatgctgctttattttcttagttttgtgttctctctaaaggatcattgttggcttaaatatttccagagcattgtagagatgtgtaaaggtagaaattttggtagtagttaatgaacacatgccaggccaaaattattagaaggaaaagtttaagtttattttaaaattagtgttttgaggatagtgagacattgcttacagctttcgaattatttttgtatcttttgcccacttttctatttagaagtttcttttcttactgacttgtaagaatcctttgttttctgtttgaagagagtagaccctcatatattggcaaatatttactcatattgctgtttggcttttgactttgatgttttctggtatttaagaaataaacatacagaattttaaaaattatatctaaatatattaatatttttcttatcgctactaggcttcatgcttacgattgccatactccaagattaatattccattgcattttcttattttgtgatgtaaattttagtgttttggtatttgtatttaaatatatctgggttttatttaaatagtatttactgtgttaatgcattttatgctatgaaataaacggtacatgttagtttaataggaatttaaaaatatgcaaaatatcccaaagtaaatctggttcgatttttgggaataataataagatatgtataagagaatcccagcatagagaaactaccagaacctattcataaaggagaatgaaaagaagatgatctttgtaagtgagcacaaggtttgagaggaagctagaatagagaaggcttgaatacttagcaaagaaatttacatttattttgatgaacactagtaataattaacagcctggatcataatttacaaaggacttttcatatgtagttggccctttgtatctctaagtttgcatctgtggatttagccaaccttggataaaaaaattccagaaagaaaaagtaaaaaatacgaggacaatacaagagtaaaaaataatacaaataaatacaatataactactat

SEQ ID NO: 7300 - DNA, 1042 bp, Homo sapiens
gggaccatgtgggatgctcttttaatagggtttaaacaggtgagatgtacacatttttcattttgttttctcaagtttacttcttttgtaaagatctccatggttacaccatagagagcagactggaaaaaggccagactgggtacaagtggaccaattagaagactgttgcaatagccaaggtgagagatgatagtagattgagtaggattaaagtgttagaaacagatttctggtatttaaaggtagatgtgacaggatttagtaaaattaaacatgaagtaaatgctagatgtctgacttacataaaccaatagagaattgaagtaggagcattgaaataggattgaggagcctgtgtgtttgattttgaacacgttcactttaaggtaccattgaaatatctgagagaatgtcagttttatacacgaacctatagcttagaggagggttcttgaatagataaagaaaagtttgtgtgtatatatggtaatttaagcctgaatgtggatgagtttgccgaggggtcataaagaggaaaatgaactgggagacactgtctgtaacgtgaccttagaaaggagacagagaatgagtgttcgggagagttagaaacaaacctaggtaaatactggtccatcttttccaactcccattgaaatctcaatattttcccttctatggagttagggattcctcaacttaattctgtgctgagcagaactgagctaaaatttgtactagtgctggacctattagaaaagggaggagtttaaaagatgtgtagagaggcggggcatggtggctcatgcctgtaatcccagcactttaggaggccgaggcgggcaaatcacttgaagtcaagtcaggagtttgagaccagcctggccaacatggtgaagccccgtctctacaaaacatacaaaaataagccgggtgtgggggcacatgcctgtagtcccagctactcgggagtcatgagacatgagaatcgcttgaacctgggaggcagagggcgcagtgagccgagatcgcaccactg

SEQ ID NO: 7301 - DNA, 1033 bp, Homo sapiens
tcctctctaaatataattgcttttagaatattttaatgtttcctttagaacatttgtttaccacacaattaattttatttattcaattcccaatctacttatttttataaaagccttgcttgaccatttaaaaagaagttttcaaatttggtctcctaatttccataatcttttcttcaactcttaattagagtagagttcaacttacttttattcatactattttagcttttctctcatctcggagaaggtgttgtgttttcatgcctcttttccctggcttatgctgtcccctgtgcttggattttgacctttttccccactctccttttttctctttcacctgccagttatggctggcaaaaatgaggtttctttcatggagtcttttgatgttgcttcaggaatattaatcattcttttctgtatgctatttgtgtgtaattaaagacaaaaattacacttattcaaaagaataaatgtaatatatgttatgcatatataataaatcagacatctctgaatccatcgttaaaactaaaaactagaaaatgaccaattctgtttcttttctctgtatacttctcaccaaccacaaaagggatgtttatcattcccttgcactaaacatttttttaaatcgcatgtatgtgtatcactaaacaattattgtttaattttgcttgtgtttgggcttataacaatggattcatcctgtatgtagtctagcatggcttgctttttttattcagcattataatttctaagatttatccgtattacatatacatagttcattcattagtagtttgttcattctcattatatagtgtataatatttcaagtataaatatgccatttatttgcatttaaatgtaaaggatctggaattagttttttcctatggtttgaggtagggatccattttcagtgtttttttctatatggcaaaatagttgctctactcaaataaaacattcttcttactgtgctatcactgtaagataccaagtttccttataagcatgattt

SEQ ID NO: 7302 - DNA, 1035 bp, Homo sapiens
catgtgccattgtgcccagcttattttcatgtttggtggtatcctgttgcctttttagattttaggacaaaattgatatagattggaactttgctaaaataattttttttgtagaacagaatctagtgtagagtgattcatgctggttcttgaggacttgcacaatgtctggcaaatgactggtttgcagtgtttactgaattaaaataaatctcttggccggacatggtggcctgtaatcccagcactttgggaggctgaggtgagtggatcatttgaggtcaggagtttgagaccagcctggccaacatggtgaaaccccgtctctactaaaaatacaaaaattaggcgggcgtgctagcaggcacctgtaatcccacctactcaggaggctaaggcaggagaatcgcctcaactcgggaggcagaagttgcagtgagctgagatcccaccagtgtacctcagcctgggcgacagagtaagactccgtcacacacacacacacacacacacacacacacacaaagtctttgcaaaattacttaggaaaaatataatagaacctagtttttagttgattcttatacatggattataaccagaggatcactgtacattttatgtataggcagtgattattttgcatggttattggagattataaaaaatggtgatgcatgctcaaggtatacaaaacaatcttactagtcaatgggtaaaattatggttgttctgtgatctgtaaaattttttgtcaaaacattaaaatctctctttttgttataaatgaatagagaaatgaaaaaaaagttatgctaatgtttagtataccataatgtaaaacattcgaggtattgagaattaaagggttttatttcttaagaaagtagtttgaatagtgcttgctaccttctcactgtgtaagttgttatgaagcacacatttttttctgtgccttggcaaattgtcattctcctttctctgggtggatcagctcctctcaacattttatcctttggattttaaatgttgtga

SEQ ID NO: 7303 - DNA, 1024 bp, Homo sapiens
gtccatttcattgtaagtggattgggagcttgaggctgacagtaaagtccttatgatgtaatgcagtgaattggtgatggaaagggtctaggcaaggagaaccagttggtgcagtgtgtctctgatactgtgactacagttagtggcccctttagtggatgagctactcaggagagagtggttcccagctggcacatagggatttctgccatggcttaattcagtagtatcctgagactatcatattggtacagtgagtttttttttattgaatttctctagtaaaataatataactttgcctttctatagaatatatatttaatgaatgttaatctaaataagtatttgttgtttttgttcttatttcaggctacagacaagagaaaagctttagaggagaccaaagcctatacaacccaatctctagctagtgttgcttatcaaataaatgcattggccaacaatgtactccagttgctggatatccaagcctctcagcttcggagaatggagtcttccatcaatcatatctcacaggtaacagcttataaaatgctttaaattcaatttaaaaaaaactacagcatatgccaaagaagtaaatagcctgcatgtatggatttctgactcatcttactggtgataatcattaacactgttttagtttggtaaacctgctgtttttcttttagtcctttttttatcatgataaggtaaacataacataaaattgaccattttaaccatttttaagtgtataattcagtagcattaagtacattcacattgtacaactgtcaccactgtcctactgttaagagcttttctgacgtaaagttatttgtacataaagaacagaatttttataagttttgacacacatgtatacccatgtgaccatcaacacattcaagataatgaaccatcccctttccccctgccaaatttcttcattctcctacgtaatccctccctcttgtcccttgtccttagggtttctgtccctagagattagtttacat

SEQ ID NO: 7304 - DNA, 1052 bp, Homo sapiens
tcgataaggtaagtgtgcaaaaatctggacacaatgcctataattttgttagtgttcaatatatagagaaggattatttttctatcatttaatttttagagcaagtttataaaatggtgttactcatctttttgagaaaatcagaccaaggatcacaaagattaaatgagtcgccatagtcacaaaggagtttacaatacatttcctgggtaattgccagttaaaagtagcaatgatgatcacatttcaaatcttgaattatgtggtgcttttctcttacgtaagcctctttgtgtgttgaagccatagattctaagttgctgtatcaaaatgatcactagaaaactgtgatatacttagtgtatatattttagaaaatgtcttctattactcttgttaatttgattgaatacatgtgttattttcaaaaatgtaaatggaatatgtgtggattgaatatatatgtacatatatatgaaatatgatttgtcattatagtgtaggcatagctcatggcaatgtgtttttctgaaagcagctgcagaaatttgtctttttttagtttgcaaaaatttcagaggttatgggggaaagtggggttctatgaatcccagatagtacatgaagcagatttggtttcagtaattttagcataattcattgtaaggtgatgatccctaggaacttcatcacagtgagcaacctgaaagctcccagcagccagcaataaatgaggtgggacgagtccactggcagggcggggccttaagagcctgatgcttgagctctgaattccaagttggggggacacatgcaaaggattctgggcctgattgtttcctgtaaccaggatacagtctggttggcagggcaactggctttcacttggtggccttcagtgggtgtcctcattggttgcctttggttagtgccctcagttggtaccctcagttgtttctcttcagttggtggtcctcagttggtggttttcagttgttgggcagcggtggaaggaggatgaatctgtgctctctcctccccaggccacagct

SEQ ID NO: 7305 - DNA, 1075 bp, Homo sapiens
aaaagaaagctttgaacatgctttagattctcagaacatatctactcttattttataaacaatacctaaactcgtaatctgtttttccaatccaaagcaattaaaacaaaaacaaatagaagagagtaggtgtattaatacaactataagactaagggacaagaaaacctgtttctggatacagatttattgtcaaagtgtatcaccaaattatttaataaacataatagaaatccaattaatacgctagcaggattttttttttaagaaatagacaatcttagtgtacaaatctgaaaaaataaacaggtaagtttttttaagcaagagaaacaagtttgcttatgttaaaagaatacaataactaaaaatattactgtcttaaaaatagatgcaaagatcaatggatctcaataaaaagcacagaaacaacccaaagctataaaagaatttcctgtatagtgaaaatgacatttcaaatcactggagaaaggtagcattaggacaatttgctccctgtctggagtaatgccaatttattccacccaggcttaagtgaattaaatatcagttacaacagcaattttctaacttcctgaaatgaataataaaaattggctaatatgggccacatttcaccctttatatgtccacttaagaccatgatgtattacaaggtagcatcctgggggaataactgtgtagtcaatcaaaaagtggcagattttaacattcacgccagaaaaccagacaatataagtgaaagaaccaacagtgtattttcttgttttgtaggagagcctctgtgtggaattaactagattatatgattgactcaatctcccttatgatgctctcacattggtagggcaggagcagcatatcacgttccattagtagttataattttgtactgcttgatgcacgtcccagcaagatagctgctgggcaatacatgtgatcaccagccatggaacaaaaaaggctatttcaggcatattaaaccctcacccatgtgatgctttaacaagctaataagtcatagactaaaaaccccagagaaaattccaaaagc

SEQ ID NO: 7306 - DNA, 1030 bp, Homo sapiens
aagtctagtagtttaaaacaatgactatttcatcatatgtcaggatttagtgagccagaaatttgggcagagcctggctgggtgagtcttctgttctgtggtcatatggactgggtgtcgggtggtgttcagctggcagctaggctggtctggaggagccaagatgcttcttatgagcctggtgccttcacagaacacctggaaggctgcgctcagctggggccgtctatttttcatggagtctcagagcctctccacgtggcccttcggcagggtaagctaatgcttcgctcagggccccaagaagccaaggcaaaagctgccggttctcttaaaagctaggctcccagagctggcacagggtcatttctgccaccttcttttgcttcaggcaatcacgggctagcctagattcaatggaagggaaaatagacactaccccccctttttttttttggagacaaggtcttgctctgtcccccaggctagagtgcaatggtgctgtcgcctccaactcatgggctcaagtgattctcgtgtctcagcttcttgagtagctgaaaccacaggcgtgtgcttccacttccagctaactcttttttttcattttgtagagacgaggtctcactatgctgcataggctgacaccacctcttgatgggagaggtgtcaaataatttgtggtcatctttaatcagccataaaacatatacgcatcaattaagtctttactaagttataagttaactattaaattggaagcataggactgcagcttcctttgtccacaaacgtttgtcaggaggaacctcaacagtgcattcaaagtcaggcccagtggctcatgcctgtaatcctagcactttgggaagctgaggaggacagatctcttgaggtcaggagttcgagactagcctggccagcctggtgaaaccccgtctctactaaaaaaaaaaaaaaaaagtgcattcgaattatgtggttactactgttccataaaacggaagctttcctaaacaaataatttata

SEQ ID NO: 7307 - DNA, 1067 bp, Homo sapiens
ttttttttccttttagtaagagactcactgaaaatctttttgattttttataggtattatgaatcaagactatgaatttatgtcccgtagaactccaagaatgcaaaccaccgtaatgccactggatctgcaatgagcatagctgctaacaggatttcttatgtgtttaacctaactggcccctcttttgctatagattctgcatgctcatcatcttttgttgcactgtactacgccttccttgcaattaaacaaggtatgctgaagttaggtaaccaagacatgaggcatgattaccaaaaaattgaacaatttttttctttatttcttcttaaaaaaattgggatacatgtgcagaacgtgcaagtttgttacataggtatacgtgtgccatggtggtttgctgcacctattgacccatcctctaagttccctcccctcaccccctacctgtcaacaggccctggtgtgtgttgtttccctccctgtatccatgtgttctcaatgttcaactcccacttataagtgagaacatgcagtgtttggctttctgttcctgtgttagtttgctgaaaataatggcttcccgcttcatccatgtccctgcaaaggacatgatctcattcctttttatggctgcatagtattccatggtgtatatgtaccacattttctttatcctttgtagcattgagggcatttgggttggttccatgtctttgctattgtaaatagtgctgcagtaaacatacgtgtgcatgtgtctttatagtagaatgacttatagccctttggatatatacccagaaaggggattgctgggtcaaatggtatttctggttctatgtccttgaggaatcgccatactgttttccacaatggttgaactaatttacattcccaccaacagtgtaaaagttttcctgtttctccacagcctcaccagcatctattgtttcctgacttttaataatcaccattctgactggcatgagatggtatctcattgtgatttggatttggatttctctgatggtcagtgatgttgagtttttttttcatatgtt

SEQ ID NO: 7308 - DNA, 1049 bp, Homo sapiens
cacaccaccaagctcggctaattttgtatttttagtagagacagggtttggccatgatggccaggttggtctcaaactcctgagctcaagtgatatccaccttggcctcccaaagtgctgggattacaggtgtgagccactgcacccagccagtgaaattctttagtgatttattggtagggcactttaactttttaatttcttctcaacatgctatttctttacattttccacccaagtctgttccccactcctgtatctatcctgggtagacctaaaattgccctattacaaagtctctcttgccttcatttgtcttatattttttgtagtcatccaaactagaaacctaaataatcatgtccccttacttcctctttcctcaacctgcaactcctgtttttactgtctttcttatatttcttagtaagcaaatgtgctggctccgtatttgattgaaactgatataaacgggcgagagtgtatacggaaattccttgaaccttttaatctaatacttgatccagtaattccatttgaactatacccagtattgttggtaagacagaagagagcaggagtgggcctatattatttcattcttgcattgctataaggaaatacctgagactgggtaattcctaaaagaggtttaatcggctcatggttctgcaggctgtatgggaagtatagtagcattggcttctgggggacctcacgaagcttccaatcatagtggaaggcaaagggggagcaggcacctcacatggggaaagcagtattgagagacagcatgaggtgccacatattttcaaacagctagatctcacaagaagtcactcactagctagatctcacaagaagacactcactatctagatctcacgagaaaacactcactatggtgaagacagcatcaagagggtgatgctaaaccactcatgagaattccacccccatgatccaatcacctttcgccaggccccacctccaatactgaagattataattcaagatgtgatttgggtgggacacatatccaaactcta

SEQ ID NO: 7309 - DNA, 1056 bp, Homo sapiens
cacccacctcggcctcccaaagtgctgggattacagacatgagccactgcaccctgcctccaaacactttagatgctcgtttacctttgcaaaattattctaggtttaattgctcagaatggtttgcgatcatgacaaggcagcagtgtagagaaaggatggttgctaaaataattacaggtcttattcaggcatgcatagaactgtagagacagctttgcaaagtcaaaagaagcattcaaagctttattcctggggaatttgggagcctgttttttttgttgttgttgtttgttttgttttgtttttggtctcctctcaagtagccataatatctgattatgcaacatgggattagtgttagggcgttcagaagtagggcagggcacattctgcagggcagtagcgggctttctcctttgccctgaaggtatagtttgtcagggccttctgcaggcagctggaaaaagtaatgcacctgccttggctgaagtgaatcctgtattaaatcaggtgcttaatgagaggaccaaaatggacttgtgtctctgtctcaatttagcctaccattgtatacaaggcaatcaatccttagtttacatccctgagttgtaagagatgcattataaacgtgcattagtacagtgccttttgcctgtgcaaaatgcatatttttatctgtattttatccctttgtgtgtgtatgctacaaaatgtaacaaaatatcattatgctctgaagaaaagagaaaatattatatcttctgagtctgtggcccacaaatccctgagaagccgatataaaaaggtttatccctggctccatgacttgaactcatttcgattcaaatagatgaaagttataatccaccagttggctccaaacacttttttgagactttaatacaattttagacatgtagataaagatgtacattcacctgaccttttctccatttgacccactttactcctagggaatacacgggtagtaaagaaatgggatctgttttctttgggatgcacaaaaagttccggtcctgggtaagcaagcaa

SEQ ID NO: 7310 - DNA, 1050 bp, Homo sapiens
tttcttctttccttctcctgttttttttttttaaatctccatgagacaagaccacctaagaatgagcctttctagcaccatggaaccttaacttctaggaataaaacatcctaggtacaagggaccagctcataaaagaaaaatcctgagactagagactcatttctttttaaaatgctttctccaaatgattttaagtatgaaaaggaagctgggggaatatgaaaggaaaataaatttggaaccccaaactcatcaagcaaaaaggaaaagtcaagcagagaactgggtcacaccaacccgcctcctatttggtttgtaaataagatggctgcaaagataaaaggctacttagctccctcacagtttgcccagaagaaaattacctttggggcccaagatctttaccctaaaacagttctcttgaattcactctggcaatgtaaattgatcacttatattcacaggtgcagaacagaggacagaaatcaaagtcatctctctgctcacctgagacaaacacatatctgactgcttcttctgccatattgtctatgttgtcttatgttaaaataaagattcactgagccagacaaaaacatgggtgactatttcctgagaattaacatgaggatgtctgggaggactgattcctaagagatccagtggctctgattaggttttttcttcagaggaacataattagggtctaatctcacccaacaggtcagcccctcctgcgccttgagcccctgccacacagattcaggtagccacgacatgagtggaccaaactagttcagggagtaattgccctggaaagctaggtccacaagcagaacccattgggtctgacacactccttgaattggttaaattcaaaggaaaactctgaattctggggaacaaggcctctaagttggcttaagcctctgcagctgcagaacatgaagttctacccttagaaactcccgctgggtatatgcaaaatacttatggtaaatcattcaaatatttagtcaagtggatgttgagttctaattagggata

SEQ ID NO: 7311 - DNA, 1051 bp, Homo sapiens
atatatttcatatttactcaaactataagccagtaagagacaaagtgtcccaagataaacttcagctgtgctcaccccaagttaagaatttgggggcatattatctccatcaaagaactgagtattaaccctagtagagtgagagaaattttagctttcccaatgtccatcactaagaaacaacatagagggtttgtggggctggctggctattgtaggaactgcacaccagatttcacccttatggctcaacctctgtatgcatacctaaaagatgaacagtctgatcccatcatgtttactccagagggacaatcagctgtgcaacaaataaaggaaagtttcaaaatgccccaggcttagggcaccctaactacaaattgcctttctccctattcatacacaaaagtggagaaacggcacctgggctactgaccagaaacctagtgatcaccagataactatagggtattacagccaacagctagaccttgtggccttacctcactgtgtgagagctgtatcaggcacttccattctgtagaagtctgttgaagatattattacgtgttcttcccttaccatttatgtaccgcattctcttgagacccttctaaactctcatcatacttaatatgtgtctgtcaatagattaactttctatgaagatttgcttttatcatctccaaatattacctcatcccactgtaatagtctaaatcctgctactctgttcctgggcccttctgacaaaacccctcatgactgttctgatgactgactaacttctcacccccaggacaggcctacaggagatgccactggataatgctgagatagactggtatacagatcggtctgatttaagaggagagggtggaaatgttagaacaggctatgccgtggtttccttattagaggtaattgaagctggtcctcttccccaagccagatcacctcaagtggctgaatactttaagttttagggtacatgtgcataacgtgcaggtttgttacatatgtatacatgtgccatgttggtgtgctgcac

SEQ ID NO: 7312 - DNA, 1050 bp, Homo sapiens
ttttctaacaaggagcagcctgaaaaatcgagctgctgacatagataagcaagctgaaaccttgcatgggtgaatgccggaaattgtgccaatagaaaagggctacctcagggctggggatgttcaacatggaggcttcatcttccctattctttgtacagtaaaggaacaggcaacatggcactggccaggcagagaacccatctgcataataaaagattagggtgggggcggccagattttctgcactatgcaaatggcacacctagccctaaccagttttttgcaccttatacaaatagcatacctggtctaaccaatcttttgtgccctatgtaaatcagacaccaccacctcaagttcatctataaaaccctgtgcatttcaccacggactggaagacccgcccaggaccctctctctgcaggggagagcttttctttctctcacctattaaacctctgctcttagcctcaccccttgtgtgtccgcatccttgatttctttggcatgagacaatgaacctcagatattactccatcagtgatgctgcttcactcccacgcttaggcccttctcattttatccagactccagcccctaactctgggccaccacaactctaattttgtttccaggcttagtccccatacttttgaaccgaaatgttcaggaagagaaaggagaataggactccatataccatttataatcaacatgccgagctctacaaagcaagcattttttattggaattgcattgaatctataatttggggagaaaagacatttagaatattgagttattctgtcttttgtttgtttgtttgtttgtttttgagacagagtctcgctctgttgcccaggctgtagtgcagtggcgtgatcttggctcactgcaagctccgcctcctgggttcacgccatcctcctgcctcagcctccccagtagctgggattacaggtgccgccaccatgcctggctaattttgattttgcatttttagtagaaacgaggtttcatcacattagccaggatggtctcgatctc

SEQ ID NO: 7313 - DNA, 1033 bp, Homo sapiens
taggaagaaatcttagtgataagccagtgtagtttcccattttacagatgaagagacctagggaaaggttaaacagcagggcccaagccatagagctagtcaggctcaggatcacactccacattcctttacttgtagtccaggtgattccataaccttatgctccagcaggtagaattactgtaagagatccaacaccttgggcttttttctcagcatgtattgatgcgcacagcatttatccctaagaagctctaagttcctgtatcttacatacagatgattgctttaatttactttgccaggtgtattcataaaatggaatatcacatcaaaatttttaagcatattcaagtcttccccatgaatatattttaacacaaaaataatttttataagatttttcattcgaaaatatctccacatttgtagtcattttctttcttaggttttccttatgttaccaattataattttttattttctatatgacatttccccccatcgttagacatctgggttgccagtcagcctttattgttttgattacttcatcaaggatgaaaatgcttctctagtagaaactcactttcatttctttggaagtatttggattcccttttcaattagaaccctgggatgtcctcttatctctttgaccaatgcctgctggcacagagatctttctctttttggagtttgggttaaaaacaaaacagcccttagacaccgagtaggtgaccatggtcttactcaggttatatatttttaaaacatatgcttttaatttgttttaggcacaagcagcatctcaagaaaacttagagcagtttagagagaataattttgcttcaatgaaaagtcagatggaactcagaattaaagatctggaatctgaactctccaaaataaaaacttctcaagaagactttaataaaaccgaactggaaaaatataagcaactctatctagaagaattaaaagttagaaaatctttgtcaagtaaactaaccaagtaagtcaaaatatagaa

SEQ ID NO: 7314 - DNA, 1026 bp, Homo sapiens
ggtttttatgctttatttttacagctctgaattcacaagtgttagttataactacatgtaatgtaacaaaaaagcaccattcaaatcaaatattatttcttataatttctatggctttagatattatagagtggactgccccgtattagtgggaatcattgagaatttgctctatagtgtatccccagctgtgtacacatagtctgtcaccttgttttaatgaatagttgttcactaggaatatttgttttaaggagtgctctatcatttaaaaaagatatatgaaattcaattttattaataattcttttaggacacccagtctgttgattaactgcatctaatgtgttttactttatgtaccagtttaactcggtgcccttaatcatgtgatctggtctacagtaataaatcatataatttttttatcccaatagttttgttttctttttcccccttacttgtagaattaatgttgtattttacagaagatgatcagttatcccctagagtagtgactgcaagctataaatctaaagttactcacctatacatatatatgcttgtttgctctcatttcttcatgagcttagtagatccaagaagcaggacttttaaaacaaaatacctaaatgaaatcccttaacacaggaagacatgaaacagaaaaagtatgaagtaaacaacttaaacagtgcctgtagattgtttcacttctcatttaataccttttataaggtaatgaatagagtctagctctccagggacccagatatatacatctattcatttaataaaaattcactctgtattgggtactgatattctatatcctaaatatttttggaaacattccctcagtttaggcctgcattatccttgttctgcaatattgtcttctaattaatctccctttatttattcatatgcccctgaaattcattctctccacagtatttagggtgatctgtctccaatgcaaataggaccttgagtccctcttgaaagcataaatgttcaaacatc

SEQ ID NO: 7315 - DNA, 2055 bp, Homo sapiens
aagaattggaaagaagagagtagggttggttatggagagatcaaggaagccatactatgattaaaagcccactagcaactttatgacttgcaatacaatttcagtttgggggacatagtagggaggagcttgacaccagattccaagagggcaatctaacataaaagaatgtggaagcaaactaagtatggaccagagcttcttaaaatttaataaatcagctggggatcttgtttaaaatgtacattttgattgagcaggcctggggttctgcatttctagtaagttcccacataatgctgatgcttctggtccttggaccacactctgagtaacaagggtatagacttcctttttgagaaatctgaaagaagcgtcattggacaataattcaaggcataacaggatcagaataaagcattatttttcttttatttctgagcatgtttcttccagaggagaagaaacaaagagatggagaaatagaaattgtagatataagataactattgttaaatgaagaggaaagaagtgctgagaatgttccataaaaagaatatagaatgggaagaatcaagaccacagatctggagattacttttgcaaaagaagagagatcgtgagtggggaaagagaagaaagaaagaagttagctaagtcatcttggagttaacgatgaggaaacttgagagaactcatttcagatggattcattgcatttacactcaaacagacgattagatcatttctgctccagagattattgcaagcaggagggcatgctagaattggggtaaactacagtgattcatatctcctttctataactatcagacatcaaagatatatgttgctttggactgatcttggtggtttgcctgtcactcagcactttgggaggccaaggtgggtgggttgctggagcccaggagtttgagaccagcctgggcaacatggcaagactgcatctctacaaaaacatacaaaaattaggcgtggtggtgcatgggcctgtagttcggctgttcaggaggctaaggcaggaggattgcttgagcctgggaggttgaggctgcagggagcaatgagccatgattttgccactgcactacagtccgggtgacagagtgagactctgtatcaaaaaaaaaaaaaaaaaatagatgttgcattgatattaatcaaatgagtttaatttgaatatagaagcattggcttttttcttaaagttgctttttgataacgatagctgtttcataaaatcctttagaggataacattttagaaatgaaaaaattacagttaataattccttgaatactaaaattgttattttaaataaacactgcattgattttaaaaaactgcactaattttgaaatataaaatgttattaatatctaattctgtggcaattaaattttttccttttgataaatattacaatattgaaagcttattatgtattatttcttagatgtgttttatataccttcttgcatgagtggatcaagaaactttaagatggctaaactagaggatacaagaaatgtaggcatgccagtagcccacatgggtatggaaaaaaaatgcgtatttttgttaactgttattctacaagtgtatatccaagctgatcaattcagaacactttctctgatgagaaataagttatatatccaagtaaagtggcatcataactgtgtgcttcctaaattacaggacaagttgaagaacatgataaatacttgtagtataatggtataaatgattctgatgtgttgcattaaagatatgctgtcgcattttaccatcagccttgacatttctcctctcagggtcatgatttgctcctctaattaaagattacttttctccacatcgaccagcatgctcacattggtatatgtgcacttttctattttagttatagtcacttggaacataatcttacattcaaatcataactgcatgttttattaaacctatattcctgtttttttctccagtatacttctgtcatgttgctgtcctaaccaaaataaaaaacatccc

SEQ ID NO: 7316 - DNA, 1039 bp, Homo sapiens
aatccttacatgataggtgtgtctcctgaaaacagcagagaatttggcttgtgatttttaaaaatccattctgccaacctgcatcttttaagtggagcatttagaccatttacttcaatggtaatattgagatctgaggtactgttccagtcattgtgttgattgttacctagtgactttgtttcctccattatgttattgttttataaactttgtgaattgtatgctttcagaagtttctattctgttatgtatcaaccttttatttcaacattgagaacttttataaatatttcttgtagggctggtctagtattgacagattccctcagcatttgcttgttcaagaaagactttatttttccttcatttatgaaacttagttttgcttgatacagaattcttggctgatgatttttttcctatttaaggagactatagataggactccagtccctcctggcttgttaaggtttctgctgagaagtctgctgttagtctgataggttttcctttacaggttatttttaaaaattctttttatttaatcttatttatttattttattttattctttttatttttgtctgattggattaatttgaaagccttgtcttcaaaccctaaagttcttacttctatttggcatagcctactgttaaaacttcccactactttttttcttttcccccctcgagacagagtctctctgtcacccaggctggagtagtgtgatctcagctcactgcaacctccaccccctgggttcaagcacttctcctgcttcagcccccctagtagctaggattacaggtatacgctaccatgtccagctaatttttgtatttttagtagagacagggtttcgccatgttggccagggtggtctcaaactcctgacctcaagcgatccacccaccttggcctcccaaagtgctgggattgcagccgtgagccaccatgcccagccccccactacattttgtagttccctaaatgtgtctttcatttccagaagttctgattggtttttctttaa

SEQ ID NO: 7317 - DNA, 1020 bp, Homo sapiens
gtgcatgggttttttttccttgtgaaagctatcagttaagagtgcatgtttaactaggaaatataaacatattaagtaaatattatattaagtaaataacacattaagtaaatatgtttatatttccaggagtagtggaaatgtaaggcaaaggcagaagagaggtacagttaataggatttagtgattattgagtgtaaaaagttagggggcagagagaaatctcagctgattcctaggtttccaggttgtgcacaagcatttaaactggacatgaggagtaggaaattgtcaggtgagtagagaagagtggcaggtctgcagggaagattaacttttttctatacatgtgagtataatggaatatttatagaggatattaattctattatagtctccagatatggtcccagagggatactttgtaacaaactatcagtcttatgctttaaattttatatatttttctattgttgatttaaagtgtgttttacttttctctttaatagtggatgaaagctctgaagactccttaagcaggtagtattttacagatttttaaaaatatatttaaaggaatacagagaaaagaaactgttgagtgccctactctgggtagacaccatattatgtgcttctccatatagtcgtcccaacagctttgcaaagtatctgtgctatattacaacccaactgtgtggttcagagaggttgattaattggcccatgacctcacagtgagcaagcagctgacccatgatttgaccatcagcctgcttggctcccaaatcccttctcttgcccctcagcatagattgatagagacctgtgcggtgctggatcaaggtacaggtccaaatcagatcaattcagagacctacatttagttctatgttaactctcagagtttttcttaggagcctggttagtccaacaatttgtcctaatatgcttgataattgcagtggtaattagtactttgactttatcatcaaaggttttaggccagatctcacttag

SEQ ID NO: 7318 - DNA, 1084 bp, Homo sapiens
tattagtctgttctcatgctgctaataaagacataccctttattatatgggtaatttataaaggaaagaggtttaattaactcacagttcagcctggttggggaggcctcaggaaacttaacaataagggcagaaggagaagcaaacatgtccttgacatggtgtcagcaaggagaagtgccaagcaaaagagggaaaagccccttaagaaaccatcagatattgtgagaactcactatcacaagagcagcagcacgggggaaccatcctcgtgattcagttacctcccactgagtccccctcaccacacgtagggatcatgggaactacaatttgggatttggttggggacacagccaagatgagatttgggtggggacacagccaaaccatatcaacatgctatttaatgtttataattttatgaaccattgtatgttttgagacagtgcactacagtttataaaaagtcctgtcactctcataggacggctctacatttggcctgtgccaatggtcatccagaagtagtaactctcctggtggacagaaaatgccagctcaatgtctgtgacaacgaaaacaggacagctctgatgaaggtatatagtagccagctctttcagcatcagatggatttgacttaaatacatagaatgaaaatgaatttatctcattaaaatataactaattggtgaaacctgtggagtgtttattttgcattcctagaatttatgatctgtttcttggtctaatactcccaggctgtacaatgccaggaagagaaatgtgcaactattctgctagaacatggtgctgatccaaatcttgcggatgtccatggcaacactgctcttcactatgctgtctataatgaggacatatcagtagcaacaaagctgcttttgtatgatgcaaatattgaagcaaaaaacaaggtatagatcaaccaactttatttttacagtatttgaaatgcgtttgtttcaacagtgacatatgtaagggttagttttctgtatttggaagcgcaagcattccctgactgaaagtattttaaaataacttaattgtctaagatttt

SEQ ID NO: 7319 - DNA, 1112 bp, Homo sapiens
taatggagtatttactcaattaaatttatcttagggcctgaaagaagaagtgtggaaattgataacaaaaacaaaaccatcacagcatatcatgaatctggtcatgccattattgcatattacacaaaagatgcaatgcctatcaacaaagctacaatcatgccacgggggccaacacttggacatgtaagttttttgtagtgtctcgccctgtcacccaggctggagtgcaatggcgcgatctcagctcactgcaacctctgccttccggattcaaacgattctttcacctcagcctcccaagtaactgggattacaggtgcccaccaccacgcccagctaatttttgtaattttagtagagatggggtttcaccatgttggccaggctgctctagaactcctgacctcaggtgatccacctgcctcagtctcccaaagtgctgggattacaggcgtgagccaccatgccctgcctaattcttaaatatctaattactccgctgccccaaaagggaaaacattatgttttgtagtaactgattcagtagtttctctaagatttttatcatttagtacaagtttatcagatctttcaacattgtagacatttaaaaaatttctatgcacctggggagaaaacagtcctattgcagcattatccacctattgttgttgctttataaaggatgtttttattctctaattgctggtttttcatcagtcccctgatgaccagctttcagcaacatggtataaagtactttagtgagagctaaatgataattctggtttgtatttttttattttgcccagtcttacggtgctgaaattctggtttttaatgtaactatatcagaactgtatctgaattttttttaaatttttattttattttatattgatggagtctcgcgatgttgcccagtctactctcaaactcctgggctcaagtgatcctcacacctcagcctcccaaagtgctgagactacaggtatgagccactgcacccagcctgtatctgaatttctttcattacattttattttattttaatttaatttggttttattttatttattgtattttatttttgagatggagtttcactc

SEQ ID NO: 7320 - DNA, 1024 bp, Homo sapiens
tataccactttggaggtatgggagaggtctgagctagaattaaaaataggagattatatttatatgtatgttaagtccacatgtttggatgagatcacccagggagtgagtgtaaccagaagagagatttaaataccgagttacagagcacttacttgaaggttcacaagacagagaagagaagccaggaaccaagatgagaaggagctgccagtgagttaggtgacaatggtatcctggaagaaaatatttctatgatgaggggagtgatcagcaatgtgaaatgctattgatgggccaagtgagaactaaccatttgatttagcagtaggtcattggtgtacctgataaagagcaatgttagtggagtagcaggggttaaattccaattgcagtgggtttacaagaggtggaaagaaatgagatggaatagaggattgcaaacaattcttggattttgtctgacagaagagcacagataatgtatctcataatacaaaataaagttggaatgttggtaaactgttaggtggggggttgtggaaattgatagaatcaaggtcaccagcagagagaatatggctgggagaggaggaatgagtggttaatggaggaagtaaattgtgtagcaataggagaatgaatggaaacaggaaataaaactgttgtgctcacttgaaattttggatcatgaatttatattaagtcaaaatgagtggtttttctactgattttttttttttattttatcttttccaaatgtgaattctgcaactttagtaccacactgtgctcttctctgtgctttgccattatatctgctctattacatttgatttctcagaactgtagtggctgggtaattatctttcaggagtgttttagaagaaattcttccgcaggagggatttgaagtacgtgatctgaggactcttccaactctgaagagattggttatgttattatttctgcttttcttctttacttattcgtgtctctgtttatacataaccatgttttttca

SEQ ID NO: 7321 - DNA, 1120 bp, Homo sapiens
gcaaggtgaagagtgaacaggtatcacaggcatacagaaaaatacctggaggtcctgagttaggaaagggtttagcaggttgaaggaacaaaaataaggctagtgtggctagaacatagtagttaaagggggtagtgacagaagaggttggagaaaagacttgaggcagatcatacagggagtaaaggatatattatggctgatttcattttaagtgtattgggaaccattgaaagttttaaaacatgattagattttcatttttaagagatgactggcttttgctatatggagaataggagagggcaagagtggaagatgttatcagctaaaaatacccacccaccccccaattaaagctgttgcagtggttatggaaagaagagaatgagatatattttgaagaaagtggaattgcatgagagatcagagagatgatggggagaggtgtttctgggtttgatcagatgaatgcattgaaggtgctatttaccaagatgacagtgtctggagaagtcctagtaattgtttgaaaaagaagtctgacatggcctattgaatatggtattgaagtttttgaaactcaactctttgccttagttcacatcaagaggcctgattttaggagaatttaccatcaactgaatggacagttagtagtatgtgatgttggtagagatgataaagggatttttatgtaccctaggcagtcttaacagggctcaaatatagtgaggactctcaggcatttcttgctttgaaggatggtaacacatttggaattccttgttgcttaattggttgaatacacttgaaattaaatggtaaaaaggaagacacagaaaatgaactttttcattgagaagagctcaactctaaatccttttgtgaaagaaaagagatataactaattcaaataaaagagatataactaattcaaataaatcttttcaaagaggtagaaaatatgtatcttgaaatgatttgattatttttaaagtttcaaaagaagttactgtttatttttttttctttttactgcccccaggctgtaaggaacttactgtttctttctgactctaaaaatgatacattgcttcacttgactagccttaaaaca

SEQ ID NO: 7322 - DNA, 1049 bp, Homo sapiens
ctacttcacaggagtactggagggatttgcaagctaacgggccaaatgcttccataggaataaggcatgcccagctaacagaaatttaagtccctcttccccacctctctcatctagaccaaaaagaagactacaatttagatccttggagacttttcctgtatgccttccaaaacttcctgctcacttagatgtaccttgtgctttgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagccactgcacctggcctgtagcaaataatttttaagcattctcaagatgtatgatgttgggtttaacatcatatgttcacagtgttttaaataagaaataatctgtctttagtatacagaatggttctttgtttgcctgaaaagtataagaatacaatttacttttcccaaactctttttccttatttttttctttcaaataactttaattatttaatcccatactgattaaaatatgtctgtctaaagggatctactactatttgcttttaaaaaagtgttccctatttatttaggaaaaagtgaagcaagcaactgaatttatatgtaaaaataacatttagacctgtggatcaaagattattttcaaaaatgagatatcaatttggtatcagtaaaaagtgtcttttctcttagtatataaataaataaaatgcaaattaagagtgtaagcagttgtgaatcattacaagcagtctgggataactaactcctagggataaccatttctatcctgttccaaagtcttattt

SEQ ID NO: 7323 - DNA, 1042 bp, Homo sapiens
gtgagccgagattgcgccgctgcactccagcctgggtaacggcaataatctgtctcaaaaaaaaaaaaaaaaaaaaaaatatatatatatatatatatatataaacataataggattatgttttatagaaaattgcttttcataattgatagtgtcccataaaatgtcactgaaaaacttaatggaataaaacattattttaatataatgtaataggattttagctttgagggaaagtaatgtggtttgaggagtgggagaaatgcatgtttcattcaataaggtttatttatagaagtataaaattcttttttttttgagacggagtctcgcactgtcgcctgggctagagtgtaacggcgccatcttggctcactgcaacgtccgcctcctcggttcacaccattctcctgcctcagcctcccgagtagctgggattacaggcgcaaaccaccacatctggctaattttttgtatttttagtagagacggggtttcaaactatgttggccagactgatctcaaactcctgacctcgtgatcttcccacttcggcctcccaaagtgctgggattataggcatgagccaccacgcccggccaaaattctatttttttttttttgtacaaatttaggctctcttctggggatttccagaatattcagctaacatttgaataatgtgccttatgtctgttgaatttaaaaagagatgggtgtactaaaccctggctacacattaaaatcactaggggatcttgtgaaaaaatagaaatgccccaggatgaccccagactaattatttcaggatttctaagagattgggataatcactgtaatagagggaggattagaggatggtctcattaaagatggaatctcggccgggcgcggtggctcatgcctgtaatcccagcactttgggaggctgagacaggcggatcacctgaggtaaggagttggagaccagcctggacaacatggtgaaactccatctctactaaaatacaaaaatttagctgggcgtggtggcgggcgcttg

SEQ ID NO: 7324 - DNA, 1080 bp, Homo sapiens
gctcaggagatcctctctgcttaggctcctgagtagctgggactacagggtgtgccatcacacccagctaatttttgtttttatttgtagagacagggttttgctatgttgcccaggctggccttgaactcctggggtcaggtgatccacccacctcagcctcacaaagtgctgggattacagacatgagccaccacaactggccaatttaaaaattttaaacatgagaaaaactatagatatgctagaaacatatatgaagaattatcctcaaattgatgtctccaaaattacagaggtaggaagtgagaaatctattttatcttagattaattctttttctaccatagtgtatactctttggctttagccccaaattccttatctactgagaatttgaaatttggcagagtatacatataactttttcacttacactagtcagttttgatttgtcataagctttgaataaaagtaccttattacgattgcttaataatagttattctatattttagtatgtttttaaagagacatttgcaggttattttggttatatctacagcatgtctattcatgtattcttttatttattgaaccatcttaggcattgctattaaagtttaaaatctcagagtgttttgaaatcaaagaagcaagcaactaacagaaccataacttttgtttctataagctagaaataaatcattatctaaagtattaatgcaatataaaatcactattagtatagctaagctaatttataacctgattatcagttgtattccccaggtgatttgtatttaatgtgtgtttccaacaggttcattccagccaacaaatgaaatgatgcttaaattttatagcttctataagcaggcaactgaaggaccctgtaaactttcaaggcctggattttgggatcctattggaagatataaatggtaattttttgtgtagagctatgcaagaatttaaattttaatgacataattatcatatggctattacttaagtggttatatattattctgtgcagaaagtgtcctaggtattgggtacaatttttatcctccaggt

SEQ ID NO: 7325 - DNA, 1062 bp, Homo sapiens
tgaaaagcatggcaataatgtgagccaattcaaagatacactacagttcatgtatcaaaggaaaaatactttttgatggtttttcagagatactgaggagtttgaaaatagatggaggagacagactttccagccaacttctagatcatgaatgcacatttttttccatttaaaaagtctttttttgctgaagtcacattagtcctttgtagcctaacaccattcagctgtatatttattaaacaagtcaacccttctaaaactgcagtgtggtaactataaagtgaatcttgggagaaataacccttgggctatatagaactgaaaggatgaatatcaatattaagatgtggggacaaaattaagatttagctaagaagcactataaatgcatttaggtttcagaactagtagctcaacctgcatgtaaaaaggagtgcttttataaacaatgctctttgcaacatacaagcacacacagaagttattcatgcatagttaggaagtcattttctgagactttggctggaaatctaggtttcatggatgaaacactttgggtaacatctccaatattccccttgagaaaatgaagtaacaaaatccattagacacttaaagctaatagatattctttaatgtggctccaggtctctttgtcttggcatgttgtggtgttttggcacaaaggaccatcagaaaagccatttttgtctttgaagatgatagattctgcacacttaatccattaatctgagctgatgggcttttgcccagagttaaaatattttctccttacataatggttttcatattaaatcatcgaataacactaatttttctggtgactgcatttaattccattttctagatgtagaaaattaaagtgagagaggaggttaactttttctttctttttttttttttaacaaggacttccatagtgcttggtatatgtgctcaagctctcttctaagtgttttataaaatatgaactcgtgtggtccacataactaccctatgactctggtactattatcttcatttaataggtgataaaga

SEQ ID NO: 7326 - DNA, 1059 bp, Homo sapiens
cccctttttcattccttctatttctgttgctcttttctgtcccataaggagtcctctgcccttgccagtgtaaattcccccgacctgtgctcctccactcttccctcccacacactgcagacttgggtttgcagaaggctgggggaatcatcagacaaaataggaaggggaaagatcaaaggacgtaaagaaaggaagagactgtgaatacaggtgttcaaacatctattaaagatgtatgtttaattcatctttgcagtgacccccagaggtatgtgatccctttacacatatgagaaggttgggttaagaggttcagtgatgtgcccagtgactgggagagtcagagtacagatccaagatgctgtgacctcaaaacccatacccttgactatggtttgatagtgatttttctaggaaggagtgaacagtataaggcatctagattccttctcaggtagttgagctatggactaggactttatttcacttctttccagatttaaaaagcaacaatgaccagaactatgagcggggaggccaaggactggagcagaagcgaggcgggtggccatgagaggtagatattaggtggagttgctgtagctagcaatctattctcctcctattacctaaacaacaaatatagggcaattggagactagatttttttctaaatctcatttgcgtatggaaatcaagctcttagtataggattaggtcctctaatccagggcccagaaacacctacaggtaactggcattattcattgtgatgacctggctgtaataacaaaattcataaagtaataattattgtctattaaagtgattgactgttgggagagtttttctgctatattttgtataacaatggagtcaagacagggactcatgaacccttatgaatcatctacttgggagaaggagtgagaaaataactcaggtaaaagggaaattaataactttaaaatcctataatcgaggggttatacaattatgtaatcaaaggatcaagtcaatcccttgattatataatttaccaagaaattagttgga

SEQ ID NO: 7327 - DNA, 1034 bp, Homo sapiens
tctttatagttggaaagaaagtctatagataaaaaaatagataccaaaaaagtgtataccaatttcataatcacttgtaccaaatttgtagttcactttcctgagaaaactattccttttatgtaattatgacaaagagattagaaactgccctcaccttgctccgtgtgttagtgatttgaaaacacgaactgcactttcatttatattagctccacatcaaattcaggattttgtaccaactttctgttgtgcgagtatttgctagttttaaagaaactagtgccttagtttaaagaaattagtgccttagtttgcttgtgaggctcgtaggaaaatgaaaacatattcctgagcccaattcaaaaccaagacacatatatgctacatatttttcagatggtggtttgggacagtaacataaccttattcaatttgtaaaacacctttagatgcctagcccctctgggtgtataacaaagcaatgagtaacagttattgaaaataaagtaaaactcgggaaaaacaatacagttagttagcggcaaaactcaaagagggtcttgggggtacttctcaaatattcatacccggagcacacagaaaattctagacttccaattctacacccttgattgagactgtacttagctaagtaaaatggacagagcaggctaaattcagcagtaaagaataaatcatagttcttcaaaatagtggaatgctggctgggcacggtggctcacgcctataatcccagcaatttgggaggctgaggtgggcagatcacttaagatcaggaatttgaaaccagcctgaccaacatggtaaaaccctgtctctactaaaaatgcaaaattagccggtgtggtggcgcatgcctgtaatcttagctactcagaggctgaggcaggagaatggcttgaatccgggagtcagaggttgcagtgagctgagatcacaccattacactctagcctgggcaacaggaggaaaactccatcaaaaaaaaaaaaaaaaaaaaaaaagttgct

SEQ ID NO: 7328 - DNA, 1175 bp, Homo sapiens
gcttatatgttacctacaaagcctacaatatttactatctggacctttactgaaaaagtttgtcaacctttctttagtggtttaccatttttattcaccttttaaaagaacctacttttgactttattttctctatttttgtctattccctgtttcattaatatctgcctttatttttaattactttatttattgtacttatttgtgtttaacttttgcttctttttctagcttcttaaggtaaaagctgtgttcattggtattataggccaattcttgtcttatataattttttaaaggtatacatttttctttaagcacagttttagcctcatcccacaaacataagttgtgatttcatttttatttaattcaaaatagtttctattttttgtgtgatttaccttggacccagggattatttacaagtgctgcttaatttctaaaactggttattttccagatcccatgttgttattgatttctagtttaaaaccacaaggtcagggatgatattatatgtgatttcagttctttcatattaggctttatgactcagctgtctggtctgtatttgtcaatattccatttgcactgagagaaaactgtgtattctgcagtagttttatgcaatgcttttaaaatgttgattaagtgaaattggttaagtgtgttttttcagtcttttctatctttatcattttttaaattttattttatcaactcctgagaaaggggtgtgaaaattttcaatcatgattgtagatttgtttatttgtagttttttcttcctagagctgtcccttgaacaacacaggggttagagacgctaaccctccatgcagtcgaaaatctgtgtataacttttggcttccccaaaacttagctactaatagcctactgttgaccagaagccttaccaatagcataaacaattagcacatattttgttgttatatactgatttcttacaataatgtaagctagagaaaagaaaatgttattaagaaaattctaaggaagagaaaatataattactattcattaagtggaagtgaatcttcataaagatcttcatcttggtcatcttcacgttgaacaggctgaggaggaggaggaagaagaggcgttggccttgctgtctcaggggtggcagagatggaaggaaacccaca

SEQ ID NO: 7329 - DNA, 1033 bp, Homo sapiens
ttattagtaatgcacaaaactagtttgtggagttttatgagtggcttgacttctggttaatggcatgaaacctacaaaaagagagcaaaagtagagaaaaaattatattcacccaaacaggggaatggccacaactccaaattttaaaatgtaaaacgcacctgcaaaatgctatgaattattgacccatatgtaatatgctgacttttaacacatgcctcttcagatctcaagatttccccccaaataagtgtcatggtcattcgaagcatagtcaacctttctttctttctttctttctttttttttaagagagcagagattaggggaattgaatgggtcttggaagaagtgaagactttgccatcagagacccagttttgcattatgaggcatcagaagtagagccttgggaaaagtcatacggacatgtcattttgttttgtctatagcggccttccagccatttcgtagacatttcggagtgaaaagggtattagagacaatgattgccagattgtaacacaaaaagaaactataaacttttagagatttagagtaaaccagattgactgtttgaatgctcaaaactaaatgacaacgtgttctcagtgtgaaagggattgcaggttgttgtgtgattgtatttgaggtgattccatcacaaaagcaaacagataaattcaagtaacttccttaaagtcacaaggctgttaaaacagtatattgtttcttaataagagaatcaaaaaattatataaagtttttgtttgcctttttctttttcttttttttttttttgagacagagtctggctctgtcgcctaggctggagtgcagtggcatgatctcggctcactgcaaactccgcctcccgggttcacgccattctctcagcctgtttttgtttttcagagacaaggtctcactctatcacccaggctggagtgcagtggtgccatcattgttcactgcagccttgaatgcttgggctcaagcaatcctcctccctcatcctcccaagtagctagga

SEQ ID NO: 7330 - DNA, 1047 bp, Homo sapiens
atgcaatcatagcttgctgcaacttcaaactcatgggctcaagcaatcctcccatcttagcttccttagtagctgggactatatcaccatgccctctaattctttaaatttttttgtggagttgggggtcttgccatgttgcccaagttagtcttgaactccttgtctcaagcaaaccttctgcctcagcctcccaaagtactgagattacaggtgtgagccaccacacccagctccttatttattcctttacattaaacacatatttattgagcatcttttgtgctagccactggatttataatggtaaccaaacaaagctcctgctgtcgtggggattacattctattatatgtgtggaacattgactatacattcaatcagttagcaaataaaatgatttccattgtgttaaaagctatgaagacaagaaaacagtgtgattgaaagagtgactgggtgggagttggttactttagctcaagcagtcaggaatgtagactcggggaggataatatttaaagcaagacctaaaaactgagaaggaggcagcttgcatgaacatatcagacaggagtagccaacatggagaacctgagatggaactgggcttcgcctgagaaaccaccttaaaattttcaaatattttccatatagaatttatcattgtctcccttgttagtaataatatttttgtatcactcgatagactatatcacaaatcatcttttaatctttctgtgactattaatttcttaataaatatacagatggtcccaacttatgatcgttcaacttagaaatttttaatatttgatggtgcaaaaatacgcagtcagtagaaactatacttcaagtacctctacaaccattcttttcttcaatttcagtacagtattcaataactttcatgagatttcaacactttagtataagataggctttgtgttagatgattttgcccaactataggctaatgacgtggtggcttacatctgtaatcccagtactttgggaggcagaggcagaaggattgctggaggccag

SEQ ID NO: 7331 - DNA, 1059 bp, Homo sapiens
aaatactgaaggaaatcagtcataatcctcaaatcagacagaatattgttgaccttgggggcttaccaattatggtgaatatacttgattctccacacaagagtctaaaatgtttggcagccgagactatcgcgaatgttgccaagtttaaaagagcacggcgggtggtgaggcagcacgggggtatcaccaaactggtgagtagccgtgatgttgtcatcgtcatctagtgccagccgccactgcacacagctccttgctgtcctttctggccacgctggaaattccatagccatgagagcgtgttccaggagccttctgtctgtatcgcttgcccttaagaattatttttgcatatttatattagtgagtgtccaaaacaaaaacatcttcaaactcattttttgaagaaataggacagttttaaagcagatgtaactgtcaccacctattgtacgttgttaggaatgcatccaagtatacatgcatgggaggtaagagatagtgagacctgctgctcggtggaatgctgaaaactttaaaacgtcaaaagctttacaacttaaaagctgttgacatctatgatgccttttttttttttttttttttttttttttttttttgagacagagcctcacttctgtggctcaggctggagtgcagtggcgcgatcttggctcactgcaacctccgcctacggggttcaagcgttcaagcaattttcctgtctcagcctcccaagtagctgagactacaggtgcccgccatcaagcccggccaatttttatatttttagtagagacagagtttcactatattggtcaggctggtcttgaactcctgagctcaggtaatccgcccaccttggcctccgaaagtgctgggattacaggtgtgagccaacgcacccagcctgaaaagtatatttaatagcaaggaataaaatgtataatatttaatattgtataaaatcatgacaggattaaaaactgttatctatgatcccagtttttaaagatgtacctaccatctttaaaaaaaaccactagaaataaacac

SEQ ID NO: 7332 - DNA, 1060 bp, Homo sapiens
gaagccagaatgaatacactactccagggggtggcaggctggattcctgggttcctcttacccatggacactactctaaatgcaaacttgaatgagtcctgtctcctcctggactctcctccgtatcttgctctgcaatagcccaaatgaatcattcttccactttgctctctcttctacatttttttccttgcccccacctcatactacaaggaaatgaattttcttatatcctcaccctatgcaccaaagcttccattctctcctttcttgcagttattgaaacttttcagtgacagcagctgttctccttcagatcttcttttccctaggctctgtgtaaccacagggcatggggaccgtaggcagaaatctcctctttattgcttcaaactaccttactcttcagattagacctcctttcctatgaggctagtgtaaccctctgtctttcctggttgctgttttctatggatccattatcactgacaattttgacattgactgactatcactttcatcctatgtcccatcatcatcttgaaaaacctgaaaccccaagaggaaaaccagtaccaaatcttggcctacacactccctggtttcagtcttactgactgttgcctcctgtccatcaagctgctgctactgccacttcctggaattatcaccagaagtacccttcttccaaaatcttaacctagactgaagtcatttgttcattcacttattcatacttgctttaatttattaattcttctagcaaatatttattgagtgccttccttgtgctaggggagacagtataaaagacagaaatggtccttacctttatggaacttactaagacactacaagaaaacgcagaaataaaaattttctgatggtgaccaaagtggacaaggtactgagctacaaaataatgggaacttaggtaattactcatagaccacagatttgattctgttcttgctgaacatcgaggtaaagacaaaaacctaaccagttacttaatttatgtggtccctaaaatgaaaacagatcaaatcttcaaaaacaa

SEQ ID NO: 7333 - DNA, 1104 bp, Homo sapiens
gcatacggtgcaacgggtccgcgggaatcttggatgcgcggaggtcccgagaccagggtaacggactgggctgcggtcgcggccgggtgaggctgggagcggaaggcggcggcggcggcgcccgggggagggcacgggccctgtaggcctcccacaagggcgccggcgtgcgcggccgcagggcgcgcagtgttgacccgcgtcctagcaacaggcgggcgccgactgcggggggcagggtgctgcaggtgagtgcggctgggggtctccacgctcacccccgcaggggttctgcagccgcccgcgtggatcgggaaacagaggcggctctctggccccgccgctgccgctctcgcctgctcccctttccctcccggggaccaagacccgcccccttcccttctctctcccagccccatctcactccttcctccccgcgagaccctgcctcggccctaggttggggaccgtctgctcctcagtccctgcgcccctctctgcactacctcggccccatcacctcccggatccgctctccacttctcccgccgcttccctgcctctccttcccccagcccgtctttctcctccgccctttgcagctctgcctcccgctcccagcgtggttttcgccgtcccttccctcctcgtccccttaccgaatccattcctggaaacttagggtctcagctctgacgcccccttcttgtaacgagtctggtgggggccgtcatcccacactaggcttagctttggttttacttagggccctgttcatgtcatgtctaaaagttcgattttctgtcggtcttactgagtaacttctgcattctcagaaagcagtgtatgcgcggactccccgtggatgttaccaaccacatttcatagatctcagagctgatggctgcctttccgtagccccctaaagaattcggttgtgcttctgtttaagtgttaacgatgtgattaccgaatgggtttcatttcactaatgatgctggaagcttgaaattgacctttagaaagaaaaacaatctgtggtatctattggataaagagaaaaatgagtgctaagtgattcccagtttatgtaaacatcccagt

SEQ ID NO: 7334 - DNA, 1050 bp, Homo sapiens
ctcatcctctcttgcttaccacgatgtaagatgtgcctttcgcctctgccatgagtgtgatgcttccccagccgcatggaactgtgagtccattaaatctctttttctttataaattacccagtctcaggtatgtgaaaactgacaaatacacatatctgtgggatggaaatacattgtttatgagggtggaaatagaaggatatcagaattcacatgaactagggaatggcatagaccatcagcaagggtagagctgcatccaggacccatctcttgcaaatatccaggaccatatattttgtatcccaacctcatttctagatgtagtttctattcttgtggattcttttttcctattgagatctctttacttattttacattttattttttttagttatgtttctgtgtgtttttgtaatctggtttaagttcattttagaacaagatatggcacaaaaacttgcttaaatactatatttctttctttcttttttttttttttaaattctctgagacagagttttgctctgttgcccaggctggagtgtaatggtgcaatcttggcccactgcaacctctgcctcctaggttcaagtgattctcatgcctcagcctcctaagtagctgggactgcagccgtctgtcaccagtcccggctaatttttgtatttttggtagagacagggtttcaccatgttggccaggctggtcttgaatcctgacctaagggatccacctgcctcggactctcaaagtgttaggactacaggtgtgagccactgcgcctggcctatatttcttttaaataaggctgtagttctgttttctccagaaatctttgtttttaactcacaactatgttagatttctaggataagaatatggaattgttagtaccttttaaatggttgtgttatgtttacccctaccctttaaagtaattgtgtgtatatttgggaacaggaggaaaaaatgtagcaatctgaattttattctttttggtattttgaagtatttcaacaaacccaaattgatattttccagat

SEQ ID NO: 7335 - DNA, 1027 bp, Homo sapiens
gattggggccgggcgtggtggctcatgcctgtaatcccagcactttgggaggctgaggtgggtggatcacctgaggtcaggcgttcgagaccagtctgaccaatgtgatgaaaccccatctgtactaaaaatacaaaagttaactggttgtggtggcatgcgcctgtaatcccagctactcgggaggccgagacaggagaatcgcttgaacctgggaggcagaggtttcagtgagtcgagattgtgccattgcactccagcctgcgcaacaaaagcgaatctcttatctcaacaaaacaaaacaaaatctgattaaaaatgactttataataagctgggatggggaggtggggcagttgcagataaagtaagactggccataaattgaaggtaggtaagaagttcaagaagtttccttgtagtattatactctttcctccagtttagtatatgctggaaatactctctatgttaaaaaaaaaaaaaaaaaaaggaaagtaaaaagactgtaattcgtgagtggggccacttagtaaaggatatagggcatcaatacaaggcatacttttattttgttattgctccaagagaaactaatagaagatctttatgtactgtatgtatcaatagtagcgtaatagcattagaaatcaatggtttggctgggctcagtggcacacgcctgtaatcccaacaccttgggaggtcgaggcagatggatggcctgaactcaggagtttgagaccaacctgggcaacatagtgaaaccccatctctacaaaaaatacaaaaattagctggacgtggtggcacatgcctatggtcccagctacttgggtggctaagatgggagcattgcttgagccagggaggcggaggttgcagtgagccgagattataccactgtactccagcctgggtgacagcatgagactctgtctcaaagaggaaaaaaataaaatcaatgtttcggcctttttgggaagaagtaaatcattatctgtcatgtggcttactgtagtgactt

SEQ ID NO: 7336 - DNA, 1046 bp, Homo sapiens
aaagatttgaaggtgatgaggtagcaagctatacaggtgtctggaaaggaatgtttctggcaaaggggacagcaagagcaaaggtcctgaggaaagactgcctaatgtgttcagaaataataaggaaagctctgtgattgaagggcagtgactgagagggaaaatattaggaaatgaggtgaggttaaagaagtgggtggaggaacagactgtgaagaatcttataggccattataagaagattggcttttattctgagttaattgggaagccattgaaaagttatgagcagaaaatgacatggctactgtgttgaaaatatctgtattgcaaggcaaggagcagggaaaccagttaggatcctacagcattgcctaagtgcttcaggttactgtttcaaagcggaaagtaagcttctcatctaaggccattttctctatctgtcctttcttgccacccccccttcagttcaccttatattatcaattatcccttcctttgtatattcaaactctctttcatctggattatttccactgatctttaaacataataaatcctaccaccagaaaaccctttcttgaccgtatactcttaactgctcacttcagccaaacatctgctaagtcttatttgtggtacctcacttgtttcattctttactctcgtattgacattttaggtcactattgtttgacatctgcccccgtaatattagcaaaatagatttccctgaggcagtagttcttaaagaggcagtgctgagtctccagggggcatttggaaatgtgtggcagtattttttttttttatcactgctatattttcagtatgacttaagggtgaagggtgctacagatatttagttaccagaagtcaaagatgctaaacatgtagcaatgcgtaggacagttctttatatttaagacttgtcctgctcaaaataccaatgttgtctcatttagaaatagtgttaaggtcacaggtcacaaacaacttctttgcacctatgtttaatgaacatttttttcactctttcttaatct

SEQ ID NO: 7337 - DNA, 1051 bp, Homo sapiens
tgactgcaccactgcactccaggctgggcgacagagccacaccctttctcaacaacaacaacaaaaaaagtgtatttaaaaagcacaacaccataatgaattgacaagtggtattatatgtcttcaaacctaatcccagtgaaataaatttctgaatttctctctagcatatacatttttaaaacaataagttggagaaataaatgttggcacagattttacatatgtttcctctgcctccacttttgggggctcaggggttggattagtgatgactgaccggtctatagatgtttgctgttttgcagtgaaaacccatcttataactacagtcttaactctaagagcagaagatctcaagatatcatctggctgatcactttgccttcagataaagattagaacctaatcatcccttacagagtgtctacttttttgttttctttatgtataaaggcttttggtgaaagcggtctaacagtcatctggcatctatacatttggacatgtaaaagttgttaggatttagaacagctttcagtggaattgcaacaagtgcatccagctcctggttttgtactaaagtagctggtccacgtcatcactcagttcttgtccctctgcacagcatggagtgacacttgtcaacaagcagtttatattttcaatgctgtacttaattcttaacacagtggttaagcattgaattgcacatttaatcaaacttgagtatgttttccctctcgggattaacttgaaaagacaaaggtgttgagtcagttatgaataatttctgactgtaaatattgtcactgtaactgaacctcctgcgttgtgtttccttattcaacgtgcccagtgtcttccaactccaacttctcagaagtcaccctggcgggtttagccagtaaagaaaacttcagcaacgtcagcctgcggagcgtcaacctgacggaacagaactctaacaacagcgccgtgccctacaagaggctgatgctgttgcagattaaaggtatttcagagcagcctggcacggtgactcagggcc

SEQ ID NO: 7338 - DNA, 1042 bp, Homo sapiens
tgtcatttccaacagcaggcgtctgctggcccctcttgccctctgcacactggactgagttgcactgccttcgttcctggctgcaggcgatgcgccaaactcttcccatcaaataaaagttgatgaattggaccctttatatttggaaatgaaatgactttacatacatcttaactttttatttgctgtgggcaaaattgatgtgatgcagaggatggggaggtggggtgatagttttaggagtagcaaggctgaaggatcttactggagaaacagatcagtccaagcctagaccgagatagaggtcagtggttacagcaagacgtacaatagcggtgccaggtacctgcctgtcccctccaaccaaaactcaaaccaaaatgattttagaaaattaagttgattataacttttattttcttttagaaatttctttttgagctgcaatgtgtttccagcctggtgttgaaaaattcttgcagataggctcataaagttttgagctggtaaacattgtaactagcctgtagaatttcctttttttctttctacattgtaagaggagacagggcagtaatctgagtgttcctcctttgacttgctttatgttgttaaaacaaggttgtccttacccatgatgtttctctaaaataccttcagcctggtataattactcgttcatattctgcttggcatcatactcagtcgtgtgttgaggaatgaatgtgtggactatatattacctagcctacctgcggtttaaggtttttaatggctatgttgatttatgattcattttcgtcgttccttagctcattacttgcacttactaggagctcaataaatatcagcagaatggacctgaattagtacttgtaactcttgtgttggtcacattattcagtgataattttaaaaggaaaatgtgtaatagcaactaaaaatgtgatcccattgacttattttattttatttttatttattttaattatcttctttatttgaaatgtgttgttttacatagatgctatttttatattag

SEQ ID NO: 7339 - DNA, 1690 bp, Homo sapiens
cagggactcatgcctgtaatcctggcactttgggaggccaaagcagaggattgtttgagtccaggagtttgagaccagcttggtcaacatagcgagaacgactcagaaaaaaaaaaaaaaggaaaaggaaaaaggcgattcacagaatgggagaaaatagttgcaaattatatatgtcataaaggacagtatctagaatacataaagaactgttaagactcaataataaaaagataatttgattaaaaaagggcaaaggattggaatggatagtcctccaaagaagatatgctaataactattaagcacatgagaaggtttttactatcattagccattagggaaatgcaaattataaccacaataaaaaacacttcatacccacaaagacggataatgacagttgtttgtgaggatgtgaagaaattggaatgcccgtgtttccaaagcaactgttttggaaaacagtccagcagttcttcaaacaattaaacacagatttaccttttataacccaatatatccactcctaggcatatccccaagagaaataggatacatacctatacatatacctatacctgtagtcccagctgtacaaaaataataatatttctagcagcattattcataatacctaaagaatggaaacaacccaaatgtttgtcaactgaagaagagacaaataaaatgtggtatatccatacagtaaaacactattcagctttaaaaaggattgtagtgctgacatatgctaaaacatggatgaaccctgaaaacatgctaagtgaaagaagccagacaccaaagaacacaaactgtataattccttttatgtgaaatttctagaacaggcaaatccatagacacaaagtagattaatggttgcctacgacagggggtgtatggtggcaaattacgagtgactgctatgggtctgtggtttcttccgggaatgatgaaagtgactagaattgagtttctaatggtcgtacaattccgtgaatatattaaaaaccattgaatgatacattttacattagtgaattgtatggtatgtgaattttatatcagtaagcctggtgtgtgtgtgtgtgtgtgtttgtgtgtgtgtcttacatatattggacggttaactgtcagcacttcatgatagatgagacttagggagtgaggacaagtgaggaattaagaatgacctctaaattttggtcttgagcaatttctcagaaggagatgaaagactgagattaggagggtttctttttgctttgttttgtttttgttttatggagagggccagctttgagaatcaagagttctattgtggacatattaagtttgaggtgtctattaaatatccaaacaaatcttaggcagacagttgaacgtgtgtctagaactccgaggagtaatctagactggagataacatttagatgataggtgaatctgcaggaaaggatgaaaacagagagagagagagagagagagagagagagaatgcatgtggcacaggatgaggtagaataggagaggggagttacaaagcaaactgagaaggaatggccagccagggaggaaggagaagtaagagagtgagcacaaggtcactgaactcaggcacaaagtaagtcctaccgagaggtagtcataggaggacagaaggatctattggaattgccaagatg

SEQ ID NO: 7340 - DNA, 1053 bp, Homo sapiens
aataatttgttttctaatagcatgaaaaagataaaaaacttaggaataagtttaacaaaagaagtgtaaaacatataccttaaaactataaaacatcattgaaagaaactaaagaagacctaaataactggaaaaacattccatgtgcatggatcagaaaacaatattttaaaaatgacagtactcttcaaattgatctacagatttaatgcaatctctgtcaaaaatctcaaatgaatttttttaattgacaagtagatactaaaactaatatggaaattcaagggacccagaatagccatgacaatcctgaaacagaagcacaaaataggagactcagcttcaaaacgtattacaaaactacagtaattaagatagtgtggtactggtattctattctattctatagaatagaattgagtctagaaataaactcatacattatttgtggtcaattaattttcagtaaatcagtggaaacaatacaaaacaatgccaaaacaattcaatggggaaaaataatctcttcaacaaattgtactggggaaactgtatatccatctgccaaagaaaagctggactcctacctcatatcataaacaaaaattaactcaaaattaataagaggcttaaaggtaagccttaaaactctcagaaaaagcatagatacaaatttaatggccttggattggatttttttaagatatgataccaaaaggacaagtgacaaaataaaaatagataaatgtatcaaaattagaaaactttgtgcagcaaaggacaatatcaagaaagtgaaaagggctatgcattagtccattctcgcattgctataaagaactacctgagactgggtaattcataaagaaaataggcttaattggctgatggatcttcaggtcatataggaagcatggttgcagaggcctcaggaaacttacaatcatggcagaaggtgaatgggaagcagacacagcctgcatggctgaagcaggaggaagagagagaagggggaggtgctacacacttttaaacaaccagatctcatgagaa

SEQ ID NO: 7341 - DNA, 1084 bp, Homo sapiens
cagcagattaatcacagcagagtatccagtttcattcgtacgtgtggttgtcttgtattgtttgctattttctttctcagatttttcagtagagactttgtcctttttcagagagagttcaagtggatggccttgaggacttgaaaagctgagatatgatgattttgaagtcatttcacatcgaagccatgatttaaatatcggcgttaaggtaagtattgaggaaagaaatatgacacttttgtggttaacacattattggctttgcttgcactgttagaagagattaaagcacattgtgaagggtgattttgtttgaatcatgttcaacaaaccagagctcgaagaagattaaagcggcctctgtgatgcggtgtggaaccatagacatacaggagagctgagccactgtgatggttggaaatgtcttcatttttcctcgatggtcatgtgtcccagtgtgccctttatgaacttcaggaaagaacaggaaagcttacagctgtggttttctttctgagctgagccgtggctattagggagctttcggggagtgtgaattagataggacctttacataggagcagagccagccaaaggagtgagaacaggagcacccttctggaaactgtgctatttgacctgcctctctggagcaggagttctcaaagtgtgttccctggaacacagctccctacaccactaatacagtggggacctgggtcagaggatgggtctatgcctaagtgcgtttggaaagcattggattaaagttaaatgaccttcttcaaaactaatgagctttgtgaatcttgatgggtgtgagtagtgggcagtgctcaccagagttccatggaactattttcttgtgaggcatcttaagaccagtgttccatttgttcattaaatattgattgcgcaccagccatggatggtgttagatgctagggatgcagcaaaaactgaggttgacagtgctcatgtttagataataaatacattaacaattaaggaaaggtaatcattgagagacacaatagcaaatgtttaagagcctggtatctgcagctcagtggcttgggtt

SEQ ID NO: 7342 - DNA, 1025 bp, Homo sapiens
taagatgaacacagaccttaagactgatagaacagactctttaagtctaataagaaacctttacaatcagttttctgaagcctgaagcctgctacctggaggcttcatttgcatactaacaccctggtctccacaatcccttatcttaaccagacatcccttcttattgattctaagtcttcagacagtaatttaactctttcagccaatttccaataagaaaatctttgactccatctatgacctggaagccctcacccccactcccagcttccagttgtcccacttttctggaccaaaccattgtacatcttacaagtactgattgaagtcttatgtctttctcaaatctataaagccaagttgtagcccagtcaccttaagcacatgttctcaggatcccctgagcctttgtcatgggcccttggccactcatatttggctcagaataaatctcttcaaatgttacagagtctgactctttttatcaacacctgacttagaatctcagcaccatctttggacccacctgctctgctacctttgagcccttagtttctgcctcccttggccaactctccccattaaccattctatgaggacaggtgaatagtcattaaacatgaggtgaagcacagtgttttttgagaacatctgaatgtcctgtgaccattcctgtagctaacatacacttgaacctagaaaagcatatctgaattgtaacagaatttgtatactcctctttcttcaccaagcctgtctaattccaggcagaaatgtttctccttcttccttctaaatgcaacatcattttgtcctttgcatgtttcattggtttggttccttttattaattatgtaataattatggtttggttccttttattaattgtgtgtaaagggtatctcctcactgatcactagacgataagctccaggaggaaaaggatttctttctgttttggttgctactttatgccaggaacctagagcagtgtctggaacttagtaggtgcttcataaaca

SEQ ID NO: 7343 - DNA, 1051 bp, Homo sapiens
caggcatctattctctcccatttttccaggcatctctaggaacttactgccctttcaacgcaaagtttaaattttttatttgaagaaccagccaatgagaatgtatttggtgatgtcttcatagctgcaaccttttctatgtatgcgtgcctgtgaaggggtaggagggagaaaccttctagattgttttcttttttccttcctcttctctccttgcctttgctcctctcccccaccccccatccccaaataaatacacaaaacagaggtcctatagtgtcatgcttgagaattatggattcgggccaccctgcctggtttgaatcctgacttgtctctaacacctgggcaagttggttagctgttctgagtctcagtttcctgatctgtaaaatgaggatgaagacagttcttacctcacaggattatgatgagggttaggtgagttaacatatggaaaacactcggagtgcctgccattaacccatttatgcctgaggttgcagtctttttgtgtgaaaaatcggaccttggcgatgaccttgaggggtgggatataaataactcccacaagcttagcgttccaataatggaacactaggcatatatggttaaggactatgtcagcgtcagtgaccatgagacaaaaaccatatgggtcatagctatttgggagtagttgttaggaaaaagaattttagaatggagcattctgaaatactagtgtttctatatttttacagtaataggaaaaaagtcccgcctgggcacagcagctcacgcctgtaattccaacaccttgggaggctgaggcaggaggattccttgagcccaggagtttgaaaccaatctgggcaacatagggagaccttgcccttatattaaaaaaatatatttttatatatatatcatatatacatataaataagcatttatatgtattgttatatatatataaggttcagagaaagtagaatgttattgtattccgtgtgtagcaggaaaaataatcatcacagatctctcctgaacatttggtgtatgccaagca

SEQ ID NO: 7344 - DNA, 1036 bp, Homo sapiens
taaacatttcaaaattatttgtaagacaacatattttgtggcacagtttggtgcatgctcagttcctcggtgaacacacatacacacacacacgacactgcaagtttagggagtggcgtgagctctacaacttggaaaacttatgagaaagcacagacgtggctgagggaggagtggttacgattttgagcatggtaggctgaggcgcccagcccactggagcaggaagtaccagtgaactaggatattaatgaacagttcaagaacccacctgaggctaggcacagtggctcatgcctgtaatcctagcactttgagaggccgaggcgggagaattatttgatgcccggaattcgagatcagcctggccaacatagggagagaccccatctctacaaaaaattaaaaaattagctggggtggtgtcatgtggctgtggtcctagctactcaggaggctggggttggaggatcacttgagcccaggagtttgaggctgaagtgagctgtgatcacaccagtgcaccccagcctgggcgactgatctagaccctgggctccttcccccaaaaaaacaagagcccacctgacagggactttggaggagagacttggcctttactgttaactttccccaactgtttgtcagggccactgaggaatcccatttgggatgagaaacaccccacattgcagggcacggctacctgaaggcaatcctgagaatccccctggacgttggtgtctggatccttctgatgcctgcctgctggttccacgagtctgctggccccaggccaggccctttgtcggagcccccgccacaggggctgctggcgtgcatctggagaaccagctgacagaaggcctgtgttctattcccctccccttctctgcttcacttgccatgaatgagcagaacatgagtggaaaagagtgatgcatttggggtggaagatgcgattgtcaagagcagggtttctggcaccaggtggtggagaaggagaaaggcctgacatctctggagcagtgggggg

SEQ ID NO: 7345 - DNA, 1096 bp, Homo sapiens
ttcattttctcatttatgaaatggggatgataatagtgacctaggttataaatcataagagtataaatgaaataatacacgaaaagtccttagcacagtgcctggcatatactcactgttttaaagatagcttcagctattattatttgtaaacataccacattattttaaactgattataatccatttaatcattattttaaaagcacttctagtctgtaaaatataatttctttggtcttattaattaccactgctactgctgtcactattaccactgctaccacagatatcttcaagcaagcagatgtaggaattaatagaaatttggtttaagggcaaattaatggcatacaatttggagacatttacttaggatacaaaatcaatatgcaaaaatcacaagcattcgaataaaccaacaatagacaagcagagagccaaatcatgaatgaactcccaatcacaattgctacaaagacaataaaatacctaggaatacagctaacaaggaatgtgaaggacctcttcaaggagaactacaaaccactgctcaaggaaataagagagtacacaaacaaatggaaaaactttccatcctcatggataagaagaatcaatatcgtgaaaatggccatactgcccaaagtaatttgtagattcaatgctattcccatcaaactaccactgacattcttcacagaattagatagaaactactttaatttttacatggaaccaaaaaagagcccgtataggcaagataatcctaagcaaaaagaacaaagctggagtcatcacctacctgacttcaagctatattacaatgcaacagtaaccaaaacagcatggtactggtaccaaagcagacatataaaccaatggaacagaacagagacctcagaaataataccacacatctacaaccatctgatcttcgacaaaccaaacaacaaaaaagcagtggggaaggattccctatttgttaaacagtgctgggaaaactggctagccatatgcagaaaacagaagctagaccccttccttacaccttatacaaagattaattcatgatggattgaagacttaaatataa

SEQ ID NO: 7346 - DNA, 1014 bp, Homo sapiens
aatagggattagcttgggacaaggccaaggcagagtttataggtcaactgcagctactcttcctcttcccatgggttactaaccaatgactcaagagcaatctggcttgatcttagttggatgggaatgttgtcggcagaggtagcattctcattgttctggaaggagcaggtttcattttcacaccaatcacgagagtgttaggggaaagctgtcccttagctaagttggctaggaaggttttcaaaaatccatctcaattaatcatcataggctatgaaatgacacctgaaaaatatgaagaaaatggaatgggtggtttgtgtgttgaatacaaaataatgatataaagcattctagaattcagaaaccaacttatgaaccaagatgttattttcagagtggatatactcaccttgcctggaccctgattaaactcctcctctttttttgtttaaagttcaatttatattctgaccgttttctttgtttagagttatattgctttggttcatatttttgtactgccttcacaaaatattaggggtgtttacttagatcttaggtttctcaagtctttttcttccttccttccttctcttttttcttttctttttcttctttttttttttttttttttaatttcagacaaggtctttctttgttacccaggcaggagtgcagtggtgcagtctcaacctcctaggctcaagtgaccctcccacctcagcctcctgagtagctgggaccacagctgtgtgccaccatgcccagctaatttttaattattttgtagagatgggctctcaccatgttcccaaggctggtcttgaactcctgagctcaagcgatcctcccacctcagcatcccaaagagctgggattacaggcatgagtcaccacgcccggccaagcctttttcttttgtctctgatcctcctaaactttcttttatctccaaaactcttgctctgtgctttgtacactgctgcatgttcagatagagcttaatct

SEQ ID NO: 7347 - DNA, 1142 bp, Homo sapiens
gctcagccaatccttctgcctcagcctttcaaagtgttgagattataggcatgagccaccacgcctacatttataaatatttatggaggacttttatgtacagggcagtctgccgggattttcacttatctaatgtcatttaatcacaagtaccacgtgaagtaggtagtattactcccatttcacagatgagcaacatcaaggcttgagaggaaaaatgattggccagagtcatgtatctaggagtgacaggattgagatttaaatcaagatcttctgattccagggtcacattcacttcccagccaataagtaaacggcagtgatgtcaccatggaggtcctatgtgtgtgtaacagtggattctggaactcagcttgaaagctcatgcagtagaattttaagaacaaaactgtccaattagggttggagtttttagtgcccctacattggatttagaggctagaattcaagcatctgcctgctttttgctaaaaatgtttattgtacaaataaatctgtacccaactcctgaaaacaccaggtttttatttttaaatgtgcacaacttccaaaggccggtttggtgctgaattggaaaggattctagttcgcaaaacctggaaaatgaccattactcttgttttctttctttcgttctttttctttaaacagttgtattgaggtataatattgccatgttttcttaacctagctttttggaagaaagtttgggtcaatgttaagccaaaatttcttaacttctagggctttttgatatggtcttgcataagtttctcaaactctcacttttttattactcccagataaatcttttcagtagaaatttgggaaatttttgcattttaaaaactcgtacttgctgatgcagttttttttctttcttttctttctttctttttttttttttttttaagacagagtctcactctgtcacccaggctggagtgcagtcactgcaacctccacctcctgggttcaaacgattctctggcctcagcctccccagtagctggaattacagatgcgcaccaccacgtctggctaatttttgtatttttagcagagacagggttctgctatgttggccaagctggtctcgaactcctgaccaaaggtca

SEQ ID NO: 7348 - DNA, 1047 bp, Homo sapiens
ttattgtttctatttctcatacatacataacttcgttttttgtggctggaagaaaaagtttctatattttgtatttgtctttgttcttctcatgcacacaatttactgttggtgtttaataatttggagctcataaaattaaaagttgtaattttgaccatttgggctaaaaattatatgagggattacatatgcaatggattagtatttcttgatttgcaaaagaagggaaaatgatggtaatttagctcaaattgcctttctttgaagaaaatttctgaatgactgaaaaccaaatatctatattatcactttcaacctcatgtttctgcaaagtacagaaaaactcctcactgacagtgcacccagcccctgactgggttttcaggattatgtccatgtgcataactgcttggatttcttcttttaaagtccctaaaacatgaatctgttctttgagatcctggtttccttagcagagttgtaggttgcgggtttcattcacgtggaaattctaagtagaacttttgctgccccattttactgttggtgaagggccgttgttaatggaagtttacgttttaaaactcagatgactcagaaaccagactgtgatcattttttgcagcagcaaaatgacttattctgacagcatctcggtttggggcttctgaagaaaaaggatgaagctgatctgttgaaacaactactttcccaactcggaggcaaaaggggctgatagaagataacattcacctaccatttcatcttgtgacccccagagatcacgtttgcgtgttctggctgagttttttattattgtttgttttaaatgattaaataatacacaattaaatgtcaggatagcatctcttgcaaagtgaccagtgcagcagaattgtctttctatccatatttgagcttagagaaacatttcccatgtcctaagttcttagaagcaattactttagcgttggggagcattgttctaccagacccatttatgcaggggagatgaagcttaaaagacgggatgtggggtgggag

SEQ ID NO: 7349 - DNA, 1002 bp, Homo sapiens
tttaaacagattaagtgaaaaaaaagtcacattgggagaaacaatttgccgtatgatgaaagtcttgcttctgacttgctttttttttttttgagatggagcttgctcttgttgtccaggctggagtgcaatggtgcgatctcagctcactgcaacctctgcctcctggcaggttctagtgattctcctgtctcagcctcccaagtagctgggattataggcgcatgccaccacaccgggctaatttttgtatttttagtagagacagggtttcatcatattggtcaggctcgtctggaactcctgacctcaggtgatccacccaccttagcctcccaaagtgctgggattacaagcgtgagccaccacggcccttacttggttttttgatccactccatcattgtctccccttccttgtttgacatcactggtgtcacttcggtcatcctctttgtcacacagccataaggaggcatggatagttcagtggtagaattctcacctgatgcgtagccattgggaataagtgagaacatggaggtcaaataagtagcctatgacctgaaacacagcaagtgcttaggaaatcatcttcctctctcctggcccctcatccttcctcactccatttccatcctcctttcctttcactttctgcctcattctctcccttttctcctacccactttctccttccctccctccgagtttcctgccttcccttttctctggtatcatgccttttcttgcaccatgccaaggatggagccagaaataacaccaaaagcagaaactcaagccttggaattacaaggtatgtgcaaaggaattttttgtgatacgcctgcctttcccaaaggactcatctgttttttttttcttttttctttttttttttttagacagagtcttgctctttcgcccaggctggagtgcagtggcgtgatctcagttcactgcaacctccgcctccctggttcaagcgattctcctgcttcag

SEQ ID NO: 7350 - DNA, 1042 bp, Homo sapiens
agttaatgctggtgttttatgtgttttgacattttattgagttaactgtttttatatttaagcccttcatgtacttactcattttttcttctgtgtaataatctatagggaagggagcaaaacaaacctgattcttctcctctgtacattcagaatccatttgaaacttctctcaacataagcaaaaatgtaagtcaaagccagctgcaaaaatttgtagatttggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtata

SEQ ID NO: 7351 - DNA, 1340 bp, Homo sapiens
tatggatctaactgtctgtgaacagtttttctagtttttatttatttaatagaggacagtcatttttgagaatatctttcctttgctcataataagtataattttcatctaaattttccctaaaggcagtgttttatttctgtactgagtccattgtgattcttcgtggcttgcatttttggtcagtcaggttaggctagttgatgctttggtaacaaacaactcccatatctcaaagatctcagtggcttaacacatcacctatttatctgttgctgaggttatatgtcacagcaggtcagcatgggcactctagacattgtagtagctcaagcacccaggctgaccagtgtttcatctccacctgcgctaccatcactgaatagtggaaaggcaaagtgaagaattgagcatcggctcttgaagtttctgcctggaagtgacacttaaaacctctgctcacatttcactggccaaagcaaatcacatgagtttgcttaaccttagaggggcaagaacatgagatcttccaaatgccagaaaggtgatacagaacatatggtgagcagcttcaataactaccacactcctgctcatggttcacagttcaccactttcctgcgcccagttccattaatcagagctattttttcttgtcattttcacttctgttacctcaaggattttattctctcatttatagtacttaatttaaaaaatctctgtcacctttcttctgagtgattctaatccttctgttgcttctgagattgagtccaccatgactcctccctgatgtactctagtactgctttctcacttgacctctttttgccatcctgagatagacccccaatctgtctttgcttttgtttggattcctattcctaacataaattgtgtgtgtttgtattttaaaagagaatggacagggaactaggttatgaaggtaaattataacaaaatggctaaggaagaatcttgaaattttaattttttaaaggaagtttatttttagtccttttaatataaaaatatctaaatgacagatcagtagagaaaatgccacatgtttatttgtagggattgtatacagtgatttatttaatctatttttttctgattataaaatgatagacatagaaatacataagtatctctgttggtcacactgcctccagagataacccggtgaataatttaatatattctggattttttttcctgtgcgtatagaaaagcttttttttttaaaagaaaaaacccagaacataatctttaccgataataactttaacttcattttttttcccccattagtagtgtcttggcagttcaat

SEQ ID NO: 7352 - DNA, 1676 bp, Homo sapiens
ccttctgcctctggagtagctgggactacagtcctgcaccaccacacccagcttgaatactttagatagtctctttaacttgcggatgaaggccagtgggaggggatctttgttttgcctttggatttttctgcttcatcattcttttcagtcttttcagcttctcttaactaacattgttttaaggttccgtttctttttttttgacatggagtctcactctgttgcccaggctggagtgcagtggcatgatcttgggtcattgcaacctccgtctcttgggttcaagcgattctcctgcctcagccttccaagtagctggacttacagacacctgccaccacgcctggctaatttttgtatttttagtagaggcgaggtttcaccatgttggccaggctggtcttgaactcttgacctcaggtgatctgcccacctccatgtcccaaagtgctgggattacaagcgtgagccactgcgcccggcccagtgttccttttcttcatctacttaaattgaataaaattaatgctatgttagaatcatatcatttgtaaattttaaagacttgatattttgtagcattatgataattgttttaatatatgagctaaaatagtatgttagatatatcgtgaaatgtgttctgttttttcttatgtttttggtatagggtctctatgctgtcgtagaattttgccaaaaggaaagcataggttcactgcagaatgggactcatactccaagcacggccatggagactgcaattccattcagatcacgtttcttcaatctgaagttgaaaaaccagacttctgaacggtcacgcgtacggtcaagtaatcagttgccacgttcaaacaagcagctttttgaattactttgttatgcagaaagtgtaagtttttaggtgtacctcaacttttagaactatgtatttttttatgaacaataaagattcctgtaaaatgttcaagctacattattgtttaatgggtatagatcttcagttttacaaggtgaaaagagttacggagatgaatcgtggtggtggatgcataatgagatgaaggaaagtttttttctatttctagctttctaagaatgtcgtcatgctcaacacattgagtagatgttgagttttgacatttgagatggtattgatgactggcatatggtcttgagattgtatatggttcctaatgtctttttctttcccctcctaatgtcttaacgtagtgaattgtagattcactgtagatttcctcatgtcaagtcattcttgcattcacagaataaaccctacttagtcaaggtgtatttacaaaaatgcattattacatttgtcgtgctaatatttttattacaattttaatatctctataaataaatgggattgcttttaaaaattcaaactacaggatatgttgaatgaaaagtgatagtaatccttgtctgctccttccccgccatgccccatttgtacttacaggtaaccacattcttctgaagttttcggccttttgaacagtttaggttttctttctctttccagcataatgacataaaattgtacatggttttctgtcaattttaaaatgtcttctttctgattctctctctctttttttttttttttttttgagatggagtctcgctcttgcccaggctggagt

SEQ ID NO: 7353 - DNA, 1068 bp, Homo sapiens
tattgatatcagacttggtggtttatgatctctagagtctaccattccagactttttaaagaaacaccttaaactacttaactggaagttaaaatcttgggggaaaaaaattagttgttaacattcaggtttgtgctttaatactctcttagaacttgaataatttttttctctctatacttagttcatttgttgaccttcccattgtggctagtgggttattaatatttaattcttcactgtcacaattcttgtcttgattccctgtgattgtaaaactcctagcctctttctttccttagtaaaattatcagggagctcttcatgggcagtaacgaggttttaaattctttgatttccctgatacagagcgcatgatagttggtaactcactgttaattgtttgagccagatcaagacccttgagaaagaaaaatgccttaatagcttatgtcaaaacaccgaatttccaaactcattgtctcattacactcaggcttgtaataatttcttttaggctttggaatgttacaatttgcacaattttgtgtgtgcatatttgtacaagtattaaataagtgattttagtttcctggtttttttttttttttttgtggaactccgttttcagcactttgcatcaagcatagtaaatcaaaacagagaaagtgggcagttttaatagtagtcatgggagagtagtcaaacgaacactgaaagtgcagtaattccacctcatccatgttttcactgtccacagtttcggttcctcacagtcaactgtggtccacaaataggtgagcacagtacaatatgatattttgagagagagagagaccacattcatataacttttattacagtatattagaattgttctatttcattattagttgttgttaatctctgtctcttttttttgagacagagtctcgctctgttgcccaggatggagtgcagtggtgcaatctcagctcactgcaacgtctgccacctggtttcaagtgattctcctgtttcagcctcccaagtagctgggactacaggcgcgcgccaccatgcctggct

SEQ ID NO: 7354 - DNA, 1030 bp, Homo sapiens
attttcattttccttagctgttttttggtggccttataatcttgggctcttctacatgggatgttgatgatgggggtgatggtcaccagcagctccacgttcacatgcttgcggcttccgattgatcacatgcccaccctttggatgaagaggaggtgtccaaaatagtctgataatccctatctcatggggtgggggataagtgtgacagttccaccacaaccacatagagtggttttttactagcaggggtgtgctgttaccagaactgttacctgaacaggtttagctgttgtttggatgccagcagccaaaccaacaacagctaaactgcaggaggctacccagcttattaggtatttgactttgggcagtttttttcacctgcagtgatacctaccctgtctatcttaaaaggttattgtgaatttcagaagagtgtgtatgtgacagtgcttggaaaactattaagagaaggtgctatattatgtttaaagccagtgctcagctctcagattcttacagttttttttttccaggctgtaaatcctctctttatctgtagtaattgtatattagagtttctagactttttgttattcctctctggatgctctctggcttatctattatgtccagagtagaacatgtactccatatgtggcctgattagtaagtaccaaagaagtgttattaccccttaaatttggatttttaaaaacgtttgtctcaataaggcctgaagttctttatatgaattcattctcttcctatcctcaatccagaagttaagacattcctatgatgcatcagactttcaggcctcttttataaaactgctaggttaatttttcccccattacgtgcatgcatctttattttgtttttaattctaaatacaggatagtattctgtctttttttttttttttttcttttgagaaggagtctctcagtcacccaggctggagttcagtggcgctatctcggctcagtgcaacctctgccttctagcgattctcctgcctcag

SEQ ID NO: 7355 - DNA, 1049 bp, Homo sapiens
tttttttgagacgatgtcttgctcctcccctaggctggagtgcgatggcgcaatctcagctcattgtaacctccgcctcccaggttcaagcgattctcctgcctcagcctcttgagtagctgggattacaggcacctgccaccatgcctggctaatttttgtatttttagtagagacggggtttcaccatcttggccaggctggtcttgaactcctgacctcaggtgatctgcctgccttggcctcccaaagtgctgggattacaggcattagccaccatgcctggctgagttacatttctaatagctatttagatttctgctaatcacccaaatgcttaaccagaaagtggatggtttgtttagatttgagggattctgtagtagagagggaagagaaagggggtaacatttatcaagtgcccactttgtgccatgttctttacatgtatttttccactttaactccattttgcaaatgagcaaatcgggctttagaggtttaaaaaaaccgaagtcataagtcgagttggcaatagaaactggatttgattacaggtctggctgtctgactgtctcatcatcctggtcttagaaatcttcatggcttttatttgtgaggtaagatcagtgaactcagaattaggaggtttgagtaccggcttcacctcttctatagtttggatgtttgtcccctctgatatggtttggctgtgtccccacccaaatctcatcttgaattgtaatactcgtaatttccacatgtctaaggagagacctggtgggaggtgattggatcatggggcagttcccccatgctgttctcatgatagtgagtgagttctcacaagatctgatggttttataaggggctctcccctcctcactcctcatgctttctcttgcctgccaccatgtaagacgtgcctgcttccttttgccatgattgtaagtttcctgaggcctctccagctacatggaactgtgaatcaattcaaccttttttctttataaattaaccagtctctggtatttctttatagcaatgtg

SEQ ID NO: 7356 - DNA, 1029 bp, Homo sapiens
gcctcttaaacttagctcctgagtcctagattcagctatttctcttagaagccctactgtttaaggggtgatcatgttttctctcagccctttctgtagacagagatcagaagtatgtgcacatattgaagataaaataaaaatatttcataagtttatattggtgtttccaattcaaacttgagactatggtggagatgatagtgtgtttaaatcttctttctgtatctctttcctctgttttcaaggatatgagtgcttatagaactggaaagtcctacaattatgtattttcatcctatagtgcacacacaacagtctcagaatgacaacaccacaatactactcaaaacattaaaatccatatttttgcatacattctcgcccccttaatcacatttaggactggagatgtcttctgagactttagtttattcagcaaccatttagagcatcttctctgtctcacactcactgctagaaaggggatacaaagagatgtaagatatgtccctgttctctgaaagctaagggtcagggttattgggttatgtatcattctggtataggaagatgtggccatagaatctgggattctgttcttctttaaaagaagttaatgctaatgttaattcttctttacttgcatgtttcttaaaataaaaccctttctctctactcttatcagggagcagcttccttttggtggagctccttaaatactttctaatctcccttacgtagtatattattagtcagggttctccagagaaacagagagagaacaagagaaagatatagagtttattttaaggaattggctcacaggattttgggagttggcaaatcaaacatgtagaatacagcagcaggctatatacttaagtaagagttggtaatggtcttgagtgtaaaaattgcaaaataggctagtaggctggaaactcagcatttctatgttaccatcttgatgtagacttgcctctttttcaggtaacttttatcttagctgttgaggccttcatctga

SEQ ID NO: 7357 - DNA, 1064 bp, Homo sapiens
tgcagaaggtaaacaataaaggataaaatacctagctttaaaaatactttaataaccatgagcttatgatcataatcgtcttcattactagctattgttatcattagtaatacttgatttttttttttttttttttttttttttttttttttttttttttttttgagacagtctctctctgtcacccaggctggagtgcaggggcgtgatctcggctcactgcaagctccgcctctcgggttcacgccattctcctgcctcagcctcctgagtagctgggactacaggggcccgccaccatgcccggctaattttttgtatttttcttagtagagacggggtttcactgtgttagccaggatggtctcaaactcctgacctcatgatccacccgcctcggcctcccaaagtgctaggattacaggcatgagccactgcgcccagccaatacttgatattttaaagcaagaaacagcagctgttaaggtcactccctttgtaaaatggatctatatgagtttcattttctttaataaatgaaactttaggctgaaactctcaaattcccttatctccaacatgcaaagttaatttcatccacatctgtcttgtgaaagtatctttctttctatatcagttagaatgctttcagctggtaagtgacagagacccaactgaaagtatcgtatgtaataactgcattttattgtctcatataactagaaatctggaagaaagatagtttttttgttggcttatatagcagctaactcttatcatcagactctctggctctgtcttttcattctaccatcctgataagttggcttttgtcttcagacttttcccctcctcatctcaagatggcagctttaactccaagaatgacatactcatatcaaagcacccatgactgtaagaaaagaaggtgtctctcttatgtctttttttaaaatgaagaaaactttcttagaagcctcctagaaaacatgacctcattagctaaaattgcatcctatacccgtttctaagccagtcagtggtgaggggtacggaagtcctgt

SEQ ID NO: 7358 - DNA, 1015 bp, Homo sapiens
taggaagttagtcaaaaggctatacattccaggcccttaaagaaaacctgcattacttgtttggggacttagaaggtatctactagtactttaaattagcatctatgtttattgctgatacatcccataaatgttttctgtccatgttatgtaccttaatatactactttgtaattcttttgtaggggtcatagccatttcagggccatctctaaagacactgcaaaggacacatgctctagctgctctcttctccgtattgttatataagggaacctgaattaaaatgaattaagagtttggatgaaagggcattccctagccatcttagcaaagggagtgggagtaggattggaagagggaggataatggcctgtatgtgaatgtttatgcacatcatgttttttaaatcaggtctagctagtatcaagagctaaatattttttaatcgtatttttgaaaagtagtagaaaatagaacaatattcagatttgtgaaggattgatgactcagtattagagggaaaactcaccaaggaaaagatctaatagttttgaacatataaaatgtaaggtttatttacaatgaaaaaaatcacacaacacactggaggaaatgcttgtatcaaatgtgactaagggtgaatatctataatatctgaagaggaagttctctcgaacttaatgaagaagttttaatacataagtaaacaaagtattttagcagttaatgattaataaaaaggtgggattatgtttaccgtcactggtaatcaaagaaatgccttttaagttaaccttgagttatctcttctattctttcgaaaatactgaaaattaaaataactgacaattctggagaggctttaaggaaatggacccattcagtcttatgtgtttcttgtgctactcccagccactgcctttccctgaacatgctgtgccattttaaattcttacgtctcatctttatgagtccttcccctcttctttctgttgactttccatctcttgag

SEQ ID NO: 7359 - DNA, 1050 bp, Homo sapiens
tggcattgagtaaattctagaactgagtcagtgttctttctgctgactatttggtttcagtgctattaagtgtgttctactattaatagaactaacactcttaatagctatttaaatgcttcctatatactaggcactctctgttaggtactttatatatgttatcttggttaatctacacaaagcttatgaagacagttcattttacctgtgtattagttttgtattgctgctgtaaaataaaatgaaacaaacaaacaaaaaacaaaagatctggccgggcgcggtggctaacgcctgtaatcccagcactttgggaggccaaggcgggcagatcacgaggtcaggagatggagaccagcctgaccaacatgatgaaaccctgtctcaactaaaaatacaaaaattagcagggcatggtggcgtgcacctgtaatcccagctactcaggaggctgagacaggagaatcgcttgaacctggaaggtggaggttgcagtgagctgagatcacgccactgcacttcagccagggcaacagtgtgagactctgtctccaaaaaaaaaaaaaaaaaaaaaacaccaaaaaaacctttgtgacttaaaacaacacaaatttcttatcttacattctggaagtcaggagcccaaaatggacctgacatcctgttagcagggcttcccttctccctgaaggcttaggggaggtcaattttcttgtcttttccagcttctggaggctgcctgcattccttcacttttagtctctttgcatcttcagagacagcagtggctgggcaaatctttctcacagtgccatttttctggttttaattcttttgtccctgctttcccctttaagaacccttgtgattactttgggcccatctggataatgcagatactctccttattttaaggcccactgattaccagccttaattctgtgtgcaaccttcattccgccttaccaaatgagtggaaaaaacacactcaaaatggtttttttttttctattagccaacagcaatcaacacagaagacttttgtaa

SEQ ID NO: 7360 - DNA, 1034 bp, Homo sapiens
gaatcttagtctctggatgaccttatagagcaaagctacttacctttccttgaccacttgtctgcctcttgactgtaacgtgagagagaaataaattctttttttatctgagccactatattggtctcattacaggagtttagcttatatcctagttaatagagatggtaatgatataagcaggaatcaaatatagaatgttagattggaaattattcttgatttttttcagttgaagcttttcatttatgtattctttctatgaaaatttatttttcagattgtctaattgtaccaacactttagaaataaagctcttactttaacatcacccctgttataattatgctatgtttctttttattttcataagcatgtgctttacatatttatattaaaattttatatcctgatattttcatgtgatatctattttctttcttgctttagagttcttatatttgcatggttattattgtataacactcagttttactgtacttaaaattttattattattggtcactgtggactagttatgtccccccaaaattcatatgttgaggccctaaccttccacatgacagtattggagatgtggcctttaaggaggtgattaaggttaagtaaggtcataagaatggacccctgatcagatagaactggtgcccctataaggagaggaagagataccagagctctcttttcacctgtgtgaagacacagtaagagtacagccatctgctagcaaggaagagggtcctcatcagaacttgacaatgccagcgccatgatcttagactgcagcctccagaactgtgaggaagtcccagtcatggtatgtcattattgcagctgaagttgatagtatattggcatttagattgctttcaagttttccttctataaataatgctgttttttgtttttgtttttgagacagagtctcactctgccacccaggctggagtgcagtggcatgatctcagctcactgcaacctcagcctcccaggttcaagcaattctcctgtct

SEQ ID NO: 7361 - DNA, 1041 bp, Homo sapiens
acattatagacaacacagactcactgagttttaaggattgctgtatcgatttggaatatccaatcatcgtatctgactgcttgaatattttggtcaaggggtactacattatcgattagttattactagactataatgcctctcaaactccgggactagtagtcttcaggaactttgaagggaagaatactgtgcacacttcagggtgtatttatacaggagctcgagagttcacatttctgtaaattcatttcaggagtgtgatatcttttcatccaggtaggaagagcctttgaatcagaaagcagggcttctaatttttgttctattcgttaactagcttcgtgtccaaggacaagtcacgcaaacttggaactttgtttttcttatctaaaatgagagccgatggtttatctgtttgttggtttttccaggatcaaatgagatcacgagagtgcaaatgaaaggctaagtgtgctattgttattaggagattcgcattggtcccctagcctggatgagatgtgagtcagaaatctctggaaatagagcagcaaagaagacagcctccaacctagcagggctcatattgcagtgggaaatagacaacgaacaatacgtgcataatgtaatttcaggtagtcataagtgcagtgaagggaaggaagaaaggaggacagtgggggaacagggaaggttgtttttggtgggatctgtcaggaaaagccattcaaaggcagggacacttgaagtgtgagggaaagagcctgaggtaagaacatttcagagaggaataattaatagcaatgaacacttaaaaaaagtagagcttaccatatgtaaggcactattctgaacactaaattaaatttttacaagtcttttgatgtaacctagtatctccctttcatagatgaggcaactgacacacagaaaggttaagaatttgccaaagttgcacagctaaaacgtggtagagactatttgaacgtgggcagtctgacttcagagtccaggctccaggtgactgtattttcggcc

SEQ ID NO: 7362 - DNA, 1052 bp, Homo sapiens
gattatacttacacaaacctagatgtataccagatgctacacctaggctatatggtataaactattgcccctaggctgcaaacctgtacagcaggtgactactgggtactgtagatgattggaacacattggtaagtatttgtgtatctaaacatatctaaacagaaaagttacagtaaaaatacagtactataatcttatgggatgaccattgtataaagcagtttgtcattgactagaacatcattatgcagtacatgactgtatttagacaagaaaaatgggaatcttggatgccagagtaatactcttaatgattcataaagcaggaaaggacctgtagggaccctcacattcactgtttgttttatagatgaaataactgaggcccagattgatgtgaatgcctaaagtcatatgcttagtgacagtatgataagcctaaggctgaagagaagtaatattttgattagctatgttatttctatttaaagtttgtgatcaatttaaagcatattctggcatgttcaataatacttgaggaacaagtaacttgctttctgtttcacgctaagctagttgttatttatgtggcatattgaaacatattttccttctattatgtacatctgttatgaatatagaagtggcagggggtaggtactgcttttactggtctcttctggttctggttgcataggaagtaaactagcatccctctctgtcccctggcaaataatcagaattcagcgattctttttctacccactgatattcctggataggccattgtgtgtattaatctctttaatatggatttctgttttcacttatgttctagaatggtgctatccaattactgtagccaccagccatatgtggcattttaaaaaattgtggcaaagtatgcataacctaaaatttaccttagaaaccatttttaagtgtacagttcagttgtatgaagtacatttatattgttatgcgaccatcatcaccatccatctctagaacttttttcgtcttgcaaaactgaaactctatatccacta

SEQ ID NO: 7363 - DNA, 1035 bp, Homo sapiens
tgtttttttctaactaatttatttgcctgttatttcatttataagcactataatggactaacaatcttttttttataggaaaatattctttaaaaaaatcacattacttgtgtatgtagttcttacgagcgtgtttaattccaaaggtaaaattttctaatacctgacttaaaacaatggcatttatttgtaaataaaaataaaagtaaagataatatagtctataatgtatatctctgtctctgattattatgaaatttctaacaaagaccatctatttgtgaagcatctgcattaaaacacgcaagccagttttattaagaaggtatttaaggccaggtgcagtggctcacatctgtaaaccccccactttgggaggcaggaggattgcttgagtccagaaactcaagaccagattgggtaacatagagagaccctctctctacaaagaattagttgggtgtggtggcacacacctgtagtcctagctacttaggaggctgagtgggaggatcgattgaacacaggaattagaggctgcagtgcagctatgattgcaccactgtcctccagcctgggtgacagagaaagactgtcttaaaaaaaataaaataaaataaaaaaggtatttaagacttctaggaagagactagctgattaattcaaattaggtactctccaataaagcatttgaatttgtatgatgagttcagagtctttaaaaacttaaaaaaaaaaaaaaaaagcctggcaaataagtgaatagaaactgttgctaatttgttcaccaggccttttccctgagaaatataaactgttgtcactttatgtccttattcatcacttcaaattgtttgttttcctgaacatttaccactaatatggaatttcaaaactgttgggttgaaagatcaatagaagagtatttgaaatgtattttgtgaaatcaaatgttggtacgtgatggacggacatatgcttattttaatagtttttaaaataatcaagtatttactaagtgccaggcacaagcct

SEQ ID NO: 7364 - DNA, 1063 bp, Homo sapiens
tgcctgctctttgtactaagccattatatttacctacaaagtaggaaatattgaaagtctttatgtattctttcttctgtattttttagccagagagacagaaaaaaatttctcaggttgtgtaaaaatgtcatagattttatttctttatcctaatttagaatgcaccactttgatacttgaacagatttttaagtgataaacgtactagtttcagcaggttttatggcatttgtgtgatggtgtttgggatcctaaattattagatttttgtgagaatttattatgagaaacaactttatgtttttttattcaactgatattattgtaaaccaaaaaggtattccatagccgtgtagtcctttaaccttgcatcattgttacataatatatggcagctactcttggtggttttgttaactttgaattaaaggtattcatgtattttgctgaaagcacaaactgaccatactcttttttctccctgcttttctctaaagctgaaaactcgtcaaggaacagaactgctaattcagtctgacaatgacactgttattaatgattggtttaaagttcttagtagtacaatcaataatcaggtatgtcgttgacttaggtaaaatttttacttcagagctgtttttcttttttttttttaattgcttattggatatccggattgcaatctatatgtgaaaaggcactttatatatgtttgacagagatggaaaaaacaatggtcaatttagcagccccccagggctggtgaatgatttaacattctcacttatgtgatgtttgctaccagtggatttgaaataatgttcacatcaggcattggctgaaaagaaatagttcaaaaagaaggggtaaatggtgcttactacatagtatttattcaataactgaatgagttggaaataatactatttggtggaagaagtctgaggcgagcttatgaaatgaaagaagctgtagtctcttcattagcactttttcttttctagtgacagttctctagtttttccgcctctcccctccaagctgttcagtacccttgtgt

SEQ ID NO: 7365 - DNA, 1191 bp, Homo sapiens
cctcaaaacttagtggtttaacaaaagaaccattttgtttgctcagcctggcctgggctgagctgggtgatttttcttctaatctcacttaggactattcatgaggcttcagtcgtctagtggcttgattggaactggatggtctcaagtgacctcatggctagtattggtgccagctgttggctaggcctccttgtccgcaagatctttcattctcaagggagctaccccaggctgcatcaagtgacggcctcaggattccaagagggtgagggtggaacctgcagggcttctcagggcctagatttggaagtcacacattactttcagagtattcattggttaagactgttcaggagactagccaagtattcagagttgtgggaagagaggcagcctattgacagaagagcagcattatctgtcccattccagaagggtgtggttacagagatccaagactgattttgtggacagccttccagatcccaacctctttttgtagtctcatgtctcagggctttcctgttgtgttgtgtagacagattggtttaattgctgttttccaagtggagcccaggttttctggtttgtctgatttttactctttattgttctgcctcgagcaccaacccatgccaatctctccgtgccaaatgctccctttcttccaagactcatgacaagcatcaccataacaatgaggctacttctttatttataataataaatatttatttaaaaataatatttagtgtacttgggttatcatttgtcaattatttctctcattagataattacaatttttttgtttttcccttaagtaaagagactatgtttttcctttaaataagaacctataacagagcagagtatcttatgtgcagtaaacattcaatattggtaaactggcttgaccaacactagaaaagtgcatgaaagaagtcactgtttcctgaattagccttgtagtttcaaaaggtaaatcaagaataaaaatggtttcatggtcaaataaatttgggaagcagtgtatattttattcctatcttagaaaatcacagtgcaccctagaatatcaaaagcctgtgacatcttgaaggagagaatctagttatattttcttcaatccagtattttccaagttaatattatatacctttttcaaaaatttattttttgagggtac

SEQ ID NO: 7366 - DNA, 1026 bp, Homo sapiens
tatacatgcatttgtaaatttgcaaatatagcattaccaatttttcttttctaggagtagttccagtttatatcccacttgcatatgaggcctttttagtctatagcctcaccaacatagttttgaaaaaattttttcccactctggtgggtaaaaaaaatttcagtttggctttatatatatatatatatatatatataatatgatggaagttgagtcattttgttttctgtgaattgtgtattcatatattctagatatttttcaattttaaagtagaaattgttactttataatagagaaaaagaagaatttgagaaaatctatttgatttattgttaatataaaattgttcttaattatttttgaatacacatatatgtgagtatcacatgaaggttttttttctttttcaaaaatgaagtttggcagtaatcagtccaaaccagagttcacagtggacctcaagggggcaacaattgagatggcttcaaaggataaatccagcaaaaagaatgtatttgaggtaatacatttttttctaagtataacacattctaaactgtagtaattggatgttctgttttttgagctattttgggaaatagtctttcattgtgactagttaaggcaaagttggtgattaagttagatggtattgtaatttaagaaaaaactggtgtaaaaactggctttatttgcataagttgtttgaactcagactgtatattacaagcctttgtttcacaaatcctatcttttgccagcaataataaaaaggatgtggttccctttacttaccaaatctaatattaaaaagtaaattaaggggaatgttgataatggggaggctgtgtgtgggggtgggcagggggtgtatgggatatctctatatcttcttctcaattttgctggaaccaaaaactggtctaaaaaataaaggccttttttttttttaaacctttccattttatcttttaaaaccctccccagtaatatatgatctgtattagttacttattgctg

SEQ ID NO: 7367 - DNA, 1024 bp, Homo sapiens
actcagttacattaaaagccgttggtctttgttgcacctgagtgaatctttgcccatgcttaattttataatatcttgtaggtcatttgtaaaatactagttcactaactttgctcatttctcaaatgtttacacattttatttataatatcaaagaatcatacatcagtactgtcagaaaagtattgggacgttgtcaaatccattgtagcagatgccaggtgttccaaagttctactttctgtttgaaagcttcaattttttttatggtggtaaaaaaatacataagtttgctatcttaaccatttttaagtgtacatctcagtggtgttaagtatattcacattgttgtgcaacagatctctaaaaccttttcatctcataacgctgaaactctatacctactaattccctcttcctccatcccccagcccttggtaacctttctgctgtttctgtgattttgactaccttagatattttgtattggtggaatgatatgttatatgtataacttttgtgactggtttattttgcttggcataatgtccttgaggttcattcatgttgaaagttttgttgttgttgttgttgttgttgtttttgagacagagtcttgctctctcgcccaggctggagtgcagtggtgcgatcttgggtcactgcaacctccgcctcccagattcaagcaattctcctgcctcagcctcccaagtagctgggattacaggcatgtgccactacgcgtggctaatttttgtatttttagtagagacggggtttcaccattttgaccaggctggtcttgaactcctgacctcaggtgatccgcccgtcttggcctcccaaagtgctaggattgcaggcgtgagctaccatgcccagcctcatgttgaaagttttaattttttgttgtctataaataatattatttgttttctttgaaaacttcatttatttttaagataatgtttgtgtgccacatatccaggtctgaataactatagtatgtacatcagttgtt

SEQ ID NO: 7368 - DNA, 1062 bp, Homo sapiens
acatgctgaattttttatgctacattaaggcaagttctgtacatgataccagttaactttttagtaatttattaaatacagacacagtatttggtctccctatttttacattttgacaaagtgagttagtatattgaataattttcagattatatagttgtaaaataacagcaaagtaaatcattccttttttgtagaatttatccttatagcattgtattcctttctttgaatagaaagacataaattatttttcagtgctgctttgttcatatggaaatctaatttgatagcaaagtatctaatagctgctgtgacttaaggagaaaaagaagtgtttaattataaaattaagaaaaaactacaaaagtattaggaaagttatattcttaatgtattctagaactacgcatgttacacattgactaatcttttcttttaagctaatttttagagaacgagaccatgttggttcagtcatgtgtaagaacttggacctcattgtctatgtgattgtataaacagtattactctgttccataggatcaagagaaatatggattattaaatgtaacaaaaattgctgaaaatgggaaaaaggttcggtaagtacacaagtctttaatgttcttacatgattcatctgaaataaattaaaaattctcaatataattattttagtataaacaataggtgctgaagaatctctcaccatttgttttctatgtaatcatatatgtaagattgtcatgagatttatgaaaattttcctttgtcttgacatatttcctaagtaatattaagttaagaggtaatgaggcagagggttctgaggatgcatttgctttaatattttttttttcagtaagcagtaaatgcacatggtaaaaaacaaaggtagactaagtattgagtgaaaagtcaatcccccagccggcattacttcccctccccagaggcaatcagtgttaagtctcctgaattctagtgctttcctccagagataggatatatatgtatatgtttgtatgtatagagattaattttctaaacataatcttt

SEQ ID NO: 7369 - DNA, 1025 bp, Homo sapiens
gtcatttggagccaagatgtttagattccactttcatttctattgtttatgaactgttttttgtgttttttgctttgttttgttttagtataatgcttcatcccagcagcaaagagaaataattaaaagtaggagcctggacaggcggctgcaagaaccaatagtattaacaaagtggagacatagcaccattgtattggacactaatgataaggtaggactgttgagatttttggcaagttctttgcattatattgtacagtgaattgtaactattcgtactaatattttatgtatttagtaaatattctttgctaaaacatttgatttcttttgaactaatttaagcttttgatctgcatgtatgttgaaatgttactacattattgtttcttttaccaaattgcatactttagtgactacatttttatgtatttagcatcagtttgtcatgaagtaggttttggttttgagggttttggtttttgcacaatagactgacttatctgtagcttactgatgtgtgtaccttgatacatttgatcccagtaggtgacagatttttcttgcttaccttattttaaagtcacattctgttatcctttgtcttcagtctctaggaggtttcatagggaagacatttaattaattttcctcatcccaggtaatattggaattctattccctttgtttctctaaatgctctctgcagaaagcacttcttttatcagtctgaggagtaatgtcctctgtttcaaaaacgggtaaattttaatgcaaacattagaatggatgttttaaacacttctttagaggttacttattcacagtgtagcttcattttggggataagttgggaacttagtatgaatttgcagaatattaggtatattgattttgaaatgtaaaggttttttaaatcatcaggcttcttgtagcatgactaacagtttttctgtaatttttaggtgtgttcatgaaaacagaattaactatccctatggcatatttcattatgtttggat

SEQ ID NO: 7370 - DNA, 1046 bp, Homo sapiens
gtaatttggatttcatgaagactcttgtggctagaaagtccccttattttccccaattattggggtaaatttctatgatgttcctagtgtggaataaaggagcaaaatttgttaatggttcacccataatttgtgggtataattctttggcgtttccagctctgtattgtgggatagccttttagacttcctgcttttggtaatcctgagttcagttctctaacactcctgcgtggtcttgaaaactaacattttagtttggggtctggcaaatgccttcaagaagaaagctgctcttttttcttctgcttgactgtcttgattcttgtttccacttagcttttgacctctgaggatttcttaattaaccttttgttcatagattattttaaaaaaaattttatgtaacattttcaactgtttctgttaagatgatcaattgggatacctacctgccattcttctataaatggagcatctaccatagccccctcatatttgtactaggatacatttgctgcagaatacatcccaaagttactgaattggttacacctttgaatggagttattaggtatagaatagttaacatctatagaatgcttgccaaaaataatcttaactttaacttttacttaactgccattaaacaactattttccagtggaagatatccagatcttaaagcctggttctgtagtataatataaaacacatgaagatattggaggttacttttcatggtagaacatcatatttactgtgcaaaatttggaaaattatgatgagaattttgttagctagaaagtcatatctttgaaaaagtgattctgtgattttgtttcttaaattaattttactaattcagttgccctttttctgtttctaaaagttttactgcactcttctcgtctatgagcttgcattttaagttgcctcaattaaataaaaataaactcctgatttttgaattaggctttcaatgtttaaaaaatgtttctgttgtaaaacatatataattcactttatgcagtgtttctgtaaag

SEQ ID NO: 7371 - DNA, 1034 bp, Homo sapiens
actgcagtgagccgagattgcaccactgcactccagtctgggcaacagagtgagactctatctcaaaaaaaaaaaaaggaaaattttatttgaattgtacattagaaagatttgaaaataagctatccagtgtatcaataataaagtaaaatttaacaattttagagaattaggaaaaagactaaattatagactaaaagaatttgaagtatacataggaacttttaacatgtttcttagctattttagtaaatagatgggagtgactatgtatacagggtctcaattactggtctctatacaaattatatgaagattaatatttccaaagtggctggagcacatcttccagcgacttcttgagaaaagttgtgtatgggaggtaaaatggaaactatgtgtgtatgaaaatatctgtcttctcctctcatatttaattgatagtattcctgggtatagaattctaggatggaaattattttctctcacaattgtgaggcattttgaactttaatggatatctgggtcagcccctctttggggaatccccagtgttagacccattaggtctttccttttggactaattagaatgtccacagatgtctttaggtctcttgcctatacacggtaagggctgtctgtgtcttggtgttggcattcattttgcatgtggtccctcagtctcccttctttctcttggtacccatgttcctattgtgtctattgtcccccaactcagaatcttagtatttttcccttctcagagggaataactctccatatgtctgctggggtagggatgggctgcacacctagcagccaggtatgtagaaggagattctggcatttttaatccttattttagtaccactgctttcactccccagtttcacagatacctgataccgtcagttgctgagccagttgcagattctgttccgtaagcttgtcgggtttattttcccctactctcctttgtctgcaccatactggtttagattctactttcttccgtgtaggtaattcaggttt

SEQ ID NO: 7372 - DNA, 1025 bp, Homo sapiens
gctaatttttgtatttttttgttaagatggggtttcatcatgttgcccaggctggtcttgaactcctgagctcaagcaatctgcctgcctaggcctccccaactgctgggattacaggtatgagccactgcacttggccttattcttgtctttttaaatagatattaaaccttacatgtaaattaacactgttgaaatacactgttaatgataaagtgacactttgacctatgttctatttttgcatagctgaaatagttgaagatttcattttctgttctttctgatgttatagaaggggactcttaatgttaaagggatggcaatttgtaatgatttgaaggaattactttggaagaatgaagaacaatacatattcatctgatttttgtgtacatggttttaacaaaatctagcttaaaaattgggagggtattttcacagggcttggcaaacattttctgtaaagagcccagtaacaaacattttaggttttgtgagccatgtggtctctgttgcaagtgttcaactctgccattgtagcatgagaacctaagtgcatagccaatatggaaacagaggagcatggctttgtttcaacaaaactttatttacaaaagaaggcagcaggctggatttggaccatagtttgcttatccctatactataaaggaatatagggaactgctgcattttttaaattttttacactttttgcctcattttaataaatgtaaaatacaataagacattcaaatacaaaattgcacaagcactgctatacagataatacctgaggcttctgaaacagaagtgtctattatgtgatttctcaaaaagctgatcagttagtgtaaggaagttctgattttatttattgaagtaggtttaggagttttagtgtgaaattatggaagtccaagatgtttgaaagttgaaaatctgtgtaaacggtcatggcctgtccctattatgattgtattatgattacaacctcattcaggatatcaacaaaagttaaaatt

SEQ ID NO: 7373 - DNA, 1067 bp, Homo sapiens
cgttgagcatcttttcatatgttcatttgctatttatatattttccttggagacatatttattcaaattcttggcacatttttaagttgcgttgccttattattgagttgtaagaattcgttatatagtttaggtagaggtcacttaccaaatgtatgatttgcaaatattttctcccctctcccattctgtagttgttgagacaaggttttgctctcttgcccaggatggagtgcagtggtgcgatcatggctcactgcagccttgacctcctgggttcaagcgattttcccacctcagcctcccaagtagctgggacagcaggctcaaaaacaagcctggctagtttttgtattttttgtagagatgggattttaccttgttgcccacgctggcctcaaactcctgggcgcaagcgatctgcctgccttgacctcccaaagtgctgggattacaggagtgagccattgaacccagcctaatagtagatattttcagtttcccgtctaatagttccatctgtgccacagctgagtttgattctgttgcttgctttgtttcttcatactgtttttttcttgccttttggcatgccttgcaatttttggttgaaagccagacaccatatatcaggtgataggaactgaagtggggtattgggttatctgagtagaaactggattgcttttaatgttcgctgtagttgtaggtaccagaggctttaaattcttcagacatcagtgtttgtctctaagagattttccttagtatctacttagatactaagtatctaagattttccttagatactacttaaggtaggcgcccccaccccacacccaactcccaccctgtgcccctcagttcactgttgatgtactggaggcctgttggagtggtggtaaagtatggggaaggggatagtgttctgttaggattaaatcttagccttttagtgtgtgtgcgtcatgagctgtgaattttacaagtgtctcttagtttaccctttcccttaggcaagaccagggatgtggagtctgggaagtgccctttcctcaggtcagata

SEQ ID NO: 7374 - DNA, 1031 bp, Homo sapiens
cagtttatccgttttcccttttatagatcatgcctttatatcaagtataagaactctagctatattaggcttttccagagaaatagaactgataaggttgtgtatgtgtgtgtgtatacagtcatgcaccgcataatgacatttcagtcaatgatggactgcatgaatgatgacggtaccagaagataataatactgtattcttactgttcatttctatgtttagatgcacaaatacttaccattttgttccagttgcctacagtattcagtacaataatatgttgtacaattttgtaacctaggagcaataggctataccatctaacttaggtgtgtagtaggctataccatctcgttttgtgtaagaacgctctgtgaaagtcaaagatgaaattgactgttacatttctcagaaaatatccccgttgttaagtgatgcatgaagtccagaatttgcagggtggactggcaggctagagactcagggaagagctgatgttgcacttcaaattgataggctgtctggtggcagaatatctttttgcttgaggtaggtcagtctgttgttctattcaggccttcatttgattggatgaggcccactcacattctggagggcaatctgctttactctcagtccacatttaaaagtgttaatttcatccaaaaaaaagcactgtcacagaaactttcagaataatggaaatatctgagtactgtggcccagcccatttgacacatacagttaaccatcacagaagccttagatcctgaatgctttatttttttttaagtttatagtttcacattttatgtttgaatttgtgatccattttgagtaatttttttttttttttgagatggggtctttgtctgtcacctaggctggagtgcagtggcacgattgtagctcattagaaccttgaaccactcagcttaagtgatcttctcagcctcgtgagtagttgtgactacaggcatgtgccaccatgcccagctagtttataatttttttgtagagatagagtt

SEQ ID NO: 7375 - DNA, 1028 bp, Homo sapiens
tgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagaca

SEQ ID NO: 7376 - DNA, 1047 bp, Homo sapiens
tactactagaattatttatttcactgttacttttcctactgtatacacctcttgtttatccctattcctctcccccttttttttttaaagcttctatgtatataactagtagttgctggttagtgttccttggtttaagaaggtcactgaccactgtctgctggttaaaagattagccgtctttttcttttttaaacaaatacaattcataaatcagcttacccatagctttatttgggagaataaaaacaaagggagggctgacctccctttaaacattactgcttctaaacagttctacttaggtagtatataaaaggaaaccaaatcatttaatattgccatccttctaattttggggaaagtagccacagatgttggctaaaatgtttataataaactgttggcatattttattttgttttattcttcatgattatctcaaacaccaattttgtaaaactaaacatatttactctatgctttctcccatttttaggtgttaaaaagtaatcgaagtacgaagaggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatca

SEQ ID NO: 7377 - DNA, 1008 bp, Homo sapiens
attgctatatatggaatgtataacaatagactgttgtttagaaggcatatgaaaattttttgaaattgcaaagctgcagtggctcacacccataatctcagcactttgggaggccagggcaggagaatcagttgagcccagtgtttgagaatcagcctaggcaatatagtgagaccccgtctctacaaaaatttttttagacagggctgattgtacatgcctgtagtcccagctatttgggagacgaggtgaggaggatcacttgagcccaggaggttgaggttgcagtgagcagtgtttgggacagaaactctgtgtcaaaaaaaaaaaaattttttttttgaaagacagcacaggtaaattgtttaaaataggcatcttgtatttatttaaatttaagaatttatcctttcagacacaaaatattttattcaactctcatgctaagtacaatatacagaataaaatttgaaaatatatgtttgttcttctactgttagggttatgcaagatagacgagaacaagcaagacaagacttgaagggtttggaagagacagtggtaagaaaaacatgaaaataaacaggattgggaaatattttgtgggttttttctaccatgattattctaaatttaaagtctgagctccaaaaatatcgctgttcttaatccaaggcaaaagaacttcagactttacacaacctgcgcaaactctttgttcaggacctggctacaagagttaaaaaggtaatgtaactatgccgaggtaggcgtttgcataaatggtgcttacttctaggtaattatttgtattcaaagtgaaataactttacagtcacgtcaatttttgtatagttaagcttagttttttttaatttttttgtaatacttaccttcttttctcagagtgctgagattgattctgatgacaccggaggcagcgctgctcagaagcaaaaaatctcctttcttgaaaataatcttgaacagctcactaaagtgcacaaa

SEQ ID NO: 7378 - DNA, 1026 bp, Homo sapiens
ttaagttgtcatcttagtttatctagaagcaatttccctgcctccataaccatgtgcacatacatagagtttatggaagtcagagtttgcaacaatttgagtaggaaccaagaagagaataacataacaaaataatgatgaggtttggggcgtaggtcttactatgaatacctgatggaagtaggcataaggattcaggaagatgaaagacagaggagaacagaatcatgatttcaaaccaaaatacgaaaaattttgtatgtccacaagtagccaggtccctttcctcttttcctccatagggtataggataacagaaaagtccttgatgagattatagaatttaaaagtttggaaattttaatgatgacattgagaaaactgtgatattgatactgtgttaattatttttttctttcgtcagccaaaaccagaaaatgatgttagagcaggaacgtctaagagtagaacatgagaagttgaaagccacagatcaggaaaagagcagaaaactacatgaacttacgtgagtaattgtttttaattaaagtttaaaaataaaagctaaattagaggattataggcattacctttggatatagccagtggatacatattttactttgtatgggctaaaggattttttcttaaatccactgagttggtttgatttatatctaaatacttggaatatatacttgcatttgagtgaaagcaaggtcttatatttcattgtggttaagattaaggtttctctttattaatctgcttgctgtttctttatctccatattacttcaggatccagcataaaaatgaacctaaaacaatatattaagtaacttcgaagattttaagatctaacacaaaaactgagtttttgttaaattttctcttgcataaaagagcattgtggtgtttagccttgccattttgaacagaggttttcatggtttaccttttctcattttctcaaaactcagttttctagaatcttagcaggtagaaagtgcatgattataatttt

SEQ ID NO: 7379 - DNA, 1027 bp, Homo sapiens
atctggggatttcccacagttacgaagcggggtgtgtgtgtgtgtgtgtcttaacataggggacttaggagttatctcatttctttaccattcccttaactaatctgttctggattaggccaaaaaaaaaaaaaccaaacaaaccataaaggaatacataataccaacacaatggatgtaacttgtatactagtctacatgtcattgaacttggagagcaggtgacatttgggtaatttgaagttgaatattgctaaggaaaatgcttattgtaaaatccatttgctccttggtttatatgaggaaccttaaaggcttatttcactcttctattttctctctattcaaacagagaaagtccatgaaatggaaaaggagcacttaaataaggttcagactgcaaatgaagttaaggcaagtttgatgtcacatttctaacagctttaattaatcagtattaattttgattagtctgactttaacatccttttcccccccaaaattttagcaagctgttgaacagcagatccagagccatagagaaactcatcaaaaacagatcagtagtttgagagatgaagtagaagcaaaagcaaaacttattactgatcttcaagagtaagtattatacttctctagttaggaggaaagaatcggttactgatggtcatggtatatattcttattagaaacctgcagttttcatcaaaattacatttttatcttggaaaataaagaattttctcatttatgagtaaaacttctaaattccaggtgaaatttttgaggcttttttttaggtcttttgatctaaattattcagtaaaagaaaaaaatccccaacctaagtctattattgcataccacagtcttctccaaatcctttatttagtttccttttttaaaaaaattcttggctgggtgcagtggctgatggcctgtgaccccagtgctttgggaggctggggtgggaggatcactagaagtcaggagttcaagaccagctgggcaacatagtgagactcca

SEQ ID NO: 7380 - DNA, 1034 bp, Homo sapiens
ccacaattccttctggttgagcttaaagttcatcctttccctgccacctaaacatcctcttgttaaattttaagctgaacgtgcacatgattaacaatgaatttactgaagaggtcctgtaaagaggaagtgaaaaaattgaaagaggcagaatttattagtttggttgtatttttgtgttttctttaggtttacatttatttatttttcttgttggcatgtattaacattattctcagtttttaaaaaaaggaaggcaaaaagtaagctgtatttatttacctttcgttgaaaacagtaataaaagaaaaaaataagatccagactttgtatgaatattgagtaatactaaaatatattttataaaaagattttatagcctaattgggaaaacacacattgaacatttttggctttaattttttattttactttttccttacagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaagtatgttatagaacaaagtttattcatttttttgaaacagccacatagaaattttatttattatacaagttttcagaaaaatgtgtgtctataggtgaaatttagttgtttttttcctagtctagctgcagtaaatttgaatgatttaactgagttatatttgcctaacataaatatgggttatgtatagaaatttaccagaatgatgtgactggtggtaacttgttaaagacttcagaattccagggtgggcaaaactgcagggaaccagtttcctggcttggcaactgaatgaatggggccattcaccactatcagaatttcacaaggagggaagatggtaacgttagatggtggtatctgtaaaattagtatttcatatttgagtcttcagtgcctt

SEQ ID NO: 7381 - DNA, 1047 bp, Homo sapiens
gaagcttttcatgttcttttttcttttttactggttattgatgacatatgaacattttagaaaatgtaaagaaaattataaacttgtaattttgtttcattcttttgaaatcttatgtataggttagtaaaactggagctgaaggtgctgtgctggatgaagctaaaaacatcaacaagtcactttctgctcttggaaatgttatttctgctttggctgagggtagtgtgagtatacatgtcttctatctccctgttaccttatggggcattatttaaatataggtgtatatgtgtgcctgggtgtgtatgagagagagagagagaaagagagattgagattcaatgtgtttgaatcagtatgtgtaagttagttgtcttttgggagtttattttataataacattttattatactggtcttgttttctttctttgtttttgtatgcagacatatgttccatatcgagatagtaaaatgacaagaatccttcaagattcattaggtggcaactgtagaaccactattgtaatttgctgctctccatcatcatacaatgagtctgaaacaaaatctacactcttatttggccaaaggtttgttgttaagaaagtacaaaacctaaatttagatagaccttttgtttataaaatgtaggaaaatgtgagctgttattccaacctgtacatactgttttgtgctagacacactcagtttgaattgatgacagataatacaaggtgggtctgatttttagactgcttggtttaagttttagtacacattaaagtcagatgtaattttagtcaaatttgtgtgacaagctgtaatttggtattaaagaaaataagcatttgaatcaaataatgaggtcaaagcctggcaaacataatcctctgttaagcctgtagacatgcatgacaggttaatataatctgtatgagatgattaggaaaatcagtaatgatgattccgtctttgactttcaacagtaatttcttaattcagccttgcaaacaaattggaaaaatataggcctttgtctttt

SEQ ID NO: 7382 - DNA, 1974 bp, Homo sapiens
taatcagttcctgagtttaaatagtaagggatacctgtatttgagattatatttgagattgttttatcagttagcataaccataaaataaataacattttagacaagaattttttgtcaccctgttatatgggaaattttgaatgcttatgtgttgttgattttatgtagtataaataactttttcctgttctccttggctcctccttcctcaaaataactgtcactcttctctgataagaatgttgccataattatcagtgctgctgttaataatagatgtggacccactatagctttgcttctagaaaacagcctgtgattttctgccactgctaaagagcatctgtttttatcatttatttgagtgtactatattaagtaaatgactgcttcttttagtgtgattcatattactgattttcataaagtcatagagaacaaggacatcctagtatttgcatgaatttgcctcgaagtagaaggaacaatgtagaattatatggaaagaaactaaaacctttttaattatgttcattttacaatgaacattttacaagcatggataatctaaatctagtgattaaatgaagggttaagatctgttggtaacccatgtggttgatgtacagtactgtgtatgtgtaatagttgaattggattttttaggtatttacagagccgtttccacaaaaatatagttcctgtcctttcttgactataagttgtagattgaaactctttgtttttacttcatattttataatttatttaagaagtctagttttgttttttgtttagggtaaacttcatgatccagaaggcatgggaattattccaagaatagtgcaagatatttttaattatatttactccatggatgaaaatttggaatttcatattaaggtaaattccttgaggaaagattatattttattttacagcaagaataatgttctaaaaaaatagtaaatgctggtttctttaattttaaaaattgtttttctggaaaggtacagttgaaagatcattcaggttagtaaacttggatttttgttcatctgccattagatgaacaggaatgttaactaacgtaaatgattaagtctttagcctccttcaaaaaataaaggaggttgctttactgcagaacttgaaggtttctactacataaaactattctaattcattttagatgaagataatgtaatttatgtccaatgggaagactgcttaaataactaagctaatttggctaatttatgtcttcccattagaatgtgagctatggctggtatgttgataactgtctctctagtctaaacaatgcctagcactcagacctcaatatgcgaataagttatataactttagttgatcggtgtttttttaaatttgccctttaggtttcatattttgaaatatatttggataagataagggacctgttagatggtaagttaaattcttgctaatcagttttaaataacatctgttaattcctttttaataatagatgtgagactatttctttgtaacctatatgaaattgtcttaagttattggaaatagacaaaattttttttcttctaaagttttagttgaatacctttaaatagaataactagtttaaagcgatgtttatgggtacttcttagtagtaattagagcattggactgggagttacataatctgagccctgagttctagtcttctgtcaactgtcaattagatacattgtccttaggcaaatcattgaaccattcagggttaatgttcttgtttataaaatgtgggtggtaggttggagtggtcctaaaattctatattgttgcattggtttctatttacatctcctgctgtgtctgtaaggtctgctttagagcaatgttttaatatgtttttagagttcaactattgctgttaggctgctcaggaaagcctatcagttatttcatatccagtgttaagagt

SEQ ID NO: 7383 - DNA, 1023 bp, Homo sapiens
aaatacacatatttaaggagaaagatggcgtaggggtaggtcgtgggtacctagggaggtgtgaggacaggaaagcaattaaatacatggtaggttgtacttgggacaatcattgttaaacagattggatgagaagccatggttagaaattgttggtaggcaaagatcagcagaatgatgggccagctgggatttcttttgagatagggatttgatgagcaagttgccagtaatgacctgaaagcagatagtactctctgggtccccgacaagttcactgagaatgcactggctcataattatctggacaagtttataacttgattttatgtagggctattaacattccctatctgtagatttgttagatacaattgttacttttgaataaggtttatccacttgtattctcttgaattctgaatctgagtgatttgtttcccttgtgttaagtagctatttattcattgcccactatatgataagcatctcatcaggtctttgtagatttcctgttttttccaccatggcttcctgacctgaactctctgccgctgtattcacctttggtttttccagatgtagcctaccttgtatttattttggttcctctgctccttgagtatatagtacagtggttaagagcaggtctctggaaccaagtctatttgcatttgcgtctcagcttcatcttactagctgtggagttacaggcaagttatttaacctctctgtgtctcagttttctcatctataaaatgggactaataatagtacagtgcgggctgggcgcagtggctcacgcctgtaatcctagcattttgggaggccgaagtgggcgaatctcctgaggtcaggagttgaagaccagcctggccaacatggtgaaaccctgtctctactaaaaataaaaaattagccgggcatggtagcacatgcctgtaatcccagctacttgggaggctgaggcacgagaattgcttgaacctgggaggcggaggttgcagtgagccgaggttgcag

SEQ ID NO: 7384 - DNA, 1045 bp, Homo sapiens
aagatatcaactaaacagattttaacacacacagaaaataagaaaaccaatttccaacattttttgcccttatagcccaagaacttagttcaactcaagtataagaacctgtgtagatactaataacttattaggttttcttgaatattatttcacaattttctgatccattcaaaacatggcagaatttgtacctaacctaattttctagttgtaccaggcagaaagtatatcctggaggataaagaaagattcttcatgagttatataagtgaaaagtataaaacttgaagtgatattctaactaaattatcaaactgaagttaaacaacaaattaggtgacagtattttgaaaacattaaactttagattgaggaaatgtgcatgatttatagattccctggtagccagggatgcatgataaatctttttttgttttaaaataattcttactcaaacatcacaggcttcttaaagacgcctttaaaatcagaggtattgtgattgtatgtgctttttttttttttaattggcaaaaaagagaaaaaggtttcctttttaaaaactgcacacacttttttgggggggtaataaatgaacatttttttgtttgttttttttagaactgagctctccatagacaaacataagtagcataacacagtgtctttcctcagacatcattctgtacagtaaatcaacataaacaactccgttcttattgactggattttttccaggtgggttaattgggtggggaaaattaattaaccttaacattagagcctcttttcttcctgttaaacttaaaggatgagttctttaaaaaaaagcaataaaccaaccaacaactgtaatctttcatatagagcaaatttttttaatgactacaattagaaaatatgtagaactattagtatatatacacagagccattagggatcatctgaatgccttgggaagatatggattaaatagaaaccaaatgtaattatcagatattctctcaagctcagtgcaaagctgaattccaaatctatggat

SEQ ID NO: 7385 - DNA, 1095 bp, Homo sapiens
aagaggaccttaatgatcacctaatttaatctcattctcattttatttatttatgtatttatttttaagatgaagtcttgctctgtggcccaggccagagtgcagtggtgcggtctcggctcactgcaacctctgcctcctggattcgagcgattctcgtgcctcagcctcccgagtagctgggattacaggcatgtgccaccacgcctggctaagtttttgtatttttggtagagacggggtttcaccatgttggtcagggtggtctcaaattcctgacctccggtgatcaacctgcctcggcatcacaaagtgctgggattacaggcgtatgccactgcgcccagcctgtctttctcattttagatgaagacagagtcccaaaagatttactttctcaggaatactcagctaattatgatagagctgaggactaagaatgtcaaggtcttttggcccctagaccatagttattattaccaccacttacagcttaagggttgctctgtgcatttctcctagactatttgccaaaagtgtccaggaaaaatttcataactagactctgtagaagacagcaatatctaacaaataggctaacatagtaatctaaaatgttgattgcatttttttttttttatgagacggagtctcactctgtcacccaggttagagtgcaatggtgtgatatcagctaactgcaacctccacctcccgggttcaagcgattctcctgcctcagccccctgagtagctgggactaccacacccagctaatttttgctttttcctttttttttttttagaaggagtcttgctctgtcatccaggctggagtgcagtgacgcgatctcggctcactgcaagcttcgcctcccgggttcacaccattctcctgcctcagcctcccaactagctgggactacaggcacgtgccaccacgcccggctaattttttttttgttttttttttttggtagagatggggtttcactgtgttagccaggatggtctcaatctcctgacctaatgatctgcccacctcggcctcccagagtgctgggattacaggcgtgagccaccgcgcccagccaa

SEQ ID NO: 7386 - DNA, 1390 bp, Homo sapiens
gatcgcaccattgcactccagtctgggtgacagagtaaaactccatctctctcaatcaatcagtcaatcaatcaataacataagaatatatcctctagagtagtggatctcaaatattttgtctataagaaatgttaatggtatactatgttttttgttgcttttcttctctcttctccctttccccccaaaaggaatgaagtttttgcttaaatatagaataaatgtgttcgcaacattttataaagcattcattttggtgctttgtaatggaagtgaaaatctttagttgaaaaacaatttgttaaaagaacttttattagaaattgaggttgtagcctataaaaaccaaacactaaaataatcaactttaaagcttttaaatattcagtatgagttggccttttggcagttgggggtaaaaagaaaaagctttaatatataatctttgaatagctattttaaataactgtttcttgtctgattttttaatagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttggtatgttgactgttaatgatgtacgtttctatagaaatgtcaggtccaaccatttcccatttgttcgactatgtggtctgttacatttatggcttaaagtccttttctcttaaacagttaaaaaaaaaatcttggtctaagtatttatttgaatcctgttgctataggagtttgtatgtgtgtgtcttcatttaaacatacctgcatacaaagatggtttatttctatttaatatgtgacatttgtttcctggatatagtccgtgaaccacaagatttatcatatttttcaataatatgagaagaaaatgggccgtaaattgttaaccattttatgttcagatatttctctagtttttacctagtttgctttaacatagagaccagcaagtgaatatatatgcataaccttatatgttgacacaataattcagaataatttgttaaagataaactaatttttcagagaagaacatttaaagggttaatatttttgaaacgttttcagataatatctatttgattattgtggcttctatttga

SEQ ID NO: 7387 - DNA, 1051 bp, Homo sapiens
gcgcatgccaccaggcctggctaattttttgtatttttagtagagatggggtttcaccatgttagctaggacggtctcgatctcctgacctcgtgatccgcccgccttggcctcccaaagtgctgggattacaggcgtgagccaccacctccagccgcgaaatttttctaccatttcttaatgtcttttcatcttttttttttaatagactttcatgggaccaaagttgttaattttgatgagatccagtttctcaattttcctcgtaatggatcctgcttttggtgtcaagtctaagggctctttgcctttcctatgttctcttctaaaagttttgccattttacatttaagtctgtggtccattttaagttaatttttgaatagagcaagaggtttagatcaaagctcatttttttccctcttgatatccagttgttccagcatcatttgtttaaaaagctttccttcctctattgaattgcttttgcttcctggtcaaaaattaactggacattgttgtgtggatctgtttgtagattctcaattctattcaattgatttctgtgtttatcccaagacaatatcgctgtcttgagtattgcaactctatagtaatttttaacatcagggagaatgattcctcctgtattatctttctttttcaagatcgttttgatattttaaggtctttcctttacatataaactttagaataaacttgtctatgtctacagagaaacttgctgatatttttgtgggaattgccttaagtctataggtcaatttagagagaactgacatcttttctatgtgaatcttccaggtcatgaacacaatgtttgacacttgaagtattcaggtctttttttatctctttcattgacactttataattttcattatacagatcctgcacatgttttattagatttatacctggctctccgcttaatactcgaagccttttttaaaagggtagtcaatgtgtatatttttatatgcatttgcgtgtatgagtgggtgggcatgtaggtacgtaggtaggtagg

SEQ ID NO: 7388 - DNA, 1046 bp, Homo sapiens
taaggactaagcagtgggacagatttagtttgtgttattgattatataagcacttttagacagatttaaattagttcattgctgctgctgtagggcattttagaaaaaaacagacacatttgtatctgtattttactgctctcggggctgttttggaggcatagaaatcatcagcataaagattacaacaaaaaataacagtttgggagagccttttaaaatttaattttggggaaatgattcaattagattgcggcttttctaagcgtagaaagagactctaattttattcccttcccgcttacattgtcacacatcacactgggcatgtaggctcttaatatgtacagcataaacgacctaagcctaaacggatgctaggggtacaaataaggacatgagaggacagaatcagaatgaaacttcatgtctgggccacctgttattgtgctactcagtcacttgactttacatcctgttgattttataaggaaagtagtaaattggcaaatgtttcacactgaagagaaataacagaactggactattttatctgtaaaggtcttcctttttgtattctagaaattgattactgagctttaagcaagaggataggtagagagtaataaccttgtatcatttatttcttgtgaaatataatagatattaaattgctcttttccttgccagatactatctgtccttaaactattaccacaagtatttcagatacaaaagtaaaatgtgttcattttaattttttcttttctttttttgagacagagtcttgctctgtcacccaggctggagtgcagtggcacgatcttggctcactacaacctccacctcccaggctcaagcaagtctccttcctcagcctcccaagtagttgggattacagccatgtgccaccacacccggctaatttttttatttttagtagagacagggtttccctatgttggtcaggctgatctcgaactcctgacctcaagtgatccacctgcctcagcatcccaaagtgctgggattacaggtttaatttt

SEQ ID NO: 7389 - DNA, 1023 bp, Homo sapiens
ttattttgtttccatatatggtatagtaaatgtgtcaaagatagaagcaaagtgttagaaatccagaggaagaactaacaaattttaatagttttctatttttgtgtatattaagcaagataaaacagactttttactgcgaactgcgatacatgtaaggctaatgcgtgattaagaatggcatagggaagcatctgtacctggtcttggctttcttgtgacttcatcttcctcagctctgtccttcatatctaggatgcctggacattagcagcagttaagtcttaggagctaaaatcaagtagaagtactctaaggagaatcctgtaagcgaagctaagaaacctgctcttacttccttaggtggactggttgtagcattctaataatccttatacctaggatgctgttgatcatctcttcagccatttaaagtcctttttgcttctctcttagtattctgaatcttcccctgagtaccaaccagaacccagccatagatggggaaggcagaagaagacaagaagggagaattaagctacagtagaaagatcatagggttctggagtcagacctcagtccaaatcctacttccgccacttcggacaagtgacttaatcagtcttcagagtgaacatgaagtatctaataaagggtctgaacatagtgatacggtttttttttttacttaatattacttccctcttctctcagtcattttcactatgtaaatagtagagcattctttagtctctgccactgatctaccttaccacaactagtctgctgaacctcaaaaattaaatggatctaagcggggtgtggtggttgcacctgtagcaccagctacttaggaggcagaggcaggaggatcacttgtccaggattttggggctgtaaagtgccgtttgtgcttgttaatagccactgcactccagcctgggcaatatagcaagaccccatctctgaaaaaaaaacagatctatattaaagatctgcaaacttttcccgtaaagaatcaga

SEQ ID NO: 7390 - DNA, 1089 bp, Homo sapiens
ttgtctgacaaagtagtattctgaggtactgtctttggtatttctgagctcttaacagaagattttatagttactcccatggcttagtttttagatcatgtttttctggcagtgccctggatttgatcttggctcagaatgcatttctcaatgttagcattgtttgcagtctaaagagactgcaaattttctaaaccatcaagtccttgctcttcaagaggtcttgatttaatttatatcttctcattttttgctgtatatagcagaaacagcaaggcagcactttctagttgaaactctcctttgctaaatcactcagttcattacataaaatttccaggtttttgtgggggatttttgttgttgtttgtttgtttttgagacgaagtctcactctgtcgcccaggctgtggcacgatctcggctcactgcaacctccgcctcccaggttcaagcgattctcctgcctcaacctcctgagtagctgggactacaggcgcacgccaccatgcccggctaaatttgtatttttagtagagacggggtttcgccatgttagccaggatggtctagatctcctgaccttgtgatccacccaccttggcctcccaaaagtgctgggattacaggcgtgagccaccgcgcccagccaaaatttctggtttttatatgaccaaaggtcacagtgttactaagcctcctgccccttcctaggaaggatacctcctcttctagtttccaataacatctacctcacttttctattctccttgtagccttatgaaataccatgagactttttaaaaacagcttcttaactaaactatccttaagagccatggtctgtttccaaagccaatccaacattgcagtgttctgttatagcagtgaggactcccagtatcaacatgtattacttatctattactatgtaactaattaccctaaatgtagcagtttaaaacaacaaacatttgtaatcttacagtttatgaggatcaggaatccaggggcaacatctgttgggtggttctgacctgtgtctgcataaaagctgttcaggattgcagtcagctgcagccctgcttc

SEQ ID NO: 7391 - DNA, 1070 bp, Homo sapiens
tacaggcatgagccaccgcgcctgccctcccctaactctagaaacttctgaactgtatgtatttctacttaaatgtcccattcttttccctacaccttgactttgcatagattgctatttaccaaccaataatttttctagtcaatttcacaatgaaaatctccttaatcttcttaaagttaataacttttttcttatactattcccagattatgttcataactctattgtaaacttcatcagagtgccttattttcatgtctctcacccaccaaactataccttccttgagggcagaaattgtgccaccaaaaggcagatccaaatacagtctgcaatgaagtgtgaataaaatttaaaaacaaaaattacttttagatcaaaaaatgttttagatgctttctataaatatttttttaaaaatcacctgcagttggttctatagtgagatataaaactgaacaacattccaaaatcttaattttttcttaaaaaaaatttccctggtagttaacaagtattttttatttgtactcactgtaattttctctgattaagtgttatttggtcacacttctcacttggctttcaagcctgctttcaatttataagaacaggagaaaaaagaatgctatagcaagtatttaaatgtagcagttatagtataagagaatttttaaggaaaagggtgatacagtgatatgtttttttctgcttaaaacatcactgtcagtatatttttggatcttgaaagatctcttgtgtttatggcttggggcctgcttgctaggcttgacttcagtactgtttactaaattatagcactgcaataagacatttcaccaatatgatattgaagcataacaagttatttcataaggaatggtaattatctaacattctaagcaaatttggcagtgtgacttggtggggcgcagtgctgtccctgacacaatgacagccttactctctaaattagtaacttccgtaggagaccccagaagcacacctccctcccagcagtgaaagccgaggattcccgttttgattagcaggcgccttctgttcac

SEQ ID NO: 7392 - DNA, 1605 bp, Homo sapiens
ttgccgttcgtattttgtttcactttctgcctttgcatgtgaacttctatcttttttactgcactgtgtgtcctttatcactattgctgttctttttttaagtctggctttaaatatcgctattgtggcttttctttttgtatgttaacttcgcgtttagaaagaccgtaaaataagtaatgtgatatagaaacagcagccatgttgtagtgaaaagagaatgtgctttgcaatcagttagacctcaggtcaaatcccacctcttccacttagtaagtagaacagcattgagtcacttcacttctctcaactgtcacagggagtcagtactctgttttgtatggggtggttgtatttggcaaatgcactccagtatatgaaatcagcctgtcagctctaatcctcataacagtcctgtgcctagaatgatattatcctattatcttttgttctttttctgtttatttatttatttattttgagacagtctctctctgtcgcccagcctggagtgcagtggtgtgatatcagctcactgcaacctctgacttccagattccagcaattctcctgcctcagcctcccgagtacctgggattacaggtgcctgccaccatgctaggctaatttttttgtttttagtagagatggggtttcaccacattggctgggctggccttgaactcctgacctccagtgctctgcccacctcggtctcccaaagtgctgggattacaggcgtgagccactgtgccccaccagtattatccttaaataacaaatttgttatgagtaaattttagggttggatagtgaaaattgatcacgaaatccaaattgcaaaatagaaaaatataacctactatgatatttgtatggtatgcaactacaatatcattattggttctcaaaagatttgagatcaatttcttgaatataacttgaaatttcattaaaagccagaagaccatatatatgtatgtatattatatatatatgtgtgtgtgtctgtgtgtgtatgtgagaatgattctaattttcaaatgtaagtttgtaactgttcatatctgaattttcatgaaatgcttccagcatattctaataaaatcatgcaagcccctaaaactctgataacaaaggttaattgtgattagaactaaattctcctgactggtggttgagaactcttcttctctttcccaactgactgactgtaatagggcctggaagatttctgcttttctcactgcctaccttattgtgcagataaagatggtattgggaacacttacataaaaatcactgtgtctcaggcatgattctgaccacttaatctgtgtttaatcttcatagtgaaagttgtaggaatgttttacatatgagaaaactgagacacataagggttatgtaacttgaccgagttcccacggctggttagtcagagagctgagatttgaacccaggcagttgggctccagagtccatgttcttgtctatgacattgtacttggtagcagttatgtatcttcagaagtcccgttacctggttaggaagaggtagatcactctttatagagatttacagcccttttacaatttgttgtt

SEQ ID NO: 7393 - DNA, 1030 bp, Homo sapiens
ggtgtacaggaatgcctgtgatttttgcacattgatttttgtatcctgagactttgctgaagttgcttatcagcttaaggagattttgggctgagacgatggggttttctaaatatacaatcatgtcatctgcaaacagggacaatttgatttcctcttttcctaattaactgatgggcttccctttgtgggaatattgttatgtgttatttctttctcctgcctgattgccctggccagaacttccaacactgtgttgaataggagtggtgagagagggcatccctgtcttgtgccagttttcaaagggaatgcttccagtttttgcccattcagtatgatattggctgtgggttgatcataaatagctcttattattttgagacacatcccatcaatacctagtttattgagagtttttagcatgaagggctgttgaattttgtcgaacaccttttctgcatttattgagataatcatgtgttttttgtcttaggttctgtttatatgatggattacgtttattgattgcctgtgttgaaccagtcttgcccagggatgaagccaacttgattgtggtggataagctttttgatgtgctgctggatttggtttgccagtattttactgaggatttttgcatcgatgttcatcagggatattggtctaaaattctctttctttgttgtgtctctgccaggctttggtatcaggatgatgctggcctcataacgtgagttagggaggattccctctttttctattgattggaatagtttcagaaggaatggtaccagcttctgtttgtacctctggtagaattcggctgtgaatccgtctggtcttggactttttttggttggtaggctattaattattgcctccatttgagagcctgttattggtctattcagtgattcaacttcttcctggtttagtcttgggagggtgtatttgtccaggaatttatccatttcttctagattttccagttaatttgcatagtggtgtttatagtattctctgatgg

SEQ ID NO: 7394 - DNA, 1032 bp, Homo sapiens
atgtgtaatcttgcatgtataactagattgaaaaattagaagagattataagggtgtatttaaatactaaattatattacttgatttcttaggattatccttctattgctcaccttgtccagaaactgagtgaaaataatattcagacaatttttgcagttactgaagaatttcagcctgtttacaaggtaaatgtgtgagataaaaagaacaagattctaaacatttttgattgttagaggcaaatcatgtctgaattgaaatgtgggaaaatgccaccagataggcaaaccgaattttacaaaagtggtttatattaatttttaatcacatattataaaactggtttctaggtttgactcctaaagttagttaggaggaaacatgggaactggcatttaaagataaaagttgctcagtggatcctaattggttgaatgaatagcagttgtattttacgtgttttatcttttaattgcaggagctgaaaaacttgatccctaagtcagcagtaggaacattatctgcaaattctagcaatgtaattcagttgatcattgatgcatacaatgtgagtacatcttaaataagatcagttttggacaataccctgttgagaatactttgtacaaagaaagtaaaacttccttcatacacactttagcgagcccaaagtactacagaaaaacttaaattctgtatgtatctagaggaaaaactttatacatattgtcttacaaaagcaagattcatggcctaaacaaagtgaaaatgtgataaaggcatgtggggagtatttccaaataactgtttgtttatcattaaggaatagatctccttgttagaaagcaattgtaaaacataacttacatttaaacttacaggatttctccaatctttttcctccccaaaatatcctttatagagtcatctattctgatgaattgtgctagaaaagtttttttttttgccaattcttctcttcccatatattcagaggatatgggtttctatttcaggaggtacacactc

SEQ ID NO: 7395 - DNA, 1033 bp, Homo sapiens
attcacttgcagggagtggcatcccactacacacagaacagagttcacaacttcagtgtctaaaaagtcagttgtaccctatcacgtgttctgccttgccctctccagactaatttatggtgttctatttgttttcttctcttataaactgactttttgtctgttttgtccactgtggattgggaatatcttttttatctttgcatcctgaaggcctggtgtttaaagtatttgttgaatgaaactgaatacatacccattgagttacttatggaattcccaggtttttgtaaaaattatgacaacatgttttattttattgtgtttaccgtgtaaaccacatttatttggtttttctcgtttgcgtttgattgccaacaggcaagtttcattttctaatctcttgtctaattaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggtaggaatgttgggaacattgaccattttcattataaagtcttggcaattctcaaatgttgttttatattttattcctttgttactcacaacatacttgtgagataaacaagccagttttttagccttttctgagtggaagttgatattccagtcacacgtttaataatcttttctgccaccttgttcctctgtcactggatgctactgtttgacacagattgtacctcatagataatgacttgcatgcttattttcatactaacttgatcatttatcttatgacttactttattttatttttaagagtttcactcttgtcgcccagactggagtgcagtggtgtgatctcggctcactgcaacctccgcttcccgggttcaagtgattttcctgccacagcctcccgagtagctgggattacaggcatctgccaccacccccaact

SEQ ID NO: 7396 - DNA, 1021 bp, Homo sapiens
cttgatcaggtttttgaaaacgaatgttcagcattgaggtaactgaggcatctggatatgctggtctgggcccctgggagccgcaggagataatggagatagagattctatgggctgagaccattggtaggttttatggtgttgaggaatacttaacactgattttttttttgagcgctgttaattaaatgttaaaatataatcggtttgctttagagaaaggcacgaatggattctggggctctggtatggaagttattttcgcagtgtaggtgcaaggtgagggaaccagatagggaggggagatgggcgagggtctgtggagaggggctggagtgaaatggtttgagagccatcatgtttataaaagcaatagaaggtacggtggggtaatactttctatttaatgcatttttcattttatttctttataactaatataaggcacattttacatttcagatgaatttacaaccaattttctggattggactgatcagttcagtttgctgtgtgtttgctcaaacaggtaaaaacaaaaaattttcttagttgtcttttcatttccgtatcttgtattgcgctttgaccagttaggttcatatgagaacctaagtcataatcatgctgctccttctggaagccctgcaattgttcctcttactcagagaaaggtcaagttccttcatggtcaggctcccctcacccctgccacctgggatgatgggaggcaagttggctggtgaagtactaaaatgctagggattgaacacactgcaagaagatcttttgagaacatgagagtgtgtaagtgaacagaaggcaaaagcaagtatatttagaagcaaatgaaataaatgtgtagaatggaggattatgaactgtccattattatctgcaaagactttctagaagacattctcactctttgataaaaaagtctcacaaaatgttggcatcatctaggaaagcagtgaaaataaagctgaaaatgtatttaacccttctataaagatgtggc

SEQ ID NO: 7397 - DNA, 1102 bp, Homo sapiens
ttaaactgtttccagctgctggccttgttctctcagctgttcttcaacactgaagccttgtttcgcctgcttccgggtttggagctcttccggaggcacaagggtttcagaaggttgactttttgccttgtcaaggtttatagaaggaaaggacagtgacatttaaagtagtgtggctccgaatgttaggaatcattttctgttacctaataacttcatcttagtggtgattgtctaaattgtatgatatgttgacagatttctcaaagcagtctctagtgatcattaaacagcctgagttgtatcctgaagaaacatgtatctgtccatatatggaacaaatatttgttccattccctttgtgtggaaactgcctgcatgcttcattcatcacagtaatgcatttcctcaggaacttttaatgtttcaggtgtctgttgtcatagctttggaatcgtgataacattatttgacttgcttagaattatagtctaatggatttactacacactaaaccttttagacaggccttgaaaggtgaatttggtaggcatttcacacttctgtgacactcagattttgctggtctcttggatacagtcacaagtgatatgtaagcaaaactgcaagctcaggcataacagcctgctgggctgagcacgattgcagaagtgaatgacttttcacgttacgcttaactcttttctctcgggtgctcagagcacaacttaaagcattctctctgagccaggggaatagcatcctggaatgtaagcccttgaagatggaggtctgtaaaagaaatattcagtgttaacttggaattcagtgaacttttttcatattaaaggaaatttgtcaagaaaaataattgcacagttaaattgtgctacagttgttttcattaagaaagtagaaagaagaccctaacagtttaaaaaacaaatggccctcattgtctttatattgtgcatataactctttgttatcttcagattatatgaaactattagtattatttttatattcttctcatctttttttcttttgccttgagaaagtcacgttcttctcattgtgtactttacatccaaaattattt

SEQ ID NO: 7398 - DNA, 1031 bp, Homo sapiens
ccaccacagacaggatggagaggaagatgtgacaaaagatgtggtcaaaattagttttaatcaaggaagcattttggaatgatctgcttaaaaagtggatataattacgcagtttgagaagataattctccttaattgaaattacggggaataagtcttgctctcaggtgcttattgataccgttgatcatgctggttcttttgctggctccactcacaattatctttgacaacttgccccaaagtaaactttctcaaccaaaaccgttcccaacttctttcctcctcacagggaaaggcaaaaaagtccgcaggcatagagagtggaaagaaggaacagcatactaggctggtttgaaaaacaatcaattgctaggtaataatgtcttaccttttgagtggaaggaggagctgggaagaattaagttcgggcaggttttttgctcattttggatcagcccttcatattatggcttaatagctttgtttatagtgtatttttctgcttttacgttcatcctctgaagtcttgagttaattttgtgcccctttacccccatttgaattaaatgcttcatttttttcccgtttctcacataaagctatttttttttcaggacagggaggggctggtggtggtggtggtgctgtaccagttgtctgtttatgagatcaccattagacaacgtttctcattggcttgaattatttgaattttgtgtgattttcctgttatgttgattctgttcttggtgtctatgagttctgtagaggattccagcctaaattttcttccttagttctgtttacttttcctcgacttttgtggttttgctctttgatcactgtcaagatctatttgagattttctgactttcttgaagagcagaatgagatctagattttctcttatttttaaagaagattcttcactgacttcctttcactttttgttctgtggaagtctttcctaggtgttaagtttccaggctttacctccccctacccccaacgtattatctttaggcatt

SEQ ID NO: 7399 - DNA, 1033 bp, Homo sapiens
cattcatttagttgatataatcctaccagaaggaaagcactaagaaacactcgtttgttgtttttaaaggcaacagacttaaagttgtcctcagccaaggaaaaatgatactgcaactttaaaatttaaagtatcttgcactgataaatatatttaaaaattatatgtttataaagttattaatttgtaaaggcagtgttacaaaatgttcagtttatattgttttagattgttttgtaatttttaaaggtgtaaaataacatattttttctttatggaaatctataaaactttctgtagtaaaatgttttcattttactggtatattattgcttcatgttttgtaccatcataagattttgtgcagattttttttacagaaattattattttctatgacaatatgacacttgtaaattgttgtttcaaaatgaacagcgaagccttaactttaaatgacatttgtattctcagacactgagtagcataaaaaccacatagaactgaactgtaacttaaattccaaactatgactactacattccaaagaaacagttgaattaaacattttcataaaatatcccacacctgatggcttttattatattagcactgttctagttaaagaagttggtgacatgccactatccaataacttccaagatttttaaaaattctcttttttaaaatatcctgataaggagagaagattaagaagacattttctgaaagtagaatctcaactcacattggaccctgtcatgataaggaatacggaatttgacgttaggaatgggaatgatcctaaattgtgtgtcaaatgttctatatttcatttggtaaagtttcttttatcatattcactcataacttggtaagttttgttcttgcagaaaatagtaatgaacctgacagtatttattcatgcacccacgctgcatttaggtaatgggaaaagttgggtatgacattacaactggctgtttggtaattcttaggagagttttattccatctaggaccagaataatagg

SEQ ID NO: 7400 - DNA, 1023 bp, Homo sapiens
tttccatacccattttactaatatgaaaaggctgactaatacatgattagaacagtggttatactggcgggcttttattagaaagatgttctgtctttacccaggttatttcttggggaagttgtttaagtgggattttcactttactcctttttctcttctactcataggtcctgaatgttcccagaactacacaacacctagtggagtgataaagtcccccggattccctgaaaaatatcccaacagccttgaatgcacttatattgtctttgtgccaaagatgtcagagattatcctggaatttgaaagctttgacctggagcctgactcaaatcctccaggggggatgttctgtcgctacgaccggctagaaatctgggatggattccctgatggtaagaatgacaggaagcaccccaaaaagggaaggttctggaggaagggcaccagtattcttttacaagtctcatgatacatgaatcattaaaaaaaacctcaaaaggacactggaaaacaaagcaaaactctctatattcagagcagtgatgaaatatttgagctcaagaagaccttagtaattatctagtccaattccttcattttatagataagaagctgaggccatgaaagattacaaaaggttcttttagctatttttgtgatataattgagacaaacacatagtttttctctctaaactattttgctcatccactgacctggctactcatcattaattcacagattgtaagaggatgggctcttagtaattccattacatcaaaccactcattttataaatgcagagaccaaggacctgagaggttgagtacttaataaaattttaaggctaaactatgcatccgttatgctacaaaacaaaaatttggaaaaggaacgagaatgtttgggcattcctaatttagacaggttccctgtacattctctacagatttttcatcttagggaatttgagtcacctcaatacatcatttatagtcattgacctatgcattcata

SEQ ID NO: 7401 - DNA, 1026 bp, Homo sapiens
tgtgcagtggcgccatctcggctcactgcagcctccacctcccaggttcaagtgattctcctgcctcagcctcccgagtagctggcactacaagtgcatgccaccatgcccggctaattttttgtatttttagtagagacggggttttaccatgttagccaggatggtctcgatctcctgacctcgtgatccacccacctccgccttctaaagtgctgggattacaggcatgagctgaacacactttttagtggctgaataatattccatggtatttgacattattttgggttgttcgcttagaacagatttctaaaaaatgcttttgttaaataagaggctatgactcttttaagacttttcatacatcatgattagaacattgcaagccagaactattaggggacgactctagtgtaaaaacactcagaaacatagatgcagactaattggctcctcctagctccaccattgtatatttttatttccaaatcctgtttctaatactctggaagaaaaatctgttctcttttgtgggatacgtaagttaattcttggacggcagcacagcgatcgtttacaggttgttcagtttgaatagctattaatgctcgtgcaaaataaaccaaagagccacagaaacacatttttgctggtgaaaattgtgttcgccaacatcatttctcactccagcttatgatgtcaggcatcatatttctccattattaatgtactatgccagtggggggaggtcctcttggaaggagattaaaaagacaccaccacctcaaatcccccttcctaataatgtgagaatgtccggaagcctggggggttggtgcagtagctcacagtgtcagacaacaccctgtggaggattagcttcctttccattaaccatctccactgtagagagtcaggggtcacttgtactcaccagagaaaacctgacttaggcaaagtcactattcatctgttcagcaccacatacctataaagcctcagaaaccgctattcagtgactga

SEQ ID NO: 7402 - DNA, 1047 bp, Homo sapiens
gccagaacaggagggtgagagctgtctgtgtgtacagcccattcttccgatccatgagatgagactctctacgccctggcagtaaaccccagtgaagcagagatgacagaggtctacctgattacccagcagggagtcactagtcacccagtgtagaaataagtttaatgtcactttcacacactgttcctgggacgagtgttgaaaatatatgctttcttgcaagttccttttcaacaactgaaaaaatatttccagaggatcccaagatctcaaaaacttgcttggctccatacaaacatgtgtattttcgtgcctgccaaaatgagcaagattaacaggataactgaattttgactgtgaactgaagttgatgagtatagtatcaacaggaaaatgtggcactagttttcagaagataatatgattccaggggattttttttttcttagaatagcatcctagaatctggttttcatagggcaggagaccatacccccatctaactgtaggatcccagaaaatcatcaaggggtgacagcctctgttccttcctctcctccttctccctctgccgtcaggacagagggtagtaaatcctgcctttaaacctcaaagtgtttgaaggaaaagtaggtttcttggaacaagatgtactttttttttttttttttttttgagacaaagtctcgctctgtctcccagactggagtgcagtggcacagtctcagctcactgcaacctctgcctcctgggttcaagcaattctcctgcctcagccttccaagtagactgggactacaggcacatgccaccaaacccagctaatttttgtatttttagtagggacagggtttcaccatgttggccaggctggtcttggactcctgacttcaggtgatccacccaccttggcttcccaaattgctgggatgagaggcgtgagccaccgctcccagccatgtactttagccacgtaagatataaggtaggaaatacaattttcagaggccccagtaatgttccagaatcgttatattccatcca

SEQ ID NO: 7403 - DNA, 1048 bp, Homo sapiens
ggttgcagtgagccgagatggtgccattgcacactagcctgggcgacagagcaagactctgtctcgaaaaaaaaaaaaaaaaaaaggccgggcgcagtggctcacgcctgtaatcccagcactttcggaggccgaggcgggcagatcatgaggtcaggagatcaagaccatcctggttaacacggtgaaaccccgtctctactaaaaatacaaaaaaaattagccgggcgtggtggcgggcgtctgtagtcccagatactcaggaggctgaggcaggagaatggcgtgaacccgggaggcggaggttgcagtgagcggagatcgcgccactgcactccagcctgggcgacagagcgagactccgtctcaaaaaaaaaaaaaaaggcaaatacagcaagagagtaggtcctatttcgaacattttgagaggcttttaaacattgcaggtagagatgtgcaaaaaagaacttgagaaacgggaaactgggcaaagctggacatagaaatgtgggaatcacttgttggctaaagctgtagaaattgacttttcgtagaagggcaaggagaaaaagaaaagaaataaatgtctcgagaaaaagcccccttgatgggatggattaaggttagagggtgttccaaggacaatgggaaggcgttatgagagaggtaccagttacaacagtgtcttgctacagaaagctgctgatgtgagcatttcaaaaacggaagcattgttcacagtgtcaggtgctagaaagaaatacaggaaattgtggacatgggcgatacagtaactaggctcaccaggacccttgaggcagcagcttcacccagcccttggggcagtacatcctaacacagacattcagcattgaatgcatatgaagagacaccgcgcatttctttggatttgaaagaaatacacgcagaacattctaagacattcgaagcaagatgatcaagatctacggtgataaaaatgtatttcaccatgtagtcttaagaggaagggtggaattaacttggaaaacttatgtagccctctcac

SEQ ID NO: 7404 - DNA, 1035 bp, Homo sapiens
tcccctgtcctttgaccttgccatctccttcctgcatttctggttatgacagattttccagtagtagggaggggagttggttcttagtggcaacaccaaagagcatgtttgcaggaaagagcttgggatcatggcagagaagaggttactattctagctccttatccccacctcaccctcatgaatggccttatgtgatacacactatatctgcaactcttcaaaagcactctcaacgcttcttcatttcaaatggctacagatgtggctgggagacccaatagaagggattggctttcttttttgtgggactgttatgggcctctatgggtcaaatgaattctgtaggatctacctctttgtgagtagcaaaatccttcttggaccttgttaccttgcaagcaaacatttcatatatctctgtctctcacactctgtctcacactctctctctctttcttattactgtcaaggtattgaaagtggtgactgcagttcagaactccactttcttacttagctgtcttcagcatgacagcataacttcagcgtaacattccctccagtggactgaaaatgtttgctcaaatcaaataccccagtggctcttctaatgcttcaaaacattggccatttcttggccctgatttctccaacttttgtgcaatcttatacataattggcaactccccagtgttggggccttcttctctcctgcatctcatggtgctgtgccatcttggttttctccccacttctctgacctcttctcttttttgcctctatttctcctccaacactgaaatgtaggcattggccaaggttttgcctttgccctgaatttttcctctgaataagctttttgatcttagccactaggctcagataatacctagcttcctgaatctgacgtgagcgttggcctcaaacttacaaattctttctggaggatgttgaccacctggagaactgaccatttcctaaaattaaaaacaaaaacaaactttgcagcttcctatgcaaatgacttctctt

SEQ ID NO: 7405 - DNA, 1026 bp, Homo sapiens
taccaaggaattgtgtgtgtgcgcatgtgtgtgtgtgtctatgtgtgtgtgtgtgtgtgtgtgtgtgtttctgtcttatgtgcattttacccacatatcttacttcagacctcagggcagtctgcttccttctctctatactgattaatttgaagaaaattttagctacaaaaaattggttctcccacattgttgtaatttccatccctaacaaacctttagtgaattctccctgtttaaatgtagaaagactgtgtcttccggggatgatgcagaatccacttagggtgcacagctgccgtagagcgaagcctggggctccatgaagctggggaggaagggggttggtggatcttagtaggccagagatgaaaaagaggtgaaatgtctgcagcctatttctgattatcttcaaactgataactcataaaagaatcccatttttgttgctgtaatatcagtcacaagttccttgttttaattaaagtttcatgattaatgtcaaatccctggtttcatgccggcattttccaacagtcttgtctctgggtagattaatttatgacttaagtgaagataatcagtgctttaggcaaataaactattccatcacatctaaggattcttgcctgggctgactgtacaaatggtgcagtcttccgttaaaagagacagacatgctatggaatgctcatccagtcatcgtcatagccagaggtgatgctggacattatggtcattttctttactgaaaatgttcccaactacattttaggccatatggaaaatgggtgcatttcactccaaaccatattgatgcaattgtgaatgttcaaaaatgcaaattgcatcattcctgcgggagatgcagtggcttcccagaccttcttttccttccgtgaaaatctttgtgaacattcagctgtgttgtgtgtgttgatggagagggttgagcaatacatactgtcgccaaatgattttcttattgataaatggagcaatatactttgttttattactcaattg

SEQ ID NO: 7406 - DNA, 1037 bp, Homo sapiens
tttatttatagaggtttcaaacatttaatagtcattgaagaactgtgggctccctttttaattttttcaatgacatcaaaaccctcgattgttaaatgtctgaaaggaactcagaatgcttgccccacaccatgctgatagctacctggctgcctaggaatctgatggccctcggctccttgaggttcacaaagactgatagctgggtggtacagctcctgtttcctgaacgctcaccctgcatgagcagttctaggggaccgttgggtcacgcttaacacatttctgtagccatctttgcctacctctcttctctgcgtccttaaccctctgcaaaatgatttcacaagaaatcaactatagatgcctgtgccatgaggtgtgatctattagtaaacagccttgttaaaaacgtactgaaaggctggcattcccctggtggtcctggcaaggattcataagattgaagagacatgttagcaacattagatgagaagtcactaatagtgctgttctcttatagaacaattggataactagttatgcaaagcctctataatttggttctgctgcccccattcaggccacctgcagacagtcttcacttaggcaccatccttattgccaattacttttcttcgctgaaatacttcttctttaatgaatgttattatttacactttgcagagtagttcatgacaacctgatttgacttgtgtccacgacagagacttttattttttagaagacatgtaagaaaaaaagtaaatcatgtgttcatggttatgtctctaaaaaatgcaattctgctgatgtgtagctaaagcagcctattaattagcaaaggcacttaaaattgttttacaccacagacagtattcaagctttgagaaataaaaaggtgtgttctttgcatgagaagttcaggcatatattatccagagagagctcattacttttttctcttttacagaaagttagataacagcctcttttgacagaaaaatgtctattttctgacaaaggaccggaggcat

SEQ ID NO: 7407 - DNA, 1076 bp, Homo sapiens
cctatggtccattttgagataatttttgtatatgagatgaggtaagaaactcaagttatcttgctcgcatgtgtatgttttaaccgataattaaaacagaccagtctggccgggcatggtgactcacacctgtaatcccagcactttaggaggccaaggtgggttgatcacctgaggtcaggagttcaagaccagcctggccaacatggtgaaaccttgtctcaactagaaatacaaaaattagctgggtgtggtggcgtgtgcctgtagtcctagctacttgggaggctgaggcaagggaatcacttgaacccgggaggtggaggttgcagtgagccgagatcatgccactgcactccagcctgggcaacaagagtgaaactctgtcctaaaaaaaaaaaaagagaaaaaaaactagtccagtctgcctggtgaactttcatttgtcctctggaacccatcttggatatttaagctctctgtggtactttccgtgtcctctcttctccactctgatacagcttcctcctacttatctctgtgtacatttgtctgttgttgaatatgaaatccagtattgtcatgatgtgtatatgtctgtgttccctactggaatatgagcttattcatcttggtgttttcaatggctgaaacatagtaggacctaaaatatttttggttaaatttgattaaatattaacatctctaaaccttgaaaatcttggtctcttttttttctgtctctctttcaaaatttaaaacagtcaagcatttgaaacaacaacaacaatgaaaatagagccagggaaccagcttgttcaggaaaaggaataaatcattctagctgacagtactcagtagactgctttgtagctttttgagatagacatataaaaagggacactgatttgatggaacttgaacaggatgatggataagtgctccaggcctaatgaaatagcatgtctaagaaaacctggaaaccctcagatgacagcagacacgcgaccagttccacctctgctatttactcccagtcattctgcgctttgtttggccgagggtttcatggcccc

SEQ ID NO: 7408 - DNA, 1029 bp, Homo sapiens
aattgtagaatatttttaaaaaattaatagtaacttaattactgtcagattcatggagttccttggagaaattgctttggcaaatagataaggaaaatttacaaatagcacaaaacttggtaaataaagcaatttctaaagaatccgccatggactagtatttttaagttattttctccataaagtgcatgtatgttatcaatttgccttgcaaaatcatttttataagaaagagagctatttctgtttttaccaattatttgtggtatttgaaagtcattcatttacaaaaacataagaatgatatccatttactcattcattcattcattgagcaaatatatattggaggtcactgtgctgggtacatagtggtgagttcaataaagtccttgccttttctagcatgggggatgggagttaactaaaaaataaaataaatgaataaatattttgtaatacattatgataagagcataatcaaggtgctgaataatttctttgggaagatgacatttggctgagtactgaaggatgcaaagaagtcattcatgcagagaagggaggaaagagccacccaggcagaagggagctatgtggacaaagcaaaaggctgggagatgtttagcatgggccagaaactagaaggtagtcagtgtggctacagtgtgttgagtggtatgggaagaaatcagagaggtatgtggcagatgaacctaccgaggcaaagctaaaatatgaaattttattccggatgtcatagggagccatatagtgttctttagattgtgagcatagtctgattcataattttgaaacatcccaatggctttttatgagggaaactgattacaaagtagttgtatcagccaaagtagttatatcagtagttatatcacaaattgattacaaagtagttatgtatcagtagttatatcagaaattgattacaaagtagttacgtatcagtagttatatcagaaattgattacaaagtagttacatcagccaaagtagttttatcagtag

SEQ ID NO: 7409 - DNA, 1050 bp, Homo sapiens
aaatttaaacactctttttgtagaggatctaattttatggtattttaacgtcaactttgataaatattgggaataatattttccaagagctaaattattcttagtttccccatccttttaagaaccctaattctcactctccccctgcactcccttgatgaaaagagttgcagtcatccagacttattggagaatagacttgattggtgctaagagaattgtgaaggtctttagccccacattatttcttattgaatcccactaaaacttttgaaaatttcacattggtttaagagatttggacatctgttaacgttttccgtcttgagtactagcatgggtctaggtctgttccttcctgtaaactagttgttgcaaggcggtcagggttgcaagacaatttttccataataccaaacaggaaaaacaacagtagcgcaacaaaaggtttctaccttgctaaaaggaaaagaatatttttataattaaagcttttagttatttgtcatatactcattatcggaaaatgttgttatctttagtcctgtattgacacaaatgtgttacgtgttctttattatagttgtggaaaactttagtaaaggtggtattaaagtagtcccggtcaggcagccctggaaactgaaataaatggaataagagtgggaaataaaaaaataagcttcaatatctgtgtttagcccagtaaatggtgtctattactacagatgcagttttcttttatggatatcactggacagacagtaggctgtgtagattgtgaaatttagtcatcatctctccagtaagtgctctctctccccatttccttagatcataagctgtaggttacccatattatagccgtcacataccccaaaactagccttgtacttcaatagatggttggattaggtataatctccaaggtctttttaaactctgattccaacatttggcattcaccagctatagagaagatgacattgtcctagtgacacccttttagttgtgcagagttttctcggtatctctgttaattcaaatact

SEQ ID NO: 7410 - DNA, 1023 bp, Homo sapiens
acattattaaggtcccacttatgagtgacaacatgctgacctagttttgacagacaggggacctagttaaggtactggatttatatcttcctggtaaatattaaatatgatgaacactttactgtgaaagttcctagatacctcttgccctgaaaagccactggcagacagctgtgtcttctctgagtggtcgtctgattctttgaaactttctatgatatttcagcaattaaggattgcttagcctctacactcatggtgtcctgaaacctcaggtagctgaggccttaagacctgcgggataatgagggagagccaggccatgaagagatgctgcagaccctccaaggtagcaaccagatggcttctaggcctcaggtaccgtggctcatcactgtgggtggtgattgtgactgtatggatcagttccagagtaggtctgtcagaatatcaatgtctttaatatagttttaagcatttgaagaatttaacattcttggtttggccattcatgactgtgaatgacacatgatttacagtattgctagggcctgtaggctttgctggagcatgaggggttaaagaactaatgtgagtcaaggacagtatctgttgcgcacctacttgacacaaactactttactaggccatttcagatacacagacaaatgtcgtaaagtaatgattgagtccacaccttccttctgatatttatttgtaaggaattttatttgcatctgggagagttccattagtctctctttgtaacagacaaatctaaaacctactcccacagtttcttgtaaagaccagcacatctttgaattgtcttggttttttaataagatttccagcttttataccagatcaaggcaaactggatgtaaatatagcgttatccttgctgaacactgttgcagaccaacaggttcacagtttcctacatcctacccatttataactgaaacagtatgtcagttgatttttaaaagtgcaggtggttttctgatcgttcactatgat

SEQ ID NO: 7411 - DNA, 1050 bp, Homo sapiens
tctcatggctcctgcaccattggttgaaaaaactattttattacattgaattgtttttgctgcagcattgtgtagttttcaacgtatctatcttacacaggtctacataaacgaaagtttggcttatagatgtgtatctgtgtgttttgtttcgttagggattataaatagcattgcatttttaatttcagtgactacgtgttcattgccagcatatggagaatacaatggatttttatatgttgatcttatatcctctgactttgttgaacttgctttttagttctgggagatttttgtagattctttggaattttctttgtagatcatcatgtcatttgcaagtaagaagcattttatttcttccttttccatctgtgtacttttatttccttttctaggcttattgcattgcctagaacttccaacactatgtggaattacagtggtaggagcacacatccttactttatcatagggaaagcattcagtctttctccattatgcatgagggaacctgtcggtttttggtagatgctcttaactttaggaagtttcactttatttctagttttctgaaggttttctgacatgatgggtgttgaattttatcaaatgcttcttctgcatcaattgatacaatcatgtaacttttcttctttgatctgttaatatgatggattgtagtaattgatttttgaatattgaaccaggcttgaatttttgcagtaaacaccatttggtcacggtgtataatttcttttatatattgctgaatttcatttactaatatttcattaagggttttttgctttcatattcatgaggaatattggcctatatagctttcttttctttcttccttttctttgctgctgtctttatctgattttggtatcttttctgaattcttttgaatatatgtttatgtattgtttttgctagcagaggtctacttcaaacatgaaaagaataactgcaataaaagattatattcagtctaaagtgttgctttatagaagtaagattttactgcatttaagtgtgtac

SEQ ID NO: 7412 - DNA, 1036 bp, Homo sapiens
cgaccctattgagttttttctctttgtaataatggttccttgccatcctaatcaatattacttgacaattatagagcttgcttctctctgtcttgggtgtatatttaatcaaaaattactatgctttggccccttgatatatattttttaagtatctataatgatgcttttgaacttttttcttgttctggttaaaatgttatttaattttccttaaaaaatgcagtttgctcttataatatttcactcatttcaaatgtaacaggagatagaatacatatgaatataaggtatatttttaattctgtagggatagcctccagagtgtcccaccaacatggacatctgattttgtccctatataaacttattttttaaaaaacaaaatgagaaataacagtatattaaagttcattcatgtatctgtccttcagagaaaaaaagtgaaatgaaacacatggataggcaaattacaatttgcaaaccaaagataaagttctggacaagacctgggaaatacacgtgtggcaggtgccctaaaacacgctgcacctacaaccaccaaatgttgtatttttcaaaagtcctgtttttattattttttgcataccagtcttctgaactttgcatatggcaaatgaatggcaactattgtaaattccaaacttttccaattttggttgttgaaatcgtgtttatagggtggaatgaacacagaagtggaattcaggtgacttgcatcctcctctacattcttctaagtaatttgggattttagtcaaaacttcaactgcttgagctttaatttcttcatttgtaaaactgaagatttggactagataattgactttcaactggtgtgttgtgatctctggtcaggagcagtacctcaatgggtttggagagtgggaaaggccaccagtgtcaccttccccccaccaccaccttcacagttgttttactcacttctgtacatggggatcctttgtaaattttagtttttaaaaagggtgtttttgagtatttaggaaaaagt

SEQ ID NO: 7413 - DNA, 1008 bp, Homo sapiens
gaaaagatgtagcaatttaaataaatttttctcctttgctgaaatgtctagaacaatacaatacagacttttaaaaatccttcacgcttgtgtatgccatcccaacatcctcagtcatggcctgaaaaacctctggccactcagatcctaattttttgcatcaagatcactccaggtatctctccttttctaggctttgtttttggtaatactcatcttttaagtttcacctgactgcatcatgggcttttctccatcatgcatttaataatgatgttgttgctatctaaaataaatatcatcatttcttctggcagaaaagatcatattgaccatttaaaacctaattctgatgttaacttttgccaagatttccagcacttcctacccccagtaacccaggcaattacaacacaagtgaatggctttggactcatctctacaccaccatataattatcactgcttgtaattctttctccttcactagggcatacgtcctttaaggacagagactgtgtcttgcagtacctgctctgcagcagttgctcaatgaatgaatgaataaacaatgcaagttagtggggcttctttgtaaatttcctggtaatttttcaaaggacattcacagtttagaatgcgtgtagcattttcacattataagacatttgagagagtatctttggctttaggaaacttcaaaccagaaaaattgcatgcattgccctgagctatatagttgtagcgtcagaggtagtaatagactcgaggtctctgtttgacaatcatttatgaaaaataaatgtgctaaattctgttttgttctaccaggttgagcagatatgtggaaaattagacttttactaatatagcaaagtattaaaattaatagatgtaacactttgatcgatgtctagaattttctcttcttcttttttcactggacaggtaaataccagctgtcccctacagtgaatatgccccaagatgacactgtcattatagaaga

SEQ ID NO: 7414 - DNA, 1030 bp, Homo sapiens
caggaaacactgggatctcaaaagcccctttagctgaattttttcttgaaatcagggtcacatcttccttctcagagccaacagtttctcttctagttggcagagttatacctgggaggtgaatcatgcagagaaacagttgcttattcatttatttaaaatgggatgcctcttacaaagcccctagtagggaacagtctttccttccctgtcctttcttttttatttgagacaggatctcactgtgttgaccatgctggagttcagtgttgtggtcacagctcgctgcagcctccatcttctgggctcaagggattctcctgcctcagtctgccaaagtcctgggattacaggcacgcgccatagcacctggcccacagtctggctttcttagatgatggtgttctcttgtgagattatcaatagcatatacctccctctctttcctcagtccccattttctctttctctatgggattgagtctgttctcttagaatgcctcctttttcagtgatctgtattgtattatactctgcttgttctaaatgtatgttgcagtttggaattaggggtgaggaggacacagggcatcctctcttgaaaggtaggatcatctattttcccaaatatggaaaaacatactttgttgtataataggacatttgaaagttaaaaataaattatatgttgccttgataatattggagcttgaaaaaagctaaatttcatggatccattataaattatgtgccaactgtagaaaataggtcagacttgcccatgtgcaaaatgagctgttgaaaatgtgaagtttttcttaaatcaatgttcagattcccacattttaagatcaaatcaactaagataaaatgattagcaaataatacaaactgaaaattatacctaagttgtttaagagtttttcttaatttttaaacttctgtttaataaacacataaagcaccgttttcaggttgcagtgaccactcatctgaacctatgatacaagcatattttacagagaaaata

SEQ ID NO: 7415 - DNA, 1136 bp, Homo sapiens
agttgataaggtgcagaatttggatggaatagcaaggtgatagaaagttagtttctattttacatcagaatatggagattcctatactatctgactttatgaacattctcagtaatatagcatttcaaatgatttttgaagagcacaatttttaaaaaacatttttctgccagagaactaagttctaaaagctggcattaatttctgtctatgtcaaaagccaaatggattaatagtggaatatcacatgaaacatacaatgtttcacatcagtgttcttaatgataataatgacttaagacttggtaagaaagctgaaaaagattattcccattctgcagttgttataataaataaactatcccctggagaatatgctcttctttaaaacaggttcagagttcagcaatcagaaaatattgcaacttgattaaaatttttcttcatatatgcagccagctccttatcctgatctttcaagtaggaaaaatatgagaattgtaagccttggtaaaatgttatggaaatgtaaaactcagtaaacactgaaaaggcaactgaagattcaaatcagaaagtaacaattaagaaccttccagagttgaagcaagtaagcatagtgagtgatgagacttaggtgtgtccatagaaagaatattcttgttttccattttttcaaatgtagcttttccatgcttataagtactgattgacagaataattttttatttcagcaacctccaaatttaaagtcaaggggaactatgatgtgtattgatgttgttttgtattttaaacatcaaaatttaccgtactttatattcttgtaacagattttatattgaggtagtgcagttcattcacacatagtcattatttcgtactctgtaaatgtttcaaggggctgggcacgtaagcccaatactttgggaagccaaagtgcgtggattgcttgagcccaggagtctgaaaccagcctggccaacatggtgaaaccccatctctaaagaaatacaaaaatttgcccggtttgttgacatgttcctgtagtcccagctactctggaggctgcagtgggaggatcacctgagcctggggaggtcaaaggtgtagtgagtagtgattgtaccaccgca

SEQ ID NO: 7416 - DNA, 1997 bp, Homo sapiens
acaacatgcaacataagcatcagcatatttggttcagttctccttactccctagacctatggaagtgatgcccttgggcccagatggatgcctgcatgctctatgggtaatgttacaggacaggactctgagctgatgaatcttttataatggcagtaagcaagactcactccccttggccctggagggagacactgtctctgtctcccacagcttatctctgtagaggtatctttgaaaagcaagtccagaacagaagcaatcagtgcctctgtttataagacatgcagatttgcaagagacaaatggagaattgtgtcccaacacagaaaataaaagttgtgaaatgaacagtttaataagaggctggtaatgatatcaattggctcggtcattttagaaagtagtttgatactggctaccttaaaatgatcatgccatttgaaacattatgttatagacttcctccaaagaagtgaatcctaaatattgaaatgtttttatttagaaatctgtcagttactggagttgaagtgttctttgatgagtgaattgtgaaatgatgatatgtttacccgatagaatattgaatcattaaaaattgtttctttaatgattgcaataaaatgatacattaaatatttatattttattattactatgtaagaaaagaaaaacctatatgatctaaaaaaaaaactgaaagtaaacaccaaaggtaagaggaaaagacagaaatcatctcacatcagtacaacagtgtcctggagagcctggtgttctttaatcactctaactgaacttttgtgccatagaagatgaaggacacttattttttaaaacaaatatgttaccaaattcccattttctttttaaaatttatctagagggtggtgttgagcacctagttagcccttaatagttacaagacagttttctgagtacttcaattagctcatttgatttttgtggaaactctgagatagatactattatttcccacagtttataaatgagtaaactgaggcacagagaagttaagtaacttgtcaaaatgattctgcatgcaaaatccgtgttttttattactgtgctcagctgccatatcaaatataacatgtttaatactttaaattattgtatttgtttaatatcttaatttttgtttcacatttgtatcatatactgggaattaaggacaatgcaacaaatacatagctaatgagttttattttcaaaagaaaaataagtgttactctggtaagcaagccacttctgaaaagagattgattagtctgaataaaatcgtgtcaactagagggtggccacttggtcactagtgtgtggtgggagaaccctaagcagtgcagacgcccttcgtgcaaaacaagcggtgccagtgttcctggcatggtggtatctgcttgagtggtcatctgggataaatatgtataggaatgcggcagatgatggcaggtaaggtgctgggactagttattagattcagtgatttttagtaagcatcaatatgtaaatcttcctgtgtgaatcattgatgacaggcaaaatggaagaagaatgtgaagacaaattgcagtgtacttttggatgctggactaaatatcttccaagaagattcctccatgctctggaatcctaataatcaatgagaagacttacatattggaactgaattttaagattccattatgcatggaactggtgcagagatacatactttttgttgttctctgtggttagatagctttcataaatcagcaccatctgttcttttgcctttggttgtatggagtcatgttgtatatgtatcaagacgggaggcatttcatttctctgggaaatggaaatttcatggactgtgttaaatactacatttgatcagtactagcttgagataagaatagtaggaatctggttgaggggatggcgcttatatacagtgattacatcacaggcgctgaataattcttcataga

SEQ ID NO: 7417 - DNA, 1102 bp, Homo sapiens
attagaataaaatttaaccttttaaaatcatctctggttcttttctgaagaacataatctgacacaaaaatgacatcagtgttaatctctatgtctgcttccattccttatattctcttttgtttttggcgggcgtgtgtagttttaataagattaaatgtaaggataccattaagaatgctaagtatcttcatgagagcttctgcttgaccacttgctaggcatctgggtcccttcgtgatatgaatggagtttggagggcacagcatcactcatttgcttttggacctggggtgtgcagttgaatgggggtactcatcaatttctcctttaaaacaaattttacaactgtctttatttattgcttctttggcctatggagctaaaagcctgcaagcagcggggaagtaagttagaaattttactgagtgaaaaatctttggtggtgtgtggattaaccttcaggggaagtctgttaggagctgatggttttcttacctgtgaatactactgctagaactagacatttagagcttgcactacggagaaagatacattttcatttttaactttgaccttcaggtgcctttgcatattttcattgcaggcagtcttaaagatttttgttgtgagctgtgtgattaaatacgacaatggaaggaatacatgctttatactataactctctttattcccacccatctgtacgtcatttgcttttgaaattttgttctttatttctacgttccatctatgttccatgagctgtgcaactgctattctttaaaaaatactggttatgaaattgcattaacattttcatcctacaatgtgtttttttcactgcctgtgtcctacaagcctgcttttagaaattgaatcacttttataagtcatttttaattttgaaattttatgatctagctatttaatctatttctatccaggactttcccagttaccttcaacatggtcttgaaatggccctaaaaaattcccgtcttcagtgttcaaacattttgcccggtggttgtatgttttcttcccaccgctgaggcctgggtatatgtgccctatagtatttttgtgacttctgtagata

SEQ ID NO: 7418 - DNA, 1036 bp, Homo sapiens
aggccgagggtcccataggcttctgaatttcttaaaatatttcatgttttcatttggaagtgagatggagagggtaagggagttgtggcttttttcaaagttatttgaaatactcacctttgtgtccagtattttgtggctgactaccttttccaactgttttagggaacattttgctcatactttgtgtggaaagtttcttgctagaggctgtattttcatttgagagttaacatgtggttaatattttatcctgaggaagagtatttcaatcggtgtgaatacttaaatcatcttgccacctctttggtcttccttattaagtcagtgttgctgtgaataaagaggccagctagtctgtggagagcatgtgatttatcccatcaagaaagatgtaatgagctcttagaagaatctgctttccatgcagtgccggggataaggactgtggactatttcactgtgcagttgctacaagccattgttccttccctctaaataatgagtggcattgtttttgtaaatgatatttccccctaaacaattaacataggtagacttagtataaaaaccaggtccggacaagtttccaaaagagattctcacctgattagggaaaggggaagaaagtaataaagggaacctattgcattggcatcattagcttccttttcttttgattttttaaatggagaccttgcaatgtttcttaccccttgggtttattatttctgtttggtttagttgcttagcatgtttgctatctttccaatacccccgatacacacaaccacttgtaagagatgctttcttagttatgtctttgtcatctcgcttttctttctattagaagggtgagatgttttgtctaagtttaggaaattatttttataaacatttttgaagtatttttcaaggttccccaacccccttttttttccctgatagtaatacagcttgctctttgcatatgtacggtaatgaagggtatatagaagcagggaaatgccatcaggcttctgtgtccatgggttct

SEQ ID NO: 7419 - DNA, 1289 bp, Homo sapiens
agtggtgcaatctcagctcactacaacttctacctcccaggttcaagcattctcctgcctcagcctcccaagtagctgggtctactggcactagccatcacacctggctggttgtttaatttttttagaaacggggtcttgctgtgttgcccaggccagtctcaaacttttggacttgggtgttcctcccatctcagcgtcccaaaggctggaattacagacatgagccaccatgcccagcctgttgttttaaatgacatgctactatcattgtagaaaatttggcgaacttatagaacaaaataaaattattcataactccagaacccagcaacaaccagtatttacacacacacacacacacacacacacacacacaagttggagtcatgctatgttcatatatttgcatcctgattatttcaacattatttttcgtacaatagggattttccctggtgtgaattttattatcaatattttaatgagtgtaaaacatttcattgtagattgtattctgttttctctcaattttggacatccatgctctttctctttttttcacattttaagtatcagtgttgtgagacatccttaaatataatatttatcttaaaaattgttaaatattcagcaatctttttacttccatggagcagtatttaatgtaaccagatgcccatactttcccataggaaaagccttgatctacatacatatttttagatgaagtgatattcgcatatgatatacttaaatagtaatgtgtaatgaattagtattttgaattttcgttggctttactcttcaaatactaatcttgctgtctgcgttttatgctgtttgtattttagtctgagagctcatatataaatatgattagatggcattttattttcagttataaaaagcctcctcatcttttcaatattcagaaggaaggaaagcatacttgctgcttaggtacaaagcattcaatttatttatttctgttaagcccaggagagcttacctatggtctcatgctttaagatgttataaattcttatgagtctgtagtggttcaggttttctgtataaaattgtagaaataaattagttgtgcattcatagccctctgatttagtgatctctagtggttaaaataagttaacattcttaaataactcatctacatagttaagtggtttatattcttccaagttaaatgagcagagtaaattattttagaataatgttaccaatcaattaaaatcttgtttctaagcaggaaagttgtattctgatat

SEQ ID NO: 7420 - DNA, 1042 bp, Homo sapiens
gaatggaacatcctggagggattattggccttccagttcaaacgattcttctgcctcctgcctcagcctccctagtagctgagactacaggcatgcaccaccacgcccaactaatttttgtatttttagtagagacagggtttcaccatcttggccaggctggtctagaactcctgacatcacatgatcttcccacttcagcctcccaaagttctgagattacaggcttgaaccattgcgcccagctgtagatatttgtctttggaagaaagactttgtaaacctccttagaaagcttttagtggggcgggcaagcggcggggccatgcgcatggcatgctgggctgtgggcgctggctgctgggaacccggcagaacatggccgtgcatgtgtgctgaagggagaggtggccacagagatagcgtgttcctcatgatcaagtgccactgcatcaccatcttcacagatgccagggtgtctagcatggtgtttgagttgaagtgcatcgtcgagggcatcctcagcagctgtacagggatgaccagctcttggatgttggcaagacgctgggagagtgtagcttcaccagccaaagtgcatggccacagccccggccacagcggtgctgggcttccaggcggacgacggccttgaggccctgcacatcccatggttaggaagccccaggacacaggaagcagtgctcacgagcaagccgtgcacagagggcactctgcgtgtccgtgagaggcccacttcccccagtaaaagagatttagatgtcgggggcaaaaaaaaaagggttttagtaccatgaagattcatttgcatcccagtgcctgtggtcccagctgctcaggaggcaggggtgggaggatcccttctgcctgggaggttgaggctgcagtgagcccagattgcatcactgcactccagcctgggtgacagagcgagactctgtctcaaaaaataaataaataaaaataaataaataaaataaaaataaaaaattcatgtgcaagatgaaaagcccagctctga

SEQ ID NO: 7421 - DNA, 1079 bp, Homo sapiens
ccactgtctaagtccattcaggctgcttcaacagaataccttagactgggtggctgataaacaaccaaacctcatttctcatgtcctacaggctgcgagtgcaagatcaaggtgccagcagttttggtgtctagtgaaggcttgccttctcatagatctttacttctcaatatgtctttacatggtgggaggagcaaacaagctctattgggtcattttaataagggcactaatccaagtcatgaggacacagcttcccacaaggccccacatcctataccatcaccttggggattaggatttccactcttgagttttggtagacacaacattcattccataccactagggtaatgtcctgatgccaaggtctttaccttaatcacatgtatgatgtaaggtaacatggcaggttctagggattaagatgtagacatctttttttttttggcggggaggagggtgggagggcattattttgcctaccacattttacatgcatttaaatatttacggtagtgtgaaaataacgcactttacaaatacatcgtcttccatgataatatgaaatgagcatctgacctagtgatattaatgggctgatcattttgatttcagtattttgggaaggaaagtaatgaacagtaatgatctagtgagtgtattcacccattcttacattgctataaagaaatacctgggactggggtaactttcattggctcactgttctgcaggctttctaggaagcatgccattggcatctgcttggcatctagggaagcctctggaagcttataatcatggtgaaagttgaagggggaggaggcacgtcacatgacgaaagcaggagcaagtcgggcagaggggggtgccacacacacacttttaaatgatcagatatcctgagaactcattgtcatgaagacagcaccaaaccatgaaggaatcgtccccaggattcagacacctcccaccaggccccacctccagcattggggattacagttcaacatgaaatttgggcagggggcaagtatccaagccatatcagtgagtatttctttgagaccattttt

SEQ ID NO: 7422 - DNA, 1074 bp, Homo sapiens
gttgttaatttaaagagttactattgagggattctcttatttatcatttgttaatgcaggcatttctggatacacgtaaacatatgaattgtcaagctaaattgttcacagattagaacactatgctgttgacccctgtttccacgttactccctcttagatatgttggaaggttggcagagtggcaaggctggaacatatacccataggtgaggtactgctctaatatcacaaaccatggggctagagcctgagacgggtttgaggtcaagtttcctggtactgtgtacgagaaagtctatccacactttgccattcttggcttagccagtaggaacattcgctagtctttaatgtgctcatggtattttagtgttcttttctaagttttaggtcttttttatcagacagtatatacccttcttaatatgctgatgaagcgtggaattaatctcacatgcataacatttaaagttttccagtggcaagcttaagattcttgttctgtagcgagtttttattggtatagtttgtattactatgattacaaaacatcattggttcaaatatatccttttgcttactcgtccagttaaacactagctctatttaaatgagtttttaatgaaccatgctagcaagtaaggctcagagaatgattaaggatttagtattgtctctgtgtcattaaagtaaattcagtcatcagaaagcttacaaattgatttttagttccctttttgttgtgtctacgtaataattagttactacatcatcgcatttgcttctgagattattcatcttgcccatttgccagtcttaccatgttctctttgagggaacactgcatgtgttcatgataaaatcacaactcgtgccacttcctccagtttggagtcaacctatctgtatgtgattagcccatttctgaattattttgttctgtcttactgtgctatcctactttttattaatacttaagcagtagtgttatgtagttgtaacctcatgggtggataccagtgtaacagtggcactcatgatagagagtagagcaagaggggtttatattat

SEQ ID NO: 7423 - DNA, 1061 bp, Homo sapiens
gcctcctgagaagctgagattacaggcatgcaccatcatgcttggctaatttttgtattttttagtagagacatggttttgccatgttggccaggctagtcttgaattcctgacctcaagtgatcccccaacctcggcctcccaaagtgctaggattacaggtgtgagccaccatgcctggccctaaattaggatgatactaatgatagcaacaacaacatcaaccaccgtccctactgttctgcagccgctggaccttgggctcacttgctttgtgcctgtgattttgttcactgtctgcatatacaggcacatttgctcataatgacctcagaagtttatggcaacttcctgtggttggcattgtagccctcttcatttattagacgaacagaaactgaggcactgagagctcatgtgacccattcaatgtcacccactagtcagtgaaaatgtgtggatttgaatctttgtcttctgacctccagggctgccccctcaaatttctcctgccgctcttcagcctgagaggcacgcccgtcctttggagtggaactcacctctttccattgacttgacccagacagactcctcctgtctgcatttccacagcattcacattccttctgggtctttttttttttttgagatggagtctcgctctgtcacccaggctggagtgcagtggcacaatctctgctcactgcaagctctgcctcccaggttcatgccattctcctgcctcagcctcccgagtagctgggactacaggcgcccgccaccatgcccggctaattttttccttctgggtcttaagacctcctcacactgatacttgttgccttacaagtagacctgcctccaaaagttaacccgttggctatgtggaaattgaagtgcagcctttcatggaaatgggggtgtttattatctcttgccgacgtactgaatgctttctagagctgaaatatttttgccaacagatagaattgcaaaggactgttttgccatttctagtggatgtagatgtttagggcaaatggtgttaatccaaggagtaa

SEQ ID NO: 7424 - DNA, 1066 bp, Homo sapiens
aatgttggactatgaggtccatcaaaatttaagactttcaaaggaaaaaattatttaaaatagggttttgtacattaattaaataagactgtactgtgggtactctttaaaggcaaccacccaagttctgttgaaacacatacccataatccccacagagctcttctttcagaggatttctcatgggaacaagttctactgctagtagttgaattatctatgttatcacaattgtatgaagaaacatattggatcaagatttctactgtttgcgaaaatatcggctacaaacacacagaaatgcaactgtcgagctctgagttacctgttggttgcagttttgttctcctgctgcagcccactctctggaaatgctggggcagccactgtttgatttgtttggacctggctgatgtaaggtctaagaatggatatacctggattattcctgtccaagtagttgaaagtggactgcttttttagagtgctgaacaggaattgaatttgggacgtgatagagaccaaagaaagacttgtaggaagtgaatgtcatttttgttcaaagtatttgcaaaactaaagccaataaaaggctgccttctcggtggcccttttatttagttcctggctttttccttggaatcagagaaaagtatggcaagtttccccacagaagagagtggaatgtcaaggaagattgttcataaaccacattcattgagtgactgctgtgtttagggtgacattttaatgccagctggtagttaattgcatgctattttatttttttttctgttatcttaaaatatccttcatacgtgaccacgctattttatttattagtttattttattttgagacagagtcttgctctgttgcccaggctgcagtgcagtggtgcaatcttggctcactgcaacctctgctgcctgggttcaagtgattcttgtgcctcgacctcctgagtagctgggactacagtcatgtaccaccatgcctggcttttttttgtgtgtgtgtgtgtttttagtagagttagggttttgccacattgcccaggctagtc

SEQ ID NO: 7425 - DNA, 1028 bp, Homo sapiens
atctctactaaaaatacgaaaattagctggacttggtggcacatgcctgtaatcccagctgctcaggaggctaaggcagaagaatcacttgaacccaggagacagaggttgcactgagccaatatcataccattgcactccatcctgggtgacatagcaagactccatctcaaaaaaaaaaaaaaaattagcaggcgtggtggcgtgcacctatattcacagctacttgggaggctgaggcaggagaatcgcttgaacccgggaggtggaggttgcagtgagccgagatcgtgccactgcagtccagcctggtgagagtgcgagactctgtcttaaaacaaataaacagacaaacatgggatataggattcatgaaatgtttcattagctcttatgcagtgatatgtacatacttcttttcagcctgtgacttcaaccttattttcaggcttttagataatcaaaaaaagtattcatttttgcccacattcaaaatattacatttataatccgagtaactgaaagaatgatgatacaaaatatggttgtatgtagaagaatgaatgattgtagtgttatggttagtatagagttaactgatattcatggaattagaaaaatggatttgttttttaaaatcaataaataaggtcaggtggggtggcttatgcttgtaatcccagcactttgggagatcaaggttgaagaattgcttaaaggcgggagtttgagaccagtctaggcaacaaaggtagacacctgtcactacaaaatataaaaattagccaggcgtggtgacacatgcctgtagtcccagctacttgggaggctgttgtgggaatatggtttgaggccacgagtttgaggctgcagtgatctgtactgcatctgtgatggagccactgtactccagcccaggtgacagagtgagacactgtacttagaattaaaaaaaaaaaattaaaataatcagttttaataagttaaaaaggccatatttctctcttcctctcctctctccagataat

SEQ ID NO: 7426 - DNA, 1055 bp, Homo sapiens
ggcaggagaatggcatgaacccgggaggcagagcttgcagtgagccgagatcatgccactgcactctagcctgggcaacagagcaagactctgtctccaaaaaaatatatatatatagtcacgtgtaacacagtgttatatttaagcattgcaaatttactttgtgaataatttctccctcataatttaaaaatatttaaaaatcaaacccaaattaaatatccactgtaaattatcctatagtaaatgtcctgtggtaacatgaacatttcctccccaaaccctcattattctgttgaatgattttgcgtttctctacaatttccacatgttgatgtttgaaccttaatgcaatacaatttttctcatgttgtatttggctaatgttgtctgctgtctgcttactcaggagagtgccacagtgatttgcttctgaaggaaaataaagttatttcttagatttgtaaaatacagttcatctggcattaaatattttttaatacttttacttagcatgaacaggactttggaaaatttgatgagtttagatttgaatatcaataaccttagtgagtgtttatttttagatggttttgttaacatttttatttggagataataatatatactgaaaatgtaattaagtctctaccagttgaagtgtttcatattcagtattattagaaaagtgaagagtaggaattgagcaattaacatttgagtgcatcttttttacaattgaggaaattgaagttcagagaggttaatttgccctgaagtcaaacagccagcaagttctggagcaggactttagctcttctttaactgcagcatctctgttctttagcttggaaatcgctgcgtctgagaacaggggaggtcacgccacatggtctgccaccccacagctgcaagagtgtgtaaatcattattcttaagactcagaattttgtttcttatgaaaatgaatataatctctgtagtctttgtaaaaattaaacccctatgatttttatatcttatttctataaattccatgaaataaaatttgtagc

SEQ ID NO: 7427 - DNA, 1085 bp, Homo sapiens
ttcaagggaggagtttgggaaggattggcacaattaagataattaaaatcatttgcttttgattgtttaaagtaatgatttttaacccataagtccagtgtcccctttttataatcaatattttgtaaatcttttggtatcctacaataaaattcttagaaaatataacctaactgaaaatacaaataaatgaataataagtaaatagaaaaaagaaagtacctgaattcttatagaatatactatattaatttataatattaacattataggatgtattgtattataggctaatttgctctcaaaagataaatacaaagggcataacttataataaaaatatcaatccaatatataaatgctcaagcatgactaaactggaaacaaatgccttcacaatgtcaaaacacctcccactgggtggcagagctcctcttgacaaactcttggttgaatacttcacagtggcattgtatgaagagtgtgtgcatgaagcaagtatagttcggtacttggaggctgattctctgtgtgtgtgtgtgtgtgtgtgtgtgtgtgtgtgtgtgtgtgtgtgtgtttttgtttgtttgtttgtttgtttgtttttgagacggagtctcgttctctcacccaggctggagtgcagtggcatgatctcggcttactgcaacctctgcctcccaggttcaagcaattcttctgcctcagcctccttagtagttggtactacaggtgcctgccgccaggcctggttaattttattttttgtcttttggtagagatggtgttttaccatgttgcccaggctgatcttgaactgctgagctcaggcaatccacccaccttggcctcccaaagtgctaggattacaggcatgagccactgcacctgctcgattctgtgtattcttacttagcgaagactgtaatacattcttgaaattcttacctatttttaagagacagggtcttactctgttgcctaggctggagtgcagtggtgtgatcatggttcactacagcctcaacctcctgggctcaggtgatcctccaacctcagcctcttgagtagctgggactacagac

SEQ ID NO: 7428 - DNA, 1066 bp, Homo sapiens
tgctcctgtaacttaggagatatgaaatatgagttcatgtgtcaggcctggggtttcttattacacagaagctaaccctatcctaaggggtgtgctctttatgtgcagaaataggagataggagccaaattatttctgtgtctaccaaatttttccaatttgaggaaaatagataaagcctactcccttgtgattatgtcccaagagtttaaaatcaaattaaaatttggtgttgaaatctcaatttcctttaaataagatgacttaaaaattaatagtcactggtcttaattatgaataatgcattatcatgtaatattaagcctcacataagatataatacgataaaaattctgggatgttgaatctggtttaagaatttgtgcattctcagaattttgttttactttcattaagaaacagtacatttaaggccaggcatgatggcttatgtttgtaatcccagcactttgggaggttgaggcaggaggattgcttgagcccaggcatgagctatgattgggccactgcagtccagcctgggtgacggagtaggaccctgtctctttaaggggggagcaggggaggggaggagaaccatttcagtaatcttttctactttatgaatgtgttcataataaagactcctgtggaaactgttctggataaaattattagtgcaagtagtgccagaatagcagatatttctgcatggctgcttaggaacttagtttttgctgacaattttgaaaatgtttcttattccaaagtgcttagaggacctccaggcttatgattgttctttcccaagagtattttttgagggacagggagaaggagctcctatatcttggttccgtggttctctgtctaaagggaacactgccgtaaatacttgagtcatactttaataaagcccatagaagagtgaattgggcttaactccctcatttttcatttgaggaaactaaactgcctgagtgaggcctgaaagccgtttttgatgattttcaggcgtatgcactgggatgggtcactattttggagtcatgtaactttggatttt

SEQ ID NO: 7429 - DNA, 1064 bp, Homo sapiens
aaaaaagaaagaaaaagaaaaaaaaagaaaaattagaaaaagtggtgagccttagtactagaaatagtaaagaattagcaggtgaagtttagcagattttttttaaattaacattgttagtttaatttcagttcctaatagattgatgaaataaacattaacaagaatgtgtaaacatctgtaagttaatgggtgcaggactaaagcattttaagtagtaatcatcatacaaaaacctgattgctttccttgatagctctatggaattacttaattttaaaaaggctatagatgttaaatatcacgattttcgagtaagtgattttttgaaatcttattcaccaaactaaccgaattggataaagaaatgtcaagtgtgtaataaactgtccaagagttagtggcaattgaaaacatatcaagttgaagagaaccacaggataatgtgtatcttttcttttaatgatctagaagaattagctaagcaatatattaaatctacagatgatcatgaatgaggtgttttctttttgttttttatgagtgttactgagaatgaagcagtagggtcaaacatgcaagtttaataaaatggcaaaagatgaaaaaaaagtctttgcaaaaagctaactaatgtttctggggatggataaatccctaggaacaagagaggggaagacctaatgagcctgggaaaacctaatgagcctaaagtgttttattccatgtaacgaaaacatatcaaacagtaatcttgggtgactagcctatttttttgtctgcccagttagcttaattgacagccatcattagatggcattatgattgggcaaaccaggaacttctgcagtaatggaagttttcaaaaaaaggtttgtctctcaactgaaaaataatagacaaacatcacagagacgcttaaaaattgattgagtcaggtaacgtttgttttcatgtgaattattaggaaactccgctcgattagttggacaccatgtacctctctttttcaaggtactgtacacaggagcttgagaagagatgaaatggggccaagaaactag

SEQ ID NO: 7430 - DNA, 1053 bp, Homo sapiens
acagtcatattctgaggtactgggtgttaggacttcaacgtgacattttgggggatacagttcaacctataatagtactacacttttttaagtgattgtggggagctcttgataaatgaatttaagggtacactctggctctgtttaaccaagttcttacattgatttttatagagcaaaatatttcacttctactcattactatgtaatctcacaggctggttgagttttggaccatttgtcatgtatcttccacatatcttctatgtctctctctctctatgtatacatagtagaaagagagagagacagggtatcactatgctgtccaggctggaccaaatgaaccttctgtcttggcctcccaaagtactgggattataggcatgagccatggagcctgtgctactttgtattttaatgtagaactattctcaatagagcagtacccctcagactttgaggttatattaatgtcctacagatcttgattcagtaggtcttgggtggaacttgagatcatgcatttctagcatgttctccagctgatactgatgctgccagccctcagaccatagcttgaggaatagagtcaggagtggctgcacaatttgcaggttcagtgtttcagaaccactcagtgtagcaaagccaaacactaacgggattgcagcaagagaaagtgagacatttattgcgtggccccaagcaaggagaatcgggcagcccatgtttaaaaccccaactccctgatggcttacaggtagggatttttaaaggcaaggaggcagaggtcacaggtatggtaataaattcatacatggaggttgtacatggttttgacctatacaggtgggctttcttgaagcgccgggtgattaaacgtgataggtagattttaaaattttcagatttgcagttggttaaggaagagaagctttgtttaaatatttggggtcaccagaaaagaatgttagctgtggcttgtatcacctcagatagactttacagcaaagaacaagaagagctgtcagaggcccgccctcagttttc

SEQ ID NO: 7431 - DNA, 2283 bp, Homo sapiens
aatgtagtcacattttatagtagacttaagttctagttttaagtaaattttttttatttttacattttcaaatgacttttaacaaatactctgaatgaatactcagtaaatacttaggccattaatattttgcaatggaaatttctattgtagtttcagttcatgaatctttgctccttaccccatcccacaagaaagacttaaacattcaatgagaggcaaatttgacttcttcaaagccggaatggaagaagggagacagaatgtcacaaactgtagtctgaacttgacattgtgatattcttagagaatgtttttacttttaagccttaaaaagtattcatgttcttgaactgtggaactccagtctcaagtttggttgtttggcaagtaaattaagactaatcattataacagtcctttgctacatgtctactgtagctgagctctgtcctgtgtgttttagacattaccgtatttagaaagagaatgactccaaggtgctacatggagaaactaaagagagtcacatggccaagatgtaccacactggagatgccaaaacttggttaaaagccctcatctgactgactttatttatttttattttattttatttttttgagacagggtctcacacttttgcccagcctggagtgcagtggtatgatgtttgctatagccttgagctctctgggcacaagtgatcctctcacctcaccctctcaagtagctgagactacgggcatgagccatcatacctggctaatttttgtatattttgtagagttgaggtctcaccatgttgcacaggctggttgacttattttgaagccgattttctttttgtcgtcctcctctaccttcaggacttttcaggtagtataatcctgtcgtcgtaattcctggcatcacttactccattcttgaggttttctggtctcttgcatagccaggtgagagctgagttgaaaagctttttatacaggcttcatggatatgtatactggtataagtgcatcacacagttaataaaaatattggagaagaccatttagttcacttctttataacagcagtgcctgtacacactttcctcaagactttctggtagttggaaatatgagtttaaaagtaatagtcattaaattaagtggaaactgtgggtcatttcaaagacattgtttttacaaattgattatacacatactaggtccttccaagagcatgcttaggttgaacagaaagtcttactaacaaaacacgtgccctgtgctctgtattgtcctcagggcatatgattgactattacagtaataaacccttgctttctctgaggtgcaaaaagaagctatagtctgagtgcttgggagaggcataagtcataattgtaggctgtaataaatgcaaatctatgaaaaatgggttagcttcaaacagctgagtcgcagagtcttgcaaaaccatgccccattattcctctctggagcccagatcatagaagaattatccatcttttttaacagtgggatttctaaggcttctcagaaatctccggtctcttggtttccagcaagagaacaatatcgagtcttaaatgacagaaatgaattcctaaataagttgaactttttcaagtttttaccaaatttaaataataatgctcatatgaatggtagctcatgtcttccctgtgcaggtggtactgaactaacattctaaatttgaaatggcaggctctctgttcccctgtctgggtaatctctgataaaacattaatcatctcaaggttctattcaagtccattgatggaaattgtgaaatgtaatttagcttgaggaattgaattaatgttttctaatagccctgagatattcactgatttataggtttgaatgctgggaggtgcatttgtgtttctctgtgtgtgcgtgagctcatcctagttaatctaaataggtgtttagaaatgatgcacattctatatcataaaaatatgtattatctctgtgactggtgaatattggtatggtttatttgtgtctgtcatggaacttatacattgctttatacacctggtataaattcgtgctcaactgagaaatatttgttgaattttaaaaatcctttaaatgtatatgcatatatatgtagacatggaatcacagatgtatatatttagttctaatgttttattttcaagcaggtgcagaatttatctgatttgattacttacactatgtgcctctgttgtgcaaatactagttttctcatcctttgttt

SEQ ID NO: 7432 - DNA, 1029 bp, Homo sapiens
actcttccctcgatttaaaaaaatattttttttcattctcatattgtcaagagagtgctctgaaaagttacagtgtaacagtaattgaatattctatttatttttgcctttgaatactaagatatataagtcaagggtggactattccttgtcataaagctgaaagtttaatttcaaactgacatctgctgccagttctgtgtttcagtattttatttatatttaaaattccaccttccctatatttgtaatatcatttttttgtggtaattgtgtctttgtgttcttcctttcagtaggtgttatttattaggctcacttttattctgcgggcaacttcagagatcccttgttcctcagaacatgctagaattccttctcttcttcagtgtcctaagtagatgatatgaatgtgcataattaactacgttctgcagttctcagctcaggaatacttttcagctcttacagatagacacttaggcgtaacagttgttacttatgagctcattttaaaagtagataaatgtctgaattttcaaagacaaagggtttcagagttcttgatagtttcttatagaggtgggtttagagcctgtgagaaagccactacttcagaatcttaacaaatagtaattgacacccagtggcaaaaatcagaatccgcttttctttcaacagcagatatttaaggcttaattgctgactgaaagtgcagttcgccctcctgcttctggagacagtgatgcccccagcccagctcactggacaatcagccagggtcaaggtgtggtccccatacccagagacgtcatcttctcctcttccgatctccacgtgtaccccagcttaccccagcttcatcttccctatgcacagaaaattaggataattctaagaattgtttttcttggaaacaatgttttcaatatggcaaagtgaaaattgtttttctaaacaagatattggctggatgtggtggcttacgcctgtggtcccagctacttgggaggctgagatgggaggatc

SEQ ID NO: 7433 - DNA, 1090 bp, Homo sapiens
cagtagagtgagatttgtcaatatctttgttgcttatagttcgacaaagtacacttcttttttttataattttaatcttgaaaaatttctttcacataaaggaacaatctctatacaagtaattaggaaacgtcttacagataaaagataattttgcctgagtttcataaacatctcatttcacagtaaattccaggaattgcaattttttcccgcttctggggattaaactagtgagtttcaaatgatgtctccatagctgaaaattttaagcacacataaaaagtccaagggcccatgtagaatgacagaatggaaataagttgtatttctttatcattgcaataaactttgctatcattttttaatgatatttaatgaatttcaaatgtagtcggaaactgaaggattccatagtgccacagggattggagaaacaagctgtgcttagggcaagcttgaatggttctcaactcttaggagcttacctgaaatgaatctgtgactcgatacctgtggggtgggccgctctataatgagttttctgaattaacttccatgtgaaaaataatgttcactaaagcataaataactagttacatttgtgtcatgtaacctaatatgctaatttgaattttatttacttatttattcatgaatgaatgaacgacgggttctcactttgtcatccaaggtagagtgcagtggcgcacttatagctcactgcagccttgaactcctggactcaagatcctcctgccttagccttttgagtagctgggaccacaggcccctgccactatacttggtgctaatttttgcttttttttttttttttctttgtagagataagagtcttgctgtgttgcccaggctggtctcaaactcctggccctcaggcgtgatccttctcctgcctttgcctcccaaagcattaggattacaagggtgagccgctgtgcctggccttgaattttaaattgaaattaaaatttaggcttggcacaatggctcacgcctgtaatgcgtgcactttgggagaccgatgcaggaggattgcttgagttcaggagtttgagactagcctggg

SEQ ID NO: 7434 - DNA, 1309 bp, Homo sapiens
tttttctttttgctgtgagtaccacatgcaaatttaatgttttctggtacagtttttctgttttcattctgtgctcattttctgcctcctctgatccttctactccctgtctaatatgttgggatgaatattatggcctcacgtactattacttgcctctggttctaaagatcatggcaaagaaatgagtcgtttggagttcctaatcaaggttctagtctgcatattgaactctgattgacttggaaacccctttgcccaaacaaaagatgaaatgttccatcctgaattcagcatctcttgttcaatgtgttccgtgactgtttgtcttcctcttcacattattttggaacaaattaggcagaagagacaatctttgcagattgaatttaggcaagttaataatgtcattgggcaaagaacattaacccctggggctcttggaatgtatcaagtcttctgtgccaagggcagatgccatcagggacagagatgagctcttaagggacacaaggacacaacttaacaccagagctgcggagcaccaggcaggtggttctgatttaaacttgcagcccaccaaggcactattgcttcattctgggacattttgacaacctgtcagccaggggtaattttctaagcaccacatttatttttctggtatactccctcatgtctgttaattttgacagctgtccactgctccaggacttgactgtactttcttctttcccttaatcgctctctaccaaactatcactccaaaggatagaacataattacattttgaaatttcaaaaccacagcactattatgtgtcaactattgttaactatctataataacttttaagtactaatgatgttacatacacatttgacattttttggacctcagttttgctttctgttaattgtgtgcctacgtgggcagtagaggcctttaaaaaaaattcaagaggatatatagtgaaggcttgagaagtttttacatgtctatgaacctatgtaactttcacgcacatgaagatacagaacactttctgtatccagaaggctcgcctgtggccttcccagtcaatatcctgcccgatgttcacaccatagattatacatatgtacattatacattctctcattgctggctgcttttctcatattacatctgtgagattcatctgtgttgttgagtgtaacagtagtccatcttgtgcagtattttgtcgtatgatttttccacaattttcttttttactccattctagtgctgatggacatttaagagtattttcattttggggctgttt

SEQ ID NO: 7435 - DNA, 1047 bp, Homo sapiens
ctttaaagttttcgttggtccttccacagactgcagactgagctcacaggagtgtgtccatgatgcaaacagaagtatcttataggtgccaaaggatggacttaccttttcctgccttttaccaacatatttgcaacagaaaaaggatcatgtgaacagatatcacctagggtagctgtcatttggaatttgtgtaattattagaatttgtacaaaacacagaatatccctttttttaaatccattcattctacatttgcactcttttccctcccactatcccaggaagttacttaattattcagtggctcttctagctgttatgcattaagaattcctattgttggcacaaaatccatcatttaagcctcatcttgaggaggttgtcatcttcttatttctgatatgtctgtgaaatactgcattttttagcatatttgtgtgtaccctggagggttgtttgcaaatacatattgcctgtgttgtgcatttatctgtaaaatgccggaatttcttacacttttaatgggtcttgagtaatgactttgtgggtgggatagggtgaagctctgtcagtttcgaaatctgtaaggtgaagaaaacttggtactagttttccaggaacttagatgggcccccaaagattaagatttgtgctgaaacacatttctcaacgtggcctctcatcttatgcatctatctacaaatctggacagctacttacatgctcatgctccagctgtgtttggctgtctttttttttttttttttttttaagacagagtctctctctgtcaccaggctggagtgcagtggtgtgatctcggctcactacagcctccacctcctgggttcaagcgattctcctgcctcagcttcctgagtagctgggactacaggcgtgcaccaccatgcccagctaatttttgtatttttagtagagatggggtttcacaatgttggcaggatggtctcgatctcttgaccttgtgatctgcccgccttggcctcccaaagtgctgggattacaggcgtgagccaccatgc

SEQ ID NO: 7436 - DNA, 2615 bp, Homo sapiens
agaataaactggcccttattctgcctcactcaaggtgcatgattttcatctatttttgggactgagtttggaatgcatcgttaacatagaccggtttcaactctgctaaactgttcaaagactagaatattttcagcaactaggtattttttaaaaaggaaaagaaagcaacttactttttctgtcattgcatgaatgtatttccctgggagctgcttactttctaaaatcattaagagctgaaaatttcaaactcccccccacctctccccatcaccacacaccaccctttacagacataaataggtcttgtatattttcagtaatcaaaagctgtgggtacttctaattgttctattgcatatcaaactttataaaacttagagtatacctactagttaatcatacatacacaatgtttagcagtttaattttgctcagaaacaataaagattataaactgaaataaaacaaaatgctgtcagcaaccacattatatatatatttcaaaaaaggaaactcctaatctgtctagcgtattctaggaactccatatttcacccacgatcatactggctcctgagaattttcctcacactgattcttggttacaggcatgcttatttttccttctttgattaactcaggtccacacgtaaccctttttgggttactgggtcatcttcctaactgctctaagcctagatttctgtttaatattagagtattctgttcccataatgtccgaccaattcttgatgagtactggcatttttaaattttttaaacagtgacagaatgtagtgacagtttttctttgtatgtatcagagcatttcttatgataatagctgtatcggtggcctcctaatcaagagcattcagcaactttcacgttccctggatggtttgctaggtacctggattattgattggaacttcaggagagtttaatgactctcatccttcttgccacatgccctagccgatatatttaatattacttccagtcgttgccaatagaatgcactttaaatagtgtaggaatatactaccagagattagagtagatgtggatgaatctatcatgaataaccagagcttcaataaaaggcccctttggtataaaattctgaactttgaaacagttggcctccgcctaagttttggtatatttccactagctagaaatttcactactcttaataaaaataattctgcagaaggtttcccagcctttctgacggtaatgtcaaatgatttttctcgtctcatagtttattgcctagcactttgtaacattctgctaatttctgctggttttaaaaacacgatcaagagagtgaagtaagaggctgggcgcactttgggaggttgaagtgggagaattgcttgaggccaggagtttgagaccagcctgcacaacaggttttttgttttgtctcgacaaaacaaaagataaaaataacaggacatggtggctagatagccctagctactatggaggctgagacgggaggatcactggagtccaggagttcaggaatacagcgagctatgattgtgcccctgcactccagtctgggtgacaaagggagaccttgtctctaaacaaacaaaaagagggaagtaagtactcaagacctcgatctcttcttacgctccttaaccaactggctctgtatctcaggagtgtggtatacttctaagagcaggtttcagtatccacacagtcttgacagtattgagattggtggtgtttgccttgcattgtttgaaatttccatttttacaaaacctgccctacagactttctcatgctaaattattggagcttatatttatctactggtgataattttggcctgcttttgacagaggaatcttattttaatgttgtgtgaatattaattaattttagactcataattaattgacaaaaataactgagttgaaaatgtacctggggattctaaattttaaatagaattgttagttttaaagatgtctatgccattgctttagaggaaatactgacttgagtccaaaattagtcgaattatgaatgacttattcattcctggaatcttaggattgtaaagattttttaaatgttctgggccttttgatgcatctgttaacaggggttatctagtcagttgagagaaaatctgaagatgcccaaggtcctcatattggttggtgcagtatttgcgtatcacctatttctactctcctgtagactgtagatgatctctagattacttgtaatacctaatacaatataaatgctatgtaaattgttgctataccctgttagttttaaaaatttgtaggctgggtgcggtggctcatgcctgtaatcctagcactttgggaggccaaggcgggtggatcacctgaggtcaggagttcgagaccagcttggccaacatggagaaagcccatctctactaaaaatacaaaattaggcgagcgtggtggcaggcacctgtaatcccagctactcgggaggctgaagcaggagaactgcttgaacctgggaggtggaggttgcagtgagccaagatcgggccattgcactccagcctgggtgacagagtgagattccgtctc

SEQ ID NO: 7437 - DNA, 1806 bp, Homo sapiens
tttcagagagtgggtagtaattaagtaagagttaatgattttaccattgggctactggtatgtatttatgatacatagctctattattcctacaagatatacttcgtaattgcacagatgttgttgaactccaatttcaagccataaaagtgttttggggctgctttctttttatatatctttgtaattcactagcaagccctaagaaaggtgatactaaaagctgaatcaaaaagaaagcaggtggtcagtgtgtgtgtatgtgcacacaggttaatcaggaggggaatttgcttttttgatttgttgttcactttgctatgttttaaatgtatttttataaaagtgcaaagatacacttattttaatgctttaaaataacttgaaatgattgagcaatcgtaggctagttctgagcatgcctttaaattcaggaaaaaagggttactttgtatgttggactttaggtagaaatatttattaatatttgtactgtttgtagctttggttgatttatggtcacctatgtaggtttaggttttgtacactgtggataattatatatgttaactttttaaaagattaatttttattgaagatacagagaaacagtaactagcattatttatttgattggctgttcaacttactttatcacctcttcagctgttttccagtccacaattgctcaattatttcacaggcaagtaagttataccttcatattttcccaaaatgagaataatgatatccatcttgcagcattgctatgatgactagcaacagtggtttttattcattgtgtctggtactatataccagcattaagaagctttctgcagccattagctcataaaacctcactatagccctctagggtaagaattgttgccccagttttccagataaggaaattaatcatcaaggttcacatggctttgccaaagttgggtgaaattcctaaggagctgagctaggactgtgcatgtagagcaccagacattgtgcctctcacacgattgtcatcttacacgtccatatcgatcctttggaaaaagtaggtaaagagctactttttattttttctttttcctaagtgttttttaaccttccgttgtattaggctttaaaaacaaaatggttgtcctcttcctaaagaataatttctctctgatagggaaaatgtgtgtatatttcaatattttggtggtatatttggaataggatttgttaaaattgtttttaattattattatttttcatattaaacacagctttcaaacacttaggcataaacatacaattaaatacacacatttctagcctatggttatgtttctgtataggttatatactgcatgaacagatgcatactacatttcagtgtctttattagaaatgtatcacagctgggcacggtggctcacgcctgtaatccgagcactttgggaggccgaggcgggcggatcacgaggtgaggggatcgagaccatcctggctaacacggtgaaaccccgtctctactaaaaatacaaaaaatcagctgggcgtggtggcgggtgcctgtagtcccagctactcggggcgggggggtagggggggcgctgaggcaggggaatggtgtgaacctgggaggcggagcttgcagtgaaccgagattgcgccactgcactccagcctgggcgacagagcaagactccgcctcaaaaaaaaaaaaaaaaaaaagaaagaaatgtatcacatttatttcccatcttcatgtacgtggatgaaaataaattcagcagtttttagctctctcccgtc

SEQ ID NO: 7438 - DNA, 1032 bp, Homo sapiens
catataaattttaggattttttttccatttctgtgaagaatgtccttggtgtctagataaggatgcattcgatctgtagatcactttgggcaataggaaatgtacttaatttttatttagaaagttaagcaaaaatatcaaccagtattaaaaatgttttaaatatgtgttagacatttagacatctttaaaatcttttaaatatatgtagacatttatatttaaaacatttaaaaatacatgtctatgtttagttatgtttatgcctgcatgatttaaagaaagaaatgatctgggtccaatgagataacttgttaataaactgtttatcattcataatcagccttgttaccctagaataggacacttattttaatgtctgacttggtttcttttaaatttatggcttttatttctttttttcccttaatcttctgactactcattgttagagaacttcttgatattttcaattagtttccagagcttctgctctggttagctgtttttttagcgccaactctgaaataatttcccaggttcctggtccttcctctgagagatttagtccttcatcccatgtagcggagcaaaaggagagaggtcattggcctcacattacttttctatgttggttgacttaatattattacttttcccaagaaggaatacatttttacagtaggaaaactttttttttcttttcttgaatttagctgtttgcctttgaaagctagatcaagcatacaaacacatgtatgtatgagtatacatgttctcatgtttccctgtttataaacttttcctataaggatagcctaggtagtacattcttaatgtttgctatagttttatatcttgaataagttagttcaggaaaagatttgctgacaatagatgataaattcgtagcttgtgatgcaacatcattttaaaaagcaagtttaaaaattaaagttattagaaaaagatgcaaaatggtttctccacattcaccctagttggtttctcccataaactgagaatcttgga

SEQ ID NO: 7439 - DNA, 1025 bp, Homo sapiens
tccaggaatggtgaatttggaccttataaatgggatctgggatcacaaatgggcgtgggtttcactgctttggctaccagtggaggagtaggagtcatatcttggttgtcagggaggtgggtgatgtcttctgaataaattggtggcatttgggagcaagaacacagaataaccaaggggaggtgagattataccacatgccagtggttgatgatctgggcatatatggcatgggtgattatttgaacaatatctatattttatgcttatttttaactccatgagagtggggtctctgaggaggaggtggtggtggtgtgtgtgttctttatatcccaggtgcctggcctcaaggtatttgttgagtgaatgcatgaagggatgaaccttcataagggttcattctgctattatattatgcagaaacagagagaggtaagcttattttatacaatatcagggagaaggctggagagccagtgtcaggaacagtttcctgaagtcagagctctcaaacattgaggttggctgcctgtggaggaagggagttcaggtaaagggtgagcagtagaaatattgtagaggacattcaaagatttttaactggtagttaaaccagatgatcctaaaatgctatttatattctgagactccattaaatatttgagcacctactgtttccataacaatgtgagcatcacagcagacagattcagcagtgtgagaaacgagatgactacccatgctggagtattccaatctcatggtggtggtggtaaaataaaaattaaaaaagaaaaaagttggcaaataacattataattctatacaataaaatgcaggatatttaagctatttattcattcaataaatatttgaatgccaataaacttcataagtgtcagcatcaccattgtagttgaagagagaacaacacaattttttaggagaaggtggagttgagctacaccgtaaagactttatgggactgtgggccgggcatgatggctcacatctgtaatccc

SEQ ID NO: 7440 - DNA, 1092 bp, Homo sapiens
acatgcaaaatgtataaatctgaacaaattcgtttcttcagaataaatgatgatcttggacttatgttcctggaatgttttccaaattgagttttataattatctttttttctgcatatttctaatagatgtgtaatattgccctgtttaaggaattctattctttaacaaggaatgttgtcagatgtaatataagcttgatttaagtaaaataatgtaatcgatggcaggtataggaatggccacctttatgagtgctggttcttctactgaattttaagatatgtgaaaactaaataatgattaaataaatgattgatagtcacgtattgattgataactctttttcttcaacttacatggactgttacaacctctgagcaccatggtttgggaatttactttatcaaaatacattttatgtgaaataatgtttggatacacaatcttttttcagttttggtactatgaagttggtttaataagaaaagaatctgacatttaaaaaattgtaaaatctgcacatgatgtaattgcatttgtgtttattgaagtagtttgttataaaaacttgtagagaacaataacaatatccatgctcctttagaaagtgtagtgtgtaaataatcagtgtagtgatttttttaaaaggtgtcaaggtagcagtgctctttctttcagtttgtgcagtaaactgtggggtttgggttctgtcttaggggtttccaggcgtgttcttgaaatgctaggaatgtacaaatacgtcatgttccagtgttaaaagttggaaactaggccgggcgcggtggcttgcctgtacaaccggcaccttgggaggccgagcgtgggtggatcacttgaggtcaggagtttgagaccagcctggccaatgtggcaaaaccctgtctctactaaaaatacaaaaattagccgggcgtggtggcacatacctgtaatcccagctaatcagaaggctgaaacacgagagccacttaaacctgggaggtggagtttcagtgagcctgggtgacagagactcttccctcccctcaaagaaacccccaaaacaacaacaaaaaaaacccccaaaaa

SEQ ID NO: 7441 - DNA, 1940 bp, Homo sapiens
tgcttctcactgggacagcattgagcattggcgattcttgggacagaggatatattgcctgcaaagcctaaaatccatactctgtggccctttacagaagcatgtgctgagccttcacctaaattgtagcaggaattcaataaatgttgactgaatggacgtattagagatttcccaatcaggttttacttaatatgtacacagagtcactggtccctggcatttgactacttgaatactctgtagtaaagacacagcagagtatgtgcttgagcttatttcttgtggatggatcatcccatcccgttattactaaatgaaaatcttgtctaagctcctgtgcagtatctctcaacaggaaaagggaataatttggggagagaagttgccagagtttggaaagtattcccacgtagcatgggtgaacatcctgcatttattgtgaattggttccttcatcatggctgtgcaaatcccaggagagtggggcagattagggcacaacgtgtaaactcagcacctcttctgcctgggctttagagcagaaagcagactctgtccaccaagagggcttgcagcaactttggactcttcatgaagctgatgaggcaacctgtgtgtacccacctctgcccatcatttcttcctggaatcagtaatcttcccacataacactttaaactatttcagtcagagggcttatgtatggtctgttagttttgaagggacgtcataacaaagtaccaagaactggatggcttgacacacagaaactcattgtctcacagttctggaggctggaattctggcatcaaggctttggcagggtcacacccccctccccaaaggctctagagaagaacctgctccatgcctgttcctggcttcggaagcccaggtgttcctggccttgcaggtgcatcagtccagccctgcaccttcacctggccttctccctgtgtgtctgcacagcatcttccctttgcgtcttgtctgcctctgtgttcacacttcccctttttataaggacgttagtcatctcggattagggctcaccctaatgacctcattttaacttaattaatccaataaagatccgatctccaagtaaggtcacattctgacatactggagtttaggacttcacatatttttttgtcgggagaggggaacacaattcagttcataatagatgggcagctgggcacggtggctcatgcctgtaatcccagcacttcgggaggtcatggcaggagaattgcttgagctcaggagttcaagcctgagcaacaaagtgagatcccatctctgtttaaaacaaaaattgaaaattatcttgttgtggtggcacatgcctgtggtcccagctacttgggaggctaaggcaggaggatcccctgagccaaggaggtcaaggctgcagggctgcagtgagctgtgtttgtgccactgcactctaacctcagtgatagaataagaccccatctccaaaaaaaaaaaaaagatgggtatctcagatcaatataattcaaaagaatatttggctttgaaagtggagtcttataaaaatatagccaggcgaagatgacgtgtcatcctctgagcctagaaagtctggaacacgatcgcctgggcttatgcatgtgcctaggtgtgggtcgtggtggttatgacatttcactttggatgtgcacattccatcactcatatctttggctgcagttagaaggaagggagtgttttttgaaagcttgccctgaaattatagtatgtgcaactgtgttagatttgagtgtcataaccatgttcttcttgtgtgttttgtcagttccttggctaattttcagatgtttgcatccaaatatgagttagggctctcaaagcagtcagcattttcttctttattttacattttagtcataacagatataatatatgcc

SEQ ID NO: 7442 - DNA, 1049 bp, Homo sapiens
ggcagggttgcatgagcccaggagtttgaggctgtagtgaaatatgattgcgccactgcactccagcctggagaccccttgtttcaataaataaataaataaataaataaataaataaataaatctgtttacagaaatcactatgtgtgtttgctcctcctagcacagccttggaggataagatgccaggtgcagtggctcatgcctgtaatcccagcactttgggaggccaaggtgggaggatcgcttgagctcaggagtttgagacaccaacatggtgaaacgctgactccacaaaaaatacaaaaattagccaggcatggtggcttgtgcatgtagtccccagttactccaggaggttgaggtgggaggatcacttgagcccaggaagcggaggttgcagtgagctgagattgtgccactgcactccagcctgtgtaatagaggaagaccctgtctccggaagaaaaaaaaaaaaaaaaagagagagagggaggataagggtggactaggatgctctggtcgggacttgtggccatagttggtcatgggtgtttggaggttgggaacctggatgtgaaaagctgcattcctgcaggaggagtctctgccacatctgggcagggtgttttgaccattgtttaaacttccttgaaatcaggcaaggcctggtcgtggatgcagaagggaatctgtttttccagttttggtgatcaagggtccagctccatgccgagtaagtgcaggcccacaaggagttgaaatgctttacgtttctaaactccaggagtaccattgctatgtcggtgattttagatcactttctccatttcctctctccctccctcttctagtttgataggccctaagtttaggcagcctgtgtaggggctacacgttttcatcagtaatacaggccgtgtttcgctgaccacagttggggacagctgcatgtattctttgtgtgttttgttttgttatacattagatacttagataaatatctacatatatgaaatatacttaatatctatgcatattctatctgt

SEQ ID NO: 7443 - DNA, 1025 bp, Homo sapiens
ggccactggagctctgttaagccaacgggaagtaaagacactccaaccatgcattagaaaaatcacaatcggaatgataattgattccttctgtttgaatctattggagtgttacagatgctttgatgaaggtaagacttgctgggtttatcctctagagctgtacgctactaatgctttgtatttatgtataatcagtataataagcttttgactgcataagattcttattttcaaaatatacatttttagctaccccatttctaatttctctcaaaagcagcatttctgatttgtatctacctggtacagatgccagaggagctggtgttggcagtattatctgtgtttacctacatcgaactgttcataccttcttctgagatactgttcttctctggtctgtcttttgccagccccttaaaaccaaagttaattcctttgtcctacatgggactgatttgcttaggagaaaagtgatgccccactgtcccctggctaatggcgtgtgaaggttgtggtggcctccttagcgcagaggatggggctggattctgggagtacttcttaggattagggatgggggtgatctagggaatggaattgctgaagtcagcagggagtccactgctgaggtcctctttttgagacacggtcttgctttgtagcccaggctggagtgtagtggcgcaatctcggctcactgcaatctccgcctcttgggtccaagcaattctggtgcctcagcctctcaagtagctgggattacaggtgcctgccaccacacctggctaatttttgtatttttagtagagatggaatttcgccatgttggccaggctgatctcaaaagcctcccccttccaaagtgctgggattacaggcgtgagccactctgcctggcctcaggctaatatttctaattaaacatcaatacgagagacctaaaaatggacaactttgtcacttaaaaaacccaaaacatccacctattaagacctcagcggcggctggacatggtgctc

SEQ ID NO: 7444 - DNA, 1031 bp, Homo sapiens
gtcatctattcctgccattgtgtagcttcctgggtctgttactgattaccttttgaataagaaagggacaggtcagaggactcaggctggaactagacaggtcaatgtagttgagtatggaataggggttaaaatggacgctaatggccttctacttaaaactctcaaaactagagaaaggaaaagtgaagccacagtgaaatgtcacctccctcttgttagaatagctgttatccagaagaccccacaaaatgaccagtattgtgaggatgtggagaaaaaggaaccctcatacactgttggtgggaatgtaaattaatacagacattatggaaaacagcatggaagttcttcaaaaacctaaaaatagaacttaccatatggtccagcaatcctacttctgggtgtttacctgaaagatttgaaatcaatatgtcgaagagatgtctccacacccgtgtttgttgcagcgccgttcactgtagctaagatacggcaccagcctacgttggacggatggataaatggtctgtatacacagtgcagtactagtcagtcataaaacaggaagaacttctgtcatctgtgacaacgtgtatggaactagagaacattgtgttaggtgaaataagccaaacacagaaagacaaatactgcctgttttcacggatacgcagaatctgaaaccattaaactcacagaagcaaagaggaatgggggttagaggttgggaggttagcggttgggaggggggttggggagatcgtaaccaaagggcacaaagcctgggttacataggaggcataggtttgatttatttcttattcttttttttggagctctgttacatggtgtagtgaatgtagctaataattgagttccgtacattttaatactgctgagagtaaatttcatatgttctcatcataaaaaatgttgaatatttgaggggatggaaatgttagttaacttgatttattcattccacattgtattaaacaataacatcacttttgtacctcaatgataac

SEQ ID NO: 7445 - DNA, 1060 bp, Homo sapiens
tccagatgctgggatgcagtagtgaatggagacaaagcccctgtcctcatgggcttagactccagcttatgacttgttgtttataataaataatgaacattgtgaggttattcacaggaagggatgaataatggatggatcttcaaaacgtgattctggttaactacagacatcctgaagttccaggtataaaaagccttctttaaagcatactatagcagtcagaatgaatgagtagttaataaagctctttgctgaaataaaagcaaatatgttcacacttccaaaaaataaatacccaagtgggagttgtatggttctgatgtcaaacatgttatgagaccatcagaggtatatggaaatttggggaggaagacagtaattatataaaagtgcatgcaagcctgggcaatatagggagaccctgtcagcctgcaaaaaaataatgataataaaaaatcgtagctgaaggtggtggcatatacctgtgggtcccagctgcttgggaggctaaggtagaatcactaaggagaatcacttggggcagggaagtggtggctgcagtgagctatgattgtgctattgcactccagcctgggcgacagaacgagaccttgtctcacgcacacgaaaagcaattactgaattagagatgtgatgtgggaaacgctcccatctaagtaatgaccaagaatattccgtgatagagatgaagtcttagcaggacttccctctcaggttattagtggtgatgatcctgctttgttttattaccttattactattatgctctctgaggtatgaagtgatattaatctgtttgcagtgagaaataacactttatagcattgctatcatttaaacatattaaaatatgttgtaatgcagaaaaacaccctggggagagaggtgaaaacttaggagtttaatttgaaatgcagttgggaaattatttggacagcagagaaagctttagggcaaaatttcagtaataaagtatattattttctaaattattcatcagggagttgagtttgtttttcatgtacctggacttaat

SEQ ID NO: 7446 - DNA, 1074 bp, Homo sapiens
ttttagtgttcttttgtgctttctgacctaagtgctggcaatgtgtaccttcatgtgtgaattgattatgaagacaatttctaagagcaatcctcaagactcagtttttgtctggctttctgtaatcattgaagcaacttaaaaaaaaatgtccacttcatctttagagttctccccctgcccaggcacacaggtctcactgcacaccctattcgtcaccccacaagatgcatgtgctgtctttggcttagcagttcacatgcaaatacaaatacagtcacgtgcagcataaaagcatttcagtcagtgatggaccacataaaccacaatggtcccgtcagattataatggaactgagaagttcctattgtctagtgacgtcgtagtgtcgacctgcagtgcagtccttaggtgtctttggtgatgctgctgtgaagaaacctactgtgctgtggttgtataaacgtctagcacatacagttgtgcacggtgcatggtgcttgatcatgacaatctttgactctgttactggcttatgtatttactgtactttttattgttattttagagagtcatccttctttaaaaaaaagcccgttgtaaaacagcttcaggcagggccttcaggaggtttccagaagatggcagctccatgtgtgctgtcacctctgaagcccttccagtgggacagaggtgctggtggaagacagtgatgttgatgatcctgaccctgtgtaggtctaggctaatgtgtgtgtgtgtgtgtcttagtttttcccaacaatgtttacaaagtaaaaaaccataatttaaaaatggaaaaaagtttataggataaggatagaaaggaaatatttttgtacagttgtccaatgtgtgtgtgtttaagccaagtgttattatgagtcaaaaagttgaaaaaattaaaagtatataaagtaaaaaagttacagtaatctaagtttaatttattgtggaagaaagaatctttagaaaatgtagtgtagcctaagcatgcagtgtttctaaagtttacagtggtgtacactcatgcctttggcctcgacactcact

SEQ ID NO: 7447 - DNA, 1090 bp, Homo sapiens
gtaaaacttgatggccgccgatgtgttgctgaagtaatcagttgtaaaatgaggaggtagaaatgtattcttgtcttttctgggaggttcaggtacacacaacttcaggttgatgatgatccaagttccttccctgtttgtgtcttaaaaacaagattgaaagcataaacaaaaccaacaacaaagttctttgatcaagggaagggattgcaactgttcacggatggaattggattggaccctgaattcttacagcttgatttgactttgtcatttagtgtaggatttcttaaccatggtttcactaggtgcttatagatactctaaaacatgcacacactcatacatcccaccccatagatgcccagaaaccactcaggactcgctgaatcagaatctccagtggtagtgggatggggttggggctagtcaggtaccctcacttcctcccgcaaaggtcccaaagtgaatccagcctaaacattgccaggtgaagaaactgaagtctagagcaccaggcgatatgaagataatagaactgtttagtgacagatttgagaaagaagccagtggcatttgagcatatgccctgtgctcaccccagtaagaaatcagaagcatagtggtgcagatcacctgcctgagagccagcggcggcctggcgagccggtgtgcacgcgctggctggtattggtgtcagctttcgtgaaggcgtcccttgtgttttgaggcttctcaagttctgaggaagcacctgcagctgcacagaggtgcgtgtgcatggagttgggaggctagccgccaaatgctgctcagattcccaggccagagagatggtctttatacgtgataagagcacggataagccacctgctttggggtcaaaattaaaaagtcaatatacaagtctttaacctggttactaataaagaatctctcagccctgctaacataacctgtgactttgttcgtgttagccattttctggttatctaactttgaatgaccttttcactataaatcttttagacacataggtgtagctttgtcaaagagtactatatttttattcttcctagtagaattttac

SEQ ID NO: 7448 - DNA, 1030 bp, Homo sapiens
gactatgcagaaagtaataccagaaatgaatgaggaaattcagagactgcctaaaagtattgttgctgattctgttggcagaatcttttctcttccctttcgaaaaatcatagtttaaaactgcttgaacctgagggtggtggcctaagtgttggtatttgccagttgagaatttaagaatgagtgccttgtattgtcattaagaattccataatattgtttatagaagtagggtgttgacctagagatctctgccaaaacctaatttgtctaattaaattccgccgagcatttctaacttccttccctaaacgacttctaattgcgtgtcgttccagtggtagtgatgataatgatgatgttctgcccttgtaaacatgcctttaaattattaagttctaagctggcaggtaaaatggaattacttttcatcttaaagatgagatgtggccttttgggggatgtgtgtggatggggacattgcgggtagacgaagaatcaggtagacttcttgtacaaaattcctggatcatttgtttattgtgggaaggagcactgctaagaaagacagactttttccccctcaagcaggaaccatcctctcttcagagcgttttgtttccctgctaggagccaggatgtgacatttaagcagccatataaatttcagttttgtgcatcactttgaggtaaggtttccgtagaaaacataagttttaaaattgttttgtgtgcgcttctttggggagggagatgtagttggaataagagtataatacctctgagatttgtcaagagaattgagaccatgctttttccctgctgctgttgagttatggaggcggaggcttgggtgcgttcaagatggggcatcactcgttacctgtggcctgccttggtggctgaggagggcattgctgctggcggtgtgatggttgttaacactgctttacaagcggtgctgaagaccactctcgtccatgatggcccagcacatgagattcgcggagccgccagagccttagacaag

SEQ ID NO: 7449 - DNA, 1029 bp, Homo sapiens
ccaggctggagtgcagtgacgtgatcctagctcagtgcagcctccaacacccgggctcaaatgagcctcctgcctcagcctcccaaaagtgcttagattacaggtgtgagtcactgcacctggcctgaggatttaaaaacaagcgagcaaacaaaccaggctatcctagatatttgtgttatgaaatgagtttctgtaggtaatcagtttcacttatttttttatttctatgaatttatagagagcatggtatatacttggcacccagagatagttgtaagaaatacattgtttattttctgtgtgttagaatttgaggattctcaatacattattaaggcaacctccacctcccgggttcaagcagttcttctgccccagcctcctgagtagctgggattacaggcgtgcactaccacgcaagaattctgaagttccttgcgtctgaatgtgtgctatactgcttgacttaatttcttacaaaagattgtcaagagatacttcttttcaagggcacagtcgaatgatgaccgtccactatcaggcattttgttatcagcacttgtgggtagtgtcaacagggatctcttggctgctgggaacttgaggttgagatgacactgcagttgcatttctgtaacagcatccttttctttcatctagccctcacatatttattgagcatctgttccattctaggcaggacttgagagattgaagtaaatagagaacacttgtccttagggatctgttgtaaaatggggagatgaaaatgttggcggggtgctggtagctcatgcctataatctcagcactttgggaggccaaagtgggaggtctgcttgagcccaggagtttgagggcagcctgggcaacatagtgagaccttgtcttacttaaaaaaaaaaaaaaaaaaaaaaaaaaaaaaaatatatatatatatatatatatatatatatatatatataaaatacatacgtaaaatacatatataaaatataaaaatctaattatatacatgtatattat

SEQ ID NO: 7450 - DNA, 1083 bp, Homo sapiens
ataagacatattaaatgagggagggcttcacatactacatttgtaacaattgtagttcacacttaaggaattcaagtaaattatgtgttagtgaaaagcagtgatacctgaaataactaaggtgttcttatttcaagtaagtagtattttagttattactaaacatgtgaaattaatttgagttcagtgttttacatgcaaaaatgggatgagttgcagggtggggatcccagaaatgtgtttaatttccattaggatgtggcatcatatgattactacctcgaattttaaaatgattgcagaaaggccgggcatggtggctcacctctgtaatcccagcagtttgggaggctgaggcaggtggatcatttgaggtcaggaggtcaagaccagcctggccaacatggtgaaaccctgcttctactaaaaatacaaaaattagccaggtttggtcatgcgcgcctgtcgtcccagttacttgagaggctgaggcatgagaatcgtgtagggccaggaggcggaggttgtagtgagccgagattgccccactgcactccagcctgggcgacaaagtgagactccgtctccaaaaaaaaaaaaaagattgcgggaatcacgtgcattaagttgttaactcccttagaatgtttaagccaccggtttactctgagttttttcctttgtgcacatgtggcttaatttccgtaagtaaacatgaattatgatatctgcctagggtgttacatggtgaccagcgtactgttttttgctgatcaggtaggtgagttgttgaattccttgccttccttcaggtgaagtggatgtagcccaggagaacatgcttttaatgcaggcatcttaatctttccatcttggggaaatatacattttaaagaagcagtgttttctgaaggcataccttatcataaatcctacttacagaaaacagtataatgaaaaacttatgaaatgtgttttctgttgtcttaatcaaaaggaataatttagttattcataaatacataccctactgtcttctgatgaatacttgagattaagattaaatggaataaattaaaacct

SEQ ID NO: 7451 - DNA, 1050 bp, Homo sapiens
tgtgaatttgtaacattattaaaaacttattttttatggaggggaagaggcagtattttaaatgatagcaaaagaaaattaaagtcaagtactaaattacccctaattttcctcattatcctttaattattaacgttcagggcacagcactgaggaagttttctgttagtgcctatacagttctcacttccaggatttacccaaatttgttcaaatggtactattatattaccctggccccttggagtaggtttgattttctaaggtgtagaatactctagatctctttgagtgtaaaaaggtactttgttttgtttgtcctttctctgtgtttctggaacagtgatgtcgtgtttactcttagcatctcagtctcagttttctcaattgacattttgccaaattaggaaaaactgaaacagtttaatgttatcttcaccaccatttagagcagctgtcatgcgtttgtgtacgtgaactttcctgatggacaagctgtattttgtgtgaatctctgtctggtttggtctttgtcatttattatttgaggaccttcccttcgttctcaacagtgggcctaggccactcctgtttattccctgtgggtagtacagcaaatttagaaatgtggataatttttccaaatttatcacagaataaaaatacttgggattcagttcctgcgcaggccagtcacctgagactgattgtaaggggcgtaaacaaagatttcagagccaggcgccatggctcaggcctgtaatcccagcactttgggaggccaaagcgggtggatcacttgagcccagaagtttgagagcagcctgggcaacctaacgagactgtttctacaaaaaatactacaattagctgagtgtggtggtgctggcctgtagtctgagctactcaaaggctgaggtgggaggatcgcattgagcctgtgaggttgaggctgcagtgagccatgatcacgctgctctactcaagcttgggcaacagagtgagaccctgtctcaaaaaaaaaaaaaaaaaaaaaaaaaagatttcagg

SEQ ID NO: 7452 - DNA, 1049 bp, Homo sapiens
tttccatttgtttatatcatatctggtttctttgagcagtgtttttaaattctcattgtagagatctttcgtttctttggttagctgtattcctaggcatgttattctttttgtggctattgggaatgggattgtgtttctgatttggctcttagtttggatgttgttggtgtgtaggaatgctactgatttttatacattggttttgcatcctgaaactttgctgaagttgtttatcagatcaaggagcttttgggcagagactgtggggttttctaggtatagaaccatatcatctgcaaacagggagagtttgacttcctctcttcctatttgggtgccacctcacctcttgagtagttgggactataggcatactgcacgatgcctggctaatttatgtaaacatttttgtagagacagggtctcattgtgttgccaaggcttgtctcaaactcgtgggctcaagtgctcctcctgcctcgacctcccaaagtgctgggactacaggcatgagccactgcgctcggctgtgttttgatgtatggattcatgtacagtctcgttgtacttgctgtggacacttagatgactatggagacagctgctgtgctcacctgtacgcttttccctttggcactctctgtactctgagcagctgagatgagcacgcctgtttctccaccacgtttcctttttacttttacagacgcaggttttccctcggggttctgccatccttctttacaccttgactttgtgcctttccatagagctagcgaggcgtggcttataacatgttttctgggatatgcctggccctggtgcatggcttggaataacctgttgtggaagtttggttgttgcacaagtaggatttatggggctgtacgatctcaatgcttctgagaatgctgaactcaatggactcatttatgctcagcataatgtagtaaggcctgaagggttatgcagtaccaattactgtttccatttgtccccttgcactccagctgacattagatgccctcagagtttatgtttggagc

SEQ ID NO: 7453 - DNA, 1028 bp, Homo sapiens
gttacatcgtgaggtcagaagatggtaagatcacccagatattcactctgcttcctactggggctccttctcattcctggccctctccccaccggcctgctcttctttccctcagctgtgagctgggtgcacacagctgttgtgtcttgttcacacctatattcctgacagttagcatcatgcctggctgagagttggtgcatatcttaaatgttttcttgaaatttcaagtaagacaaaaaatatcaaataccaaatagtgtataaatttggaagattagattcactgttgcacctgtcatggtggaatttgtcccatgtggctcctgtgggtcaggaatacattgtatcaaaaaatgcagatcctggctaacaaggtgaaaccccgtctctattaaaaatacaaaaaattagccggctgtggtggcgggtgcctgtagtcccagatactcaggaggctgaggcaggagaatggcgtgaacctgggaggtggagcttgcagtgagctgagatcacaccactgcactccaacctgggcaacagagctagtcttaaaaaaaaaaaaaaaaaaaaaaaagcagaagttttctgccgacttatgttctgatgctatttttcttggtgccgtttctccttcttgggcttttgagtgagccaggcttagggtaactctgaaatccttttctgcagtccacatgaagagtaccatctttcatttattgtgtggctcaattccaacactcaaggcaactacagagatttatgaagaatttaaacaggtgctctttttccaccagagtattagaaagcgatgaattaacgtatcaatctttcaatgtcttcctcttctcccttcttcttcgtccttcttttttttgtttctttttttttttcttctccctctctttctcagtctctctctcttgctgttacttcctatgtaaaaatagcacaactccttgtgaggaaaaattggaaaatgcagaaacatacaaaggaattaatcacctgacatcctgctattgctg

SEQ ID NO: 7454 - DNA, 1074 bp, Homo sapiens
gaaacacttggagccaccagggtgtgcaaactactttttgcagataagcaaaaatacaaattcttcagacacataatatatgctgtttgcttattagaatatttctgtagattgcattgggggttaataagtataataagtatttcatatattgggcaataggaaatctagtatgctttagagaaatcagtattacttatgcagtacatattgcaggtttgtgcagttcctatcataatagagtatcagcatcagagccaaagggaagagtgtgtatgagtcactccatcataaaaggagcagtgactcaataccaaacttagggtgctgtctgaatttttaatcagttgcagtattgttgatatgaggttgattcctttttatgggcaggaagttatcacggtttaaaatgtctaattcccttttggtgatgctaacttgctatattcagtgtttctgttctttcgtataggatccaaactactggatacaggtgcatcgcttggaacatggagatggaggaatactagaccttgatgacattctttgtgatgtagcagacgataaagacagagtgagttcaggtcctggggaacctgttctgaatgcattttttttttttgaggactagggagcgggtgcgattcttttcctttctgttttagacacatactttaaattatgtgtgggccacccactctagtatattttcttttataataagtatcatgaatcttcactgtcctgaataccaaggtataatgattttcttgatacctgggacttaacactaggttttggggttttaaaactacacttttacaatggaaatatcacaaaaagatttctatgccatattctgccttaatttaaccaaacataacatctttcttcacaactcgggcctgtccttatcatctccgtgtatacaacatgcagccattctgcattctggtcccagcgttggccctgagaagatccatcccaaccgtggccttggcggtgcaccgtgctcctgtgcagtgggcgagtgtgtcccaggcagcctaccctgtgcagggcctggccctcagg

SEQ ID NO: 7455 - DNA, 1053 bp, Homo sapiens
tgcatgatgctgaggtttggggtacgattgattccatcacccaggtagtgagcatagtacccaataccttttcaaccatctcctcaccctcccttctccatctagtagtccccagtgtttattgttgccatctttatgtccatgtgtacccccttaaaaaaggccttttatcttgggtgttgcgacagtgtctcccttcctaatgtgtcaccttggcaaacttcttggaagaatcagtgtgtcctaaagggaaaatgtggatttccaggttagcgtctgagcctaagctatgcttgactgtgacattatgtggtgttgatctcaggcaagtcaagtgtcctattccttagtctcttcttctacaaaatacagttgaaaacattgatcttgcaggattgtcacatggaaaagcaggtgtcatgtcagaagtgctctgtaatcagagtgagggtgaaggaatggaatggattaggaggtgggcgcagcaccaggtgcctgctttcatggtgctgatggttgtgaagcttgcagatacagatttgagttctggagcagaatatcctgtagctacgtccacactgtggtttagggacttaggcttggattattccatattcactaccttccctcagtaaagccttctgttttctgtctaccagttcatcaggtaacaatactacccactgttcgtacccttccacactcttagatccatcgggactagagtgaggagaactgggttggccaaggtgagttttggcttgccctcttttttctggggtatgagtaagatatttatcggggcttaagctcacttcttctgcctaagattcctggccagtcacactggggacccacctctgcaggtgaggacgaaggtattcatattgcaagttgggttcgttttcattgcaagggaagagtgtctggatgtcttctttccccacatctgaaatgtttcctggaatgtaaactagaataatcacacagcatttcttgagccagctctgagggacaggataaagggtgaatgggggcgttgatcctgacatg

SEQ ID NO: 7456 - DNA, 1046 bp, Homo sapiens
tatcatactgaactcagtagtttaggatgcattcctaagtttagggaaagctgtgaggatcttttgattcattctagaacattccaaagcaccactgaggttgcacaaggtggttcatagcaataggaccgtgatgcttatagggcaagaggaggggatatcacaggacctctgggacagagggaagcactgaggccttctgcaactctgcaacaaagttcctgtgatcccctgccctcgcctctctcccagcactcctgggatttcagcattttaattaatataagtcaggtggacgcttatcttgctggattcctcagtagtacttgatatggttgatcccttcctcatttcttgaacagccctctggtgcggtcattctttaacataaactttttattttaaaataactttagatttattaaaaactgcaaagatagtagagagagtgtacccctcacctcatcctctttgctaatgtcttacatcactgtgatgcatttgtcaaaatgaaccaacgttgactttaactaaacttcagaatttatttgctgttcaccagtttttcagttagtgtcctctttctatgccaggatccagtccagagggctacattgcatttagttgtcaacttcattttatgtaataaaaactttacctacatttcagtggttggtaattttgtttaaggaggtgatcccttaaacaaaacggagaaagtgagttactttctgctagctgaagtgttactttacatccatttgtaaatttttgttcagatatatcaatcattaccatttactgaacacccccatttgtgcttgttctggttttatgttttatgctacaatgtgctctaaacattttagaaataaaattagcagtactttgtgtgaagtggcaataggcttcctccccttgaccccttctgtccccttattttgagacagggtcttactctgtcacccatcctccccctgacctcttctgccctgtttttttaagacagggtctcactctgtcacctaggctggagtgcagtgcgg

SEQ ID NO: 7457 - DNA, 1049 bp, Homo sapiens
ccgaagctcctgctttcagtgaaggagcctgtggtaggaacatagggtctgcagtttcagatgttgtggcctgctgtgccttgttggtgattgtagattcttcacgatcaatatggagaaggctgcctgcattgtctcccttcttcttttgaaaaattagtttttacagataattgcaaacaatgcaaaattaaggaatgcaatctctttttgacgttttactccctagtagtgactggtattaaaaagcctccacgcagtacaggatgtgggtagatcaaccctggattggttggttgggatgtgattcattagatcatctatgagattctctgttttttaggtcagagtaattgccattgatcttatgatgcagttctgcttccaggacacttaatgaacacggaaactgaaaagtaaagaacttggcctgtagggtctgtgagacgggaccacccctgggagccgtgttgtgtagaggccatccagccaaggactgcaaacgtggagatctgttgtggcagtggattggattaatctctattaatcagtctattaatctgttgatctctagctgaacaatctcttttgttgaattgttgcattatgatatttatcgtgactactgagattttggtcccccccttacattggtgtcagaggcaagtgcctctgatctcatcccagttcctgtccttgtaaactctgtgattgtttgtagtttgtcattaaaaatagttatcaaaggcaagtaatttggaggtttaattgagtggaggaaacttggaagaaccaagtttcagtagcatgtagctatcacgtgaattttcatcctcccaaggttgtgctggggagattgagacaaaagaagtacaaacaccttgaaaactaaataggcagttcctgtgccaggcaatgggatgggattgtctcattgcttctgagtattgtcgctgaacctgattattatgaatttaccttattgttatattgtacattttaagaaatttttaggtattttatattctaatgcttgcaaaatctggaat

SEQ ID NO: 7458 - DNA, 1032 bp, Homo sapiens
ctacttgaagagtttgctacagggggtttgattccagacttcagggcaagtctgttctgtctgaggtgtggagtgcttacagaggagcgaggggtgggaggggaggatgtggaggtgactgagaacagagcttcctttcctttctttttctttttctttttttgagacagagtcttgctctgttgcccaggctggagtgcagtggcctgatcttggctcactgcaacctgcaacctccgcctcccgggctcaatcgattcttgtgcctcagcctcccgagtagctgggattacaggcgcacgccaccacacccagctaattttggtatttttagtagagacagggttttgccgtgttggacaggctggttttgaactcctgacctcaagtgatctgcctgcctcaccctcccaaagtgctgggattacaggcgtgagccaccacgcctggccaagagcagagctttctaagtgatgcagcatggaggggttccggtggctgagatgtggattgcagcccttgatggctggctgacctagacacctcctcccgcattttctgctttttccatgatgttccggacagcaaagtggcttgtcatggtggtaacccccacgtccattcctgtgctccctctctgctccatggctgcctgggtttaggtctccttggttaggaaactgtcgtgtgaccatgcccagctacaaggggagcctggaccagtgagtacaagatttttacttttccagccgctgtaggcaaagaaaggcagggagagagagccttaggagtggatgctgagtcagccagttgcagtgtctgccccagaaccatcctataaaagccattttcaaactttattcattgtatgtgaacatgtttcaacatctttcacaagtggcttttaaatcgttgttagtcatggaagctttgattagatgaactcttgtgagggaacctggcatggtgggcataccacgacaccagctctcagagactcagatggagggagccaggctgggtgtcgtggaa

SEQ ID NO: 7459 - DNA, 1051 bp, Homo sapiens
ctgtaatcccagcaactcaggaggccgaggcaggagaatcacttgaacccggggggcggaggttgcaatgagccaagatcgtgccactgcactccagcctgagcaacagagtgagactccatctcaaaaaaaaaaaaaaattgttatgtcattaccaagaataatccaaattaacattaaaaatgcattaacatttataaaacttaattagttcagagaagaaataaggctccctgcccctaactcctcactcctctcctgtaaatgtaaacatgtaaattgtgccttctgtgttgctttcctgtcctctatagtcttagggtgtgtgtgtgtgtgtgtgtgtgtgtgtgtgtgtgtgtgtgtgtgtgtttgaaagagagaaagaggatgtaactgtaatggtactacaaatgtgtctgtagctttctagaaatggaatttcttgatcattttattttaaaaataatcactcttttctgcttttgcttgaaatgtcctattttccatagattaatatatgtttgaccttttctgaattagatatactgttttatttgtttttttctcttcttctgttttcaatcccaaactggttttaattctaaaaaggtacttccatatcgttttttgttttcataatttttgcgaattttctgcttttattttccaagcttatgactttgactcattttgccaaagtggacccatcccatgaaaacaacacaaattctgttaatttttaaattgagactgcgggttttgtgtgtgtgtgtgtgtgtgtgtgtgtgtgtgtgtgtgtgtactttttttgagagggggtctcgttctgtcgcctaggctggagtgcagtggtgccatcttggctcattgcagccttcgcctattgggctcaagggatcctcccacctcagcctcctgagtagctgggaccacaggcgcacaccaccacacctagctaactttttgtatttttagtagagatggggtttcaccatgttgcgcaggctggtctcaaactcctgaactcaagtgatctgccctcctgcctctc

SEQ ID NO: 7460 - DNA, 1033 bp, Homo sapiens
aaatacaaaattgcgttattcaccagaacatgagctactttctgtgttgtccatgtggcaaggtctttagaaatatttgtgtgggcctttgccatgttaaatggctgtattccaaggcttcatttgtggtggtctagtcttttgtaggaggatagtaaggacgaaatgaattggtgtcttccagcagtcagatgtggcacacagggctcagggcttgcaccagtcgtctgcctgttcttcaaggtttgcctggagcttatttgccagcttctccaagggtgtccccagctcttagtttgcttttccatttgtcagtccaagtgcccttggggatagagtgtcatcccctttggctcctcatgtgggcatgtatgaagaagagagacttcgtttgtacacacagcaatcaggacccctgctggagctggagaatcgaggtgcttttcagaccaatcctgaggccctgtccttggaactgaaacaacaggctgagatgactgaagtgcattaaggaggaggctttagcctgctgccttggctgttttcttccattagaaaacatctcatgaatggagcatttggaaaaacaggtagttttagaaaaagagaatttccactcagactttgagaccaatctctgtaattgttttggtagggtaaggataggctttcttgaaacactagcctttagctgaggtattcgcacacagcccctgtctctgcataaggagataataaccccaaatcaaaggactgtcttctgttaattactaaattcccatttttccactttaagttgtgtggctggtaatagcgtccgccttctgatataagtcatagcatgcaacatgcactttgcaagtgcattttgcttgaatattttgcaaagatattctattgaattgagaggcagcaagtatttgatgtaatgattacacttgatcacacaaaaacacttcacagtgccatggctggtcttcatagtagtcagctcttgactttgcttctgtttttttttttttctccccacaag

SEQ ID NO: 7461 - DNA, 1049 bp, Homo sapiens
atttttgtattttaccgtctgtactaaaaatacaaaaatattagcccagggtggtggcgcgtgcctgtaatcccagctactcaggaggctgaggcaggagaatcgcatgaacccaggaggcggaggctgcagtgagcccagattatgccactgctctccagtctgggtgacagagcaagactccatctcaaaaaacaaacaaacagacaaagaaacaaacagaagaaaggctgtaattgtatagtcccaccagcataccaaagtctttttggaagtaacctctcattagctcaattaatgaggttgaattaaaaagtcacggagtccgtcaggctgctgagtgttctgggcactctgtgagggccagttaataggatgtgcacctcctgagctgtgttcctttctcccctaccctgagcacacgtttcagaggaacatggcgagttctcaggtagcgacgcttcccagctgctgtgccatcaggtggcactccacctgtccctctctatctcgtgatcttgttttattttcttcagcgtgtttcttactaactgaaattatcttacatgtttgactttgtctcattgcctagactcccagctctgttaaaacaagcactttgtttttctagttcatgctgaatccccagccttgggcccatagtgggtgctgaatatatgttcattgcttgaactccagagggtttctgtagcctctgtctccagtttgccccaagccactgtctcaggccatctttatgaatgacactgcaggagtcctgggcgctgcagctcctgtttagggatgtgctgcttgtgggacctcttctccctgggatgcctcctttctcgctgagtctaggtctgaggacatgcggattctttaggacctaactcagttgctggtttcttccacaaaacctttcctaacatcctaacaggctctagtgcttgcctgtttgagcctccgaaagtcactgtggttatcttaaagatgccttacaccacgttcctgcgttgtaattgtgtgcatagttgtctgacggtagg

SEQ ID NO: 7462 - DNA, 1041 bp, Homo sapiens
ccctttcacttacagttcttcctgaccctcagggcctctaggatgaaaagtctgggagcaagttacttcatcacatccagataacccttttatgtgcagggtgtttggttggaggtgctgccctcaaggcgtttacaggctagccgagggctcgaggtgtcatctccgtttaagaatgcttagaataccaggcaaaaagtgatagttttaatcagcagtaagaagtgcttttgcagttcaaaggtgtgagatgatcatggattggccataaccaggaaagacttttgggaggagatggcattgactagatcttcatagaaggacagatgtgtgggcatggtgactgaaacagcatgaagggtgacttgtgtctaaggagcaggaaacatttggctgggtgatgtggtctgcaggcagaagataaggctaggaaatgactgtcccggagggtcttggatgaagggccatccgctaatactgaggaagtcattgggagccagtgaaaatttttgagcagggaaattggggctgtattttaaccagatggagctggtttgatggtaagggtgtactagagaaggggaaccccacattctgaattaatgtcacttaggaaaggaccccttgtaagtatgaaatggttataattgtgtgtgtgtgtgtatgaatttgagaaaagtgtataactgaagaacactaggtatggttttcttgtttttttttttgttttgtttttttgttcgtttgtttgtttgtttgtttttttaaagacatggtctctctctccctctgttgcccaggctggtgtgcagtggcatgatcacggtcactgaagccttgacctcctgggctcaagtgatcctcccacttcagcctcctgagtagctgtgactacaggaacgtgccactatgtgccaggctaatttttgtattttttatggagacaggtttttgccgtgttgcccaagctggtgtcggactcctggactcaagtgatccacctgcctcagcctcccaaagtgccgggaggtatggttttag

SEQ ID NO: 7463 - DNA, 1035 bp, Homo sapiens
gttccagctactcaggaggctgaggtgggaggattgcttgagcttgagagtttgaggctgcagcgattgcaccactgtattccagcctgggtgacagagtgagaccctgtctctaaaaaataaaaattatccaaatgtctaatgagcatctactgtatacctggtgctgcactgtgaggatgccctctaagagccccctgtgcggggagagagaggttgtataaaatgtttgcaaaggtggaaatggagtaggagacacatatgtgaggacatggggctgcagggaaggccttctcaactcctctcaggctgatggtgagttagagaccagccagggaaattgacatctgaggcagatctggctgagtccaccaggggaagagggtgggatggtggagggaaggggcttgaaggactgagtgtagagtcctttgtcacataggaagatgtccgtgctttgtgagcaggcaggagtcttcgaaggttccaaagcagggaaatgacataagactactgaaggccaggcatggtggctcacgcctgtagtcccagcactttgggaggccgaagtgggtggatcacgaggtcaggagtttgagaccagcctggccaacatggtgaaaccgtgtctctactaaagatacaaaaaaaaaaaaaaaaaaaaattagccagacatggtggcacatgcctgtaagtccagctattcaggaggctgaggcaggagaatcgcttgaacttgggaggcagaggttgcagtgagctgagattgtgccattgcactccagcctgggcgacagagtgagactccatcccccacccgccccccccccccacaaaaaaacacgactgaaaatacttggaaatagtctccttaatttgtttttttttgttttctttttccaccaatggtggaattcggatgggaggaggcttctaattttctgctcacaatgttgttccttcactagtttgaagattcttctgttgtgaaagaccaagagaacatatgattagttaataggagctgtattcta

SEQ ID NO: 7464 - DNA, 1041 bp, Homo sapiens
gcagtctccagtctcattttgatcatatgttagtggagctgtaataccctcttctccttgaagattgtatgagagatacatatgtaaagaaccagacctacaagagatcgagaccgtcctggccaacatggtgaaaccttgtctctactgaaaatacaaaaattagctgggcatggtggtgcatgcctgtagtcccagctacttgggaggccaaggcaggagaatcacttgaacccaggaggcggagtttgcagtgagccgcgatcgtgccactgcactccagcttgggtgacagagcaagactgtgtctcaggaaaaaaaaaaaaaagaactggacctagagcttggcccaggtaggcagtggctgcgtggtagatgcggtggtggtggtggctgatcttatatcaggtgtttagagtcgtccatgttaatggagcagagtgctgagttgggagatgacatcaactggtcctgcgctttctgggtgacacacaaagtgcttctttgaactggggttctgtagaaaatagtttggaaagcaatgtgtaatattaatttttttctttcctgagaatgttacatggagtgaaattcaaaagtttcctgatgtctagataacttcctatctgtccacgtggtcttgtaagacccttgcatgagcctgtcccatttgtgctttataaatgcatgctggggctggggcgacgttacttatacctgtagtcccaacactttcggaggccaaagcaggaggattgcttgaagccaggaattcgctagccacctggatggcataacaagaccctgtctctacaaaaaaaaaaaaaaaattagctgggcatggtggttgtgttccttcagtcctagctactcaggaggctgagttgggagaattgcttgagcctaggagtttgaggctgcagagagctctggttgcgccactgtacaccagagcctgggcaacagagtgacaccctgtctcaaaagtaaaaaaaaaaaaaaaaggatgttggttgcccatttgctgtgtgccttgggtgt

SEQ ID NO: 7465 - DNA, 1047 bp, Homo sapiens
ctaggggtgcacaggtccggggcaagcacgtgggcgcgcatcctgaggcaggaacagggcgcatatctgagcaagcgagcacctgggcgcatgtcacgaggcgagcacgtgatgcatcctgggaggtggccgagggaggctcaggagagattggagtggagttgaaaaagcaggaagcagagagggaagtccgtgtgtaacaaaacattcagtttgtaggcccttgggtcagaggaggtgacagccataattttggctccctgggaagggtctcaggcagtgtcctgatttttttttttttttttaaacgaggcagggtctgactgtgtctccttagctagggtgcagtggtgcaatcacagctcactgtagcctcgacctcctgggctccagtggtcctcccacttctgccactcgaagtgctaggactacagtgactaatttaaacaatttttttttgtagagatggggttttgaatccctggcctcaggcgattgtcacagctgggcctcccaaggcactgggactctaggcgctcactaccacacctggctctgacgggttgaggctgtggggacctggctctttcactgtccttctttgccacatgtccccgcgtcttgtctcttctcgtgagggctgaagccatcctttggaggagctcaggagcttgtcctctttatccagggctcggtgttggcttcgagccggcttcctggggaggaggccccggcctggtcccgggcttggtgatgacgctgcccacagtgggatgctggggagctttggagccttggttttgcggctgccagcagtgtggtggagcatcgagagggacgcaggtgatgagactcaggccagtggcttctacctgggactgtcagggttgcctgcgttggctgttggctccctatgtagctgctgctcgttggtgacgggtacaagcgtcagtgcttctcactcagggcagtgtagaatgttacacagtgatagtttatgtctagccaggttttgaatgctcttactggaaacagtcatatttccta

SEQ ID NO: 7466 - DNA, 1048 bp, Homo sapiens
ggctgatcttgaacttttggtctcaagtgatcctcttgcctcagcctcccataacactggggttataggggtgagctaccatatccagtctgtatattttctttgtgtctttgtgtgttttcttttttgagaccgagtcttgtgctgttgcccaggctggatatattttcatttttgacttttgaagtcattcaattctcctgcctgttaattttgttgagttttatttgtagaaacagagacaacacatgtgcaaggtcatccttaggttttagctgttgactctaaatgatgtctagtctaatagccacttctactaaacagaaattggttaaggaagggcagtgagagacagcacgggggagttgtaatgagatgggggaaggaaaggccaatttggataaaatatatgagttatcctttgagccaggttatgtcctctgggtgtttgtatatatagaaaccggtcaactatggtatttggttttgggtaaagcagagatgagggcttctgagtagtggacagaatacttctcttgcaagagttgcttttcgagcttgtttatggatacacatccatttttattggatggagcagtagtattagagaagactgttggcacactttcacaaagtaggtaagggattccttttctacatgtttagactttactttggccaggtgcggtgcctcacgcctgtaattccagcacgttgggagactgaagtgggaggattgcttgaggccaggagttgagaccagcctgggcaacacagtgagaccctgtctctacaaagaataaacataaattagccaggcgggatggcatgcacctgtagtctcagctactcgggaggctgaggtgggagaatcgcttgagcccaagagttcaaggatgcagtcagttatggttgtgcccctgcactgcagcctgggtgacagagcaagaccttgttaaccacttacttagctccttggaacagtcccactgaacaagtcccctcatgacaccagattgccagtgggcctggctgttgttggcaaata

SEQ ID NO: 7467 - DNA, 1045 bp, Homo sapiens
gcaatttaagaaataaaatcccagtgacattgatttggatgctccaaacatgtccataatggaagagcttttccaggttttggtttgggccccccagaccaaagctttgacacataatacaagctctgtaagtctgttttcctgtctgtaatttgggattgtcatctttgtagggtgtcatggagattaagttattcactgtagacaatgcccctttcatgtaatagattctgtcagtattagatctttttctttctcttcaagtttcaaacatagattaggcaaaattttaatggctatttcacaaaatcagcttgattcttgtttatgacatcaagtgttgtttttccaggttgtctgttaaagggctacttttttttttttctaaaagtgctttagaaattccagtgttagtatgtatgcatcatttagctaagaatgaagatataaagatcacccaacagtttaagctgattcttttacaggtcaaggagaattgtgtttgtctagctgtcttagccgtgtaggactttctacttgttacttcctaaataattgcagccgcaacactgctacttcaaaggaaattacataaattttatttgctgtatttaaagtacattaaaaggcatcacttacacatttttcattaaaaatacttttaaaacttggaaaggataaaagtataaaatgtaaatactgtctgtattaataaaatgcagagatgttttaaaggcctttagtgtttattaactagtaatagttctgagaataccctggagctcaaatagataatctgtgttataaaataaatgggaaagttgacatttttgtgacttttctaatccttactatataggcctctataattcatgtgcccataacacttcttaagatgtgattttgggcatcttaagatggtgatttcgggcagctaaatcagcaacaaaggaacacagaacatcttttgcttaggtaggtagttgtaagggttgacagattgatgcaacttttaatactttagtttggctaaaggcacccagtg

SEQ ID NO: 7468 - DNA, 1097 bp, Homo sapiens
ataaactctttagaagtctgagggacaaaggaaaaaagaaaactcttccaggaaacgtattttcttataccacaaaggcatttaacatgtgtcatttataatgctgaaacccagtgtgcaaaaccatatgtgaataatggttagccagattcctgcccagcagggttatactctaaacttggatttcttttattacagacagcagcacctgcagaagaaggaggtaaaatgtgcaggatattggttcctgatgtactacaacacaggatgtgactaatcactaaattcattaatgttgaacataggatttggtacctttaccactttgttagagatctggaaaaaaaatcttctagacaaatcaagttgatcttggccaagtgcagtggctcatgcctgtaatcccagcactttgggaggccaaggtgggcggatcacttgaggccaggagttcaagaccagcatggccaacatgacaaaaccccatctctattaaaaatacaaaaaaatttagctgagtgtgatggcaggtgcctgtaataccagcaacttgggagtctgagtagtgagaatggcttgaacccgggaggcagaggttgcattgagctgagatcgtgccactgcactctagccttggcgatagagcgagacttcatctcaaaaaaaaaaaaaaaacaaaaacaaatcaagtagatccctaagtgcatcatttggattgataactattttttactgcatctggaaggtggtggcattttagcggttgtcatgttgaggaatatgaaataaatatattttaaattatgaaagcacatcctatcaggaatattttttccaaggaaacttgcaatgctaacaaactcctgaacttgattattgttattttttatttttattttttattttccgagatggagtcttgctgtgtcacccaggctggagtgcaatggcgcgatctcggctcactgcgacctccacctcctgggttcaagcaattctacaacctcagcctcccaagtagctgggattataggttccagccaccacacctggctaaatttttgtatttttagtagagatggggtttcaccatgttc

SEQ ID NO: 7469 - DNA, 1497 bp, Homo sapiens
cggggggcgcaggccgggaaatccagccccaggcctttcccggctcccaggccccgggggcacaggccggggactgggaacttttggtgtgaggagagtttcgtgactgcccttccgacagaggcgggttgcgagccttctgcctcctctcccttactcgggcgggggcggaacagcggcggggggcttttcctccatgtcccctgctggtaggggccggcaggggcggcccgtcgcgtccgggggctgcagggtttggggagtcgccggcttggggtcggggaggcgttcccgggagggccaccgctggcacttggcactcgcttgcgagcatttactgagctgatcccacttgctgggctctggaaagcacaaccttggaagagtcgcggaatgaaaagttttcctgcgaggacctcagctcctacctatcccgggctggttccatgtggctgggctgcggggccgggcctgacttgggagttgagtggatttccctttttcctggtggactgataacattgtctccacttcacagcattcctctactgtgtgtcagaagtgaaaaggcgttttgttaaattgttttaccgactgtgtctgtgtttgacaacagcccacgctgaagtttctcccaagcacccggggatatatttcctttgtagtagagtcctctttggtggggagcgcattcgtttgggtgcagtatttcccatttgttcccgacagtggcctggcccctgtgggcttgggggctgcaaatgacgttggaaagtggcttggtcagccctattgagcgtacacagggtactccggtggcatcttcagttctctcagaaattaagaagtaaaagctttttagacttttgttttgcttttagtatatattggaaaaaatagcataaatttggccttttaaagataattttgggggacgtttggagacccgacacaaggatggaagacgttggctttagtagctctgttatgttccttacagttgaactcttttattgaaaatcaaataaaattagtgggaattgggcacctgtttatcttgcaaagctgacaaagggaaagaaaaccatctaaatggacatttagcatttttaagtgttgtttatgtgtgacagtttatgctttaaatgttccaaaagagtactcaaattgttcaggcactctggaaaccaacaaaacaaattgtgcaaggaaagagaaataaagtaatatgcactctgcagtacgtctaggctcctgaataggaagagggtggtcaacattttctttcactttactaattttatgtgattaaaattgttttacctactgtgtcccatgtttcatcctgcacaaaatagacataggctgaactgcctgtttggcagtagttcaaatgtagttgttccaggcattcgttccacagaaattctgaagctttgactgtgtccatggcactgttctgggtgctggacatctaagggacccactggctgtgag

SEQ ID NO: 7470 - DNA, 1026 bp, Homo sapiens
tcctggcctaggggctgctggggaaaactttcttgagaaagtgtttgaactaagagctgagagttgagttaaatagaagcttggggttgtgtgtgagtacttaggttaattagtttattgtttcacttaattatgtatcattattagattttgctgtatccattttccacattgtagttcctattttcatacttaatttggcccatttgttgaaacctcagtacatttgaggcactttaaactgattggttaaaagtcattacttaatagctgaagaactggcagtagtttgacttccacatctcttccacaggtgattagccagtcaagagctaggtttaatcccagtatcagcatgattaagaagtgtattgaagttctgatagacaaacaatacatagaacgcagccaggcgtcggcagatgaatacagctacgtcgcgtgatgtcgctctcctccagcgtggtgtgagaagatcattgccatcaccatttggtgtgttcctgtgggaaaaagcaggactgtgcctccataatttggtcatttggcagcccctgttttctgctgtttacaacatcaccagtgccacgtcatgagcgtcaaagaaaatgcctagagatatttcaagctcatgtcattatgacatttcttaaaactttattaaaagaatgagtgaagtattgctgaaaagtggaaattcggttgggtaccatgctttttctccccttcacgtttgcagttgatgtgtctttttttttttttttaatgtatcttaaaggacataaaatttaaaaacttaaatattgtaatatgacagataacctaataattgtatctacattaaaatgacaaacatgatactgctgcttgtcaaataaaaaaaaaataaagaaatagaatgccttttttatgtggatggagtatcaggttgaccacaaaatatattgactcaaagcagctaatgcatctttagttgcgtttttatctgaatggtttaattcacttgtactcctatttaaatcctac

SEQ ID NO: 7471 - DNA, 1043 bp, Homo sapiens
tggtgcaggcctgtaatcccagctgctagggaggttgaggtgagaggattacttgaacccaggaggtggaggctgcagtgagccactatactccagcctgggtgacagaactaagagagtttcattgtgttgcccaggctggtctcgaactcctgggctcaaacaattctcccacctcagcctccctaagtgttaggattacaggcgtgatccactgtgcccggccttgtttcttgtttcttttttttttttgagacagagtctctcagtctggagtgcaggggctcaatctcagcccactgcagcctccacttcccgagctgggactacaggcgccctccaccactctcagctaatttttgtatttttagtagagacaaggtttcactatgttggccaggctgcttgtttctttatttttatctttttcaactttcattttagattcaggaggtacacacgtaggtttgttacccgggtatattgtgtgatgctgaggtttaggatacaatgatcccgtcactcaggtgctgaacatagtacccaaccgtttttcaacccttatgcccttcctccctcgctgtaaaaagctgtttctttttgtgagactttacaaaagtttgcactgtttgttttgtgttctaccttatctgcctgttctttgtgtattctggaaaaatgtctggctgtgattgaaagcaatgtttcatatgcactatcagttttttttttttttttttttttgagacagagtctggctgtgtctctggttcccgggttcacaccattctgcctcagcctcccgagtagctgggactacaggcgcctgccaccatgcccggctaattttttgtatttttcatagagatggagtttcaccgtgttagccaggatggtcttgatctcctgaccttgtggtccgccttcctcagtgtcccaaagtgctgggattacaggtgtgagccacaccgcgcctggccctaacagttatttttatttttatttttttttgggacggtgtctcgctttgtcgcccaggctgg

SEQ ID NO: 7472 - DNA, 1029 bp, Homo sapiens
taccccgagtgttttcacttttgtttccgcagactgcaaagattgatagctttggggaggagtatcctacgtgcatgctagacttcttgtctcaacccttagggtctggtgaaataagatcctcacacgctttctagcacttgcttaccctctagagagtctggaccattccctaccattacgtgcatgcaaataaaacatctgtgaattgcagactgttattaatgttaagtccacatctttgccccatggattaatattaacagttgaaggccagtaccctgggcgtttaaattttgaagataagatgcaaaatattaacgttcgctatagattgtgactgttcaacataaacgtctttgaactagacctggccaagcctaccttcgtagtaaagtatcggaaataatcactttgatctgattgacaactgactacataataatcgcttaaaaacattcaaaacactgttgcctaccctttagaatcttacattccttttcaagacagacacatgaacaaatgagctatactttgcttcttttgcccttatacagtatctggaagatccttccaaaagagtcgcgtgagataagagaagtacacagtttttttgttttgagatggagttttgctcttgtcacccaggctggagtgcagtggtgcgatctcggctcactgcaacctccgcctcccgggttcaagcaattcttctgccttagccttccatgtagctgggattactggcatgcgccaccatgcccggctaattttgtatttttagtggagatggggtttcaccatgttggccaggctggtcttgaactcctgacctcaggtgattcgcctgcttaggcctcccaaagtgctgggattacaggcctgagctactgcgcccagcccacagtgttttgaattacttgtttttttcaattgctgtttatgagttgggggaacatttctacaatgtgcatgcacatagcgtgggaaaaattccttttcaattgctttttgagtatttggatgttc

SEQ ID NO: 7473 - DNA, 1076 bp, Homo sapiens
gttttcattgctgtggctattgccttaaacagaaacaaaaaactaaaacaattttacaaccatccaaaagaggcttggaaacttttttttggctggatatccatagcacaatttaattcagtaaacataaacagttaaaattattccagtacacaaccatgttttaaaaaagagattacacccaattttggcaacaacacccaggaaataagcattcttttacatttggttcaaactttctgaatggcagttgtgcaacacttgttgtgaaaaactttagaatattataaacatgttaatcctgtatttccatttctgtgaattcatccaaaagaaataaccatggatatgggtagagacagagccatatggaatgcacactgcagtggtgaacacatggcccagctctgccatcaaggagaaggtgagaacatgggggaagattttatcgaagtttcttttctggggcatatgctcaggttaaacacctgctctgtatctctagcttctgactcctacccctggccagctctgttactctagtacactgctaggcaggcagagtatggccaaagtattcacaacagtgcatcactaaatcaactgggatccacacaatggaatatcctaatgcatcattaaaaatcacattgtaaaagaagattttataacagaaaaaaatgcactgtatatgatacatttttaaaatgttacttatgccagtcacaataaaagacaattacacttatatgggatagagtagtcaatattatagagacagaaggtagaaatgggtctgggtggaaattagaatgagatgttcttagcattccagttttacaagatgaaaagagtaacggagacagatggcagtggtggttgcatgacattatgaatgtacataattaaaaatgggtaagatggcacagtgagataccatctcacaccagtcaaaatggctattactaaaaagtcaaaaaaataacagatgctggggagcttgtagagaaaagggaatgcttatacactgctagtggcagtgtaagttagtccagccactgtggcaattcctcaaa

SEQ ID NO: 7474 - DNA, 1049 bp, Homo sapiens
tcaaattgttgggattacaggcatgagccactgtgttcagcctcttttaattcctatatgtattagccagttgaggtggcttgcttgaacccaagagttctgggcaacacagcaagacctcatctctacaaataattttaaaaattagctggggcatggtggcgcacacctctggtctcagctacttgagaggctgagacaggtggatcacttgagcccaggcagtcaaggcttcggtgagccgtgatcccgccactgcactccggcccaggtgacactatgagactctgtctcaaaaaaataaactatagaaaatctgagtagccctatatgtagtaaggaaatttaattatcagttaaactgtcacctgggtaacagagtgagaccacgtctcaagggaaggggaggggaggggagggtcttgtatttattatttccttccttttacttggttttactttggtttaatttggtttacattggtttaatttgttcttcttttactattttttttttactgaatcatcattattgttctaccactcgaatcaccgcattgctgttgctaaatgaccaatagaccaacagatccttccatagaaacaaaaaaaagcccttgcttttcaatattaccaaagggaaacatatagtcagaactgcaagaaaactgccttgtgatccggcttctgtcacattttagtttacaatacaggagcataaagtagctactcaactacctcgaaaataagagaatcatttacctttctgtatataacctaattaaaaccatgtcagatccagcaaaactgattttcatctctcctcagtagatataggagtatatattgatatttctacttcatgactagataggggactaaattaaaattcgctactcagttctcagttgtaaggcccacagttgcacatgggtaggtgggtagttgcacatgcacagagttggtggtcacaactctgctttcttgcccttctgcttaacatggagctatttaatcttatttatttatttatttatttatttatttag

SEQ ID NO: 7475 - DNA, 1064 bp, Homo sapiens
aaaaaaataaaaaatggccaaactgttttccaaagtcctggtaccatcttacatcctaccggtaaagttatgagagttgtagttgccctacattctcaccaatacttgctattatcagtctttttaattttcaccatcctaatggatacgtagtggtatctcactgtggttttactttgcatttccctgatggctaatgatgttgacatatttttgtgtgcatgttggatactaatatatctttgtaaagtgcctattcagtgtcttttccaatttagttgggttgctaaaaagtcttcatatattccagatacaatacctttggcaggtatgtagatatgtgttgtgtgactattttctcccagtctgtgacttgtcttcattttgttagcattgtcttttgaagagcagaagtctttaactttgtaaaagtctaattttttgctatcttcttttatagctcttgtctttttttgtttttttgtgtgtgtgtattcaattatctaagaactctttgactcccttcagatcatgtaaatgttctcctgttttattttagaaattttaattttacctttttttttttttttgagacagagtcttgctctgtcacccaggctggagtgtagtgacgtgatctcagctcaccgcagcctctgcctcccaggttccagcaattctgcctcagcttcccaagtagctgggactacaggaggcaagcactgcgatgcccagctaatttttgtatttttagtagagacagggtttcaccatgttggccagtatggtcttgatctcctgacctggtgatccacccgcttcgttctcccatagtgctgggattacaggcgtgagccaccgcacccatccaagttttaccttttaagcttaggtacatgatccaatttgaggtgaattttgtgtatgagtaagttaataatcaatgttcattttttcccatatggatatccagtttttccggtaccatttgttgaaaagactgtctttcccctattgacttactgtggccactttgtcaaaaattacttgcccatagacatgcg

SEQ ID NO: 7476 - DNA, 1022 bp, Homo sapiens
gagctatgattgtaccactgtaccccagcctaggtgacagagtgagaccctgtctcttaaaagaaaaaaaaaattgacctggatctactcatacccaccctggtctttgagcagaaagaatcatttgggaattattttgtctcatctttctccatgatcactgttgaagaatttggtcactgtaaccaggtaaatataaaactcaggtgggccgggcgcggtggttcacacctgtaatcccagcagtttgggaggctgaggtgagtggatcacgaggtcaggagatcaagaccatcctggctaacacagtgaaaccctgtctctattaaaaatacaaaaaattagccaggcgtggtggtgggcgcctatagctccagctgctcgggaggctgaggcaggagaatggtgtgaacccgggaggtggaggttgcagtgagccgagatcgtgccactgcactccagcctgggtgacagagcaagactccgtctcaaaaaaaactcagatgaactatagctaagtcagtgctcttgacacttttttagcaatagtagctttgtttctcacagaaaaaacaaaattttctgtggaaccacactatttaaaacataagcaatattagtatcaacttgtataatttatagatctactgataaaaacaatcaagaatagtctaccttaattgaatcaggaggagataactgcagtcttacatcagccatactcgtatccatgaaatatgagtcagtcatttgcacaactccctgagtcaccttctggaacacagaaaacactgagccaagttagcccaggacctgaaccttttgtggaaaggaaaatctgtagtgtctcctcagagtatggctgccctttcacctggtagtcagtttctcatgacggttactcgagcatttataaggcagttgtgaaataaccaagacattctgtgtgttgtgctactgatgctcctcctgtcaccgacctcctctccaaatgaggcctgccttttgtccttggtagtagg

SEQ ID NO: 7477 - DNA, 1046 bp, Homo sapiens
tcatcgactgcccttgctttgctttgctttgcttttagaatgccatcgggttttgtcatgttgggaacaagttaacttaggccagttgactaagatcaaggtatgtgaacatgcctggctgggagagaagtagagtaaatgttggttcgcattccctcccgacgcccacaatgccagccatccctgacttttcttgcctttattgggaagaatataaggtggcagaaacaaacttcccaccctttttccaaatatttactgaaggagtcttgaggagagtcttgtggggtgggggggtgggggtgggagctgggaatgtttttgaactagttcttgaaaaaaaaactagtacaatagtacaactgtcttaattttatatatgaggaaactgaggcccagagatgaaatcatgccttgatttatgcagacctcagtacctgttcgtgacaaatccagttactaaaaggtaagagaaggaataagggacttgatatttatctagcatcagcaatgtgtggacatcgtgtgaacggctttataaacatttcatttaattctctacatctagccattttttaacctgtgctttccctccctctcaaagtactgtttatacatttattagtccatattttaaacgctccatgctctcaactgtattaatgctatttgttaggataagtggcagatgtccatggaaaataagtggctgcaaagtggtaatgctgaccagatgagaaaagaagtgtaaaagggaagttctaaagaattaaagccctggagagggtgggtagacaacaacagtccaaaatagtgctcttcattgaggctgtgtagattttcctgcttcctgggaaaactggggcatatttacacttgcatgtgtgtattcagattgtctggggctatggagtttgggtcagattgctgaacccgtgggagagaagttcccttgttgtctgttgttgtctgttctgattgctgctttgtaatttgggccacatatgaaagtcagcatccagtcattggaccataggtgtgtggca

SEQ ID NO: 7478 - DNA, 1066 bp, Homo sapiens
gcagcgggcgtgggcgcagcccccggactcctcgcggcgcggtgcggcgcggccagggaggatgctggcggccctccctcgccagcggcgcccgccctcgccgcagcccccgccccgccccgtcaccgccccttccctctgccctggaagcagatcggcggccgcggggaggttcggggcggcgcagccccgcgcggttgtgggatcgctcccgggggccgctcctctctcgggcactggggtcgcgggagacgtcgtcgggagctcggtttctggaggcccttccccacccggcctctgcctcctccactcccccgggctggacggaacggggcccagcgcgggatgcgaggtgcgtccccggggcccgcagcgggcgggagcgcagccagggcccggtcggggacgcaggcccagggcgctgaggctgcacctgcctctccgaaaccgggctggctctttttgtctttttatttttctaatttatttttttagaggtatgatttcgctctgtcgcccaggctggagggcagtggcgcaatctcggctcactgcagcctcgaactcctaggctgaagcgattctcccgcctcagcctccaaagtagccggtactacaggcgcgcgccaccacgcctggctaaggtgtgtgtgtgtgtgtgtgtgtgtgtgtctccaaagtagcgaggactacgggtgtgtgtgtgtgtgtgtgtctccaaagtagcgaggactacaggctcccgccactacgccaggctaaggtagggtgtgtatgtgtgttaactttttgtagagatgggatctccctttgtaacacgggcgcccgccactaagccaggctaaggtggtgaatgtgtgtgtgtgtgtgtgttaactttttgtagagatgggatctcgcttcgtaacccgggctggtatcgaactcctgtcttcaaggaatcctcccgtctggactcctcccatgggattacgggcatgagccacggcacctggctattttttttttctaagcatttaaataagctggggcttgatttgggagttttctattgtattttgagctt

SEQ ID NO: 7479 - DNA, 1238 bp, Homo sapiens
gtatccattagctgggacttaaatgactcacttagaacaaagtacctggcattgaagcctcccagacccagccccttttcctccattgatgtgcggggagctcctcccgccacgcgttaatttctgttggctgaggagggtggactctgcggcgtttccagaacccgagatttggagccctccctggctgcacttggctgggtttgcagtcagatacacagatttcacctgggagaacctctttttctccctcgactcttcctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaattgtaaaaaaaaaagtgtaaaatatgtatatatccaaagatatagtgtgtacatttttttgtaaaaagtttagaggcttacccctgtaagaacagatataagtattctattttgtcaataaaatgacttttgataaatgatttaaccattgccctctcccccgcctcttctgagctgtcacctttaaagtgcttgctaaggacgcatggggaaaatggacattttctggcttgtcattctgtacactgaccttaggcatggagaaaattacttgttaaactctagttcttaagttgttagccaagtaaatatcattgttgaactgaaatcaaaattgagtttttgcaccttccccaaagacggtgtttttcatgggagctcttttctgatccatggataacaactctcactttagtggatgtaaatggaacttctgcaaggcagtaattccccttaggccttgttatttatcctgcatggtatcactaaaggtttcaaaaccctgcattcatttctggagtccgtgattttgaaagcacctggtgttccagggagggaacgcattgctgaggtgtagaggttaatgttttaaaccatagctcaccctttacagtagaagtcacttgacaatctggtaggggagcaggcgctcttcaatggattaaactaacgggttaacatcttaataaccttcagtgcttgtgtataccaaatgtgctgcttttcctagagaaaaagctattgttcctctgtcaagactaagctaatttatttgagcagaaggc

SEQ ID NO: 7480 - DNA, 1039 bp, Homo sapiens
attagaaacttgtcattttaatctttatccatgactttatatttttttctgtcttgtttatttggaaattttaacttcttcaagtattttcaaactatttttgtcagccatttataattcttgtttcacaaagaaagatatgaattaacaaacaagcagagagattgtggcatatcttgagcacttagcatttagaatggagtgagagcaagagggaaaggagaatcatataacaatacttaccatggagttttccttctcgtgcactccacacgggcattactacatcagaaatagttacaccccattctcatagtaggaatgtccaagttcaacttaggaatccataagctgagctcatatagcaacacaatccatctctggtctgacatacctcttatttcctgtttcagatattgtgatacccaataagcctaagaaggcggcccaagtaaataacacccaggcgttctggtggagtttaaaatcattatgttatgtagactgggttgcagatagattgcagatatgaactgaagtttctatcagtaaacaggtcaagactttgggactgactggctcactgggatagatattgtcaagtttaaacaatgtttgctataatgcaggtaataataaaaataatttttaaaagcctgccaaatattcttacttggcctggtataagatctaaaaataggaagcatagcattcactctttctgaaaccttttattcttcattgaaaataacctcattttcctagctcagcagatatttaggtaatccttctcaacagcatctctaaataaaagctaaaacatgacactacctgtttattaaaaagaaaatggccaggattttatatgcctgatcccagcagcaggctcatgggatgagaaagtatagggaaagcaatggtggtaagtacatgtctgtgtttgcagaccttcatttttgtactgatacaattgtaagagaacattccacactgtgtactggttgatcaaacataagaatttaaagtaaggctgctttag

SEQ ID NO: 7481 - DNA, 1062 bp, Homo sapiens
aaatcctcaagagactctataccagcaacaaattggaaagcagtatttagtgagaataaattttctgtggacaatatgcctattaataaatgtgctaagggtgcatttctgtttttaaatgagcaaaaatgtgtaaatgcaactattagaaatgtaaaatgaattgaagaacaagaaaacagatgaaaggaaaataactgctattgaattaatagattgtataccactcctaaaaggaaactatgtgtatcagcctgaaaatttccttcaaaaatggaaatgtctcctaaaggaaacaggaccaggtatgctggacatctgaccaggtgtggtaggcacctaactctgtatgctagacacctaaccaggtataccgcacacatgactaggtatgctggacacctgaccaggtgcagtagacacctaacttggtatggtagatacctgaccaggtatactgcataactgactaggtatgctggacacctaagaatgctttatcctgacggacaagagatcattccctggagtcaatcttccttctcagggcatttaaattgtgtttctaagttggtaagatattttccacataacttcagaaaaatctcaaatgataataatggctattatttattaagcatttgctatgtgccttgctctgagctaaatgtttaacatacattcttttgtttaatgctcacaatacttatgtggaataatttttttcaaatggggaaacagatttaaaattggaaaataattgcttaaattcccatgaataataataagttcatctgagcacaggtgtgtcccatgtccgactcttagctctgtcacctcctgtcccaaacaatgtcactggtttgagcccacagttacttacacctgcgtaacaagaccataaataagaatatcttgaaatatacaacagcaggcaatctggggggcttgtgtaagcaattctgcaaatacttggagtgaagaggcagtagtcattggtggcatcatgccacaggtaagcatttaaatgttagagatgctttcatttgattggtaaagcaa

SEQ ID NO: 7482 - DNA, 1057 bp, Homo sapiens
catgcagtcactcatcattcaataaactttgcttgagcaccactgtgtaccaggcatacagccctggttctactcaaattagagtcttcaccttacacttttgatgacagccttcacagttatcttttatctttcctcaaatcctctaaaaacattcttaatctttttatgcattgggtctctttgatagccacgtgaagcctaaagaccctttctcagaatatttttaaactattaaaatacctaagaaaataaaacacctaaattagataaaataaatatgaaaataaataaggaaaatatctaataaactattactattattaaaaaccagttgtcaaatattttaaaaatatacaaagtatatagaatatttttaaaaacttatttgggaatagtctacgtgcttctctgagcattaaaataaaaagatttagtggtgggtctggtaactactatgacttcaaagtcgtgacgagcataaaggatatttagaggtctgctacacaacggtaactcccgactctagactggcctccatgttttggaataatgccaatatttcagacaaatgtcctcatttggggtctagagaataagacccctgcacatatgtagaatcccagaggatagagaccatctaggaagaaggtggagctcggccagcctctgtgtcacaccgtgggaacagcaacagaagtgtgcatgtgcacttgggtgaagaaggcagcatccgcatggcccagcccagaccagtgagcaaagaccccatgaagaagggtatgtcttagcagaggccccaagggcacatgaggaggaagggggtgaactggacagaaggcgggaggccccaagagaagagcaggagtggaatggtgtgacgtgcctgaaactacaagctgcttcaagtcgctacgtgggaagtggaggctgggaaaggccagggcctggagttggacagaccgggcaacatcagtcattccaacggagcccattgcctgctttctagaatgtggaaagacatggccaggcgcagtggttcatgcctataatccca

SEQ ID NO: 7483 - DNA, 1032 bp, Homo sapiens
aatgaatgtaaacaagcaattaagatttcaaactttaagagaattgacacagtagagaaactttatgagtttactgagtgtagaaatgccttacacaaaaagttccactttacccattatcagagaactcacatagaaatcttgtgaaagtagtcagtgtggcagaaccttcaacaaaaagtcttatctcacaaaacatcacaggctacacacaggggagaatccctatgaatgtagtgaatgtggcaaagccttttatagtaaggtacatctcactagacatcagagaatacacataggggagaagccctctgaatgtgctgagtgtgagaaaacttcctgtgtgacatcaacactgagtgtgcatcagagaacacacatgggagaaaccttatgaatgtactgaatgtgggacaatctttaaccacaagtcaacactcactgaacatcagagaacacacacaggagaaactatgaatgtactaaatgtaggataaccttttttgcaaagttaaaactcattggacaacaaagaatacacactggggaaaaaccttatgaatgtatcagatgtgggaaaactttcagtggtaattcatgcctcacagtacatcagagaaaacacacgggggagaaaccctatgaatgtaccgactgagaaaaccagtagcaatttaaatctcacactacatcagagaacagatacaagagagaaaccctatgaatgtactgaatgtgggaaaacctacactcacaaatcaagtctcaatgaacattgtagaatatagggcaaaagctctgtgaatgtaataaatgtgacacatcattgtgccacagttcagtccttactaaatgtcagagaattcaaagaggaaagaagcactgtaagtataatgaatgtaagaaatccttttgctagaagacaaactctgtggtacatcagatagcacacatagcggaaaatgtcttttaaatgttgaaaatgtcttaaatattgaaactccaaaattaaatccataaaccaaactcatt

SEQ ID NO: 7484 - DNA, 1029 bp, Homo sapiens
ccaatatgttggaaaaactccatatataacagacccatgcagtttaaacccatgttgttcatgggtcaactgtatgttaacatcagacaaaataggccttaaatcaaaaaggtcacaagagataaagaaggatattgtatgttaataaaattcaatacagcaagaagatatagcaataatgaacatttatgcacctaataagataacatcaaaataaatgaagtgaaaattgacagaactaaagggtaaaatagacagttctactataatagttggaaacttcaatatgtcgttccaataatggatagaacaaccagacagaaggtaaggaaacacaggacttaaaaacacaataagccaacttgatttaacagacatctaagttaaattatgtttgcagttcaatcaaggttaaggttatttttagggcctaactggctttgtctgctctgggattatccagacctggtctgcatttaaaaatttgcttcaatactcccttttaggatcaagtagtacacaacactatatccaacaacaactactacagaatacctattcttctcaaatgcacgttagttattctccagggtaaaccatatgttaggtcacaaattaagtctcaatagattttaaaagatagatattatacaaagtatattctacgaccacaacagtatgaagttagaaaataataataaaaggaaaactggaaaatttataaatttgtggaaataatttaaataatatacctttaaacaacccataagtaaaagaaaaaaatcacaagggaaattgaaaaatacttagagatgactgaaaacagaaacaaaacatacagaaacttatgggatgcagcaaaagttgtgctaaaggggatatttatagctataggtgcttacctttaaaaagaagaaaaatctcaaatcagttatctaacattacatcttaaggacccagaaaaagagctaactgaaggctgggagcagtggcttatgcctgtaattccagcactttgggaggccaaga

SEQ ID NO: 7485 - DNA, 1030 bp, Homo sapiens
ccatctcaaaaaaaaagtctgaaaaaaaaatgaagaaagcctaagagacatgtgggacaccatcaagtggatgaatatatgcattgttcggagtgccagatagagaaagcatagagataatttggagaaataattggtgaaacattttaaaatttgatgaaatatataaatataaacctagaagaaacacaataaacttcaagtaagataaaatcaaagaggcccacactgaggcacattataatcaaactgtcaaaggccaaagacaaagttttagagcagcaagaaagaagcagcttatacataacatacatacatacaagccattctcaataaagttattagcagatttcttatcagatcttggaggccagaaggcagtgggttgaaatgttcaaaatgctgaagggaaaaacaaatctgtcagcaaacaatcctgtatttggtaaaattttctgtcaaaagtgaggctgaaattaagacattcctggataaacaaaagctgagggagtctgatagcagtagacctgccctgcaagaaagctgaaaagagtcctttaggttgaaatgaaaggacactagacagaaactaatgccataaaagaaatgaagatatctgataaaggtaaatgcacagggagttataatacaaagatgtattactgtaactttggttagtaattccactttttgatttttacatgatttaagagactaatgcgtaaaaatgttttgtgtctctggacacaatgtataaagaagtcattttttgacatcaataacttaaaaagtggtggggacagtgctgtgtaggagcggagttttttgtatgttattgaggttaagctagtataaatttaatttatagtgttatgactttaggatgttaaatgtaacaaaacagctgtagagaacacacataaaaagaaatgagaagggaattaaaagattttactagcaaaaatctactaaaaagaaaagagctgtaattcaggaaatgagggacaaaaatgctgtaagacatagaaaa

SEQ ID NO: 7486 - DNA, 1050 bp, Homo sapiens
aaattaatgtcagagaaagaggcctggtccattatcatgcagactgtaaatgctttaaagtacttaaataaaataaaacctcccatcatacactatgacctcaaaccagggaatattcttttagtaaatggtacagtgtgtggagagagaaaaattacagagcttggtctttcgaagatcatggatgatgatagctacaattcagtgggtggcatggagctgacatcacaaggtgctggcacttattgcaatttaacaccagagttttgtggttgagaaagaaccaccaaagatctcaaataaaattgttgtgtggtcggtgggtgtgatcttctatcagtgtctttctggagggaagccttttggctataaccagtctcagcaagacatcctacaagagaatactattcttaaagctgctgaagtgcagttcccaccaaaatgagtagtaacacctgaagcaaaggcgtttatttgacgatgtttggcctaccaaaaggaggactgcattgatgcccagcaactggcctgtgaccccctacttgctgcattatatccaaaaattggtctttgtgagtagccctgctggggctgctattgcatcaacctttggggtgtccaacagctgttcttcgaattgagactgactccaaggccacaaactgttcaacacacacaaagtggacaaatagcatttagcagcaggtttggaacgtagagaatctgaatggatctgatgaaacctgaaccaggtgcttattttgttgcttttttcccatccactgagcatgacagcatggattctctttaaggagaaaccatgggcagctccagccaggcctcataggaaaaggcccggcatgaggttctggcgtcaatggccactgtgtatggctgctctgagtgaggaaaaaactaaaaagaaaaactggttccatgtactgtgaacttgaaaacatgcagactcacgggggttcctgatgcaatgcttcagatgaagattgtggacttgaaaatacagactagaaggccgggcacagtggctcatgc

SEQ ID NO: 7487 - DNA, 1032 bp, Homo sapiens
tcactgtgtatatatgaaaacgtatttggcaatacaaaccacataccccttctatttcctgacataaataaatggctatggccatttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttt

SEQ ID NO: 7488 - DNA, 1050 bp, Homo sapiens
tattttgggtcatatatgtacctactgattttctgcctgcttgatccatcagtacttacaggggtgttaagtctccaattatggtgtatatttccaagttctccttttactcctctcagtttttgccttatgtattttgatagtctttcgttaaatgcataaatgtttcagattatgtcttctttaatatgattttgaacccatccaataagctcttaatttcagatattgtacttttcagatctagaatgtccattttatgtatgtgtgtgtgcatgtgtgtgtgtgtgtgtgtgtttgtgtatacatgtataagaggtgtcttgagaccacccccaggttattaatgatgtcctaggatgactcagcatatattggagcatggcgttagaaacaaaaattagggtgctaggtgtgtcagttgttactgatgtattgtttcttgtagacccatagtcatacttatggctatgatttattgtagtgaaaggatacaaagcaaaatcagcgaaattcctagaggtttctcccaatggagtctcacagaacacacttaactcctctagcaatgacatgtgacaacgcacgtaaaatgtgtaccaaggaaactcactagacatttggtgtccagaatttttattagaggctagtcacaggtacttcctgcctatcatgtaccaaaattctagactcccaggagcaatgcacatactgagtataaaccatattacttatggttatagctcaggcttagtgagccgttcttatcagagaaggttaaggtcagaacctttctgaaatccaagttcccaaatgcccatcaacggtgatcttttgtagcagacctttcaaaggttagtagtctcaggcttgctgtattaacctttttctgtatagcacacataccatgtatgtgttgaacttccctcattttctcatttattttgttaatattttcttctgttttgttgaacatattaattataattcattttgaagttcttgtttgttaattctactatcacggtcacctgtgagtttgcttttttt

SEQ ID NO: 7489 - DNA, 1033 bp, Homo sapiens
ggactattttttttctatcctaaatgagttctgagttaggtgaaacagagacaagcatattgcatcagtccttcaggtatttcccacatagttggaacagataagcaattccttgtaagtaaggtctgctctggtccctctagaatcaaggaccaggacccacacttggaatgcggtctgccgtctcaaggctgtcaccaagccaaggagggttggggtaaaggcaagtagaagtgccacaaagctttcctaccattttgaagttgccttttattttttctttctgatttggcatctacttggttgcggtcagcctttgaccttttcagaattctgacgaagtttattttgacagtttctgcttgttttttgatgtctctgaggggacctgagcttggtgccacctacctctccattttgctgacatcattccacttcattaatcttgtcctcttgtatgtttctttcttattatataaactttctgctttaggagagttttagatttatggaaaagttgtgaagacagtagtacaaagagtttccatatacctcccatagacacagtttcattaacatattaatgtagtacatttgtcacaattaatgaaacaatactgatatattattaagtgatgaccactttattgggattttcttaatttttccctaatgtaatttttctgttccaggatgcccacattctacttagtcatcatgtctccttaggctcttcttagctgtgacagtttctcagactttccttgtttttgataaccctgacagttttgaggggttcaagtcaggtgttttgtagaatgtccctcagttgatatttgtctactgtcttcctcattattagactgaggttagggtttcttagaggaagactacagaggtagtgtcattcagtcacatcctatcaagggaaaatgctatgagcatgatttatcactgttgattacctggtggaggtagtgtggtcatgtttctccactgtaaagttactcctttgtcctccgttttcaactgt

SEQ ID NO: 7490 - DNA, 1051 bp, Homo sapiens
tgtttttaaatttctttccttttttttttttctttaaagacaggatctcactctgttacccaggctggaatacagtggtgtagtagtcagtagtcatagctgactgcagcctcaaattcctgtgctcaggtgatccgccttagtctttcaaagtgctgggattataggtgtgagccaccatgtctggcctgttgttaatttcttactgctctttctttctccctgaaagcttatcatggcagtgtgttcttggtttatggaatgaatagttttaaaaatctgtttgaagatattaggattaattttccatttctatttcttatattgatttggtttcttagcattcatttctagtcatcttggtgagtatgctttatgctgttgcttttcctcaaatatctagtaaatctttattttccattcatatttaaaagtgaagaactagtttgatcagcacaggtagctaatgtgaattcactcagctgttgagaagtgtgtcctctattactgtctcccacaatggaaaggccaattcaaggattgtagatgaattggtaaggaaacataataggtaagaaatccagcaggtttcctgccagaacctagaacatctccaagctggtggctgtgcttgaaatggacttcatgcctctgacttctgtttgatcttaccattccgtatctttcagaaattactcaaaatgtttcttctgctgaggggctccttcccaggagtattcttttttttttttttgagacggagtctgtctggctctgtcacccaggctggagtgcagtggtgtgatcttggctcactgcaacctctgcttcccgggttcaagcgattctcctgcctcagcctcccgagtagttgggattacaggcactggccaccatgaatggctaatttttgtgtttttagtagagacggggtttccccatgttgccaggctgttctcgaactcctgagctcaggcgatctgtccatctcagcctctcaaagtgctcagattataggcatgagccactgtgcctggctgtattctgtttt

SEQ ID NO: 7491 - DNA, 1645 bp, Homo sapiens
tttattaacaagtatgtttcatatatacatgggggacacccagagaatgagtgtttcacaaagaggtggctttgaattccagcttatatggcatcttcatcaaagaacaggaaatttttagagaaacgttaagacaaaggaaaggggcttggaatctctaaggctggcaacttgggggaaagcaaataaatggccgatacaggctagtttgtgaagctaattaatgtagattcccctggtaccatctctaggaccatcagttctcaagttgtcttcagttgttaacctttgttctccttgatagatggggaggcaaggataccttttgtcttcgtaaatccatgtcctgcttttaggcagatagagacaggacagctttcttgtgtctacttcttgccttcagctcaacaattcttcatattttggggtggcatatttctggtctcccacattactattttagaattggattttttttaatgtattgagttttaatagttttttaaattttctagatagtaatcctttgtcagatatgtggtttgcaaatattttctccttgttggtagcttatcttttcagggtgtttcacagagcaaaagtttttcactttgataaagtccagtttgtcaatattttgttacggatgatgcttttgttatcaagtcttaagaactcttgcctagccctaggcaaagattttctctttttttttgtctaaaaattatatagttttatatgttatatttaagtacttcatctatttagagttaatttttgtgtaaggtatgaggtttagattgaggctcagtttttgcctatggatgtacaattgcttgcagcaccatttgttaaaaattttttttcaacaaatttgtgaaaattttactgaactccttttgtacctttgtcagaaatcacttaagtatatttgtgtaggcctatttctgggttatcttctatgttccattggtgtatgtgtctgtgcctctgctaataccacgctatcttgatgactgtaaccatatagtaaggtttaatattgaacacagtgattccttttactttattcttcttcatagttgctttagctattcttagcacctatgccttttatataagttttagaataagcttgtctgtgcttataaaaatccttgttgggagtttgataggaatttcatcaagatactgattttaagggtaagatattttttgactgactctgctattttttcagcaaatatctttcctttccctgaagttagcattttttatctttcttaatcaagtcattcattcatttagcaactatttatgactgttctgtattactaaatcttgttgaattgcaaacgctgttcaaagagagttggtacagtttaaattgctcacttgtaatgtgacagctatttaatatacaaggagctttaggctcccttagctgggcatttggggtagaggaaaacaagcctgaggtgctttgttagccattttttttttaagacagagtctcttactctgtcacccaggctggggtgcagtggtgtgatctcagctcattgcaacctctgccccccaggttcaagcaattctcctgcctcagcctccagagtagctgggattacaggcacctgccaccgtg

SEQ ID NO: 7492 - DNA, 1128 bp, Homo sapiens
tcctcagtttacttaaaaaggaatctgttatctctagggcttatcaaacttatatgtgattgtgcattcctggcatctttttaacatgcaggttctgatttagtagctgtggatggggtcctttattctgaagttctgataaacctccagcttaagctgattctgatggttgacttacacactattttccattattcctttttcacttaacagcatacagatgtttctctgacagaacatgaatagcattttctctctttgtcacaattgcctagtaattcaagtccatagttcattaaactacttccagctgtttgctatgacaaaccatgtggtaatgaataaccttgtacatttataattttgtgtgtatatgtttatatattagatgaattcccagaacttgatcagcttagtgggaatgcctgtcctagagatagtattattttgttttcccattggcaatgcatgggaatgcttatttcttcacagctcctcccatagaatatgtggttcaacttttggatttggggcaaccgataggtaaaaagtggtatttcatatagtttgcatctgcgattttcttcactgagtgaggttgaatacgttttcgtgtgtctaagggtgtcttatatttatttttctatgaacttaactgttagtatcttttgcctatttttcttttgggttgtctggtcttttttcccccccagtgtcttttacccttgtgtattatatgagttgcaagccattattttttggtatatcatttgtcttttgataattgttcatggtgtttttccctatgcagaaatatttggttatttttgttgtccagtttattaatcttttccttatggttttggactgatagcatttggagacatagttagaaagtccttcccacttgattataaagaatctgcccatgtattctaatacttttatgcattttatgtttaaatctttaatccatttggagtttacttgtatgtagaaacttaattaaattactacagtatcattccatttactccaccccccgatgtgtgctgttgttttgatgctttcttctccttgtgttctgaaccccacaaggtatctttagtattacgactttagagagtg

SEQ ID NO: 7493 - DNA, 1319 bp, Homo sapiens
cttctagaagaaaaaagttggaacttttccaattcagtttttcaggccagtgcaaccttgataccaaaaccaataaaacaaacaaacaaacaaaaaacataaagctatagaccaaagtctcatagatttagatgcaaaatcctaaaattgaaaaaaaaagtctagtcatatccataaactgtatcatcaccaagagatgtttattagggcaatcaaaagatgatttattattttttaaaaaatcaatgtggccttcccttcctctttcttttgattcccctctttgagtttttatgtgtctcttttgccttcccttcccagagtggaggagttagacctgcattgtgggatgagaggagttgtggctatgtgtctgctggcaccaagagggctgagggtgaggtgtggaagggacagggggaggagatgggcagcattgttaagagattggtaccactgagcaaatatgttgagaatgatgatggcaaggtttctccctgttagagaaggtatttgtagaaataggaatgaggagagctagaaaacctgcagtgtgggattagaatagaactcatatcttttaaatacataggaacaatagagaaattgttgggtgtgcccatatacatatattttgtgattcattctaccgagaggacataaatgcagtcacagctcagtaacagtaaacacaccaactgccaagttattatttcctaaatactatccacaaaaaaggggaccagggatgattcctagtcggagattgggagaaaaagaagatgagcctgaatcatttcatgtacctaacagaaagaaaatactctggctgggctcagtggctcatgtttgtaattctagcatgttaggaggtcgaggtgggtgtgttgcttgagcccaggagtttgagaccagcccaggcaacatggcaaaactgtctctacaaaaaatataaaaattagccaggcgtggtggcatgcacctgtcatccgagatactcaggaggcagagaggtgggaggatcacttgagcctgggagattgagactgcatcgagctgtgatcatgccactgcactccagcctggaagacagagtgagaccctgtctcaggaaaaaagaaaaaaaaaagatgttgctcagcaagttaatggacaaactgtgcaatatccagaaaactttaacattcttcaaagaaatagaaaacacaatcctaaaatttatatggaaaccacaaaagacctagaatagtcagagttatcctgagcaaaaggaatcaaactggagggatcatattacctgacttcaaattattctacag

SEQ ID NO: 7494 - DNA, 1069 bp, Homo sapiens
tgtagattgtattttatttactttataaatataaactaaactagtagttgctaaacatttttatggattagaagagtgataaatatttggagaacactaacaggattaaagccaaaagtatttcctagtctccctcatctcccatgcctctgcaacctttatctcatcacaggtaagacatgctgttatcctgttaagcaattccattgacttgccacatattttttcaggtttttaacgttttcttaagtttttgttatatgtttgcaaaggaactaaagttttatcacttcagtgaagtctaatatgttgacacactctcacatgaatttgcccagaacacttttatgatccatctgtgttgcacatatctgtggtgtgagtcctttaagtcctgtggtagatatgtctctgtatgtatgtttccttatgagaaggtatgttcctctcttgtaaggaagactcttgtattcaaattggaatactcagaaactaagaaagctctaggcacatgtaggtactaaatacttttgcattaagtaattaattcaccaacaggatatttctgctatgatcttttacccacaatgtgtaacataaaacaacatatatcatggaggccctttataacattttctatttaattttcaacaacaaaaattgtaagaattagtccctaaacatcttgtctcacatcagctgattcttattgcatcagactgagcagaactgtgattttccagggatcagtgtcatttagggatgtgactatgggcttcactcaagaggagtggcatcatctggaccctgctcagaggaccctgtagaggaatgtgatgctggagaactacagccaccttgtctcagtaggtaggtaggaattgtttcccatgtagaaggccagaatgcatgtcctttcttatcgatagaaacttgtggaaattttgtaaaatataacatttagctttgaaatttagaggtcagagacaatgtatcccttttggataccagaaagaatattttcctctgccccacgacaggattaaatgaggtgtgtgtgtgtgtgtgt

SEQ ID NO: 7495 - DNA, 1034 bp, Homo sapiens
ttattgacaggcatgtttcccatgcatagaattctcagctgacagctttttctttcagcactttgaatatatcaatccagtgccttctaacctccaaggtttctgctgatgatctttttgaggttcttttgtatatgacaaattgcttctcctttgcatttgattctctgtcattttttttttctgactgtttgcttataacatgacttggtggatgtatttgagtttattttgagtttattgtgcttcctggatgtgtagatttgtgtctttcaccaaatttagggagtttaattttggcttttcggcaaatactctatttccttgtctctcttgtattcttctacatttcccataatgtttttgctggtcagcttgatggtgtcccataggtcctttgggttccatttatttttcttaattcttttttgctctgattctcaaacttgataatttcaatagtcttatacttaaattcacagattatttttggcattcccaaatctgctgttgaactcctctggtgaattcattatttcaattatggtactttttagttttagaatgtctatttggtgcttttttataatttcaatctctttattgatatttggtttataagttgtttcatggttctctctggtgctcgtatgttttcttttagcttttgagcatatttaagacagttgatttaaagtctttgtttaagaagtgttatgtttggtttgcctctgggatatatctgtcaatttctatttttcctttgattggacaacacttccagtttctttgtatgctttgtgattttcttgttcctgttgaaactgggtattttaatattataatttagtaactttagaaatcactttctcattcttctctagactttgctgttcttaattactgaagtcttcagtatccatttgtttttatgaatttttcaaacttttttttgcagtcttatgtgtggtcactgaattctctctctttagcttgtgtttaggtagtgttttaacaggcatttttcctggaag

SEQ ID NO: 7496 - DNA, 1028 bp, Homo sapiens
ttgaaaccaatgagaacaaagacacaacgtaccagaatctctgggacacatttaaagtagcgtctagagggaaatttttagcactaaatgcccacaacagaaagcaggaaagacgtaaaatagacaccctaacatcataattaaaagaactagagaagcaagagcaaacaaattcgaaagctagcagaagacaggaaataactaagatcagagcagaactgatggagatagagatacgaaaaacccttcaaaaaatcaatgaatccaggagctggttttttgaaaagatcaacaaaatagaatagccagaagaataaagaagaaaagagagaagaatcaaatagatgcaataaaaaatgataaaggggctatcactactgatcccacagaaatacaaactaccatcagataatactataaacacctctatgcaaataaactagaaaatctagaagaaatggatagattcttggacacatacaccctcccaagtctaaagcaggaagaagtcaaatccctgaatagaccaataacaaattctgaaattgaggcagtaatagcctaccaaccaaaaaaggtctaggaccagacggattcacagccagatactaccagaggtacaaagaggagctgataccattccctctgaaactattccaagtaatagaaaaagagggaatcctctctaacacattttatgaggccagcatcgtcctgataccaaaaccttgcagggacacaacaaaaaaagaaaatttcaggccaatatccctgaagaacatctatgcaaaaatcctcaataaaatactgtcaaaccaaatccagcagcacatcaaaaagcttatccaccacaatcaagttggcttcatccctgggatgcaaggctggttcaatataggcaaatcaataaacataatccatcacatacacagaaccaatgaaaaaaaccacatgaatatctcaataggtgcagaaaaggcctttgacaaaattaaacaccgcttcatgctaaaaactctcaaaaaaac

SEQ ID NO: 7497 - DNA, 1012 bp, Homo sapiens
aggaaaactaacaaacagaaaggaataacatcaacatcaacaaaaaggacatccactcagagaccccatctgaaggtcaccaacatcaaacaccaaaggtaaggaaatccatgaagatggggagaaaccagtgcaaaaggcagaaaattccaaaaaccagaatgcctattctcctccaaaggatcacaactccttgccagcaagggaagaaaactggatggagaatgagtttgacaaattgacagaagtaggcttcagaaggtaggtaataactaactactccacgctaaaggagcatgttctatcccaatgcaaggaagctaagaacattgaaaaaagattagacgtattgctaactagaataaccagtttagagaagaacataaatcacctgatggagctgaaaaacacagcacgagaacttcatgaagcatacacaagtatcaatagctgactcaatcaagcagaagaaaggatataagagattgaagatcagattaatgaaataaagtgagaagacaagattacagaaaaaagaacaaaaaggaatgaacaaagcttccaagaaatatggaactatgtgaaaagaccaaatctatgtttgattggtgtacctgaaagtgacggggagaattgaaccaagttggaaaacacccttcaggatattatccaggagaactttcccaacctagcaagagaggtcaacattcaaattcaggaaatacagagaataccacaaagatactccttgaagagagcaaccccaagacacataatcatcagattcagcaaggttgaaatgaaggaaaaaattttaagggcagcaagagagaaaggtcaggtcacccacaaagggaagcccatcagactaacagcagatctccctgcagaaaccctacaagccagaaaagagtgggtgccaatattcaacattcttaaaagaattttcaacccagaatttcatatccagccaaactaagcttcataagcgaaggagaaataaaatccttta

SEQ ID NO: 7498 - DNA, 1292 bp, Homo sapiens
ccatatccttgccaacactcgttattttcttttgttgttttgatagcagccattgtaatgggtgtatggtaatttttcactgtggttttgatttgtatttccctaatgatcagtgatgttgagcatattttcataagcttgctgaccatttatatatctttaatggagaaatgtctgttcaaatcctttgtccatctttgaatcaggttattttgtttgttttgagttgtaggggttctttatatattttttatattaattcctcatcagatacatgaattgcaaatatttcctcctgttgtgttggttgtcttttcattcagttaactgtgtcctttgatgcacaatttttaagtttgatgtggtccaatttatttttatttctgttgcctgtggtttttggtattatatccaagaaaacattgccacacgaatccattctcctatgtgttctgccatgagttttgtacctttagttcttagatttaggtctttgattcattttgagttaatttttttgtttttgttttgttttgcatgtggctatccagttttaccaacactatttgttagaaaaattgtcctttccctattgactgttcttgacaactttgttgaaaatcattttaccatacatgcatgggttttcaagattattttggctagttgagatcccttgaaattctatgtaaacttcaggatgatttatttctatttctgttactatgtcttctttgtagacttagtttttttttttttttaatcaatatgtagtgtttttctcttgtaacaatttttgatttaaagtctcttttgtctcagtatagccaccctggcattctttaggttactatcctcttctgtcatttcaatttcaacctattgtgttgtgtgtttgtatctaaagagagtgtcttgtagacaatatatacctggatcatatatttttatttattttgccaatttatttttatttttattatttattttattttattttttttttgagacagagtcttactgcatcacccaggctggagtgcagtggtgcgatcttgactctctgcaacctctgcctccagcgttcaagcagttcttctgcctcagcctcccgagtagctgggattacaggtgtacaccactacacctggctaatttttgtattttttttttttttttagtagagatggggtttcactgtattggtcaggctggtctcaaactcctgacctcgtgatccgcccacctcagcctcccaaagtgctgggattacaggtgtaagccaccatgcc

SEQ ID NO: 7499 - DNA, 1567 bp, Homo sapiens
tgaacccaggaggcagaggttacagtgagccaagactgtgccattgcactccagcctgggtgacagggcaggactctgtctcaaaaaagcaaacaaaaaaaaactgggctgaaaaataccacatcacttttttcaaaaccttgttgggattctctggtttataataaagattaaaacctgaatatttttgtttagcatcagttttaatgaaagtattatgttccattctttggcttttcctaacttgcttaattagtttaatatattggtttgcatactctgttagagtacagcataagttgtttataagtcagtagaaaaccaaacgttttcacatttgaaaactaatgtgtccaagcagtacataaccatgccagagtcatgcatggacgtgtgagtatctcccttttagagatgttttgccagctgggaggtggacatttttaggcaagtgacatttctcatgttcttttcttgtttgtaagctacaccctctcggttttctctgctctgccaacactagtggaatatgatcacatcccaggtaagttgtttattttttcacagttttgcttaaaactaattattgaggtttaaaaaatgtctatacattcatatgaaagtagaaataacatcctggaaaatatagaggagaggtcacattacagttcatgggtcaaatgcagcctactgtctgtttttttatggtccacaaatgaaggatggtttttatacttttaggtggctgagggaaaaaaaccaagagtattattttgcttggaaattgtatgaaattcagacttcattgtctatgaatttttattgggactcagctatactcatgtatttatgtattgcctgttggtactttcacactacaaaggcagagttgactggttgcagcagagactgtaatggcctacaagcctaaaatatttactgtgtgactctttacagaaaatgtttgctgatttctgatagagagttgatgaagagtaagacaaaaatgtcatataggtgaatgcagatcttgtgatcttacagttgtgaaactggaacataaaacagtttgtcggtgggctttattaggtgacattgtgaaacttctgatgacagtcttgcaggtacttaaaaaagtagtacaacaaagtgagtaattcatgtgcagtccaggggaaaacttaacagatagcaaaagaaagtatatgattaaaaaattcaaataggccgggcacattggctcacgcctgtaatcccagcactttggaaggctaaggcgggtggatcatgaggtcaggagttcgagaccagcctgaccaacatggtgaaaccctgtctctactaaaattacaaaaattagctgggcatggtggtgcgtgcctgtaatcccagctagtcaggaggctgaggcaggagtatcacttgaacccaggaggtggaggttgcagtgagccgagattgtgccactgcgctccagcctgggcaacagagtgagactccgtctcaggaaaaaaaaaaaaaaaaaaaaaaatccaatgaattgtgtagcattaggactcatggttgt

SEQ ID NO: 7500 - DNA, 1041 bp, Homo sapiens
cattaagttttcttggcatcattgttgaaaattaactgaacataatatattgtagtgtttatttatgaattctcaattttatttcacatgtttacctctatgccactatcatgccatcttgattattgtaattttgtagcaaattttcaaattgagaagtgtatgtcttctaactttctacttctttttaaagattgttttgattatattcagctccctaaatttccacatgaaattttagaccagcttgttagtttcctcaaaaaggcagatgggattttggtaaggattgtgttgaatttagatattaatttggcagttattgccatcttaaccatatgaatgcaattcagtgcctttccatttatttaggctgtctttaattacttccatcattgttttgtggttttcagactacaagctctgtatttccttgattaaagttacaagtattttattctttttgatgctattgtaaatggaatttacttatttatttatttattgaaacagagttttgctcttattgcccagggtggagtgcaatggcgcgatcttggctcactgcaacctctgcttctgggattcaagcgattctgctgtctcagcctcccaagtagctaggactacaggcacatgccatcatgcctggctaacttttttgtatttttagtagagacagggtttcaccatgttggccgggctggtctcaacctcctgacatcaggtgatccagccacctcggcattccaaagtgctgggattacaggcttgagccattatgcctggccggaattctttttaaaatttcatttatgatttgtttgttgttagtgaacttgcaccctacaacattgttgaactcttttattagttttaatagtgttttagtagattctttaagattctctatatgcatgagcagtcaactgcaaatacatatagttccacttttttttttcaatctgaattccccttccccttgcttgtgttgactacaatctgctgtgtgatgtgtaactggcaagaaggcattcttat

SEQ ID NO: 7501 - DNA, 1049 bp, Homo sapiens
agcactattaaataaaaattctgtatcttttgaaactatattcatgaataaaggggaactaaaggcattattagatagggaagctaagagaaaatgttgctagcaaacctacctttaaaaattgactaaaagttctctaaatagaaaggaaataacaagaaggcttgggatgcaggaaagaaagaagattggaggttggcaaaaatggggataaatatatttttctcgtgagtttctagaatcatttttgatggttggagcaaaatgctctgtatgtaggggaaacacttaagacaattatattttaaaagtggggagggtaaaggggcctaagtggaatgaaacttggtacatttcacttgaagtggtaaaatgcttgatagactgtgataacttacatatgtacattttaatacctagaacaactactgagaaaactataaaatgtggtacacttagaaacactataaataaacccagatggaatctaaaataatatttaggtaactaatcagaaaataagaaaaaaggaacagatgaatagaaaacagaaaagaaaacaaatagcagcctaacagagcaatatttaccttaaatgtaaataatcaaagtacactaattaaaatataaattggcagagtggaaaaaacataaaacatgatctaaaatttttaatttttgtgagtacatagtaggtgtatttatttttggggtacaggagatgttttgatacaggcacacaacgtgtaataatcacattagggtaaattgggtatctattccctcaagtatttatcttttgtgttataaacaatccagttacactcttttagtcactttaaaatgtacaattaaattatttttgactgtagtcaccctgttgggctagcaaatattaggtcttattcattctttctaactatttttttgtaccctttaaccatcctcaccttcccccaaccccaccccaccacctttcccagcctctagttactgtccttttactttctacctcatctccatgagttcagttgttttaatttttacct

SEQ ID NO: 7502 - DNA, 1035 bp, Homo sapiens
aaatcaaacctccagatactactcacaaaaaatttttccttttagaatcattttttgaaggtttaccattcttacacctgccaatagttcagtctttgcccacctcaactttactgttgtttttcttggttatttttctcaaagcactttcagtgtcccaccttaacctccattgttttgtgtttattcttctgtcagaattttttattcactcatttttaaactcagcaaataatttttgagcacttggtgtgtgctgaggatatgataatgaaaaaaattaggccaggcatggtagctcacacctgtaatcccagcacaggtcgaggtgagcagatcacttgaggtcaggagtttgagaacagcctagccaacatggtgaaactccatctgtactaaaaatacaaaattagctgggcgtggtggcaggtgcctgtaatcccagctacttgggaggctgaggcaggagaatcacttgaacccagaaggcagaggttgcagtgagctgagattgcaccactgcactctagcctgggcgacagagcgagactctgtctcaaaaataagtaaataaatataaaaaaaaaacaaaattatgtctctaagtatattatgtatacttatgtttatgtatattaagtgttctgtggttttaaagactatgaaagaaattaaagcaagtttagattactttaaggaacagtcaggggaaaccttactgaggtcaacattagagtagaaatttgaatgaaatgactgtgtgagccatgaggattctgcctcttttcagcaggggtaatagcagctgctagccttggacaggaatgtgcttggtggttttcaggaatgaccaaaaagtcacagtggctgaagggagggcttgattggaggaagggcaggaggtgaggtgagggaggcagctagagtccaaaggtgagcctatcataagccttatttggttaaaatctgtttagtggtagattttcagcagatgagcaacatctgatttatatctctgtaagatctttctcacct

SEQ ID NO: 7503 - DNA, 1027 bp, Homo sapiens
cctattctttacaatggttttagtgttaatgttttttcattaaatgtattgttaacttgtttggccaatattgtcattatacattttttgtgaagactgagggagattgaaatccttaggaagcaaatatttactttcacctgatgaaaaatcttgtgcccaagagctacatggttatgttggagttgtattagggtgttctttcaccatttctaccccctattccgaagtgtcagaggacattgatattctcccagacggagcattttacctagtgggtgtgtatggcttcttagggcagaagaatccgggagttgccaggcaggccaaatctttcatgaccccattcctctttttccaactcagctgtatcttcagagttgtctccgtctttccaagaacagaacaaaatgaacaaggtaagttgtttattaattccctactttattttgcggtggactttgtgagatttgtaagagtcagtatggtttttttgttttgttttgtttgtgacatggagtctcgctctgtcgcccaggctggagcgcagtgtctccatctctgttcactgcaaccttgcaacctctgcctcctgggttcaagcaattcacctgcctcagcctcccgattggctgggactacaggcgcaggccgccacgcctggctaattttttgcattttaatagagatgtgttcaccgtgttgccctggctggtcgcaaactcctgagctcaggcaatccgcccgcctcggcctcccaaagtgttgggattacaagtgtgagccaccgtgcctggccaagagtcaatatgttaagatgagaaattagtaatagataaaaattgaacttcccagaaaatataaagtaacagatcaatagcagggccaagttagagtcaataagttgagcttcatgtgtttcttatgtttccaacaaccatggcagaaaggaagacactggatatggatacagacaaactgactcctctgaagacacaaagacttcctggcagataccttttttggt

SEQ ID NO: 7504 - DNA, 1027 bp, Homo sapiens
ttcctgcttgcacagagactcaaagtcagccagaagtgagtgcttagggtttcccaagtacttttctgagcatgtgcacagccctgagcatgcacttgaccttctagattctcaggaatgcactgcagtttttcaaaacccctatgatcatgtcattactgaaactttccttttaagctttctggttagtctattgcttgcttcactgttatctactgcttcaggcatttgtgaaattaaataccagtaattgtttttgacaatgaaccttggggaatatgatttttgtacttgagacctctgagtcaggtcaaatacagacatccttgtaagtggggtctccatgggaactactggacaggtcaaataatgacagttttctgagaatgaagctttgaaagagttccattgctgttttccctccaggggctgctacgccagtggttttcatgatgaatgtggggtcctacttttcaaggcacttgggatagagagtcagggatgggactagggcaagttcaagtgctataaaatttgcaattcttactgagattcagttatgttttttgaataaatcctcctaagatttctgcaagcgtttagttaattttggaagttctaaaaatgtggattctgacctttttgttttttgctggttttcttgttgcgtttatggaagagagggtttttggaggtccttactccaccattttcactacctggctatactctattgaaagcacttctgggatgtctctttaaacttacaatgatcataacctttgacccagcacatcaagtattaggagttcatcttttatatgtggtcacacatttgaataaaaacttttcatcaataatgcccattgcaggagtgtttttcgttgccaaagactgtaaagcaccttggtgtcttttgctagaggacctcttacatgtgtggcagcccacctacccagtggaataccctgcagctgccacagaacgtatggagttgccaggagctgaggggctctctccagggagc

SEQ ID NO: 7505 - DNA, 1073 bp, Homo sapiens
ccctgaccagcctactgtccaagggctctgctgggcgtttcactgacatgtgacttaatgtgcctctttttgatgccagcatcattacactgattttgccagtgagcctctggggtctgcagagaggggcagaggcagaggttgaggccaggtcgctcccgtgctctagggagcatgttagcaggtggtgtggttctctggtgcctcccttcatctctccgagccttcctgccgtccccgccctgcccctccgtccagctcctgagctggccatcccccttcctgcctttgtgagtggtttcccctgcctgtgtgcctcctgaatgcacactcccaccttggggctcagctggatggccccagtggggagcacctccacctcctggaggtgaggacgcccccctcctctggcctattgagcccctgaacgtgcagcggtggcacctggcttctgagtgcttgttctgtgccctctcatctcgttcctgcctgtgagggctatgactcagtgcatgggctggggattctgatagaaggggtttagagagggtatgctctcaggagacatctgtgtgggaaggacaagcaccatgcagggagaggaggaggctggacagaagtgcagttgtagcggaagtctagcctgattccatggggactccggagtgtcaactgaccccacagctagcctccctctgaggcaggggagttggagtcaggcccctgcactgctcggcccttggatgctggcactccagtcttctgcagaaggctgcaagtgtggatgactgctgcacagccctgggggagtctgggtagggcccagctgcaagtcccaggggccactgctactacccccagaaaagaggctacccgctgtgcttgcaggccctcagctggtccctggggtgctcagaatgcaacctcaggtccagcctgctcctgcatcccacagcactgccacactgcatggatatctgtcttcctggggtcactgtgagtgtctgtgggttcttctctgtgctcctggctgccagccctgggaccaagtgttgtgctggcatgaggagctt

SEQ ID NO: 7506 - DNA, 1033 bp, Homo sapiens
agtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttata

SEQ ID NO: 7507 - DNA, 1070 bp, Homo sapiens
gccacacccaagatcacctgacacccaccctgacaagtgtccatgatgctgggccctgagggaggtgaaggctttgtggtcaagctccgtggcctgccctggtcctgctctgttgaggacgtgcagaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggc

SEQ ID NO: 7508 - DNA, 1024 bp, Homo sapiens
atgatctgcctgccttggccacccaaagtgctgggattacaggcgtgagccactgcgctcaacctaggtgtccaccactatgctcggctaatttttgtatttttggtagaggcgggatttcaccatgttggtcaggctggtcttgaactcctggctccggttatccaccctccttgacctcctaaagtgctgggattacaggcggtgagccaccacacgtggccttgatcatgcagttttaatggaggggagtggaagtgacagtagaggccttttgacaagattttgctgaacaaatcaacaagtagctagaggcaaagttggcacaggggaggtatgacatgattgggtagaactgagcatgtttaattaccaagtagacagggctcagtggagaaaggggaaaaggaaaaaaagaagaaagcatggctccggggtatgtgaggttggacccagagcagagctgttgttcacgatgtccgctgtaaggggcccactacgtgcttacaaactcctggactctgacttgacttcacaaagtccacttccaagagtaatgtcaaccagctggagaggaggtgagagtctgtaaggctgccccagacatctgaagggctttggacaagcagggtgctggggtaggacagtgggcgatattgagggcccgcttactctatggctgttcactctgattttcttttttttttcttgtgtggtgggtttttttttggagttagtctcgctccgtcacccgggctggagtacaatggtgcgatctccactcactgaaaactccgcttcctgggttcaggtgattctcttgcctcagcctccgtagtggctgggactacaggcgcccaccaccacgtccaggtaattttttttttttttttgagacagagtcttgcactgtcgcccaggctggagtgcagtggtgcgatcttggcttactgcaacctctgcctcccaggttcaagcgatgctcctgcctcagcctcccaagtagctgggactacaggtgccc

SEQ ID NO: 7509 - DNA, 1050 bp, Homo sapiens
gcagcgtttttactgggatgttggtgatctagtgattatgatgtatgttctagtgaagcatatttcaaagaagttacccaataaaactgaaagtgtcttttggatgtgtctccacactgcttacagaggggttcctataaatcagactgaacaatttctagcaagcacccttgctccttgcccatgctatcccagtgaaagaggggtcttaaggtcaagtcccctgtggttgtcacttctcccccacccatctccctcccaagtgccctgcccccgatatttaaatttcctcccagcacttagggtcctcagtgtacaaacttagaattgggcagaggcgggcggatcacctgaggtcaggagtttgggaccagcctggccaacatattgaaatcccatttctactaaaaatacaaaaattcgctgggtggggtggtgcacgcctgtaataccaggtactgaggcaggagaatctcatcaagagtaaatctcatcaagatcaataaggcgtttcccttttgttgtgctctgtattgccctgtgaaaagataatacttccaaaatgctgttaggtggatggggtgtgagatttaatttaaacccacgggctatataaagggcttcccagctgtttctgtccttacctggagttctgatcccagagccagtgcctaggatctgagaccacacagccaatatcgctctgttttttttttaggacatttcattaccatccagaagtgtctcccactgaaggcatccgtggttgtttttaaggtaagctattttaagaagagccccttttcagctgcagtatttatatttgttatactcaaatttgtttagcagcctggagtgaaaaaagttttgtccctaacattaaccttgagcaggacaccacagggctcttttcagcttgagttttagttaatgaaaagccttaggacttctgagaaatggaacagaaaaccaattctggagtaaaaataagcagtaagtgttttaagtgtacacatgtgttttggaaaggaatggtctcttcgccttgcc

SEQ ID NO: 7510 - DNA, 1010 bp, Homo sapiens
ccaagaccgccctggcttattttacagcaaatcccagaccaataaggtctttattaataaataaatccgcagtatttctaagaacttttaaaacctaaccatgatactgctgtcatgcctaaaaatacattccaaaatatcaagtatccagggtttaagtgtttctgtattaaatttttttttttttccgagacggaatcttgctcttgtcacccaggctggagtgcagtggcacaatctcagctcactgcaaactccatctcccgggttaatgccattctcctgcctcagcctcccgagttgctgggactacaggcggccgccaccatgcccggctaattttttgtatttttagtagaggcggggtttcatcatgttagcagggatggtctcgatctcctgacctcgtgatccgccggcctcggcctcccaaagtgctgggattacaggcgtgagccaccgcgcccggcatgtattaaatattttaaacagctggttggtttgagtcaggatccaaagtcacaccttatattttgtagataactttttaaattcagagcagcactgtccaatagaaatataatgtatgctataaatgtaatcttatattctttagtggtaaaaggaaacatgattcattgtattaataatttaacctaatatatatccactactattttgcatgtaattttaaaacactttttcatttctccatgatcttgactaaaataattaaaaacaaaatcctgtgaacttgtcaaaatccagtgtgagttttacacttacacatttcaagcgtggtgaatggatgctgtgtaagtgatcatctagaggttcccctttcttaaaaggctccatcccccgttatatttgtcgggctgtcttgcagcattccttccccacacttcgcatttttctgattgtttttccgtggtggtctttgagtgtctgttctttatatttcctgtaaagtgatagttacctctagaggtagtttttggttttggttt

SEQ ID NO: 7511 - DNA, 1031 bp, Homo sapiens
aatcatgaggaatggagagggcagctagtgcagaagctacaatgagtttgatgcagttcaagggcctgctgggtcactggtgctgaatatgatcataagagaggcctaggttggggaggtgacaggagagcctcatgggccaggatgaagagtctggattttactggatggccactgaaaagcctttggagggtttcatgcttggccttgtttttgttttaaaagatcaccttggctgtcatgtggaaaactcatgtttgggggagcaggagtagagtcagaccaaccaggaggttgatgtgggtgagagcaagtgctgcctaggcctagagaggtgacagtgcagggcaggggagctgggtggatgccgatatgctttagcggtaaaggaggtgggtgataggtgagatgtgaggatgagaatgaaatgacatcggggattttggtttgagcaattgagtggttcgtgtggctgtttactaaaatggggatgactggggaagagcagatgctgatggatattgctggagcaggagttctgttggggcctgttaagtgttttgttttgttttttgtttgtttgttcaactcactgcaacctccgcctcccgggttcaagagatccttccacctcagcctcctgagtagctgggactacaggcacacatcaccacgcctggctaatttttgtattttcagtagagacgaggtttcaccatgttggccaggctggtctcgaactcctgacctcaagtgatccgcccacctcggcctccccaaatgctgggattacagccgtgagccatcgtgcccagctagggcctgttaagttttaagcactttagacgtcccagtgtagatgttaaaaggtagaaaggtggagtctggaggtgaggtaagaggttagggctggaaataaatatttggcagtgaatggtattttaagtcaagggatccctcaggagagtgttttatggctgtgtgtatatgtgctattttattttcccagtaatgttcaactacttagttta

SEQ ID NO: 7512 - DNA, 1069 bp, Homo sapiens
actgaagaagcgtcagaggcaggagcggagtaactttttccccgcagtcttgctggacttgattttcatggctttttctctttccctaactctgcctttccaggaatccatcccctctgggagtaagaaatgaccagggtccgggtgagttggcgttccatttctcctaaaatgccatctccctgaaatgtccctgtgccatgtgttgttttctttattgtcaggcccccagtacggtattttatagctatggatgtagggacattaagatactaaggacatgtagctagcagatgatgtcaccagggtctgcacagagagttttcactggcccatcctgcctccaagaatttattccactcctcagagcagtgggctgtgccctcctggggagcctctcaaagcctgccttttcctgccagacatttcactcacattgaaagtcattccaagctattccatactcatcccagtgctaagtggtctcagcaaaacagatagaatgataaaccacggtgcttttcttcaaggagcttaccatcttgatgaacatattatattacctgtacacaaaaaaatgcatattaatagtgataatttattaactatgagtcaaaaacgaggaaattcgttaaatggcagcacagtggttacaaaatcactctagaaatgcttttcaactaggctatgcatcagaactctctgtggtgttttttaagaactaagcttccttctctcttccagacctagtgaaaggagagtttcactccttttttattctgttgatctttgtacatccaaaggtttattgtgaaatatctctctatacactataagtgtctctagggtaggtaaaatgagttattcatcctttatactcaggttgatttgttctctttcactagcatgtctacatatttaactgttccagtaaattttaaattaccaagtcgtacttttttaaagagagttttcagttgtccccataaaaccatctgtaggaggttacctcaaaattaacccttagactcccagggtatttgagatggtcagcccccacttagaatcc

SEQ ID NO: 7513 - DNA, 1058 bp, Homo sapiens
tgtttcaggtgaagaccaggatagattttctaagtgtgaatccccacttcacatatggaaccccttatgctgaacttgaaaagcaccaagacttcctgtagacaagaaagtgcttaggtagggacagcccctgggcatcccacccaatgtagctggcaccccactatggcaaaggtgccttgataactgagccctgtatccctcccatgcccagccagattctcatgggaagccctctcccttcttttctgcctaacaccatctcatcgtttctggcctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatc

SEQ ID NO: 7514 - DNA, 1029 bp, Homo sapiens
ggtattgaaacagacccccaaacacagactcctgcctgccctctgccgatgctgcctcctccatgctcttgagcaggtggagccatggtgctctgtggtggcgcatgattcactgagcaaacagcactttacagaagaaaatctttattttgtaatatgtgtgtccagcgggattgacactcaaaaaaagtctcacttagaaatcttcccttccttacctttgtatctcctttacatcatgagagatcaaaaatccattttgccttacatatgctaagaagcgtggcattctttctgttcataaaacagactcatgacttttaagacaggacaagcaggccagaggctttttttttaatcacagatctcatgggaattagtggatgctaaatggcaattaaagcatgattcctatgcttttgagcctgttttatgacaaggtgttactttgtagacctggcccatacatttcttttttgtcaacactgaaaaagaacagtttctgagatcgaaatggaaggaaaggaagtgagtaatgacaacaaaactgaatatttaaaaaatattcctttatagttaaatctctccagttggtgttggcttcacattgaaagagcagccatgtgccaccctggccggggtgtgtgcactgcatgcaggttctcccttgcatgcaagatgggtgctggcccactgtgaggcttctgctcggggaagttctgtggagtcactaccagggccaagaggcaggtgggctggctctgggacgagggccaggtgtgagcaaactgccagggtccgctgtgccactgctccccggccacatgcccgcccagctgtcgccttaaccagactgaacagacaggatccttcagggcccttggccccactctcagtgcattctgtcatcagggattaccacctgtaccattttcataaaacaaaaccaaaatcactaccatcaaatggccttgtccctctaaaaagtctgcttaaaattctgtttttaaaacccagtttcctagtttt

SEQ ID NO: 7515 - DNA, 1030 bp, Homo sapiens
tttcatgtaatgaatttttcagttccagaatttctgtttgtttttttttttataatgtatttttggaaaatgtttcattcatatcctgaattgcatttctcatttctttgtattgtttgtctgtattcctgtgtatctcactgagcttccggatcttggtctgttgcccaggcaggagtacagtggtgcgatcatagctaactgcagcttccaactcctgtgctcaagcaattctcccacctcagcctcctgagtagctgggcctacaggcacacatcaccatgcccagctaatttttatttgtattttttatagagacgaggtctcactatgttgctcagactggtctcgaactcctagcctcaagcaatcctcatgcctggggctcccaaagtactgggattacaggtgagagtcaccatgcccagtgttcactgagttttaatatcattattttgaattctttttttgggatttcataaatttctttttgattggaatttattgctggagaattattgggttcctttgtgggtgtcatatttccttgatttttcatttcttgtgtccttatgttaatctctgcacgtctggtgtaacagtctcttctagttttcttaatttgctgttgtaggagaggagtttttcctgagggtgtgtctatggtgttggttgtgcagggcactttagctttgattctcattgtgtgcagtagtatagtctctgtatgatttctttggctataagtcatgtttgtggtgtctgtgatttcctcagtatcttagggtatggtggaggctgtagtgaggttttgctggggacagggataccaggttggcctgtccttggtcccagtggtggcagtagtggggtgagtatgcctgcccttgggcctcagtgcagtatatgctggcaccagtgttagcaggtcaggtgggttatttttgggggacctccttgtagcttgctcaaacgctggtagtggcagtggcgaactgggtgggtgggtgaattcttgggctcctgggca

SEQ ID NO: 7516 - DNA, 1165 bp, Homo sapiens
gcctctcccaatcttaccccttttttgcatgaatggctaaaattcctaactcatttctctttcagttcttagcttctttagaggcacttacccttgacaccctccccttagtctaaattttatcacccatttgggttttgttactctttcttcatagcacctatcacagtttgtaatgatagcagtgtgtagaaaatcttatatttttagaagcagcagaatgtccccccttggaaaaaaatctgtttaattgactgggtgcttggagaagtttgaggcagtttgagtcccacaggtgacatgctttatacaaagacgggcactggaatgcagcccccatgaaatcgccatgcatcttgcccagaccttcacctcaccgcagggtccttgaccatgtgggcccacgagccatcctggaggatgttccccagatgccccatccacactcagtcctcaccctatgtacttcccttgctgctgtttgcttaatcattttctaaagaacaaactcaaagttttatatcattgtgtagtatctgaaatcacatttgattggttttctttttttagtttatttgtacatatttatggggtacctctgatattttgttacatgcatagactatgtaatgatcaagtcagggtatttggggtgtccctcactgtgaatatttatcatgtctatgtgtcagaaacaatttaaacctctcttctagttattttgaagtatataatatattgttaactgtagtcaccctactctgttgttattgaacattagaacttattgtgactatctaactgtatttttgtacccattaaccaatctctctttatcccccactcctgcctccatgcacacccttcccagcctctagtacctataattctactttctacctccatgagatcaaatttttatagctcccacatgtgagtgagaacatgtaatatttgtctttctgtgtctggctaatgacctccatccatgttgctgcagatgacatgatttcattctttttgtatggctgaatagtatttcattgtgtatatgtgtcacgaattctttacctgtttgtccattgatgtggacacttaggctgattccatatcttttgcgaacagtgctacaataaacatgggagtacagatatctctttgataa

SEQ ID NO: 7517 - DNA, 1927 bp, Homo sapiens
ttctcatagtctggaggctggaagtccaagatgaaggtggcagcagggctggtttctccttggcttgtagatggccatcttctccctctgtgttcacattgtcttttatctgtgtgtgtctgtgtcacaaactcctcttattacaaggacaccaatcctattggattagagtccactaggattagagtcacctcctgagtagccgggactactattgacctcatgtaaacttaattacatctttaaagtccctattccaaatagttatattctgaggaagaaggagtttaggacatcaacatctaaattttcacagaagggaggggaatacacagtttagcccatgatagttgtgtatcagggaggtcaacctaaaggcaaaaaggccaggtgggatgttattcttcaagaattctagctgagaaatgaagagaatctaaactaaagcattgtcaataaaaatgaaaatgagttgtgattgagaggaggaagaatttgatacaagactatgtgactgaatgtggaggggcatgagaggaaggaggctggcatggctcccagatttccctgctccaggaggagaaactgagttgaaggagatgtgagctgtgtgatatcccgattgagtattcagcactttgttagccagacaccccaggactggtcagctgtcctactttcttcactctttcgccgtgactcctcataatgtggactgtgtcacatacaactgagcatgcagcctctccacttgaaatgtgtcttaagacacttatcaccatctgaactttcacgtgaaatgtgacttaagacacttattaccatcttattttgacagtgaattctaaactcttattttttcctgataataaaaaattaaatctcttaaataaaatgttaaatcctttaggacagggactattgtgtattcattttgcccaaatgtgcaatatttactgcctggctacatacatctagtatatagtaggttgtgctttgcaaattctagttcagggaatgatttgtcagtagggttgttgtgatcaattacttgttctttgcatattttaatcaaagattgataattaaaacctgtttgattttcttgcagaatgagaagactttgggacatttcatgagtcattcaagcaacatttctaaggtagagtgccactgaaaaatgttatttattaccttgagtcttttctgttcttatgccttacatgtgtttatactcttttttttttttttgaaaagacgttagagttcttgatacatttctgtaatctgttctgggaccataagaggtatgtggcagttacatttttctggtaaggcaattttgagtgtgtgttgggggaagtgacttctgggagaaaattccattttttccagaaaaccatatactttaaggcagaagaaatctcaggcacaggagagtctgttgccacaattaggaatatatttgactgaaagtaacagaaagctaactatgatgacttacataattatggatttatatggttcatttgacaaggtgtctggaagcaggtgatccagggcagagttgatcacagattgtagtgcacccgattctgtggctgttcggggtgccactgtgtaacccgcatggacctaggggaactgaacaaggggtgaaggcgggaataaaagacaagagacaaaagagtatatttggaagaaggaggcatcttggctctagtggacaagggccctgagctttacacagccctccatatttattaggcaaaagagatagtgagaaggcgggtggaagaaggggtcagctgctcagtctagagtaggcttgcaagactgcattccttgaacaaaaggttctagatgttgcagtagagaaccttggcgccagggagtgattgcctccagcaaaccttctgttggcagg

SEQ ID NO: 7518 - DNA, 1026 bp, Homo sapiens
tgcttggcaaactttacttctcattcagaaccaagatgccattctgactacagggcagagtggtgtcacacttccaccttgatatactttatgtatgtgcttcttttatgtcattcttaagctcttccctagtttggacatttctcaccaaaacactttttcagaggagttcagtggtaatacacgttgagcgtccctaatccacaaactcgaaatccagcatgcttcaaaatctgaaactttggaatgtcagcatgacactcaaagtaagtgctcattgtcacctttcagattttgaattctcagatttgggatgctccacctgtaagtataatgcaaatattccaaagtccaaaaaactcagaaatatgaaacagttctggtcccaagcatttcaaataagggattctcaatattatcattggcatatggttaggagtgagattttggtccatattctatgcctgacacagttgttcacacatagtagttgcatagtaaataagtgtggaaagaatgactgatttgaatgagttttgggacttgctttctggaaaatatctctgatgttgtcctgcactatatattttaagtccaaataaatggacatctaaagagcagtgtttaggctgggcgcagtggctcacgcctgtaatcccagcactttgggaggccgaggcgggcagatcacgaggtcaggagatcgagaccatcctggctaacacagtgaaaccccgtctctactaaaaatacaaaaactgagccggacatggtggtgggcgcctgtagtcccagctacttgggaggctgaggcaggagagtggcatgaacctgggaggcggagcgtgcagtgagccgagattgcaccagtgcactccagcctgggcgacagagcgagactacgtatcaaaaaagaaaaaaaaaaagaagaagaagaagaagaagaaaaagagcagtgtttattgggggaaaataaaagatgatctggtctgctggaactgaactgttaagatcctaccaagtagt

SEQ ID NO: 7519 - DNA, 1031 bp, Homo sapiens
aaatatccaaactattttgagcccttcttaagaggttctctttttacattatattcatattactattcttgggatggggaatggaaggaggccctaaaacatcggtagaattgttcacgtgtatagtccataagaaaagtttttaataacttggttaagtgctagtggattcacaactctactgtcaactagctgatactccagggaaatttggtgtccatgttttgacttcttgttgtgctactcaccactgttgccaccattgtgccaaactgtctgtccttttaatttgcttttacaatccagtgttcccatacatactgcaggccaaagggtgagcctggctgttaataaggaggtacatacatatattttagcagagtgaatagatttagctgccttggcaggtgactggagagctgtctgggagtgttgagagaaacagctggggttgccattttataggattgaggctctggattgggttggactaaatgatctttatgtcgctgttaattctgaggatttttttgagcactcttagccacacttgattcttttttttttgagacaaagtcttgttctgttacccaggctggagcacagtggcgcagtctcagctcactgcaacctccgcctcccaggttcaagcgattctcctgcatcaacttcctaagtagctgggattacaggcacgtgccaccacgcccagcttatttttgtatttttagtagaaatagggtttcgctgtattgtccaggctggtctcgaactcctgacctcaggtgatccacccaccttggcctcccaaagtgccgggattaacaggcgtgagccaccgtgcctggcccacacttgattcttaataatcaatcagtttgagccaggcacagtggctcacacctataatcctaccattttgggagccgaggcaggaagatctcttgaggccaggagtttgagaccagcctgggcaatatagtaagaccctgtctctacaaaaaataattagcaaaatgaaacatactgga

SEQ ID NO: 7520 - DNA, 1081 bp, Homo sapiens
ctcactgcaacctccgcctcctgggttcaagtgattctcttgcctcagtctcccgagtagctgggattacaggcacgtgccaccacacccagctaatttttgtatttttagtaggcatggggtttcaccacgttggccaggatggtcatgatctcttgacctcgtgatctgcccgtctcggcctcccaaagtgctgagattacgggtgtgagccactgcacctggcttagtgttagtgtattttatgtgtggttcaagacagttcttccagtgtggtccagggaaaccgaaaattggacacccttgctccaagatctggaatatgacaaggatgcccactgtcaccactgttattcaatgcagtactagaagtcctagctagagcagtcagacaagacaaggatataaagggtatccagattggaaaggaagaagtcaaattatcgttgtttacagatggtgtaattttatatttggaaaaacctaaagactccacaagaaaattattagaactggtaaattcagtgaagctgcaggatacaaaattaacgtaccaaaatcagtagcatttctatttgtcaacagtgaacaatgtgaaaaagaaataaaaaagtatcccatttggaagccacacataaaataaagcacctaggaattacccaaataaatgaaaggtctctataatgaaaactataaaacactgatgcaagaaattgaagaggacaccaaaaaatggaaaaatattacatgttcatggattggaagaatcagtattgttaaaatgtccatactacccaaagcagtctacagattaaatgcaaaccctaccaaaatatcaatgacattcttcacagaaacagaaaaaacaatcccaaaatttttatggaacaacagaagacccagaatagccaaagccgttctaagcaaaagaacaagactggaggaattacattacctgacttcaaattatactatggagatacagtaaccaaaacagcatggtactggcatgaaaacagatccatagaccaatggaacagaatagagaaccgagaacccagaaataaatccacacacgtac

SEQ ID NO: 7521 - DNA, 1034 bp, Homo sapiens
aagcgccgccagagtgggcgccaaggtcgaggaggcgccgagagcgagcgagggcgcacgctgtcacctctcagaaatggaaggaaatgttctactcttgaggagactaaggaacagcaaggaagtcaggtggctagagcaaagcaagtgagaggacgatgggaaataggggctagatcatgcaggacttagagccaaacacttctggattttattctgaattgggaaaatactggggttgacatggttttgaaaagtcactttggcgattgtgtaggaaaaaaaagactgtaaggaggcaaggatggaagttgagagaaatatacagcagtcatccacgtgggagatcctagggctgggctgggctgtagcagctcctggatgatagtcacatgctctcctttctcaaaccaccagcacctctctccctcttgtcatgctcagcttttattttattaaactatcaacaatcgaagagaaattccacatgatacagaaacatcggggattctgtctaagtcttggtgctcactgctgaggaagaagactttaatcaggtgttgcagccaaggagatgggaggtcagtctcaaatccatctccctgactaaaatttggggtttatatagcggggaagaagtgtaacagtgtgttagaaaacacgaactagggagcggtaaggaaacaaaaggaagggtctggcatctcattgtctgaatgtggtaatctggtaagtttcaattatttgatactttttcagaggccaggggtccttcccgagaaaggaactcagataaaacaaatgtaagtttcgagctttaagaaaagaagggtcactttctatgtttggccaaaagaactgtctatgggactattgggtcagtttcatgttcaacaacgaatctaccaagctatctgtatctgtggcctgctattccccttctcttgttttttccttatctaaggatgactcctccaatctactcaagattttccttcttacagttgtcactttcttgtacatccagttattac

SEQ ID NO: 7522 - DNA, 1047 bp, Homo sapiens
tgtattgtgcgtgtgtgtgtacacacacacacaatatacacatacacacacaccatattttgcttatccattcatctgttaatagacagttgtattgtttccatgttttagctattgtgaataatggtgctgtgaacatgggtgcacatatatgtctttgagacactactttcaattctttagaatatatacccagaaatgaaattgcgggatcagaaggtatttctatttttaattttttgaggaaccgtcatattgttttccacagttgctgtaccatgtttcattccatcgacagtgcaaaaggattccaatttctccacatccttggcaacacttgttattttcctatgtttttgctagtagccatcctaatgggtgtgaggtgatgtcactgtggttttgatttgcgtatctgtgacgattagtgttactgattattgattccctaattagtgaagttgatttcctaatgagtagtttcatgtgcttattggccatttgtagatcttctttggagaaatgtcttttcatgttttttttttccccgaaaccaaactgtatccagctttattaaagatactttccataaacaatcatggtatttcaggcagtacatggacagacagtcgttaacagtatacaacaactttcaaactcccgtcttcaacggactaccaaaaatcagaaagccactataaaacccaatgaagtatctgatgttctgaacggggaaagtttagagtgagggttgacatttcacatttagcatgttgtttaacaacttttcacaagccaaccctgactttcaggaagtgaaatgaaaatggcagaatttatctgaagatccacaatctagaaatggaaccactgctcttttgacaggtgctatctcagtggcatcactggaaagtccagaatgcctgacacattaggaaatccgatgcctgacacattaggaaatccagtttgtctattttctccttttgttacctgtgcctttggtgtcatatccaagaaatcaccaccaaatccaataccatgaag

SEQ ID NO: 7523 - DNA, 1002 bp, Homo sapiens
gtttctttttcgtttttttttttaaagaaaatttgcaattttagttggtatttcctcattagtccaagagtattttaatatattttgaaaatgttctggtggcagaggctttttggtttttctttttcttttcttttcttgtttttagaggtgggagtctcactatgttactgaactcctgggaccaagggatcttctcatttcagcctcccacgtagctgggactatgtgtgcagcaccatgccgggcttgatttttcattgtttttaatttctagttttattgcatggaactcagagaatattgtttgtatttctactttatagcattttattctttgggatctaatagcacttttcatgaatatatacctcagaagacagtttattctctatcaaaaaggtaaaagtttgctagatatttataagatagaccttattaaagtttttttttttttttgtcaacttgatctgtcttagaatgagaatggtaatagatgaaggtctattattcataggtttctgtgtatttctcttttcatttctcatactttttgctgtaagaaagtggtagttgtgtaatttggtacataaatattaataacatattttcactgtgttgctagttacaaaagtagtgaaatgtttcatctctatcacattcactgactttccccttgaattttccttgcctgatatcaggcccatacctactggtatcttcttggtttcatttgcttggtataccttttcccatgtctctatttattaacttttaagttactttgttttacatatttcctttatatacactatagagttggtttttgctttgtgagccagcttgaaattttaaaacaggtaacttaatcacgtttatatttattgatatgacttcatatttggtcttaaatgtcttattttgttatacttacagtttccttctctatgctttcttttgtgtgtatctgtatatatgaatgtgtaagggtgtattttttgg

SEQ ID NO: 7524 - DNA, 1096 bp, Homo sapiens
gattctaccattaaaattttttaaattttatttttgtggtaaaatacatatgtcataaaattatcttaaccatcttaagtgtacaaacagttcagtaatgttaagtgtataacacagtgttgtgcaaccaatctccagaagttttttgtcttgtaaaattgtcataacgtgtcagaatttccttcctttttaaggctggataatatttcattgtatggctatataccacacttttttaatccattcattcctcaatgtatacttggattgcccccatcttttggctattgtgaataatggtgctatgaacataagtatacaaatatgtctttgagaccctactttcaatgttttcttttagtagtttcatagtttcagatcttagagttaagtctttagttcatttagatttgatttttgtatatggtaaaagataaggggtctaatttcattcttctgcatgtggatccagttttcccaacattatttattgaagagactatcctttccccagtgtatgttcttggcatctttatcaaaaataagttcactgtgggtctgtggacttgtttctgggttctctgttcttttccattggttgtgcatctatgttcatgtcagtactgtgctgttttggttactgtagctctgtagtataatttaaagtcacataattgtgattcttccagtttttttttgtttgttttttttttgttttttttttttttttttgcttagatggctttgactattctgtgtcttttgtggttccatgtaaattttaggattattttttctgtttctgtgaaaaatgtcattggtattttgatagagattatgttgaatttgtagattgcgttgggcagtatggacattttaacaatattaattcttccaactcatgaacatggaatattttttcatatttttgtgtcgtccaatgttttatagctttcattatagagatctttcacttttttagataagtttattcctaggtattttattttactttatttgtagctattgtaaatgagattactttcttgatttttttagattattgttggtatatagaaatgctactgggttttgt

SEQ ID NO: 7525 - DNA, 1048 bp, Homo sapiens
gttgttcaaattcagtatattatatcctgtcactgtaccaagatgcataaaacttgatccaaattgaagacttatttcaattttccatttgtagttcctacagacgatccacttaggaagatggcagagtacttggattccagtcgagttgaggtctgggagaagacctcctgcagcaaacaagttacatttttggtataccaagaaggagatcaattgaatttctttcctgcagtagataggggagatggcactttaacaccgttatctgactcttcaaagaaaatagattttcatttgcatgtcctacggagaaaaggagaacatcgtatgaggtactccataaacttttgtttaccttgtgttgtcaaaataatctatatatattaacaaatgtcatgcatctcattcctgccccagcccccaatatataagtctgaaattgtccttcgtataattgatatgataaaactgaggtttttttagagtgggatgttttcataaaaagatttgtttctgttagtctgtgaaactctaagatgcctaatagattatagaatcctgtcataatagtgtgttattatacaaccttagcataatagaaagggttaaacctaaagttgatacctttttttctaaatttaactctgctccttaaaggcagataaatctctttacttctctggtcttgttttcctactctataaaagggagataaattgtaatattctaaaatcaggaggaaaaaccctacatatatttagctaagcaatagaagaattagagaattggacaaggcaacctctcagttagttgctgtgcattctgagttactatgatttttttatctcctttcacttcaagttattaagcattcactcactgaacttttatggccattcactgagcaaggcactgatgttgtaaagatgattattcctaccttcatggagcatgcagtctgctatgaagagtatcagtgatataatgttggtgatgttataaaaagatatcaagatctctgggagaatagatgacagggccttta

SEQ ID NO: 7526 - DNA, 1050 bp, Homo sapiens
gaagaataatagtatttatctcaaagggttgttctcaggattaaatgagttaaaggtgaagtgcttagcagagtgatcctcctgcctcagccttccaaagagctgggattacagacctgagccaccaggcccagccctcttcctttgtttatgtagatctgagtttctgacctacatcctgttttttgtgaagaatgtcttttaacatttcttgcaatatgggtccactggcaacaaattccacctcttgctttctttatgtagatcttagtttctgacctacatcattttttctgtgaataatgtcttttaacgtttcttgcaaaaaagccatcttttaacgtttcttgtttgtctgaaaaagtatttctccttcatttctgaaggataatatttcagggtatagaattctaagttggtattttttttctttcaacactaaatatttcactctagtcttttcttatttgcatgatttctgatgaaaactcccctgtagtaattatctttgcttctctttaggtaaggtgtttttttccctttcctggctgatttaagaattttgtctttgtctttgcttttctacagtttgatataatatgttgaaggtgtagattctttggtagttatcgtgtttggtattctctgagcttcttggatctgtggtttggtatgtttcattaattttggaaaatctgggccattatttaagtatttcttctgtctcattttttcttctgatattctagtggcaccttttgaaattgccacaacttttgaaattgtcccacagttaatagatgttgtttttgtgcattcttttttctcttaacagtccgttttgccaagtttattttcttttctttgtttcttttatttatttatttattttgagatgggatttcactatgttggccaggctggactcgacctcctggactcaaataatccttgtgcctcagcctttcaagtagctgggactacaagtgcataccactgtgccttgcctaggaagtttctgttgccatttttcttttttttttttttttt

SEQ ID NO: 7527 - DNA, 1071 bp, Homo sapiens
cagggcaaaaagcatacgcatgcttcccatggaccagagaaacctggcctgggttgtctcaaatcctgtccacaaggcaactccagaagaaagaagccctttacatttccataaaacactttagaatcagctagtcaatttccacaaaataaagtgctagaatttgattggatttaattgattatgtagaacaatttgggggccatttgacatcattaaaatattcaatcttcctattcattaacatggtatatctcttcactttaagtcttttgtatgtttctcagaactatttttgtggttttcagtaaagtgttcttgcacatccttcaatagatttattcttagacgttttatatttgtttatggctagtatatacagattctgttgctacaaaactatgttgaccttgttatccagtgagaggctttgtgacattcatttaaattgtaataatttgcagattatttttgtataatcatgtcctctgtgaatgacagttttatttcttcctttcttaatctttatgccttatttagctcttgccaaactgcagtggctgagcaattggacaagataaagaaataaaagtgatccagatcataaagaaagaagtaaaactatatctgcacatgacataatcttgtctatggaaaatcctaaggaatccacacacaaaaaaactactagagctaataagtttggcaaggttgcaagatataaaattggtatacaaattgcagtggctaggacctccagcagaatgctgactataagtagtgatagtgggtattcttgtctcatcctcaatctcaggggtggtgggtgtggcatgtggagagttgtcaatattcaccatgaagtttgatggttgttataggatttttaatgtactcattaacatatattctcaagctgttaaaaagatttttttaattacaaataaggttaaatttctctcaaatacttactctgcaccttttgaaataattttatttttctcctttattctttggatgtgatgacttatactaattgactgttgaatgtcaaaccaaacttaacattct

SEQ ID NO: 7528 - DNA, 1080 bp, Homo sapiens
atcaaggaggctccagcattttgtccagaccacaaataagtgggaagctggcatttcaacctagtcggctggagtgcagagcctgggtgctggctgcctgctgtagagagcaggatgccagaaagcctcagggtgtcctagggttgggatctttgtctctcagcttgttccaagtggccctggaggacttcagcccacacaccctgagagaagaggaagggagctcacactggctatgggctgcccttgccaggagtttggtacaatctggaggcagcagagactcagaggttcagcaacttacctaacaacacacagtggggctgggggcagcgcagcccacctccagggtaagctcatcgctggatgctgttgccaggtaggcctcagcgcattctacccactagatctgagttgtcttggttggggaggggggcataattaagactgaaggaagaggcagtccctaaggtcctggatcccagccctagccagggagctgttgtacacacagctcagagacaaagaccatccagagtgaagaggccaactgttaactgggttgcttgtgtgattggacagactcaggttgtcagctccccagccctgccctgagaaggcagtctcatgactgtctctgcactcccatccccaacaggccccacagctaaaaaccacccctgaggtggggtgggcattggcagggccagggcttcacctggagctcaatgtggcagtgcctgccggagccttctaatgggtggtgcctgcaggcctctagccatgtggggctcctgggtaggggtggagggcactctgcagagactggccagtctgactctgaagacacaggcagggaaaccatggctcagagcagagaaaacatgtgggcagcagaccctgcctgcccacctgagagaagcctgccggcccctggttggtgagagcttctgctgagcccttggcccctgctctttaacatggacagggctgctcagagctggcaggtccctgggccgtgggaatgccaggctctgttggtaggtggagggcagacattccttggcttgtgacaccctg

SEQ ID NO: 7529 - DNA, 1049 bp, Homo sapiens
gcagaagactgagactagaccccatctctcacatttctctgtacagaaatcaactacaaatgtattaaagacttacacataaaacatgaaagtatgaaactactggaagaaaacatagagggaaagactccaggatgttggtctagtcaaagactttatggctaaggcttctaaagcacaggcaacaaaaacaaaaatagctaagtgggactatattaaactaaaaaatcttctgcacagcaaaggaaacaatcggcagagtgaagagacaacccgttgaataggagaaaaatatttgcaaactgttcatctgacaagaaacgaatatccagaatatacaaggaactcagctggcaaaacaacccattaaaaagtgggcaaaggatcctatagacattccacaaaagaagacatacaaatggtgaagaggtatatgaaaaaaatgcagagaaatgcaagtcaaaaccacaatgagatatcatcttaccctagtttgaatgcctattataaaaaacacaaaaaaaatagacactggagaagatactgaaaaaagaaaactcttatacattgttggtgggaatgtaaattaacacagtcattatggaaaacagtatggagatttctcaaaaaacctaaaagtaaaaccaccatgtgatccagcaattccactgctggtatttatccaaaggaaaggaaatcagtatatcaaaggaattaacccatttatgccggaggttgcaaatttttgggggaaaaatcagaccttggcagtgaccttgagcagtaggatatgcataactcccacaagcttagcattccaataatggaacacttggcataaatacgttaatgtaccccaatgtttattgcagcactattcacaatagcaaagatatggaatcaacctacgtgtccatcagtggatgaatggataaagaaactgtggtatatatacaaaatgttatactattcggccatagaaaaggaatgaaatcgtgtcatttgcagcaatgaatggaaccagcatattaagtgaaataagctaggca

SEQ ID NO: 7530 - DNA, 1023 bp, Homo sapiens
ggctcaagcaatcctcccacctcagcctcccaaagtgctgggattacaggcgtgagccactgtgcctggtgcctggcctgtgacatgttaccacaaacttagtggcttaaacaatgcaaatttaccttatggttctgtaggtcagaagcctgacacaggtttcactgggcttaaatcaaggtgtcagtaggcctgaattccgttatggagggtctgagggcgagtccatttttcttgagctttccagtttctagaggttgcctgcattcatcagctcctggctcccttcctccaccttcaagactaaaaatgacagatcaggttcttctcacattttatcccttctgctgtagacacatctctctcttacactcctcttctgtcttcccctccacttttaaatacccttatgattaccttgagcccacttggataatctaggataatcttcctagtttaaagcagccagctgattagcaactttaattccatctgcaaccttaattcttcactgtgtaacctaacctaatcacaggttccagggacaggcatgtggatgtctttggggggctgttattctgctaccacactgtacaaagataaaacacacagagaaaaaaaatttaacaaaaacagagcatcagcgagctgcaggataaccttaagttgtgtaatatacatgtaactggaatctcaagcagggacaggggatggaaacacgtatttgaagtaccaatcgccaaaatattccaaatgttatgaaaactataagctcacaaatctaagaagttcagtgagttccaagtataggaaacctgaataaaattgcactgaggcacgtcataatcaaattacccataactagtgaaacagtaaaaaagacacaaaacatcaaaaaatgaggatgatggcaaaattctcatgagaaacaatgcaagtagagcaacatcttaacagttgtgaaagaaaaacatttccaaccttgaagactttatccagtgagaatatctttcaaaaatgaag

SEQ ID NO: 7531 - DNA, 1044 bp, Homo sapiens
ctagactagtacctggggacaccaggaagaacagtcatacattccttcataagtcgtacattcctttcacagagacaggcagtaaacacgtatgcagacaaacaagctgctttccaatcaggataagttctatagagaaagtcgtgtaagactaattgggtgggagggcgcagctccttgacgaaggctctcacccagggaaggattctgtaatgtacatttgagctgaggctttaaatgagagggagtcagccatgcaaggaggtgggagggcatttggagcacctgagagaatgcaaagtttctggtgggaagagggtgagcttgagggagagagggtgctagagtggctgacagcaggacatgggccgggggaggagaggtggtccgagggacctggaggcccacagtcacatcagagttgggttttattccaagaacagtaggccctctgaagggtttccagcagttgtgctttgcccttaaggggctgcttttctttgctggagaggtggacagatgggtggatggatagatgggtggatggatggacggacagatggatggatagatagatgggtagacaaatgagcagatggatagatgggcagatgaacaagtggacagatggatggagaaatgggggagatgggcagatgaacaggtggcatcggcacaggcgtagccccttgctctgtacttactgagcaaagtttggtgctcattgcctccctctgccctccagggctgcctgaggtgtgagctcctgaaaccacatcctgggaggggcgactgctgctggaggagaggagaccaggctaggtgaaggagctgcttcctgctccctttgtcccagaggcaagggagacaccataaaggcagcagctgactggcgcacagaatccacaacagctgagttcaaatcctggctgtgccatttcccagcgtggtgaccctgggccactgaaagctcacggagcgtcagcttctctgtctgtgacacagaccatgtgtctaccttagaggatacggaggtgcttacca

SEQ ID NO: 7532 - DNA, 1024 bp, Homo sapiens
gaacatctaatgtccttttatttttcctgaaggagtccctttaggatttcttgtaggtctgatcagctaggacgaaggactgaatattcttggtttttagttctctgagaatgtcttctccatttatgaatgatggttttgctggatatagaattcttggttgactgtcatttttttctctttcagtattttgaaaatgttgttctgttgccttctggtttccatggtttctgatgagaagtcaactgttaattttaatgagaatctcttgtattttctcttgtttctttcaagattctttgcctttggacagcttgactatgatgtgtctaggtgtaaatctctttttttcaacaaatttgggaagttctaaccatcattcctttaaatattctttctaccttttttctctcccctctccttctaggactctcattttgtgtattttggtgcactttatggtgtcccatcaatttctgaggttctgttcatttttcttcattattttttagtttctggacctcagactggctattctcaattaacctatcttcaagtttactgattttttttcttctataagctcaaatctgctgttagagcccaaatagtgatttatgtatttcagttattgtacttttaaattccagaatttatatttgtttctttttataatttttatttctttattgacattctgtaattggtgggacatcattgtcacactatgttttattatatagacatagtttcctttagttctttgaacatatttacagtagctgatttgaagactttatctagtaagtataacatctaggtcaaggacagtttatatggactgctattttgtgtgtgtatgggccatacttacctatttttcttgggtatcttacaatcttttgttgaaacctagacattgtaaataatataatgtggcaactctgcaaatcagatttaccttccctcctcaggttgctgttgtagctattttgtttagtgaatttcctgaattaaatctgtg

SEQ ID NO: 7533 - DNA, 1095 bp, Homo sapiens
ccggaggtccggcctcccgggggctggggcccggccgacttaacccttgactgactgaaatgatccctgttgatcgttgggaacatagtggtgcatccctttactgcagcgctccctaaactcacctgaccctaacactcacctgccgcgcttattaagcatgcagattcccaggccccaccctggcctgctggataggctctggggaaggccttgggaaactgtgtgtttaaggagttccccaagtgactcctatggccaggtgagtctgggaagccttgcctgtaaaccatatagggtaaggcaggctctgccagaatgagcactaggtcttccttcctccgaaaagtgtattctgcatccagatacagaaaaggtcaggcagccttcgaccttgtccaggtgagaatggtgccatcaatgtacaggctggtttcacaaagggtttgaagtagcttataacatatataatacttaactatttaaaaacctaaacaggaccccacatttacacaggacgtagagaggtcaagggaaaatggagcccagttaatctggctatgaggtatgatctgtggttgagcctctttgcaaccaaaaccaagtgaaaaatgtgagtgctgtagttgcaaggttctcattgtcccagagcaacagtttcctcagcttctgattgtagaaagaatgaaaaagaattttgcacatgaggcttcattcttggaagcaggggccgagagccctgtgtgtggtgtcttcactatgacaatagctagggctgcagtagggtttagagggcaaggtcttgctgcatgctccccgagggcaggtcagagcccaggatttcacccccgccagggcctggacgagcagctttagtctctcctgacccctcttcagtaaacatggtaaagagtgtcccaaaagcaagggtggatttacaaagtcttggttagagaggacatagactcattaagcagcctcagaagagagccaggggcacctcctcttgcttaggtctgtcctctggggctgtggacccccaaggccagctgctggcttcaccagtccaggtaaggaaaaagcctggtctgggag

SEQ ID NO: 7534 - DNA, 1011 bp, Homo sapiens
gtgccttgcagagaagccagtgtacatggcagggccggctctgctgtcagccagtgttttctttagcttggcctcccctagaagcagagcctgagacaaggatctggcatgaggaagggagtcagagaagggaagaaagccagcccagacatgctagtgagtgggttgctgctgcaggcatcctagctcagttcccacaggggcttctggacacagtgcagaacaggcttcagaggggtctcatccaagaagtgaggctggggctctacccacccactcccaccccccaagtccttgagaactgctttctggggagtaaccgacatttctagcctaccctcacatggacaaaactctgcagacagagacagccttcagggacagttgcagatgcttgaggaaggagaccactggcagcgtgatgggaacagtgagtgctgaggagtctgggaagggtaccaagagtgtcagctgaatttagacatcctgggaagtggtggctgtgaactgagtgtgctagggcctcactgtggcccagtgaaccagtaaatctatgattggtcgcaaagcagtaaagccaccccagccaccctgagaaatgatctattggctgtccactgagggagcaccccaggctcaggccatgagtagaggctctttgggaacaggtatgagaagatcctgcctgggataggggcatgtctacctttgtcctgtccataccagagttcgcaggggcacaggcaaaagttgaagtgcagaaacaccctttccaactatacgcgcctgtgcaaaattcaagtacctatggtttcacttgggtattccttttcatctaatgcaagaatctttgtggtaaaactgcacatcagaaggtggtaacaaagggatcctggggtatggagtagaaaacagaggttgactgtggaaccaggagaaaaggcctcagctattcagatagagaagaaatgcaagtagtgacgtaggcagggccctgccatctaggcgagg

SEQ ID NO: 7535 - DNA, 1031 bp, Homo sapiens
agaaaataccagataaagggcattctaaatatatttcttttctatagatgtggatctcctgttactggaaaacaggaattagcttgtctgcttgaggatgtggttggttctttataaaaaggatacagaagaaatttgcacagactgccagcttcattatgctgccgacagcttccagcaaaaggaggacgtttgcagccagatatttcagtaagaatttttttatgttctatgtgggaaatgattacctttgcatttgacttcttgcttgagggatggggtccccggaggctgtcttggtcttgtggctgagagcaccaggcggcatctgtggtcagggttctgacctccttcagctcctggaaatggctgatggcacaaaccccacccctgaactatggcagctgctctgtgtctgcctgaaaaacagagacttcagggtcctgggctctaatgactcagggctctgattgcattcagagtctgtaaggactcctatgtccaaggaccgctggggcagtaggcaagtccttcacaggggaacgctgtgtgcagctgaaggctactctgcatctctgcttggaaaggatccagccaaggggctagtagagaaatagtgaggacatctcagtaaccctcactaaagtgtctgggaggtaactattagaccaaatgggatggctgtgactgtctgtttgggtccctcagtaaagtgcctgggagataattgttagaccaagtgggatgactgtttgtttgggtcacaggcaggtgctcgctgggtgggctgtgcaggtgaggattgggtggattgtgcaggtgatggttgggtgggctgtgtaagtgatgatttggatgggttgtacaggtgctgattgggtgggttgtgcaggtgctggctgggtagactatgcaggtgatgattgggtggattgtgcaggtgctgactgggtgagctgtgcaggtgaggattcggcttgttgtgcaggtgctgactgggtggattgtgcaggtgctggctgggtggacta

SEQ ID NO: 7536 - DNA, 1048 bp, Homo sapiens
tggagcaaggttgtgagagccacttatgtttgtaagctgcttatagtttgcaaagtgtgttcctggtatattgtatttttcccctgaattcaacacatacatattttaagtactctctccgaggaaggaccaggagttggtctaatttcagcccattctaggacttcctagctatttaacgaaggcaggggcgtctcctgctgcctccttatacccagacaggcttaccccctcatgctcttcatccatatcaagttgcctttcatcctccagtgacaccacatcactgtctgccctgcaatctgtgatgttcagacaggctctgtgttttcttctgagtaactgtgtgactctgcagctcacacactgacatctcgaaacagagagaagtggagcttttaaacatgcacaaggccaagtcagacccatgcagaacagatgaccttgcatccaccctctgagcgctccagtacactgcatgtgcccctgccgggttgcccccactaggatacatgtttccctgtttttattttttgtttgtttgattgtggtaaaacttacataacatttaccattttaactgttttcaagtgtacagttcagtggcattaaatgcatcacattgctgttcaaccacctctgccatccatcccagaatttctccatcatcccaaactgaaactgtccccattaataactcctcatccccctctactcaccagcttctaggaaccaccactctgctttctgtttcttttttttaaaaaaatattttattttaagttctgggatacatgtgcaggatgtgcaggttcgttatacaggtaaacatgtgccatggtgctttgctgcacctgtcaacccatcacctaggtattaggccccgcatgcattagctatttatcctgatgctctccctcccgtgccccactgacaggcctcgttgtgtgttctcttccctgtgtccatgtgttctcattgttcaactcccacttatgagtgagaacatgtggtgtttggttttctgttcctgtgttagtttgctgag

SEQ ID NO: 7537 - DNA, 1030 bp, Homo sapiens
aatcttgccagttctagaaactgtaaattgctacacaaatgctctgtgttgacattcatgctaaagccagtctgcattttcaaaatgaaaatttcttcactatttaaggctttcattgcaataactttaaaaaccaaatatttgtccaccaacttagccctacagtaatgttcccaaagactcatgagagtttatggtttattggaaagggtccaaattggaagcagatattgattttctgggagcaaactggtctgcctttacaaagtggaagttcaccctctctggataacacctgtgtctcattcctccctctctgccagatctcgaaggcactgaataaaccatgcagcttttgaggaagaaagaaccatttggaagaactcactagaacttctttgagcatctctttgggaggggaggatatatggttagcacaccatttatataataattatcacagggatttttaattttatcatggcagtgttctgacagatgtatagtgttttgagggcagaggatgatctcctaatttgcccaaagagccttatgggtttgtggggctctgggggtgccaaatgggaaggagagggggcacatgaaaaggaaatggcgggaagagggcaacaggccagggggtaatatcttcccaggccccttaggcctctacagaacggaaatgaacttcattcacccccaaacccacccacttaaatccaaagagagcttagggttattatgcatggacaggaacacattctaccaagaacacatgctcttaagagctagtagctcccagttagagtcaaaccagtcattgttatattatagattgaatccagcctctttctcccaaactgtggtcatcactgcatgaatccacactaaggtgtgtgaatgggaacctgcagattatctcctcctactgaaaatgctgcccaggggaatcttggaagctatggacagcatccaggcagagctggtcccactgttatctccagaagcaaatgcccaagctgtgctcaga

SEQ ID NO: 7538 - DNA, 1102 bp, Homo sapiens
ggccaaaaaagaatctgtctcttatcagtagcagaaaaggactttgaagcacattagaaagcagtgatagaattctgagaggattttaataataacccaaatcccagcaaaattatttccagaggacatgcatttcaggtttcttgaaggatgtttataataagccagagaatttctcttgttgtcgttaatgtgctagaactggtttcagttaaattttacatgaaaaggatatattaacctgcataaaatatgttcataatctcgatttaaaattaaaaagaagaaaaaaagccacaaccacatgtacaatatattgccccaagtaaaagccttgggaaaaaaatacaaactttgcttgtaccacgctagtaccatttttgcagagataaaatttctatgctcccctaggtacacatgcacagcccattattgttgcggggagttatgtatgtcagctggagggaagaacggatgctgaggcttcagaagggatgggcgtgcggaaaacagaagccatttgctttcatggcttcctccagtctagagagagcaggtatctcggcgttcggtaagctggatgtgatcaagatcatatctctcccacactggaagtgagaatatcctgtatcaggaagtctgttaaccttgacacagggctgtcttttccctgcaggccacacagttagtgccaaggcccctctactgcctgcccctgccaacacttgcctagcaagaaccaggtcacgtgcttctcagctgtgtcagagaccaatagaaattcactggggctccaattttgttgaaggtgggctaagtgacacagttactttcaaggagtctttatttatttattattttttttgatatagagtcttgctctattgcccaggctggagtgcaatggcaaccgtagctcactatagcctcaaactcctgggctcaactgatcctcctgcctcagcctcccaagtagctggtaccacaggcatgtgccaccacatctaacttttttttttttttttttttttgtggagctgggatctcgctatgtgcccaggctggtctcaaactcctggcctcaagcaatcctctcactttg

SEQ ID NO: 7539 - DNA, 1030 bp, Homo sapiens
attaaaagagaatgaaaagaacacaatggatactagaaaacaaaaagtaatgtgtattcaacttatcaataataaatgttaatgaatttaatcaggcagagactatcagattggattaaaaatacattccaactctatgttatctatgctcccatagataacacactttaggctcaaagacacagatagattaaaaggatacaaaaagaaatagtgcaaacaattgccataagaaagctggactggctatactagtgtcagacaaagtagactttaagacaaaaatgctcctagagatagagacattttataatgataaaaaggttaacccatcaaaaagatataacagttgtaaacatatgtatgaacttaacagtatcaaaacacagaaagcaaaaactgacagaaatggaagaagaaaatggtcacaataataattggagactccataacctattttcagtaatggacaaaactagacacaaggttaacaatgaaatagaaaacttgaccaacgctgtaaaccaactagccctaacagacatctatagaacacttcacccaagcgctacagcatatacattatcaaatgctcatagaacattcttcaggataggccttatgctagaccatgaaacttcaatacgtttaaaaggatagaaataatgcaaagtgcattttgtgaacataatcacaggattaaattagaaataaaaaatgggaacatttgaagaactcacaattaggaaattgaacaacacactactaaatgaccaatagaccaaagaagaaaacaagaaggtaatcagcactttgaggctaatgaaaattaagacacaagtaaactgtacggatgcagctaaaaaagtgcttagaggaaatttataggtgtaaatgcctgtattaaggaagaaataaagcaataacctttcttccaccttaagtcactgaagaaagaagaacaaactaaacctaaagcaagcagaaggaaggaaataataaaattagagtagaaattaatgaaagaata

SEQ ID NO: 7540 - DNA, 1060 bp, Homo sapiens
gttatctgcatcacagtcttgtgtcttccgagaactattgagaaatctgtgcactttccatagaacttctggtggtgaaggaatttggaaactcaagccagaatactgctaaacaacattgcttcctaaactttcaagtccctttttctaacgggcatttctgattattaatttattattaataatcatgtttgtcaatggaagttggctgcacttgatgtttgtttgcatgatgtctacctcagaattaaaactttaaggaagaagaaactcttctctgaaagttaaaagttttaataatgctagctaaaggagaaaatacttggattgatttttttttttttggcaatctaattatattgtaaatcaggtacctaacagttactccttggagcacatttgttcctttacccaaaagatgctgtcagggagcacagttagaagtttgcagaacagaaatctcaatatttttttttattggtgctaaaaacaggtcttacattcagtcagacctgttcaataagttcatcaatatctgataacagcattattttgatgcttaaactttaaacatttatatttaccatttgccacccacaaaggtcaggtttgttatttgttgtttgataattatattaattttcttggaaagatcctcttttcaaggtactggtaaattggtgagtatttttattagtaaagcatgaaatagtatggtaataaatgataagacatgtatttgtggaaagctgtagggtattcagtttaccctggctttcctttaagcagagggcatctttttctctcctacagtcacaaaatgtgttatcattaaaaaaaatcaaattaaagccaaaagtaggtacataaaaaccacacacatgcatgcacacaaacatcactgcagcccacagcagacccagccgttgttaccatgaagtgacaccactccaggcctctcttgtctgcaggctggcaggctgtcttctctccagttgccttcgtcttgcgcctgcctttgcattccttgcgacgggctttcttgtttctgcggtttgga

SEQ ID NO: 7541 - DNA, 1076 bp, Homo sapiens
caccaagtccccaggctgcacacagcatggggaccatgggccaggcccgtgaaaccactttttccccctgggcctctgggcctgtgatgggaggggttgccatgaaggtctctgatatgccctgcagacattttcctcattgtcttggggattaacatttggctcctcgttacgtaatgcaaatttctgcagccagcttgaatttctcttgagaaaatggggttttctttcctatcacattgtaaggctgcaaattgtccaaacttttatgcactgcttcccttataaaactgaatgcctttaacaacacccatgtcacctgttgaatgctttgctgcttagaaatttcttccgccagataccctaaatcatctctctcaagttcaaagttccacagatctctagggcaggggcaaaatgccgcctgtctctttgctaaaacataacaagagtcacctttgctccaattcccaacaagttcctcatctccgtctgagaccacctcagtttggaccttactgttcatatcactatcaacatttttgtcaaagctattcaagaagtctctaggaagttgcaaaccttcccacattttcctctcgtcttctgagccctccaaactgttcccatctctacctgttacccagttccaaagttgcttccacattttgggatatcttttcaggagcgcacctccccactggtaccagttgcctttattagtgcatttttatgctgctgataaagacattacccaagactgggcaatttacaaaagaaagaggtttaatcaacttacagttctgtgtggctgtggaggcctcacagtcatgtcagaaggcaaggaggagcaagtcacatcttacatggacggcagcaggcaaagagagcttatgcaggaaaactcccatttttaaaaccatgagatctcatgaaactcattcactcatgagaacagtgtaggaaagacgcatcttcataattaatcacctcccactgggttcctcccatgtcacgtgggaattgtgggagttacaattcaagatgagatttgggtggggacacagctgaactat

SEQ ID NO: 7542 - DNA, 1097 bp, Homo sapiens
taattagcaaacttaataagcagcaaagttctcatttagagttttccttatgtaataggtaataatggaacagctagagtcaaacttctagaattgctttgcaaaatactgggagaaagttaattatgacgtatttactgagaggagattaaataaaaccagttaaatgagctgaagtccaaaatgagattttaggtagacatacctataggtaccagatagtaagtatttggacagcaaaacaacaaaactatcttcttttaaggtgggtagcccatcagccttgatattttctttgaaaaaaaaatgccttatcttgcatcatctttttatttatttattagagatggggtctcactctgttgcccagtttggaatccggtggtgcaatcatggttcattgcagcctcaacctccatggctcaagcaatcctctcaccttagcctcccaagtagctaggactacaggcacgtgccaccactcctggctaaattttttttttttttcttgtagagatgaggtcttactatgttgcccatgctggtcttgaactcctgggcttaaatgatcctcctgcctcggcttcccaaagtgctgggatttacaggcatgagccacctcatctaacctatcatcttttaattcaagtggtttttgctttagattttgtaacttgggatataatcttcataccattccctgttgttaagtgtttcttccactctccgaaaatttttttgtatttttccttttttaactttatttttaggttatagattaaacatatcattgatggagaaagaaaaatatcaacttctgttttttgcagggggaggggttaaggttaaattatttctctttgacccatattccttatttaaaatcttaatagctatgatcttttcgtacctttggtaaactccctgaatcaatttctgctttgaaatattaaaaagaccttttgtattgttgagtctttaaactgtgcttttttttgcatctgctagtaatatgacagaatcatctgttatgttctaattttgagagcagacctattattcagacttgtttatggccttaaaatttaattttttct

SEQ ID NO: 7543 - DNA, 1053 bp, Homo sapiens
agagggcggcatggcctgaggtcgctgcttgcatgggatgcgcttcttccgccccccgggagatgtgggagggggacggggtaatcccgaggccacagcaggctgcagtacgcattcgccgaaccggagagaccctttgacgcccctcggccacctggctcaagcaggccctagcagcccctccccagtgtcttggaacaggccccaactaaatagaattgcggtttgttgctgagcaaaagctcatctgcttctcagaaagtggggtcagagtagacctgctgctgagagaatccaggctctgctgctgcccagcttggagggccctctggggagaacccttcccggcctctgtttactgatctctgcaatgggtgcattagggagtagtcctcactagggcaccccagacagggttgtgtgtgtgggagtcttagtggccatggtgtcggcagttttctggggttgggttgaggttctgaggttgggttggggatgctatgtgaccttgtcctcagagaagagacccccaagagatacccagggcaactctgctggagtctggactgggcagggggttgcacagggcacctgactctcactccttgttgctgtccttgactgtatgggcaggaactagtagggctggcttgggctctggctctagatactgagccctcatgccctgctgggatgcaggtgggggtgggtggcaggctgccctcctgccaggctgggtcaaggtcacaacagtgcccagtggccaacccagactgtttagtgtttataaaacagtgttcctgcaccgggccattctggacacagccagactttgtccctatctggcccaaactgccccattcccctgtgggggtgggagtggcgctggcagagggagcagctctggctcagctgatgggaactgcatcgctaagagaaatctggcttacatattgactgcagtgatcagggcacagtcgctggaaccccacacagccctgtcactcaccagattagccagcttagcctcttgcacctcagtttctctgttta

SEQ ID NO: 7544 - DNA, 1050 bp, Homo sapiens
ggaaagatgaatgagggtaagttcagatctgagaagccccactgtcctgtttctcagacctgccagcgctcatccagtgtgcttgctacctcaggagcaaagtgtataacgagggctgccatgacagtgcataacgagggtgcatggacagtgtaccatggatagcctgttgttatcatgagcaaagaagttgtttctttaaagagtgttaaaaatcttgtttaatttatgttgggaaagcctttcaggcatatgaaattcatgctgtattttcaaaagccaagtctgagcatatgccatttagattaagataaaactggagtgttctttctaaggttttttcaattacatactttaatgtgcctctggtctgaccttttgctctccaggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataatt

SEQ ID NO: 7545 - DNA, 1052 bp, Homo sapiens
tttgcaaagatcttgggggtgttgtagacaaggaggcctgaagacagtgatgttttaaaataaacttttgtcagtgtttactgatgtatctaggatcgagattatctttctggaaatttcatttatgtatgtatagtctagcattcaatggagggaaaacaattataacagtgattatggatttctaaactctgacagaatcttcagggagcatctgatttaactccatggtgtagttgagaaaaatgaggcccagagagtaactggctagtcacagagctagatagctggcagaaggctgaagatagaacttggatctcctgcctgccagtcctaactagtctaacacgtgcttatggtacaatatgtactctaatagaaatgggtgtgaaatcaagaatgtaatgtgaattggttttactttttgattttctcttaatataaaataaattctataaagagataaattttaaatgttttttattaatacttcattttcacaaatggcaaatgactagagatctagtaggaaataggatgaaaaggactcttctttgggtctctgtcttttttaatagtaaatacttaaagctaaattttcattttcagtaaaaggtaagaaatggtacttcttggtggagaaagatgatgattcattcgttcccatttttatgtgtagtttaggttaattaagaaccttttgaaatagggtgtattgaaactttaatgtatggataagttggttgagcagttttaattaaaacttatctctattttgaagttaattactttcaatactctgagattaatgaggcatagtcatggcacctcccatgttgtgggtactcaataaatattagtttgggaattaggacatactttgatggtattttagggtcttacatatattatgtcatagattctttcccaaatctgggaaatactcaacgatatcaaattttactggttcaacttaaaattttttcttcctatgtaatttttaaaactttctatttaaaaataatttcaaatttataaaaataaaaatacac

SEQ ID NO: 7546 - DNA, 1050 bp, Homo sapiens
tggtaagcggaaaagagggatgaggaagggctttactggcccaatcaggaacagaaactaagaacccgtgactgtattctctcccttggacttccccgtatatgttacctgacctgtaaacaagtatgccattgccagtttactatcattaaaatgtgtcttgttgcattttttgcattttcttttctatccccattccctaccttcagtacctaaaagtgacttgcaaataaaatatgctcaatgaatttctatttaacaaatatattcagtagcttctgtgtgcctttaattaatcttgggctttgcccatttttctgtaactgtctgtctgtacctggctaattacttcggtcccttgtaagattctactccagtggtaactactccagaaagaccctccttcccttccaccagaaaagttctgtattaggattcttttggttgaaagagacactaatgtagcttataccttccacctaaaaggggactgttgcttgacgtggctgagaaaagcagggtagagttggcctcaggtatgagttgatcctagaatcaggctctccctctgtttgtgttggttcctctcctgcctgcttctttcaatataatggcctcattttcatctgtctccatcagattatctctgcctgacaggaaccaggaccaaatagttccagtcttgcaaccctgcagttgagtgacccaagaagaaaggaggactccttagttttaaaatgccacaaaaatactctaatttgaccaattgggattacttctcatcccttggaccaaattgtcatagccagggatcaagaaacacaagacacatccactaatgagatttaaaggatttctaatttatttccatgacatatgtatattaagtgaaatgtttctgagatatagaaactttttataaatttctttcagaccttatgtccatttatatcaaacttaaataatgtcttcactagttattttgtaattttggaatcaagatagttaaactccagaaagaccatttctctagaaaaagaatttagacag

SEQ ID NO: 7547 - DNA, 1100 bp, Homo sapiens
ctctcagatttttttgacctgaaagagattttcagaagctccatgcatctgactatgcaggtaatttgtgagcgcttgtgtaagctctataccacagtgttgaataatgatctggtaccaacttataattaatatctgtcaggatttacagtctaggagggtatggaaggaatagccttgttaatccatcgagacagtctgtaaaataaatttttatacctttgtggaaacttcaaagaacaatttaatatatttctatgtgtgggtttcatagaagcatctttctttatccttggtttttctctgggaacatttgtcaagatcattcttttaattgtatttgctattatatgtaagctatattttaggcttcgtttggaacttgagaacccaggggagttttgctttgctgctgtattaagcctgttacagtctgatcacttcagaaaataagaatttagaaagaaggcagaaagaccaactagctgacagcaaagaggtggaaatcaggaactctgggatcttacacaatggtcttctcatatagaaaatgagctgttcatttaattaatatttagccagcatcttcagaatatattgtacttttctcacattactggcaagtttttaaatattctagcttaaaacagagctgtgaaactagagaatcttagagccaaaaggcatcttaaaggttatttcataaccaggtataggaatcccttctatagatagttgcttgctctttgttaagtatgtcagtagcaggaagcacatttattaatctaatctccataactgagagagagaatgctgaggaggcataatagtgaccctttgcctgatgaaaaaaatagtgattaaagccttcaaagaaaaagaaaactgttctaacaagtccctttcctggtagtttttcctagtagtttataattgggatcctattagttcttgaaatatctgctattttcatttctgtttgtttgaagtggaaaaataaattgggacctgtattagtttaagggattttatgtgcttagcattcaaacaaataaatattagaatttatcatttcttagtctcttccttgcataatccca

SEQ ID NO: 7548 - DNA, 1098 bp, Homo sapiens
taggctggagtgcagtggcatgtgcgatcacagctcactgcagactctcaacttctctgggctcaggtgatcctcccatctcagcctcctgagtagctaggagtacaggtgtgcaccaccacacctggctaatttttcttttttagatacactgggtttcaccatattgcccaggccaatttcaaactcctgggctcaagtgatctcctccccgtcggcctcccaaagtgctgggattataggcatgagccacaatgccctgcctgaaaagtatcttttactagtaattggatacattttaaatgtaagcctattttcactgttccaaactcttgccttaaagcaattgtccccagtaccatgatgtttttaggatagagcatatcgagtagaataagacttgtctttaaattttcatgaggtgctacttacctaaacacgtatatgtgaatttgtcacacggtcaagaggacatttatgtaagcagtaggttgttggagagaaatatggaaaaggaaagtagaaccaaaatgtgtttagccacagttaatacatgaatacaaactgaaagcttcactattttatgaatgaactgtatactcccacatatacttttctatgagaactagatcattcacttttagaagttatcctcaattatgatcttttaagaaggtaactttgggcataagtcttttttaaaattgccaggtccagttgattctctctgcacttacttgtgtatcaccaaccttcagtttgcccatcctcaaagacaccagaaatttaaaagatatatgtgaataggttaagttagttgtaaatattggcaacatggaagaacatttatttatagaatatagagtcttaatgaggggcgttttatacaaagaatgagtcttcaagtaacctggcaacaggagttttatttcattaggagttggcggcagtcagtcacactgccttatggaagtgtctcaaaaatattttgttaaatgacttgactgataattaaataactttttttttttttttgagacggaatttcactcgttgccctggctggagtacaatggcgtggtctcagttcactgcaac

SEQ ID NO: 7549 - DNA, 1034 bp, Homo sapiens
tatgtttactcctaggtattttatggtttttgacattatgggtaatggatttttaaaaaatgtttattttcccattgtttgttgctagtacacagacatacccttgatctaagtttacttatatgctttttctttattttaatttcccctttcttttcttttcttttttttcttttgagactgaatctcgctctgtctcccatgctggagtgcagtggcacactcttggctcactgcaacctccgcctcccaggttcaagcagttctcctgcctcagcccccctagtagctgggattaaaggcacacaccaccaagcctggctaatttttacatttttagcagaggtggggtttcaccatgttggccaggctggtcttgaacttctgactttaggtaatccacccgcctctgggattacaggcatgagccactgcgcctggcctctctctttagttcagtgattccttaggatttgctatgtaaacaagcatgatatctacaaatagggacagtttgacttatttttttacattctttatgcctttttgtttattttcttgccttattgcactggctggagagaccttcagtacagtgctaaacagaagttattcttgccatgttatgaaaggtggaatgtttttgccatcaagtgtgaagttaatagtgacagattgtttgtttcaggtactgagcagtacagtgaatacacaggctatgctgagacatatcgttggtcccggagccacgaagatgggagtgaaaggtgagtctgtttctgtcttcagtattccatggctaaaagcaaaggaatttgggcttgaccctcacacactctcattctgtctacttgtatttcagcaagtgaacttaaaaagaaaaaagaaaagaaatcagcattacaggttcattggcattgaaaacactattaccatcttcctgtaccaaagggaagaacagagaagataaaaccaaaagtctaaagcaaagacaaagaggggcagaattctctacagttctttacctctgagct

SEQ ID NO: 7550 - DNA, 1050 bp, Homo sapiens
gaatgtactgttttccatttgcaagtgtttttactttattgtgaatgttgtgtgagggatatttgatatttgggatacttacattttttttcagagggcattaaggtgaattgccttaatgccaaatatacatttggaaatgaatttggaagtttatttgtatacacctgttgatgcatttgtacatgtgtttggtgatgctgatagggtgccactttatggggttccatgaaaagcagatatgtaatttaatttcataacaaacatattcattagttattatatttactggttattgttattcacataacttattttattggttttcaggtacttgaagaagcagaagctcaacatttatatcagtccatcttgcctgatatggtgaaaattgcactctgtctgccaaatatttgcacccaggttagtggatgtagcttcctcagtagcttccctgagactgccaattgaatttcccttaaactcgaatggccagggtcacacagagagagagagagagacagagagacagagagagagagagagagagagagaggaagagaagagaagaaatgggaaacagtttttgccaaagagtatagtaattttgctgtattaaggaaaaggttagagggtagagagtactacaaaaggacattaaaaatgcagcattccattcctcagcttctgtttacactgttgaagcttgtttactttgacttttttctctctttgtttaaataacctctaacttaaaaaagtattcattatttcaaaacatactagtggatttggaatagcgtattttcaaaatggcttaatacgacccactccttcctcaccctcccccaaattctacaacaaatgagttaatgatactttcttaactttttttgagacagagtcttgctctgtcacccaggctggagtgcagtggcataatcttggctcactgcatcctccacctcctggattcaagcaattctcctgcctcagccacccaagtagctgggattataggcatgtaccaccatacccggctaagtttct

SEQ ID NO: 7551 - DNA, 1082 bp, Homo sapiens
taacatttcatatttaaccctggaaggactattgtagtatttttatctgaaggtaaaaataatgagtaaataaaaacagaacgttagatctgtttttcaaatttatatattgtttcagtgtgtagcctatctaaacaagcggtaaacttgctcatcaaagactaaataggtccattggtccttttatatgagggggtgctgttagtgctgtggtttaccaaagactaagccaatggtctttctccttattttactattagtactagtagagaaaaatactcatcctcgatttattgtgatgataatgacaggtaatgatttactacaagagtctgtcagattctaagctggctaaataatttttctttatagtgtgttaatgaagtttttagtaagctgagtgacatagtgccttgtcaccacaaatgctctttgattacatgaaaagtgttacaaaaagacattttctgccacaagggccatttccagcataatgaaatatggaatattttcaaatgaactccaaagtgatatgtattgaagtcttgctcttggtctaatctgcctcagtcctgagaagcctagctctaagataaacaaagggcatcttccactgggagtgcaatgttggaactgctcactgccttaagtaaccatatgcatagcctctttcctgatagttggctcctgtctccctttgtaatcctttccttcttccatgcctgctgcttaagttgcagactattccagcctcacttctcttggacacttctatctgttgcaggcataggcctgtctcatcccagactcacctcttctacaagatcctccctgtaaatatctcctttgtgtttgctggatcatcttatttggttatctttggcgatggaggtggtagtgcttattactgagagttttctatgtaccaactatagtgtcagcagtatgctttatctgatttaattctaacaaccacctcatgagttagatgctattaatatttctgttttacaaatgaagaatggaaaaccaaggtttagggagtttaagtaactaagtgacatctcatttttatctatgga

SEQ ID NO: 7552 - DNA, 1036 bp, Homo sapiens
ctgttttaaatcacaacagatttcgttattcagtaactgaaggaatgtggcctccttccatgatagccttttggtggtcattttttgttttgttttggtttggttttttgataacactgaagtaagtttctgaatgtatataaacacattattacttagcttgatttaacattcttcgtagataatctgttttctgggattttcttcaaagcttaaaaaatatcaagtatctttgttatatttgtcacaaagagcctgtaccaaactcctaatcaaatgaaagcagccttaaatgtttcataagactacagctaatgtctttatctctctagctttcgaacctctgatttggagttcagtggaaatttaacctttttggacctcttcccttggtgactcacagtctctggaatcataaggtctgcattactttacagctcaatttaattcatgagaactataggagccaaaagggaactaatcagaatcactaaaatattgaaacagatcaattgtgacttttatatttgtatggaatatgtggaatttctctccctggtttggttaatgagtgcttttgaattgggacatatgttgatggtctcatatttatgatttatgatttctaaatagtgcatatcccaaaggacagattactccaattggaactaggcactttgcttttataaacttgatgagttaccatggaatatcagtcttagttgagccctctatgcactagatcactgatgaagttagagttgttattttgtgtttgcaaaacactatctggattgtatttatttatgtggtggacaaagaggttagaagttatagatactgaaaagtgaaaattcattcagtagactttctcttatattctaataatgaaattaagctagtacttagtttgtcctataactctaacccttcatttgggtcaaatagcagtagaagttattccttttaaatgttgctgtggtgttgatttcattatccaaaaatctactgttagaggagtgaagataattctgtg

SEQ ID NO: 7553 - DNA, 1049 bp, Homo sapiens
agaggttgcagtgagccgagatcatgccactgcactccagcctgggcaacaaagagcgaaactccatatttgaagaaaaaaaaaagaataactatagtgttttaacttacacagtctgcttacttctctagcaattccttagtgcaccatgattatttcaggaaggggtaattgctttaatctgaatttcctttttgcgtttcccttatggtagattcaatagaacagagtaatccatcgagatatttttctatctgcttatggtaattgtttcctttgctgaaagaatgctttgagagaggaagagggaaacattaaatccctctaattgaatataatgatctttttgctgttcatataccatttgatgttggatttagagggattagagacattcagaattttaaaaagtaatagtgtcctcaaaagttgatttacacagtagtacttatataaataatgtgtgtgataatttgcacagaaagaattttttgtgcttattgtgaattatgaaccataaagaacttattcagtcgttgataactcaagagtacagagtagtatccagtttttctaatgacaagcaatctcatggtggactacttttgagacttgaagactgaagtaaaaataaatacaagctaaagcttaatgctaattataaaacactaaaataatcagagaattacagtgaagaattagaatgcaattgctacttaaaatttttttccttaccaactttgaggaataataacatatggataagaaagtttatccttttaaagtgtgtcatttgatgagttttgacatttacacatacccatgaagctcccattataatcaagatacagaatgtttgtatcatccccaaagattcctctccccactttgcagtccattccattttctgctctggccccagacaactactaatctgttctttttcactatagtttacattctgcatgaattgaatcatagtgggtatgtctggcttcattcactcaaaatgaagataattttgagattcatccatgttgttcaatata

SEQ ID NO: 7554 - DNA, 1153 bp, Homo sapiens
cctcggcctcccaagtgctgggattacaggcgtgagccaccatgcccttcttatttccctttcttgcctaattgccctgctctagaaccttcagtataagattgaataaaagtggtgagactggacatccttgtcttattcctgactgtagaaggaaaccattaggtataacgttaaccgtggggtttttatagataaccattatcaggttgaggagcttcccttctattcctattttagtggggtttctttttaatcatgaaggggtgtgaattttgtcaaatgctttcttcagtgtctattgaaatcatcatgtgattttctttcctcttttattcatatattacattaatttttgtgtgtcaaatcaaccttgcattactgggataaatcccatttggacatagtacgtaacctttacatatgttgatggatttggtctggaagtatttcctcaggatctctgtgtctataatcataagagatgatctgtagttttctttatgtctgtctggatttggtatcagggtaatattggccttataggatgagttgggaagtgtttctgacatgggtaaatgtttagatgtatttcaggataggcaaagcctcagagtgggagaaggatatcagtaagtaaacctaagtgaacagaaagtgaacactatgaaagtgcaagcgtcagagaaatgtgccatacataattttttttacaattttttctaccaaaggatatatcactgaactcactacaatataagcatgtttaaagaagcagttatttttaaagatggtggttttgttagtaatctccactccataagcatgatattccagaggcctctgaaatccaatgtactcaaaacttataatttttcccacaaacctcctgctttcctgtagtccccatcttggtaaagagatgcctttcatgccatcactcaaaatgatctgtcaatcattttggatttcccccaaccccatgacacctagaaatgaccaattctagacaatatgacttcttaatattgttttttgtttgtttttgaaacgcagtctcgctttgtcacccaggttggagtgcagtggcacgatctgggctcactgcaacctccacctcccaggttcaagcgattctcctgcctcagcctcc

SEQ ID NO: 7555 - DNA, 1035 bp, Homo sapiens
ttttgaactaagaatcacagagtgagaaatgccgtatccttctatgctttgttaggtgaggagaagatgtgcacgtgttaatgtgaataatttactaggtgattgtttcttgccttatctgttgtcttccacgtttgtttttaattcctggacaggcctaaattattttagggtctgattttgccatagttatcactttgcaactgattttctgtcagagtagtaaatatgtagctttaaatcttgtaggttatttttccttaggaatcctcaaatgcagctgtgctttctcctggttttttgaattctttgtcatataccttatttcaaccagagtgacctcttcacggaagccccccaggattggcaagctggagcctctgttaaggagggtaagctggggttgggcagctgtgtctctgtgtgcagagttccaaaactgtcttcctcactaggagatggaacaaggttgttcccaagccttgtttctgtgttaagcaggaagctattgtttttactgtggtccagttgaaagtaattcatcttcactaattcatgtcttggaaaacacagtaccatctgtaaacccataccacagtcttgcctctttcttaggagagaactcataaaaagtcaaacaagaaaagtaccctagagcactgttgaggatgattttcattgaatgaagtttaatttaaagaaacatttttaacattctgtatataagttggagaccagtaattccccaacccagtgtgcattaaaatcatctgtgcaggttttgtttttgtttttgtttttgtatttttagtagagacggtgtttcaccgtgttggacagttggacaggctggtcttaaactcctatcctcaagtgatcacccgcctaggcctggcaaaatgctaggaatacaggcatgagccaccgcacctgtcccattggtgcagtttttaaaaaacacaaatataaatatgttttttaacctacaaatgttactccataggtttgtggcagttcttgggacttgggaattag

SEQ ID NO: 7556 - DNA, 1050 bp, Homo sapiens
actgcttagtccttgtattaggctctgtgggccaaaaggtattgatttttgtgtagagcatcaaccccaaattagctagaggtaaatttaaatgtcaatggacagtttttaaaaacgaaacatgatgcattaacctgtccttatttgattagcctcatcttttaaactctatttatgattgtatgaatcaagtaagaaccaaatatgaattactatcactagtataatcacatcataaaaagctgtttctgttctaaccttggttacagataaatgacagcccttagattcactagatctgttttcagaagggaagactcaaggtaattggattcagaagcattagtagaggcatagttgggtgcccttaatgtcatttgaataatgggactattgcaaatctctccccctttcagattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgagtttccccgcttttgattttagcttctgttgtttctggcttgatgttgctggcttggacagggtgcaaagaacctgtggatgtctgaagtttctctttcttaagtagtaatcaactaagattgtattgtttttttgtgacattgattctcttcagaattaagaataaaaagtttattaatataatgatgtgaggaattacttccttctagaataaggaacgcactttcattgtccttgaaaaatgaaaaatattttctaagcttgtgtccctccttgcttgatttgctttcctatcctcttctccctacccggggcacatcacaagcttaatatttaacatttaattaagtgttaacatttttagcatagaagaggaatacctaaaaagctaactgaggtgtttatttataagcaagagatgagtgagccataagttctccttgccctcccagaattggcgtt

SEQ ID NO: 7557 - DNA, 1035 bp, Homo sapiens
taagtgtggaatgggccctactcactactaatctgataaagcttcctttgctaccaacttcagtcacgtttctgcacttaagaccactgactaggcatgcccaaccttattcttttactttctgtttctagtacgttttctctcttcccttgattctgacctattatctatctaggctcagagcctgagctgagatcccattttctttcctttcctggggaccttctctgacccttctcttcccagatcatctggatctcctagcctcttgcaggcctcgctgtgcctcctctgtcttctttttgtttaccgagggcagtttttttggagtggggaaggacactctaaaggctagatgatggattcagtcccagattgtgcctcacctttcattctcatgttggtgaactggtggtcttctttgcttctaccttttctaatttacaattttaggtctcatgacctaaataatggactgagccataggaattatagggaaattgtagatttttctctaaagttagtaatcccagcaatttgacttgtaggcagattagaagataaggataaacaaaaagacaaaccaaattatcatctcaccagagataaatgatgctcatatttgggttcatataacttttgatatttttctgcatgtgctcataaatgagtactctgtgtacatgtgtatttctaaatggtatcattttggccttctcttttacagcatgcccagggattgtctatttccctcctctcaacaaaccatcatggatgtctaattactcatgatctgatttagaagtcaccacatctgtgtcccaccagcctgtcggtgccatgactgtggtggtgaagcatgtggttatactcagtcttacactggaagatcattcttgatttagatccctacagctgcctgctgactgagtgactttggccaagttacttgactattgtagtagcattgtttccttacctacaaaatgaaaattatagtttctataatgctgtcttgaggattgaacgagatga

SEQ ID NO: 7558 - DNA, 1025 bp, Homo sapiens
tctgttcctttggttttaagaggctaataaataggaataggctttagaaatacaagatacttggagtttattaaatgcattatttttgctgccaaactttagttctgcttttgcctttttgacttttaaacttttttcctaaaatcccactggaacaaaataccagtactgtacaaaggcaaggtcaactcaaattatgcttcctgagttttccctgatatttgttgttttgtttttgtaagtttgctccttttccggtttttcatcaaaatttttaaattcaggcaaataatttactaccccacaatataactttgagtaagtcttaacagttacgaatcagaatctttcacagaactgtgacttttaagtaattttattcttataaagtatcctcttaaccataaaactaattttcttaaagtatattaataattacaattttcccaacaggaaattttcctcaaatctatttctctttaagctttatgattttgcgttttcctggtacttattgacaatactgtagtcatttatatatttaaattgctcaaagcaagaaaccagttgatttgacaaaattaactcagtgctggaatgaggcctcaggtgtgtccaacttgctgagtggtttgggtggatccttacatctcaggagcctcgtttttctcacaaacggaataatgacgtctcagtctagatgatttctgttgtcatatatatatacaactacattttattagattctaacataattggatgggccaattatattgaattttattagcttcagagcgtttgtgtccagaatgcatccaactaagtcctctctgattttcacctctggcgggatagggatgtgggaaatgaaagcagagtcgtcatgatcttcctaagcatcgtccaccctgtccttctactggggtccatcgctggtttcctgtctctctccctgtgacctctcttcagtgtatctggcccaccagacaggtaggaggtaggaagaaagatacagatgacacatc

SEQ ID NO: 7559 - DNA, 1035 bp, Homo sapiens
taaagtctaccagccaaagtggacaaaaaggcaaaatacatacactccagcaagcccttcttcttgtatcttagcaaagtaggtcagcacacacttacttagttcaaggggccatttcataggggatgattttatttgctaaccagagttggactgtggaattctgagcacagcatgtaatagcaatttaaaataagggacaatttaaaggttaaggcatcaaaagtaatcttctaaaattttctcaacagtagactgaaataaatgtgtaggtccttcagctgaaactatgtggctgttactttaaccatttttgttcttcaaatctataccattttatgaactcttctatttaactcttcaaatgctaaataacaaatctataccttattagatttgtttggagtaaagctatccaaattgaattagagaataattgaacacctatctcatgagtatttcagtgggctacattgccttaaaagatctgttaggttattatttactttttttgagacaaagtcttgctctgttgctcaggctggaggctggagtgcagtgacaggatctcggcttactgcagcctctgcctcccaggttctagcaattctcatgcctcagcttcctgagtatctgggattgcaggcatgagctaccacgcccagttaagttttgtatttttagtagacacaggttttgcccaggctggtctcaaactcctggccttaagttatccacctgcctcagcctcccaaaatgtgtgagccactgtacctgttctggttattattttatggaaagttccacaagatgtaaaaacttttatctgaacttgaagcttttacaaagaggcacttggtctgtttcataataaaataatatcaattcttgatttgtattgccctttaacaaggtaccccacaggtagttttgtgttataaagtttgagctaaatgctacatgtccgcaagattttgatcttcctttaagtcaactgtaagctttcagagtaaagtcatgtatatactccatgtt

SEQ ID NO: 7560 - DNA, 1116 bp, Homo sapiens
tatatggtttcagtgtaagatgatcagtatccttaagtcttttttcttaaaatcttgggtatttctagaaaaaaattcatctgatcattaacctgcaagttattctgggtgcctaagaaggtaaaaggcaagggcagatcctacttaatctttttgcaactttcactttgtcccttgtttttagtcagataccactgctttcaactgtgtttaatgtccactactctagaaactctccatgtctcttttccagaggataaacttcagtattctatggtgtggggaagaggcagttgctcagctgtacaaagtgagaatctagagaaacttattaagtggtcttttaactccactttcacaccatttccaaggtacttgatgccaccaattcctcatacttttaaggctagaggaaatatttagtgttatgtaaatcagaatgcttctttcccctttgctggcttagggctccttgttttgggcctgccagatccgtcaccactgattcatgtgcttcccaacttccgaaatcgtgtccctgttttctcctcttctgttctcttctcttctgttctcttcgactgttttgatttcttgtccctttttttaaaaaagaaaatctttttactaccatttcagaggagtttttggagacagtgagatagaatgtatatgtccagtgaaatacctttttggaaatctgattcatctttcaattaactggattcagttttttatttcccttttcaccccccaaaaaagatgtgggtgctagattgttgagatccttggggcttgacaaaatttgtcagttgtctttatatttatatactttatttttttgctgatttcacttcctcttttgatctgcttttaacatgttgctctctcttctttcctcctgaagtatcagtgggtcacaggccagaggagagaacctagggtttctccgtaccttctttaaacacatctatctttaagaaaaaaatcatgtcttgtttttacattgtggtttcaattctttatttcatagcctcttcaaacctgttttatatgatcaaattcatggtttggtaaacttcctgtttgtcacacctggcaaatctccctcatggt

SEQ ID NO: 7561 - DNA, 1084 bp, Homo sapiens
atactttaaattagttgctttttttttttttttttttttttggtgagatggagtctcactccgtcgcccaggctggagtgcagtagcacgacctcggctcactgcaatctccacctcccgggttcaagagattctcaacgtcctgagtagctgggactacatgctccaccatgcctggctaatttttgtatttttagtagaaatggggtttcgccatgttggccaggctggtcttgagctcctgacctcaggtgatctgcctgccttggcctcctaaagtgctgggattacaggtgtgagccaccatgctcagcctagttgcttttgattatctttgttaggcgtggtgactgggtgccccagtcagccttccaaagtcctcaggttatttatagtggccatgcttctgagtaaaaatcgtcagcacatatctgatcaagaatttgtaactactactgggtagcagaaacatgctaagagagaagtcatttagaaactgaaatattgcatcctctaggacattttgatggtgtatgagagaagggaaaaatatgtttgaaatctgaattgccttagaaaagctggagggaacgattattttacataacatgtatgtaaagtttatggtgttattgttctcatcacttctttagtgttaaggaggcactattgcccattacaaggttgtgattggaagtacaatcaaaactctacttttggatatcaggaacattgtccttgtgctttaggtcctcagtagctcttctggttagggacaaaagtcctaataaggaaggtcaaggatggagactagcccttctggttggggtgagatggagggaagtacaaccagaaagtgaaaagcaggatggggctggagcattcttcaagatcttcttatcctttttaaaaaaattaattagtgtggaatggtaataacagaaagtgtactttcagccattgtttttggacatttgatgaactttcagtctgccaactcatgtctcctttagttctgataatttttttaaattttctctttttagatttaaaatatttctaaatctttgtttgtttttttctt

SEQ ID NO: 7562 - DNA, 1030 bp, Homo sapiens
aagctgcctccttaaatattttaagttcagtgtaaaggtttctctgtatatagtgaactgtacctaaatgcaggtgtaaacagactgtaacctactcttgtgccaatcaccaatttttggtcaatcaaagggggccaattgttcaaactgtattcaaataaggcaaacactaagctgtaaccactccagctgtttctgtacctcacttccactttctgtacatcactttcctttttctctctataaatcttccaccatgtggctgtgctggagtctctgagcctaccgtggcttgggaggctgcttgattcatgaatcgttctttgctcaattaacctctgttaaatttaatttagctaaggattttcttttagcatatacaatacctatgaatctgccgccttgcttttttcatttgacaattagatttgtcctgaaggatatatacctgttagcactggttatctctgaaagataagatggaggaggcttggcttgcggtgtctgtttatctgtctgtctatgtatttaactttctgtatttctgtattgcctgaatcttcttacagggagaatattgccttttcgataaagagggaaagtcctttttgaaaaaagagatagcgtaaggtaattaaatccacacaaacacatataaatcggatctttgatttttctaatagctccctccatggtggaagttttggaggaagtgggtgtatgtgtttgtggaaggctttttgacctgggatagggagtgagcaggggaagtctctgaaagaacccccaaggaatgcttttataactttgccttaatggttaaggaaagtgaaactacatggatttccccctttaggcagcatttgtctccaggtgtggtaactcattttaaggaactgaaaacacattccagaatcttctatcagcatcatcgatggtatccccagttggaggtgcactactcagttggggagcacacaggctttggagcctattgttgggactcctccgctcaacatgtgaccctttg

SEQ ID NO: 7563 - DNA, 1066 bp, Homo sapiens
tctctccgctatgactttggtttctacctctccactgctaccccagacccaggctgtgaccattaccagggatttttatttgggtatgctggtgacttttgtgacagagtggaatttatttgagcctaaagtgtctggaatttttcctggagactcaagatacttgatacagtaaagaaattgttctcagattcctctatccttgtagacattttggttcaagcacttaattgcccaatttctttcaaagggagtaattccaaaaaagatttttaaagtatctagacatgaacattctaattgttagatattaatttttttttcttaagaggcagggtcttgttccattacctaggcaggagtgcagtggcacgatcacagctcactgcagcttccaactcctgggttcaagccatcctcctgttccagccttccacagagctaggactacagactacaggtgtgtgctaccacgcccagctgacatgaacattctattgacttaaattcctctggggaatagagtaatgcttcagggtttatgctttattcaaaaccaaagttctagttttaacaaataaaacaaagttcagctttattcagtaaagcataaaagaaaataaatttctataccagcaatctaaacatttgtgtactttgtttctcccaaagagaaacatcagttaaaattgatttcctgctcaaatgtcttgtctgctgcaggtgtatttcctaaaacatgatttatgcatttgatttagtgacgttacatgtatttgtagtaccgaatagtttgaataataattgaacataatttcattgcagatattttaaccatcggttattattcaatgaattatttatataaaataggttaatataatttcaaatatgaagttgctttggaaaaagtaaaggaacaccagctaaaatcaggagtaatgggtattatggaatattttcaacaataggcagtgctgttttcaaacacgtaaagtattcaaagtcattggttaactaaatgttgtgaaaccaaagttctggttttaacaaataaaacaaatct

SEQ ID NO: 7564 - DNA, 1066 bp, Homo sapiens
tttcccctacttagttctggggaaagaggggcagtattttaagacaaatcccagacatcataccatttcactcccatactttgttgtcatgttcgtttttcaattatttaccttttgtctgttgacttttctttctcttgtttctgaaataacacttggactgtgccctggtgatgttatgaaggtacactttctggtagtgttgtcctttgcatggcgcttgctgggctggtcttcatggatcctgaggaagacagctctgctggtatgcagttcacgtctcagtagaacctagtcaccagtagaacccagaggtatcactgctacctcgcgaccttgtacagttaggtgaaagactgtgcacttgtatactatgtttagaagaaatggactcaaatctaagtcatgatgatgtttattattttttaaacccataaagaaaccatggctttgattaagactctctaaatggatatagctagattctattttgtttttctaattacatagacagaaaacttttgacattacaaattaatcatttataagtttgccatcttttgagtacagtaataatttatttgtgcaacatttcagtttttttttttttaacttttactttaggttcagagtacatgtgcaggtttgttatataggtaaattgcgtgtcatggggatttggcgtacagaccatttcatcaaccaggtaataagtatagtactcgacaggtagtttttcaagcctgaccttcctcccaccctccaccctcaagtaggccctggtgtctgttgttcccttctttctgtccgtgtgtactcagtgtttagcttccacttataagtgagagcatgcactatttggttttctgctcctgcattacttcacttacgataatgacctccagctccatccatgttgctgcaaaggacatgatctcattcttttttttttttttttttaatgattgcataatgttccatggcatatatatacaccacattttccttatcccgtctatcattgatggacatttaggttggttccacatctttgccattgtgaata

SEQ ID NO: 7565 - DNA, 1325 bp, Homo sapiens
tgtacatggtaggatttttctttcatttgtgagggtgtttctttactgcttttcatgaattgggatagttcttccagaagagcttttcaaagatttttcttctcagttgttttccacattctacaactgtaaactgctaattttttgtggcttcttgctctatacaccatgcaatgcataatttatcagtttgtttaaaacattagaaagggagaaatactcagccttgtccttgaacctgagttgatactcgatctatctccatctgcattgccccctttttctctactttgtctcttattttgctgtattttttcttcctcagaactctcctgaaaagcctttgatttggtaaatatattttgggattttcagatgttgaggtttattataaatgctttaaattttctggttttattttttttaattaggttttgttgaggaacagagtgtaaaagaaaggatatggttaaaatatgaaaataagtaaaaatggtgcatgtacatcgttagtatacaaatgatatcaaatagtttagaaagagatgtcaaaggctcctctcactgtaactgttattacatttcttgtgatttgttccaggaaaaaaaaatacatattttggcacatatctgcgtctatcttgcttttggctttttacatttttaataaagggattaatatacataccgttccttagctttttctttgtactttacctatttttgagatatattcctgtcaacacatacagatcttctttattcactttaatgatggtacaatattttattttatgggtgtataataattgattttatttttgccttttttctggatgttttaatagttgccattggggggattgtgtttagctattggatttattgcagtctgcctttctgtaaatattttcgtataaatatcttgctgacatacctgtagggtaaattcctgtgagtgggattgctacatcagtgggaaaatacatttcaaattttgataaacatcaccaaattcttctctggaaaggtcactgattgtttgttttttcgagacagggtctcgctcttcacccagactgcaatgcagtggcacaatcatagcttattgcaacctcaaactcgtgggctcaagcaatgctcgctcctcccaagtagctaggaccacaggcatgcaccacgatgcccacctagttttttgtattttctatagagatgggggtctcactgtgtttctcaagctggtcacatactcttggcctcaggcagttctcccacatcagactctcaaagcactgggcttacagctgtgagcctggcctttt

SEQ ID NO: 7566 - DNA, 1060 bp, Homo sapiens
gccattcaggtggggaatggaatttgaaactgtcaagggtgactgagccctgattctgagaaagttaaacctatatttaaagtggatgtcaaggcaacataaaatggtaagcactcactatccctaggtatggtggtagtaatgtgccctcagctttaggggaacaaggagtggaccagcgggttatttggcagagggtttttaagatcggggttgcagaggtagaggcaaggctttgagtgcctataaatgtcatggcactggacccgtagtttcaccgtcacttttttttgataactatatgttgagaatccgtgtactttaaattttaattttagacaacaaaggcatcctagaaccagttatcctgttctcttgtgggaatgttctaaccacattggtcattgtgttgttcttatttctgaagcataaggattattggaaacatctttcaagtgctttgagttatgattgcagccaaacatatttatgaagccttccttcttcctggagagaacacctactctgaatgttaagcttggctggatcctaaacaatactaacaaactagatcatctctctttcctgtctgtgctgcctttccctttctccatcatagatctcaaagtatctctctgtgtccacacacacacaaacacaattgtattttttagactgcagtgttaagtttatggagttgttcatatacacttaagctttatgtagtcttctcatgtaaaagagctgctgtccttgatataatagccaacatattatcagttcagccagtatagctcattgtaacaattacataaatataaaatatcagtgctcttaaaaatacacattaatttacatgaatgtttgaggaaagctgcccgtaaagcaaattgtgttccttttgatctctactataaaattatttaattgactgagaggaaaaggtttatgacatgatggcatgctcgactttgacatttgtcatgtgatgatgatgatgatgtgttgagaggcatagagggaggggcccgcctgctggaacagcggctagaagacactc

SEQ ID NO: 7567 - DNA, 1027 bp, Homo sapiens
actctcatcttatttttaccctttcagtgttgtcatagggtcaccattgacattctgggccttttgcctggaagtacctattatgctgttaatttttcaactaactatgtttcatgctgtttgtaatgaaaagcctatgagctctgtggctccagcactccccagctgcgtgacattgggacgctgtgtagtctttcttcatgtttgctcatctgtaaatgggctgataataataaatatcacctactttacagacttagtagtagcactaaataagatcatacatgttaagtgcccatccatgcttagcatatcaaaagcactcagtgaagtttatttattataaaggtgagcatagggctggggcactaacccagctttgaatggttagcatgaaaaaattttcacagtcaagagaagaaaggaggaaaagggtatttcatgaaggggaatagctacaagtttttcactagtgatggagcataaagtgttaggagacgaaatggtaagggggactgggagcagttcatggaggtcttgttttatcaagcccagaggctcagactgcatttctgggaaatgggttgcacagaagaatttgtacctcattagggtgctggacacatgcagacttgaggaaacagaattcaacaagatctacaggagacattgtgatctgtgaaaagactgttctaagagccccaagaatattaggaatgcctggacagtgaggggtacaaaaggacaataaagcattttgtttacatcagatgctcacttttaagatctaggggacctgaagtagaaccaaagaaaggtataacttgtcatgcattgattccttttgagaaaatgaattagatgagctgaaatgtggatttctaatatgaagaaattctgcccaagaagtagcaagagggtgtcccacatttcagtctgcaaactgtgtttggaatgctgcgtgtgtgtgtgcgcatgtgcacacgtgtgccttgagcacaaatctactggcttgtgcagggaaaga

SEQ ID NO: 7568 - DNA, 1048 bp, Homo sapiens
tggcaagatgacctggcaagctgagctaggtgtttgccattcacacaggaagggggccttcagggaagagctcgagtcatcatgaagacagagcctggatggtaaaattaatgcccctcatacagatgttgagtcacatgatgtattagatagtcaatgaaagatgaaattatgttggtataccatacaaggcagtaatgtacagtactccttaagaaacattttcaataggagttttatggttgcttgaattaagttgctttgagaggtaaaaagttgcagtaagtgctataatttagaaaaccagagacttacatggtaacatctctactggattaagtcttcatgagtataacagcataagtattataaaacttaactagaatcggaaaatagaagataaagaattagtgttttgtttggatcttacctttttctgtgcctgaaacccccacattttcaaaagtcctttcccaaggtctccaacgctggttggtcctgttgccttgtggagtttctaattgaatgtatctgaagcacttcaatcagagctgaatcttggtcttccatgctgtcatcccctgtattctttcccaaaccaagtttctgttgattctgcctccaaaaagtatctcaaatccaccctcctggtccagtcacctgggtgactgcagttgctattcatactcactgtgactcttttccaccctctttatgaaatggaaatctggtaattcacctccttcccctaaaagccaaaacaaaaaacaaacaaacctgcaggactcaacttttccatgacttcccatgatcttaagttgaaatcataatttcataaccttagtgactcgcatgacctggcagttgcccactaatccccagccctccgtgttccccctcttcaatccagtcatggtggcttagttttggtttctctgagatagcattcacttccactttcctctctcttttttcaaattgttgactttaattatttctttagttcccccttaaatctcattttgtcagagaaagccttaggttagaa

SEQ ID NO: 7569 - DNA, 1044 bp, Homo sapiens
ttaaaatagttttttctagttctatgaagaatatcaatggtagtctcaggtatatccttatagcagtgtgagaatggactaatacacttgtcttgtgccatttttcaagaggaatgcttccagcttttgcccattcagtatgatattggctgtgggtttgtcatgttattttgaggtatgttcctttagtacctagtttgttgagagtttttaacatgaagagatgttgaattttatcaaaggcctttcctgtatctgttgaaataattatgtggtttttgtcttcagttctgtttatgtgatgaattgcatttattgatttgcatatgttgaaccaaacttgcatcccaggaatgaaactgacttgattatcatggataagctttttgatgtgttgctggatttggtttgccggtattttcttgaggatttttgcatcaatgttcatcaaggattttggcctgaaggtttctttttttgttgtatctctgccaggtgttggtatcaggatgatgttgacctcatagaatgagttagggaggcgtccctccttttcagtttttggaatagtttcagtagaaatagtaccagctcttctttgtatatctggtagaattcagctgtgaatctatatggtactgggctttttttggttgctaggctatttattactgcctcaatttcagaactcattattggtctattcagggattcaatttcttcctggttaagttttgggagagtatatgtatctaggaatttatccatttattctagattttctagtttatatgcacagaggtggtttttagtattccccgatggttgtttgtatttttgtggggtcagtggtgatatcccccttatctgattgtgtttatttgcttttactctcttttatcttcttttttatgctagctagtggtctatatggtctgaatttttaaaataatccctttactcttgaaattattttggacacaaaaccactgattctggagtggagtccttttttgttatttaattcctcaaatgttgtgattt

SEQ ID NO: 7570 - DNA, 1106 bp, Homo sapiens
gtgagacgagatcgcgccactgcactccagcctgggcgacagagcgagactccgtctcaaaaaaagagtgtggagacaatatttagcctgtgatttaaaagagatgtaactttcctcttacagcatctgcaatagtgtttttcaaacatggtctaccaaccacctgtgtcagagaggtggtggggggaaggtgattgtggtagtgggtgcgtgtaagagtgcgcatgcgcgcccgtgtgtgagtgtgtgtgtgtgcgcgcgcgcacacacacacacacacactcagagagtgtttgtcagaaatgtaaattcctgagtcctgtagcagatacaccaaaccataatctataggtgtggaggccaggaatctgcattttaatcacataaccatttttgtgcatagttgaatcctagaatctctgatctagagtggtagtttcattcattcattttggtgaaggttgagttggactgtggagaaactgggacttttaaagaagaaagaaaagaaagcgtaggcctgagacatatttgctgatttgagaaaaagaaatacacatgaactagggtggattttttcatactctcctggaagagtctcaaatttcaactcacctgttttgtaaaatgttctgaacccagatgaagatatgctctctggtggctcggagatgtcattgcaacccctccttccttccttgccttgtctgggagtggggtagtgggtgtacttttggggtcctctgtggggagaggtccacttgaaatattagtgagtagagatcagctggtgagccttgaagctggctgtggttaatttccagtctcagttattccaaaagcaaaatatttctctgtcttgcttccttccacctttcagttcagttaacttagttctcctacatcaattgagaattggataaacaagaagcattgcaagcaccacatggatttctagttcattttaagttgacctttcattaaagtgagtgtctgtaatcggtgtctgtggtagctgctttaaatctttcagtatttataaagattaaggatttgttacttgcgaaggtcattgagcaacttcaagaaattggcatcaatgtgac

SEQ ID NO: 7571 - DNA, 1030 bp, Homo sapiens
ctatagccattcatgtcttctactttttgtgtttaaaatgttttaaagaattcagtcatattctttttagtgattctatatggatagttgtttagaggaaaaacaagaattgagaaggctgagaaaataaatatcatagttgttttcttacaaagttggaaactgtaggcttagttcttttgattaaaaatgaaattttctgaaacaaattttttgataggccagattccttgttctgtggcattggaaaaatgaagtctgttctacataatgtggagttatcttgtcaggaagtccagcctcagaagtgttgctttgtcaagactagccaattaaaattcacttgaatagtcttcaagttttatttttagagaggggaaagtactgaaagtataggtaaatttagttgatagaacagagtgccttggttgcaagtgacagaaaactcatttcaaactgtctcaagtgaaaaagtctatggccttaagtaattgcaaatctaaggactggatctgccttcaggaggggctagactaaggatcaaaatgatgtcatgaggattcatcttggctacatgtttttgggctctgaatggagacttctagcagcttcaggtttgcttagttacaaacaaacttcctggtcatgatgagtcatgtgcctcatgctggaccagtggctgtggccaggtatattggcctattcctattggatagccagatcatgtgcttcactccagggcctgaggtcagcacatcttctgcagaaggtgaagcatgaactgatgatagctgggaatggttccctccaagggtgaatcagggcagttaccaagaggattgggggtgctgggaggtacactaattattataatgattattattaatgtatcttttaatggtttgaaaagcattttcagatgtattcttgtttgacctttaggagatattggggaggcaggataaagaagtgattaaaaacatggattctggggctagactaggttcagttattagcttgcatgagcttt

SEQ ID NO: 7572 - DNA, 1034 bp, Homo sapiens
gtctattgtatttcaggcataaaatggtgaaaatcagatatggttcttggtcttgaggagtttaaaagaagctcctctatcacttcttggccttttggctaagatcaagtatagtaaaagagtctcctatgaatttgaaattccattccatgattgtgctttctataaatcaaaaatatgacatcgtggtgtaggggcatcccctgtcagctcttctagttatgcaggtagcgcatttccgtgtgcaccaaccacatggggcttattctcagcatagctgcttttagaataaaaagtataatatggaagtggaactaaaaatcctcaatttaaaactattatgtcagctatctttattaattttataaacttgataaacacttaccctacataatttgattttttgcttccgtaatgaggagtatgtaatgtgatgtttgcacaattactgtagttttaaatgtcctaattgtttacatgtggtaatgccagactgtttgaaggtagccatgtctggagaagggatgagttttgaagtgcttactaaagcaagccaagcatatggtcagtcttgtgctactttaataataaacctcaatagaaacaacagccaaccaagataatagagtttggataataaagtttggaatgcagcataacaaattaatctatctctgtttgtgtgcttatctatttgcttatcaaagtcataaaagtttgtttcttcttaatagaaaatatagaagtatttttttacattaaggaatttgaaacttgtttttaacatcttttacacctgtgtagcattttcatatgtgcttgtatatatattatgggtggacactggggctgtgagtgactgcccattcaccacccctacactgtcctcagaccaatgtaaaggaagcaagtcaaaccatatcagtgaaccatcttcagccatgatgtctgcatcattgccttctttcagcctgagaggtctttcaggaagtgggaatttgtttggatgttatagttgcagttatttagctatg

SEQ ID NO: 7573 - DNA, 1041 bp, Homo sapiens
gtaatctacccatccccgccatggctgatgtttcatggttaggtcagtggatctgatcaccagcctcaccttctccctgatcaagattcacaaatagaccagggctgggcctggtggctcatgcctgtaatcccagcactttgggaggccgaggcaggtggatcatttgaagtcaggagtttaagacctgcctggccaacatagtgaaaccctgtctctactaaaaatacaaaagttagctgagcggtagtgacatgtgccagtaatcccagctactcgggaggctgaggcaggagaatcacttgagcctgggaggcagaggttgcggtgagccgagatcacgcctctgcactccagtctaagtgacagagtgggaccctgtctcaaaaaaaaaaaaaaaaaaaaaaaaaattagatcagtctctgtgctctgatgtgatcaaaggtcttagctgattttttaaacctaaacttataggagaatgtggaaagaatatgactggtactgtgaagttgatgttatataggttaatgtattaaaatcagcattagagagattaaaaatgattcccagcctcataatttgactacctacattgaaactttacttaaaatctcaaagacatgttcagctatgattacagttgtagatctttacacattatagccaattacaccatcagttatctgtggttcttgcaagatggctgtcgactgttctgctttccaatctcagttactatttatttacggtatcttcctcaagtcgtccctgtgtatctaagcattgttttacagacatttgtgtctataaggttgcctatttagagcatattttaaagaaagtctatttaagtgagccatttagggcagcagtggcttcttatactctcatttctgatttagaacaaaaggtcagtgatagcagtaaaggttcttcaaaagatactggcattcagaaggagttgtgtctggaatcacgggtagctcagaatgattgagttttgcttttttattctttggcctctgtatggttatgct

SEQ ID NO: 7574 - DNA, 1060 bp, Homo sapiens
ttattgtgtctacaagagaagtataattactaatagtaattatagtaattggtaataatgattatagtattaatggtactattaagaaagattgtgaatatatgctttcagggagcacactgcagtgcccggctgcctccctggtgtgatgtgttgtttggccatttggctgtggggttggttttaaggaaggcatcatgttcgggagcaggagggtggaggtgatctgtatagtgagacaagcccagggcttggggtcagaagacaaataggagtttaatctctggtgctttctagttgaatatccttgtcagatatcatctctgacgcttagctgccttctctggaaaatgggatccataaaccctgcttacctcacagggctgtgatcaaatgtgatgggtaatgccaaaacagaaggtatcgtcatggcaacaggagtatgactttcaggccatgataccactttgccgcaaacttgtgtgtattgtagttgagtatactgtagattggatctgaatacctttgctggaaaggatttgaggaggttcagcaattcctgtgtggttctaggtgggtacgtggatgccttctaagtgtggtctcagaaatccaaggtcagagtaaatctcaagtcattgaagctccagtttttgttagagtggatgtttgggctacatcactgccctgaaattgctgtgattcgacaggaactgaggcaaaccttcagctataagatgaagacctaatgcatggtgactatagggaataataatgtatatttgaatttgctaagacagtagaccttatgtgttctcaccacacacacacaaatggtaactacactgtaaggctcttttagaatttatctagcaagttttcttgtttttaccagaaaactcctcaaaaaaaagggaattgtatgaggtgatagatatgttaagtagtttgtggcaatcatttcacaatgtatacatatataaaaccatcaccttgtacactttaaatatatgtaatttttatttgtcaatcatacttcaataaagttggagggaaaaaa

SEQ ID NO: 7575 - DNA, 1411 bp, Homo sapiens
cttttctctcccagcactgtgggaggctgaggtgtaagggtggggtggcttcagcacagtgtttgaggagtgggcactgagtagcgtcccctgaaatcttgtggtgtacagcctgtgctgaccgcccaaggctgctctgcactagccttttagccagatgggttttctttcaaggacaacttttctttttcttatttctcttcctcctcttctcttacccttttccttctctttcccctcttgctcttcctcctttatttagaaaatgtataagttaaaataatagtaataaccctattacacatagataactgctgttatcattttggtgtatatctctctgatctattttctataaatattagatgttcaccaaatgcacattttgatcaaatgctgaaaggtggaatgctgaaaggaatagtattgccaaagctaaatcttgctgtcctagaatggacttctgggatacaagtacaagtttgacattttataaacattattacagttttgttattaaaatagaatttggcattgtggtacagggacttgatttcttagcatatacgatcagtgctgttaatgtttgtgatactgggtggatgttgactttgatctgagttggaggagggaggagcaaggcctttacttatttgtttagtttgtttttatattattatttttgctggctctgtccatgtaatacaatatgagtggtagtttctttccaacttattaatcttttgtcatataactgacttgtcttctctgtgactcctggacctgaagattttcttggcaatgatgatgtggtttcattttagtatttcctaaccccagctttgtgcactgtttgaaggagaatatatctggataatctcagaagcagaagtgaaattgttgtccttctacacatttttccctgatatttttgtactcacttgctgcttcacacaaccagttgagagaaaaatgcatccttaagctttggctctaaaagtgtggctgtagagaaatgaaattggctttcaagataacagagctgttttggaatctccatctgcatcttagctttcactgcctgcacactaatttcaatatcttccctggagaagaatgacagaagaatctttgcagaggtaatatgtgacaaatgtttgccctctcaaggtaccctcagttttcaacaattgactgctttccctgcaagcaaccattgactgttagtaagcatgctctttaatattgttagtagacttgccatgtcaatgctgttatacacaaagtacaatgctaggccaggtacagtggctcatacatgtaatcctagcactttgggaggccgaggtgggtggatcgtttgagcccaggagtttgagaccagccttgacaagatagcagaaccatatct

SEQ ID NO: 7576 - DNA, 1030 bp, Homo sapiens
ataaaagtctcattcaattaatataaatatttagttttggtttaaaagaaattatttgattcagagtcatctcaagaatgcatccagatatgggctggaagttgactatcatgtgtatagtcatctaacagaaacacaacgtattcctccaaagaagtggtccacaaaataagccttacattgctaacttctattggctgggatctggtaaggatctagatccacagccgattagacatggtgattgtgactgattaataggaaaacctaatgtgcttagaaagcgggaacatgaaataaggccaagagcagagaaagaagtctgaattttcacttgggccttctgaagtaattaacaattaatatctaattcataccaagttcttctttggaaaaactttttttccttatcattagtgtttttgttctgcatcggccaccttgactctctgaacgttaatgtagaaatattgaaagtgttttctcctcaactgggcagcagtaaaatggttatctcttgggactctgtttctattttaaactaagtatgtaaatgtggtctgtggctcattttgtctgctaattacatgatagactcttccattaagcttgtacctaatatttgttctaaagtatgtgcttgcactttcatattttttacaaaataattgtcagttgccttattagaaagtgacctttttcttgtaactcaatctacacgcgtacatgtactttggaaacctgtataggcaattcctgcatcagttacttcttcatgattgattttgctgcattacagatgctccttttactcatttaaagaattgacgcagatgtatattcccacacattctgtgaaatcactcagaaatatctacagtactgctggcctctgattaaacaaatttaagtattaataaaatatttgccacattaagtaattacaaaaatgtgaacattttgattatgtttttaaaatctatccttattcataataaaatcatatggagttacagttattatgatgcat

SEQ ID NO: 7577 - DNA, 1028 bp, Homo sapiens
aattatgaagcaaaattatggaaaagcacttcatactattagaaacattactgataatcactgcattaaatgttgacagtactacaaatattaattattatcatggtaagttgaagaaatttgcagtatgagaagttcttgaattttcatcatgaatttgcaatatgaaaagtccttgcaaacttgaattaactttgggtactgtaggattttcagactgcctacgcaggaactgccagttattccttttggcaatatataaaagagataagaagggattttaaggagaaaaataaaccatgaagtagaggatatatcctcaatgtagaggatatgccaatacagctttggaataaatacagggaaataaagctcataggacagcgttttgctttcttttgatgcacttttagctaaatgtatcacaaagaatgttaataataattactgaactgtattggacattttatatacaaggtactttgttattatattaaaacatctcataggacacaagctcataggacagtgttttgttttgttttgatgcacttttacctaaatttatcatagagaatgttaatagtgattactgaaatatattggacatttaatgtacaaggtactttgttattatattaaaacatctaattagatacaattattagtgtcattaaggttactaacccataatgtataataaagttggccaaaatctcatagcttgcaagtggctaaactgagaatcaaacccaggacttctaaccctgaaagctcaggaaaaactgttatatttttttctatatgggttaaacaatacatccatgcattggagaataattgttgataaatattttcaaatggacataatgttccccttcaattgtaccaaactgaatagactacataaaatctatctaaatattttgtttcccatacttccaggtaaacatatttgtaactatgttggaaaatagatcaacaattgcaaaatatacattcaaaaggccattgaaatttccaattaa

SEQ ID NO: 7578 - DNA, 1050 bp, Homo sapiens
gcaacagagcaagactctgtctcaaaaaaaaaaaaaaaaaaaaaaaaaagaaagaaaagaaaaagctttataacttgccttataatgtttctggggagaccagggaaggctcccaaacaggtctgaaaatggcttgagacagcagagaaaggaaactagcttcgtttttattgtgtttagggagtggagctggggacaggattcttgtctgtatgtgtgttggggctttcatggtttgaaattagcatgaggtccaaaaaatggaggccctgactttcttatctgcttacttagatgtaaggcagaggcgaagatggagtggtggggcttgataaaagttagcagataaacaccagaaatagagtcagatccgttgttatccctctgatcatattatttataattcttattatgatactagttgagttctttaagatgatagactcaaattacacaattcatattaatctattatgaaatttaaattaggaagctgcaaaaaaagaaactcaatggttgtttaatatgatgattgtcttttcaaattatcaaaaataacaaaaggccaaatttcctgatggcgcttatataggagtgatcacataaacaactgttgtttaaaactaagatcttgttctttaagtaatgttatgttgaagctcatttttattaagttttctgaaggggctagtaaacacaccaaatctatcttactgaagattctaaatttttgtttcaagaatcatacctggagaaatcctatctgtggccttgtcaacaaaagttatactttaagaaggattagtctaaaattaaaattgatcacagacataaacactcaatcgctgctgagctgatcatggaaaactcacatgaactgttgagattaagtcccacccaacagttttaaagttctcacaaaacgtaaatatgatatcaaatgataacctacctaatgctaccttttaattagatttccaatcagaaaacaaaagacaacaaaaaccagaagataaaattgtatttgcaaaattctactaatcctaatta

SEQ ID NO: 7579 - DNA, 1048 bp, Homo sapiens
atgtatatggaaaggcaatggaactaacacagctgaaacaattttgtaaaataataaagtggaagatagcattctactaacttcgtctaattttctagtcacgataatcaagacagtgctgttttggctgaaggatagacatatagttcaataaaacagaacagagaactcagacagttccatgcaaatttccaactgctttttgacaaaagtgcaaaagcaattcaatgtaggaaagatagcctttttaataaattttgctggagcaattgaacatccatatataataaaatgaatttcaacagaagtctcaaaagttagtaaaacattaactcaaactggatcatggactaaaatgtaaaattataaaacttttagaataaaaacttagaaaacatcctttaggcaatagagcaaagcaaagtgttcttagacttgatatcaaaagtataatttataaaaggaaaaattgataattgggcttcatcaagattaaaagttttgctgtacaaacgatactgttaaaaggatgaaagaatttgaagactgggagaaaatatttgcaaaccacacatacaataaggggctaacatctagaatataattttcaatgtgcaactttaaaaaagaaaaaaaaaacaattagaaaatggggcaaaaatacagaaataggtaatttgccaaagaagtcataagcaattaagcacatgaaaatacattaaatgtcattagccattaaggaaatgcaagtgaaaaccataaggaggcatcgcttcacacctatcagaatggatacaataagtaacaattataacagcaaacactgggaaggattcagagaaatttactcacagtacattgctggtgggaatgtaaaattgcattaccaacttggaaaacactttgaacagtttgttgccaaattaaacatacaactatcatatgatacattacagcactcctgtgcacttatcctagagaaataaaaatttatgttaatgcaaaagcctgttcacaaatgtttgtttatggtagctttatacataat

SEQ ID NO: 7580 - DNA, 1166 bp, Homo sapiens
aatctagatggaagttcccaaatctcaatttttgatttctctgcacctgcatgcccaatgccacatgtaagctgccaagacttggaaactgcaccctttgaaacttgagcttgaactcaagcctgagcttcaagttggccccttttagcaatggcttgagctgaagcagctgggacacagggcgacttgtctggagtctgcatagagcaggagtccctgggcccagtccataaaaccatttttcccttctaagcctgatggcaggggctgccttgaaggtctctgacatgccccagagacattttccctattaccttggtgattaacatttgaatgcttgttacttatgcaaatttctgcaacttgcttgaatttctccccccccattttttttttctgttgcatcatcaggctgcaaattttccaattctttatgctctgcttcctcttgaaccctttgaccttctgccagataccctaaattatctctcacacgttcaaagttccacagatctctagggtaggggcaacatgtgaccattccctttgcatggcaatagtgttctttactccagttcaacaagttcctcatctccatctaaggccacctcagcctggactttattatctatatcactatcagcattttgggcaaagccattcagcaagtctccaggaagttctaaacattcccacatttttctatcttcttctgagccctccaaactgttccagcctctgcctgttacccagttccaaatgtgcttccacatttttggatatctttacagcagtgccccactacccagtaccaacttactgttttagtctattcccattctgctaataaagacatacccaagactgggtaatttataaaggaaagaggtttaatggacttacagttccacatggctggggaggcctcacaataatggtgtaaggcaaaagaaaagcaaaggcacctcttacatggtagcaggcaagagatcatgggtaggggagttcgcatttataaaaccatcagacctcatgatacttattcactaccccaagaacagtgtgggggatacccctcccatgattcaattatctatacctggccttgcccttgacacatgaggattattacaattcgaggtgagacttgggtggggactcagaca

SEQ ID NO: 7581 - DNA, 1033 bp, Homo sapiens
ttgtgtgattaaaatttttaaaaatactcatggaaatttttgtattatttgtaataattgccctacattatcaaaaattccaagcagacttcaaagaccttgttttgacttaggcttacaattcaattgtatgatataagaaattataatattataaataaaaggttcaagttttagctgatgagaatcaaataaaaataaaaagaaatataacattttgattttcaaattgcaaaacatgtattaaacaattatttctataatgactcctgcccaggcagctctctagttgacctgtgggcacagacttaaataattttgtttaaaatatataaaacaaagactttgacccttcaatttcatgtgtagaaattcaccaatgaaataatcagattcaggttaaatgtgttttcaatgaagctattatttataacaatgcaaccctgggagcattctcaatgccctagggtaattaatttacatgaaatagaaatgactgcctcctattgctgaagtacatgtgtagaactaaaccactaatttttgtcctaaaaagaattaaatatacaatgaaaaatagtatgtatttatttgtgtgtgtataatttatggttgcttaagccattgataattagttttattgtacttatttatgtgtttcaggaggctttaatgttaataactatattagcttaggttaattatttctgtttgaagtaaaaaccaacagttcactagctcttgacttcctaaggattacctcagcatattttatagctttgcatttaagtaaactgccttcccctttatgtaaaaaaacttccactatactctttttcttaaattttttatttatttattttttatttgccagtctccctctatttcccaggctggagtgcagttgcacgatctcatctcactacaacctccagctcctaggttcaagcaatcctcccagcacagcctcccaagtagctgggactacaggtatgtgccaccacgcctggctaattttttttattttttgtag

SEQ ID NO: 7582 - DNA, 1025 bp, Homo sapiens
atttgtctcctgataaacctgtctggtaggtttgttgctgtctctatggctttggttcttgctggactaagaattctttcaggtcagtcatttttaattattttttgaatcttaatgtctagctcagcactagactcacaaaggctacaacctcctaaaaatatcatggtgtattaaattagctgcatttatttatcaatttttttcttgttgatatcctttagaaataaatagaatgtaataaatagaatgtttttacgtggatatatgtttactcattatgttccaacttggtttaaatccattgcttgtctagtactctcaaagtcttgggagaagactatgtattacagaaatgatgtgtcagaagggcatcttcataagaggccctggtgatatgagagaagtggttgaagattttggaaggagagctgcatgagcacaggtataatgacacattatcaatttggcttaagtttggctttgcctcatcatgagggatttggaatttggatgaagcatgtgaaaagcctcctcttgctctgattctacttagcatcattctctagaatacatacagctttgactattttccctcatgcacactgttcatacatgtctatgtgtctaaatattactgacctaactgggttgtaataatcttgaagatatcctttggttttttgatttttaagggattataaagtagtttttgtatatatttccagtttaatattttctacaaaagagtgaaagattttaccccatatttctcctatgcaaaaactaagttcttagcatggtgcctgccatatgggtgggtgtgcaggtggaaacaagaggaagaaaacttgaattaaaatgagaaatgtgtggtttcagagcttggacatttaagagctagagaatcttgagtaaatgcatttctctataagtgtagaaaaataataaatatgtgccctatacattttccaggtttgttatgaagatcaaatgggagcatggatgggatgattatattaagt

SEQ ID NO: 7583 - DNA, 1033 bp, Homo sapiens
acgtggtgtgataaacaatcacatgacctttagtggcttaaagtaagttttatttttcactcctataacttgtccatcacattttggtggcagagacttgaaggggaaattcctggtctgtgtagtcactcagccaacatcacaatagtttacattcatcatgccagagcaaagcaagctgtaggaggactccattccaacaaataagagctatagcctgcaagtggccagaattaatcacatacccttatccaaccccaagatgaccaggtttggggtcatactatgtgtctgaaaacaggatgaggtgtgcatgtaacaagaaaatcagaaatatttgctgaagttttaaagattgaacacatagattgttaataaattatacccaaacaatattgaataaccacctgggagtttccatcactaattttgaagatctcatgttgaaaagttggaagaatgatattaaggaaggatcagaaactcaaaatgccaaaataataatatgtggggctttgttttgaatgtgtttgtataggttattttaagctatattgtggaattatatttttatattacataaaaccaaactgaatttttctcataagaaaaatagactggaactaaaggattttactttaagccttttactcccaccgatatgatgaagaatcaattttatgattttgcttttgcccttgaacagcacaagagaccccctctcatatatcagaccttcttcagacagcctcaatccattttcttgattccactaaatcaagtatgcattgtgaagtgagtaatctaagatttattattgtcagtgggttcaaaaactcctgctgctctgattctcacaccttctagggattgaagcagaatttgtcatgtggagagtgcttagtgcctagtcgtcattatttcctggtcttcaaaaaactgttggtgtttttgttaattttaaaataaaatgtttcaatttgctggatggaaaatattcgcacacattttattttttatttaaagatttggt

SEQ ID NO: 7584 - DNA, 1043 bp, Homo sapiens
attcagaaattgaagagatttctgagattaaaaagtgtgttaagatgcaatccaacacttgcttataaagacacattttaacctgaaaaatgctttgtatatcatttaatatccaaaatttactatagcatttttgtgagaaacaaaaggaaatactgtaaaatgtatcgtttatttgaataactgagtctcttttgtttaaagttgaaaaaaatacatagatagatatataaatccaaatatatagaatttttactagtataagtccccttctattttagagcagacttcgtctattccctttaaatgtaaaagttgtctatcatagaccttttagaaaagtctacacttggaacatagaagcatcctaataaaattcacttatatagtcctttaaaatatgctaaacattttatttaaaatatttaaaatatgctaaatattttatttctacagcataaagtccatgaaaagaggaatctttatccctttttttttattgccaggatttgaaaatgtggaacaaacaataagtgctcaacaaatatgtgaataaatgaataaatgtaaattaattttaattcctatcagatttataataattggtagaaggcatttatattcttaataaatatttttaatcttctgctgggtaagaattatataaatagtggtattaacatataccctatatgtgttttacaaactaaactagtttttcataagatttagtttattcattaatgatgcatatgttagatgacggtcatcatttataataatgtatgaatctcctgcagcttcagggtaactagtggttttgtttattctttcaattatacagacacagttgcagttcaatttgccgtgtgtgtgtgtgtgtgtgtgtgtgtgtgtgtgtgtgtgtgattattgttgaattaatcttttgtcaggaatgaaacttagagagatgtatgcagcaacgtgtactcccaaagtaaatatggctgaaattttctcaaacaatactgaaaatttcaggaacatctcgtattattctg

SEQ ID NO: 7585 - DNA, 1032 bp, Homo sapiens
gcggagaattggccgggcgtggtggctcacgcctgtaatcccagcactttgggaggccaaggagggcggatcacgaggtcaggagatcgagaccagtgaaaccccgtctctactaaaaatacaaaaaaaaattagctgggcgtggcggcaggcgcctgtagggaggctgaggcaggagaatggcgtgaacccgggaggcggagcttgcagtgagcctagagggcgccactgcactccagcctgggcgacagagagagacaccatctcaaaaaaaaaaaaaaaaaaaaagaaaagaaaagaaaaagcggagaatttgttttccttatgttatgatttatcaaacttcagtaaataatgctttgaatatgttaaatatagaaaaagagcattagaaaagattatggagcccagaaataaaccacacatatatgaggacttcatatacaacagatagggcactacttctcaacaggagaaaaaaggattgatcaataaacagtgcagtgacaggggttgtacatatgagcaaaataaacaagtatccctgccttacaccaggcacgaagatacatcccaagtgaattgaaatcatagaaataataatataaatatttacaagaacgtttagggaaatgcaattatgttattggggaagaagaggatataaaaattataaatcataaaaatgaatgatacattggattatattaaaattaaaaatgtttgttaatcaaaagattacacaaaacagaaaatgtctcttttagttatttatttttattttttaacttttattttaggttcagggatatatgggctggtttgttatatagctaaattgcatgtcatcgggatttggtgttcagattattttgtcacccaggtaataagcatagtacccaataggtagttttttgatgctctccctcctctcatgctctgcccttaagtgggccatggtcgctgttgttactttctttgtgtccatgtgtattcaatgtttagctaccacttacgagtgaaaacatgcag

SEQ ID NO: 7586 - DNA, 1047 bp, Homo sapiens
agaggtgggtaaaactaatcttacagtcagagctggttgtttcagtagctattagataaaactgcttttaggtaagaacaggcagtttcagaaattagacttgtagagaattacattcttagagtaatgttttatgccctgatatggtttggctgtgtccccacccaaatctcatcttgaattgtggatcctgtaattcccatatgttgtgtggagggacccagtgggaaataattgaatcatggggggcagttgccctatactgttctcatggtagccaataagtctcatcagatctaatggttttatatggggaaaccccttttgcttggtcctcattctctcttgtctggaaccttgtgagatgtgccttttgtcttccgccatggctgtgaggcttccccagctgcttggtactgtgagtccattaaaccactttttctttataaattacccagtctcaggtatgtctttatcagcagtgtgaaaacggactgatacatgcccggagtgctttttactcctggcctcttgactctgttacagttagttatgtaaagaaagacccaatcatatgatcaatttttacagtaccaattatttatttccccttattagtttgggtgtgtgtgtacatttctgacttcttttctgaatttagatatttttcaaagaagcagcatatttattggcctcagtgtttttctctattaaaacataccattttgcttatgtctttctctcattttgtttactttgccacttttctgaattgttagttatatatccactaaaaatccacaataactacctcattaatttgatcagttggcttttctatattcttatgcatttctcgtccacatgatttgttttgcactaagagaaatgtgtcaaggttgcatataactagtgcatttctgttctccttttatttattttaattgtttgacattatgaagagtattcctcacagctgtgttgtttggtgtcgtactttgttccattttattatttgatgtaaattataacttgtcagatatccct

SEQ ID NO: 7587 - DNA, 1049 bp, Homo sapiens
actacaggctcatgccaccacacctggctaattttttgtattcttagtagagatggggtttcactgtgttagccaggatggcctcgatctcctgacctcgtgatccacccaccttggcctcccaaagtgctgggattacaggtgtgagccaccacgcttggccccaaactgttttattttagaggaagagggaatgcgacacacataggccagggcagtgtggcataatgaaaagagcatgggctctaggttcagaaaacccatatttagacccgagttgtgctcattcctgagaacttcctggcctatcatgccattgtagctctctgaaatctcctttgcaattctctatgtaaatgttagagttagcttatatggtatgtcaggatcatactatatatatatatatatatatatatatatagttcttaccccttcttccatgtatctaattcttaaaatataattttcacatgttttattcatatttgagagacctggaagaacatttgtgtgtcagaggattagaggtgataggtgatatgggagattgcttagctggataatcggaaccagtctcttttttagtgtcaatagcattgatgtgagctcacacaagacaaaaatagattctacagtaacacatataccttatcaaacaactaggaaagtgccagtgcttgaaaagaaaacctggtagcagaaagtgtgtacttcttttaagtgaccatatcaagactatacaatagaactactgaaaattgcaatgaatttgaacaatgtaccagtaaaaaaaaattgtacaacatttgatgtctttgataatttgcctttagtaccaaaagagttctgatcatttaactctgtaggtaaatgccggagagggctcaactacactggtattaggctattaggtgcgttcctgaagatttcagggctgtcaaactcagcagatgcctgtagcctatttctaactttgctctacttgttgtcttaagccatctcctaagagtgagtgtaatctgttatccaaagtgacagtgcctctc

SEQ ID NO: 7588 - DNA, 1042 bp, Homo sapiens
tttggatttagtataacatataccctttgcatttactgcagttggcaaactcagcaaccttcaaggcttattaaatttgttgaaacctaaggaaaaggacaaaaatattgttgtattgatcacacaaggctgctgatgtaattaagtttgacccaattgaaaaaaagtaatgctggagttaagactaaataggcacaatatatataggaacatggctttctcgaacagtttaattttcagtgttacatacatttcctttggattcatactgtttagcaacctgtgaggacaattttactaatgaacataactatgaatgctttaaagcaacaatggaaacattgatactccttgccatactcagaagaagttataaaatttcctggccagaaaaatgtcttatgctccaattctctttaagttgttactttctaaaatgagtgaaaggaatttgaaagttttatttgtgcattgtatgtgtataatgtactatgagaaaaatccagaaggacctgtggtttatttgaccaaaaggatattaagttccctgaattaaggaaaactgaatgtgatttgtaacccaagtttggtcatataaatgaatacatcgtaacgacatgaacatatatgtcatagattattacaaaaattcactgaatttggaaatatatatgaaactctgtactatatattttatgtccataaaaatgcattatacttatcaattagtaagtggttagacctgtgggagtcaagctaggtaaactaatatctatttacccttgtctcatattgtaaaaaaaccccacaaaaccacgactctttcacagccataatgaaggtggtcttgaccattaatgggtgtgaccgaattctctaaagttggtagtggcatagtaaggatgtttctatggtaaaatagtgaatgcttcattagagacaaacagtaatttcaaccagatgaatgataatcacaatataattttgattatatttttgacattgtctggtgggttttctgttatttgtgtaagtgagaaat

SEQ ID NO: 7589 - DNA, 1048 bp, Homo sapiens
tttgggaggccgagtcgggtggatcacgaggtcaggagatggaggccatcctggctaacacggtgaaaccccgtctctactaaaaacacaaaaaattagccgggcgtggtggcgggcgcctgtagtcacagctactagggaggatgaggcaggagaatggcgtgaacccggtaggtggagcttgcagttagcgcagaccgcgccactgcactccagcctgggcgacagagcgagactccgtctcaaaacaaacaacaaaaaaaagttcatgtgttttttctccttttcaaatgtatatgttggattctacctattattagagtcaggattctggtagccattcaaaaaaaaaaaaaaaaaaaaaagctaattcaaaactatgattctgaagaactctcttccaaatagcatagcattaacatacataaaatgaaaattgaaattaaaaactaggagaaatgtgaagaaacataatcataatggaaaaacttattattctcaacatgttcctgattaagttgaaagcataattggcactgtagagaaatctgaaaaaaatatttaatttaaatgggatataagcaaatttaatagatacatgccttagatgaggttcctttaaaagcagagattaaaaaattacttggctatagttaatttatttcagagatgatctcagaaagcacaaagagagagggaaagtaagagaatggagacaaacagtaggttgtactaacgagcaagttaccactatgaaaatctggaattcaaatgaactgagaacactctgagaaaccctattgtagcctgcttcagaatatctcaccagacgatggggaaactgggcataaaaccaccatcctccttccatattggccgtgagtcacctttcacttttcccagggcataaacacatctaactttagtttggctcatttgaaatgggcaagatccccaggttacagcaaaaatagtcctgcatataaggggagaggcaaagatttaagtagaagttgtgaacttggggaaactgtatctcacagttgca

SEQ ID NO: 7590 - DNA, 1049 bp, Homo sapiens
ataccaattttaaaatggtgggtgggatgtttgtgagttggagaaaattacaatgtatttaaaatctaagcataaattggcagtgttttatttggaaatgttacctttaccttgatattagccaccataaaataaattgcacattagatttgatcattcctgcaggactgaacctaactatattttaaataaatctgaaggctaaccattctctctctaaaattaaatatcttattgattatgactttgaatttattaaaatcttatgttcacctctttttaacttgagtataggcttaattatatacagtcatgaagacaagtgtcataattaaaattacaatgtgataggtatagtcattatcacagaacagactctaaaagacatgtaggctctggcaatagatgctatacatgtgtgttttcaatactcaaatatatgctattggtgatttataggaaaatctaataagtagccaactgaaattaaatattgcatgttattgtgccatcaaatttcatagtagcactctagcagtaatcaaaagtggaatgacagctggatttaagcaggctattgtcagagtatattcagcagtgagacaaataagaaagttgtgactgctggctataaaatgcttaaatagatgtgcctcagatagatgctatgagaggtagagaatgaaggaaggaaaggaaataaacacacaaaggaaatgggtggattctttgagtgttgttatatacttgataaatggatgtgcgagagttttagaattcagggagatggtaagaaagaaaaatggtgactgtaaatgaagttgaaagaatctgatgatgacaaacctcagttgtgcttatgagattgtgccccagaagtgggtgaaagtggaagatatcaaagctgatgtaaataaaagctgtcagctaagtttcaatgctctgaatgtgggtgaataagtattccactgaagcaataatgaggacccataaatatcagaataattggtcaaacaatgtaatcataaatgtagaaggcatttggctta

SEQ ID NO: 7591 - DNA, 1041 bp, Homo sapiens
acataggttagactgatattatccacatcaacttaattgttttcaatgtacgttttttagctttctaaagtaaagtctagagtagcctttactctagggctaagtagctccactacaaatatgtggctcttctgaggtccctaggacaatccgcatatattcaatgatgtcactttactggctagtggatactcaaaagatttgcagcactttgtgagaaaataaaattatttagcttatacattcatggtgaattttctttatcaattgttccttgcccagactcatggagttttgtgtgcagattgttactcaaccatagactcatggctgtgtgtctgaagctctttgtggaactctgtctctttatagcttcctcttcttcatttctccgtcttgcaaattctaggaaccttagtgtccctcaactctgatctctgcctcctaagtgtggcaaaacctttgattcagttagtgttttctttctgaattgtagttgctaaattgcctcctgacagaaaactaggattatatagaacactttctgtttatttccctttttacatgcatgacagtcctctgctgcttgttgtccaatgtctgtaaattgttgctttgtttatttttcaaatttttttttctgtttgttttgggtggacaagttttataacagttaaaacttcatgggtaaaagcaggtctttaggtagaaaaacaatttttgagttttcggtaaacttttagtttatttttaaacttggacacttctttctaagttcctttgctttaatttcttttacattggggagtcattaattttccacatttcacataaagtgttggttttttaaaattgtttacttgtttgagccattatttgtgtatattgaaattgataccagaataacctaatgcattgcataatatttactacccaagccagtataatattttgatgctttagaggtggcagaaaaatagaagaccatgtgtttgctgtctgtgtttaaatatgagctttaggaattcttacagcaatact

SEQ ID NO: 7592 - DNA, 1087 bp, Homo sapiens
gctctcttcccatgctaatttcattgaaccaaaggatagcacagtccttacagaatgcaggcatgtatgcatttctgttattttcttaagtcatgctaaaatttatggtagagccaaaacatgtaaaatgtatcccactttaattgtggtctaccccaccaagtcataataaaatctaattttaaaaaattttcaaaaaataaaatcctaaataagtgtccgggatgttttttctaaaataagtagggtaacatttgtccagtttgattatcaaaatcactcaagttacaagttctgatattatacctcagtttatacatgtagatataccttaggttatttttatctctgaaaagtggcacaatgattacatgtttttttaattagccagaataattttaatttggatctcttaaattgatcatggttaagaaaaacacctcagctattgctcatgtctaaatctgaaggattccacacaacgaaccattatcttttctgtgactaagctttagtatttagatatttgtggaccctgagttattaagatgtcaaattatacgaatcattcaaattcataaagacccaaattggtcactttctggaccagtttttcccaattatgctatatgaaagtgtttatattcaaatgggagatcacgccattgcactccagcttgggcgacaagagtgaaactccatctcaaattttaaaaaaattaaaaaattaaaaagaaaagaaaagaaaactcaagttacttgggtttctttatttttatttttgtaacattgattttatagcttagattataatactttaagaaaggatatagaatccagtggtttccaaacatatctgcactcagctagtttatgtgtgtgtatgtgtgcgtgtgtgtgtttgtgtatgtgtatgtgtgtgtgcatatgtgtgtgtatgtgcatgttcatgcagatgtagatgacagccacttacctcccaagaattactgtgcattatattatctaaaagtagccacatattttatgattgtgatagaaattaatacttgttgaatgtttatttgcctgatacatggcaaatgct

SEQ ID NO: 7593 - DNA, 2137 bp, Homo sapiens
tacataaattttaaaagctaaattaccagaacaaacaaggaaacacctgaatctatacttagcagaagttagttcatcaaatcttccagtaagaagatggacttttaagattaggacacaagttattgaaatatttgaggtttagaaacttttttttaaacaataaagggagaaaaacacgttagctagtgactttacactattgcttttctgaaattattctttgtaaattccacactcccacattccatactttcacaatccctttataaatttacctgaaatattaaataactaaattcgggggaaaaaagtactaataatttggttttgactttaggagtatgttattccaaatcaatatgtgattctaccgtatgaagaaaaaatttgtctttttcccatccaaatattcaaaaaacatattgcagttattaaaacactatcaacattgtgataacttactataagagaaaaccaacattttttagagttaatatattcagttcagtagaaccttttaacacatatctagcagaccacaatacaaaaaaaagtctctgttgttaatctgttatatattatgagaagcaaaagtcatagtggaagatagtggtgaagttttcattttggagtcaggagactcgagttctaatcctgccttcactattaaactgcaaagccatttgtcaatttcttgatctctagttagctatttcttcatgaataaaacggttagattgtctccaaggttccttccagctgggagtttcaatagctctatgatttgtgactcaaagtcacagttgtttcttaagaatcataaataatgctttgttgctgacgtataacttacacgtttagaacccaattttctgcaagtttaaaattaaatgtagattgctgccaaagtccttatcaaactgaatgtggggaaatttgagaaggtatgtagggaaaaacaaaaggtaatatatatcatgacatattaatttcgatgatggttccgtaaaacatttgtgtaaattgttctcaattggtacaattaatttaatgggacagccgtataaatcacatgtacattgctaagtggaggattctcccctaattgaaaaacagaatatatgtagactaaggaatttgattagtaactataaccttgaattcttttttgagttataccccagatattcctctgaatatctggatacaggagaatgctgtaagtctgagagcatcattttccttccacatctgcttggtttcgatttcgtttttaggttttggttttggacacccagtgtttattgtttttaacagcgaactatgtgctgtaatatttgttacagtcttcacctttcaacactgtattgcagcagggaattttatacatttactatttactatatcctaaaatcttctgagggcatttcagatcattgttcttgatccttgattttatttccgaatcagcccagacgtttggatgtgtgcatacctcgacagattggttggacttatctctctttgccttactccaatttcttaagtaattgctttctctgactgtctgtcatgtatttgcatcaaggttactaacacaatagtatattaagtgtattttatgtattttcagcttttgtgttatgaaataaaaatatttttttttgttttgttttgttttgctttgctttgctttggttatttggacctgacatttgaacttgtaatattcagctacctttatgtaggaaaatttgacagcagttttgcttcctagcttttatcctgatcacataatacaatacaatacaacttctcactttacctgatttctttattatagttattaattttattatactaccctgtatacagtatagtgcagtacctaatattcttttgaaataaagtaaaatattcaatataaataacttttgaataaaagttcaatacaattttccccaaccagtttagaaagctcacaactttggaaattctatgtcaacttttaaaatctgaagttatgttcaaagaagttacatagaaaagtaactcaaagttatgtgtatggttaatctcatctgcaggtttatacattctatgtctaattgaagcccacataaaactgtgagtt

SEQ ID NO: 7594 - DNA, 1027 bp, Homo sapiens
tttcctattcgtaacatgaacatttttgtctatgaaaaactctatttagtctggatggggaggagtgattccaataaatctgtaaatgtatagtgaatatttatttgataacaaaaatagttctattactaagtattcaaataaaactgataaacgcattgtgacttaacttagaagtttctgactgtaaagttgaatcctaggatacaaggtaaggagaatgtcatctgtgatcctgcaggctgatatcaaaaggcttgaactgtgcagctctttagagcaaacgattatctgatcctggatgtctatcatttctcaagccatcattctatgtaatgagttctaatttagaactgaagtattaatagttcattcaagtgtgattttatcattgtgaaggcttgaggcctcagatttgcttaattcttaaattatatttaaagctagaattgtatattttatagatagaacaaatcgataaataaaaaacaaatatgtgatatcttcacatctgttgaaggtttgtgatgtcacaggtgtaaaatctctgaaaggttgttttaataaatagtattttattacagggtcaggagagacatcagcaacaaagaaaacacatagttataaatagcaggtgtggccgggcatggtggctcatgcctgtatcccagcactttggcaggccgacgggggtggatcatgaggtcaggagttcaagaccagcctgaccaagatggtgaaaccccgtctgtactaaaaatacaaaaattagccaggtgtgatggcacgtgcctgtaatcccagctactggggaggctgaggcaggagaattgcttaaacccaggaggcggagcttgcagtgagccaggatcacgccactgcactccagcctgggcaacaaagcgagactctgtctcaaaataaataaataaatacatacatacatacatacatacataaatacataaataaaataaaataaataaagtaaatagcaggtgttcagtattggtgtgtaactatatag

SEQ ID NO: 7595 - DNA, 1046 bp, Homo sapiens
tggcatagtcattttatctacttggttgtctagtgccctctccatggtgaatattatttagttagcattaacacgagattaaagagtcttcataacttattgatatttctataagtccatcaaataggttttccccaatgctctttctctcccctttaatctctgtatacccagaccactaagtaaacctccaaactctttaccacttccatatgtcagtgtattttcttacctcggttctttcctcttttcagaaaacatgaatgaagtagtgagtgtccatggggaaaatttttctgacttctgtccttcgggatcactattgatttggctttaagatagcagcaatccttcattactctgaaacccatattaagcaaacccatctattaagctagctgggccttttttttcacctccattacttggtcataaggtaaccctaatgaatgaaagcctgagatgaggcaaaagccatagtaagataatgagagatgacaagggggctatcgtctcatgcagtttatttgtgttctctgattctacttctgcatgatcttgaattcatcacttctggcttataatggaattcacttctggcttataatggcagccctacatttaacttgttgattttgaccaaatccagtttatggtaaccagttctgatcacatagcctaatatcacaatattttccagaaaagtaaaaattagtgaataatctaaaacaaactctacaagtctaatagtcttattatgttatgaaaatatgataaaagaagtttacagatcaatctgcttatgggtgttcactcaataaacttaaatgtttcagcaaatcaaatcaaagatgtataaaaatatattgcaactaggtttgtattttagtgctaaatattgcagattaaaagcagaagacattaaaagatagataagtttggctatattaaaactggtacaattgtgaacaggaatgctaaagaatgtgtttgcacaaaatgtaagcagcagagagatagtcaccagaatatacagagaactcata

SEQ ID NO: 7596 - DNA, 1070 bp, Homo sapiens
aagtccattcacaatgttggaaaaaacatcaagcattcccagtctaagaatactggattgtaaaatattgtgcatatcaagtgctgctttgtgttctggccatcttcctgcattttttccttcattatgtcctctactggctgaggggaaaatcactatacattttttcctggacctaaattattacagaaatttaattcaaatttctaaatgtggcaggccattttacaaatgatacgacatgtttgtctgtaaacatttgaaggaggagagtagaaagttcacatgaatttattttaatataactcttaaatgcattggaaaatggtttgtccttaatggcctacagtgttgtatgagtctaggcgtataatcactgcctgtttaatagttttcctatggtggcatttggagacctttttagtgatcattggaaagtacagtgtttgtaagagtcttttggtactttgaaatattatgtaaagagaactctacaggatgttgaaaaacatttttctttattaggaaaaattctgtcattactgaagaaagctgtgttgagaggagatgcacactttcacatctacatgtgtaagactgaattctgctggcagaaattttggttcagttaactttctccatgaaaaaaaagaaaattcaactctaggatttttttttctagtgagaattatttgtattgcattaacatggaacacaatttttacatttcaatatcagtggtctactttaaaactagtaaaaacaaacctattaactatctttacttgtgataaagtaaataatgctccgatactattctccatgacatcattttattcatttctcacatatgacatgctaatattccgcagctagccttatagtgcttgtcatttataatggccacatatgatttgcttttgaaaatagtttatcattgtctctacatattatccttctttaaaaataaaactctactacactgtattttgattatattaatgtaacaaaagttgttatacaacacttcttttcaaaattaaaaagctgttattcaatgtgaagtttga

SEQ ID NO: 7597 - DNA, 1050 bp, Homo sapiens
cttttttctattctccccaaaatgaatccaaattcaagaaatttgaaaagtgtcagttattggcctcttggaaaaacaggctgctctcctctttccacaggtttactctggtatttccttgaaatacttagttttaaaatgtaccaggtaagatgtttgtcttaaggcaaacatgtggtactctcttcatgtaatctatttatgtactaagtggattaagaggcctatttgggaacaggaacatcttatcatcagccctcacatcatactattttggaattgtactctttcaaagactatagttaagacacctgaaaaaatattattatcattcataaacaatttttattgtcctatcatgttcaaaagtttaaatacagacaacttttggataaatacattctagctattccagctaattcttaagcacttatgatgacaaagttttgtttgctgtgatagtagaaaaacagactaattttcctaaaaatccaagggtttcacattaatctagttttgaaaactgtagcctgtatgtttctaatctggctataataaaataagtttatataaaatgtttagtgatgtgaaaagttgttaacttcccagttttcaaaggtctttttagacatgtacttttacctgaatttctttctgaagattaatttcttaacctttgttctgtgaaagtatttttcaggttactccctagataacacctgagttatttttaaaatatatattctcttttgtctccagaacatttctaaataaccttcccagagtatcttaaatgaattattgaatttgttttgaaaataattttcaccaaagaaggcatatttcttaatacttaaaataaaattgtgaaatttgacttgcatttgtgaaatttttgcaacaaaagttactctttattttcctgtttcccttatttatatgttatatttcccttatttatatttacatgttagtctttatctattaatagcccaaaaatctaacatcattggctaaaaaggatatattaattaatggcactggaataca

SEQ ID NO: 7598 - DNA, 1027 bp, Homo sapiens
ccgtaggggtgtggtcgagcaaagtgttttgagctgcgtttatgcgtgcttgatacctccttcttttgaaccaggtgatctggagggcattctcactggggcggggatgcttgtatgtgtaattttactgagaattcataaaaaggccaggaccaaacttctatgtttatggggttttgcggacccatctaggcattttcagtgccttgctttaaataattaagctacattaactggatgaaaaacatttgagtggtattttgaaatactagggggatgtcagggtagaatcttgttgggtataaatctgaagtggtcatttgcagtcctggaagtttagggcctttaaaaaagttgaattagcagaggttttggctaaggtgacatttgtagttgaagttatatttgatttaggactataatatctgggatacacacttttcagagagggatgcttgaagtattatataagtattaagacagaaatttagttaacatataaataggagattttatttggttggagaatattgggattttttagaaaattacgttaatcgaggggctagtgttggagtgttcatggttaaattatgatttttagggttctgactaggttcaatttaagtatcttgtttctgggggtcggcaagggtacctcttacctaatttaacaataaagtcagagatggagggagggtggattttcggatttaatcagaagtagtcctttaaattatgcgtgaacgtatctgcgtgaacgtacgtgtgcgtgaacgtacgtatgtgcgtgaacgtacttgtgtgcgtgaacgtgtattgattgttatgcccttcaagcatgaatgaattagcaccttatggttgggtatgttgactcagaatattcaagataagtccagccacaatcgattccgcagggatcaggctcccgccatggtaagtggcagcatctcgaaaattaaaaaatacgaaatgcatgacaatgctcccgtgactagttattagggtgatagtcactagtaca

SEQ ID NO: 7599 - DNA, 1091 bp, Homo sapiens
cgaacatctctgttttaggtaatgtcggttcagagattgagtttactacacgcttcctgactgttaagtgatatatatctcacttttcaaacctaaagtaaaatttaaatcataaaaaaagaggaaaagagttttgttacttttctttttttttttttgagatggagtctggctctgttgcccgggctggattgcagtggcacgatctcagctcactgcaagctccgtctccccggttcaagccattctcccacctcagcctcccgagtagctgggactacaggcacccaccaccatgcccggctaatttttgtttttgtattttttagtagagacgggttttcaccatgttagccagtatggtctcgatctcctgaccttgtgttccacccgcctcggcatcccaaagtgctgggattaccgacattacttttcttttagttttaaatggctaaaaatgtattcagtaattgaaagctgcatcaacccttgtcctacgaatgatttgcatcttttctatttggctttgagctacgaggctatgactttctagagagtaagaaaaaaataatactagggacttagatgaactttcacagattcatttaatacacttagtttgtaggacatttgcaaattcataagagcagaaaaagaaatagggatcattgtcaccattatcacaaatgattatccttatgtgtgaactttcccttgcatctttttgttttcccggtgtcctttcaatgaaagggaaggaggatgttgatgtttaatacagagcataactgtttgaaagttgaatgtctagaagtgaataatcagttcacatattataaggtggggcatgtatttgaaagtctaaaagtggtgtatatcccaattatgttttttgttggtgctgcctctatggagtccaggtaacctaatgtgaatattcacagatacctaggaagcctggatcacaaggcggcaggtaaagataggctatagtgtcaccagttcccttcaaagaatttggataattgagccaagaataataactttcattttggggcttaagattgaaggtaaagagaaggtggttaggg

SEQ ID NO: 7600 - DNA, 1054 bp, Homo sapiens
ctaaagagaaagtgttttttttttttttctttctaaaaaccaggtgttgagctccttggtaacccaatactgggtgcgcgcgcgcagagtggccagacccctctccacgcagctctggctctttttaattcggcaagtgcactcacagcagaactgccaccagtataacgtcttgacgatgggctccagggtttgacactccgcagcgccaccagctctgttttctccccaagtaagccactctacctcgcgagcagcagatcgccctgtgcgcgctacaatccgtggggcggggagacctggcgctcacccagcgagctcgactggtgctgacgtccattcaggcctttaaatgtctctgtccctgcgcaggagggaacggactttgtagcagtcactttgcccgaagggcgacgcgtctctgcttttgcaggcggcagctcggactcccctcactcttcccagcgttgcgtttgcctctgtctttgcctcgagttccccgcagcctctccagcgggaggcgcttttggtattcgtaccctgggcatgaaccaacaggactccccatgccctgtgctttttcagtgggttcgaagatcagagattgcgaggtgctctgggtgatcgctcaaggagcagggagcttcctccccctgattttggtagggggtgattttttttttaccccgaaaagcgtcctccccgctcctgaagctgcaacttgttttggtttcttctcagtcctgtgtgtggttacaacatcaaagtttttctcccttacccttccaaaaatctatccttttaatccaccctcctccccccgcgctatctccgccaggccttctcgctgtgcggtgagtggatagcgggcgcgcagtgtggcagtggcggcgaagattggcgctatcaggaggagcaaaagggaaggatctgctgctgggggctcgctgggtgaccctttgccagacgaaaagagctgggtaaggcgcagaagaggagccggaaccttctgggaccctggtgcctgacactggattttgatcaccatccttgt

SEQ ID NO: 7601 - DNA, 1050 bp, Homo sapiens
ttcctggcccatgcatgcccctttcctccatcttcaaacccagagatatcaatactaggttgattccttaccacacagcatcattctgacctcctcttctgcctctcttttccagattttaggcctgctccaataatctaggataatctccctattttaaggtcagctgattgggaatcttaattctattggcaaccttgattcttttttgccaatataactttaaaaattcacgggtcccagggattaagatgtagatgtctttgagagaccattattttgtttatcacaatcacatcctgaactccagactttgatcagcatattgcctctccagctcttggaatctgtccacagtattacaacctttgaaagcttcagtttccttatttacaaatggggataatcatcctgacttcacggatttgttgttaggaaataatgtggccatgtgcataaaaagtttcatgtagaactaaacaaacaagaaatagtcaataaatgttagttatagtatttctgacaaatacaactgaaggaatgggacaaacaattaaaaatgtacatctttttatctattcctcctaaattttcttaacttgttcattggctatagttagtgtaagggtaattgggaaatgtttaaatataatttgaagaggcatatcattaagatcattgttatattttagtactgttgccataattagtaatcataaaacatcgggttgtttaacagtatctctactactgctgcagagcttgacacagcacgagtgggcccacaaaatgctaatcactgtccagacagactctgtggacattttaaggatgctagtaccatcctggcatctgccatggaagcagatgctatttgcatctgtttgctatgacaatcactgatgatggcagaaaaaaacatctacattttaagacaatctgttcaaatattcaagaacatacttggcttgtcaaggcactttttaaaagttgttgtaagaaatgagatttataggaaatataaattattaagctaccaatacatttttt

SEQ ID NO: 7602 - DNA, 1034 bp, Homo sapiens
ttattttgggataatttgttatgcaggaattgacgaataatataaatacttttgaaatgtaacttttttatcttaataagcatttaacaaataatttgaagatggataatcacagatacctcaatttttaccaacataaccaggacccttcttgtaactttgactaataaatgatcttttgaacattaccattttgtaactgcattttagactatgatttagttgaatcacccaaagtgtgtaatgtcttttaatgtgcactgtcaattctgttctgccataatgacctcactttcagttcttaactatattcatctcagtcttgtggggtgactgtctcaagaagaatgactggtaataccaagaacttctgttgtttccataaataacagccagattacagccagaacctcaaggctgagcacaaccgctcatgtttggaatcccagccctttgggaggcctagaccagaggatcactttgaggacaggagtttgagaccagattgggaaacaatgcaagattttgtctctgaaaaaaaataaaataaaataagctgggcatggtgtcacatgcctttaatcttagctactcagaagctgagcctggaggattgcttgagcccagcagttcaaggttacagtaagctaccataacaccaccacatcccagcctgggtgacagaatgagacactgccaaaaaaaaaaaaagaaaaaaaaaagccagacctcaggatttccatacattttgcaaaattccatgcaaactgcatgcaaattttgggcttatacaaattttaaaatttaaaattcatggatcctgccagacattctcaaatattaaggaccagagcttaagaagactaagaaatcaaagcaaggggctggacacggtgactcacgcctgcaatcccagcactttgagaggccgaggcaggcggatcacgaggccaggagtttgagaccagcctggccaacgtggtgaaatcccatctctactaaaaatataaaaattagttggtgtggtggcatgt

SEQ ID NO: 7603 - DNA, 1029 bp, Homo sapiens
actctttaagattatttttgacttgaaccatattgaaaatgatgttgactctgtctgaagacttttgaggacaaagctcattttataacacatattttaattgcattgcctggcatgatgctgtgtgtctgctcagtcctgttctcagccccccttctgaaaaaaaaaattctttttggactacatagaactggctatgattgtaaaccgtatcactcaatctgaatttctagcttctctttcttttaatatctgctgtataaaatggtgacaaaatatttcgtagtcatttattatgtgttgaatggcattccttccgaaaaaaagatatgcctaactcctaacacctggtacctgtgaatgtaatcttatttgaaaataggatctttgcagatactcttcttcagataagatcatcttggattgatggcctctaaattcaaaatgagatccttatatgagaacacagtgggatgtttgagacatatacatacagaagagtgagacagagtggaagatcatgtgaggacagtggcagagattagttactcagctacaagccaaggaacaccaaggaatgccagcagcaaccagaagctaggaaagagtcgaggaaccttgccttttagagcctgcagaggaaccaacctgccaatgccttgatgttagacttccagcttccagaagtgtgagagaataaatttttgttgttagaagctaccatgttttggcaatttgttacaacagtcctgggaaacgacaggtaataaaacctcattctctgttaagtctacaccatcactcttggtatttaattttgctcttacaacctaaactttcatctccatatagctaaatgccacttgtgtatctatatctgaatccatttgagtagtactacaatcctaccaaactcaacttgcccagcactccctttaactctctctcatcattttacatttatttccattataatgtttttgttaaaatagtataatatgtatcttatttgaagggagaggagggtca

SEQ ID NO: 7604 - DNA, 1327 bp, Homo sapiens
agctgagaacaaaatcaagaactcacccctaactatggaaatgctgttacactgttggtgggagtgtaaattagttcaaccattgtggaaaccagtgtggtgattccttagggatctagaaccagaaataccatttgacccagcaatcccattactaggtatatacccaaaggattataaatcattccactataaagacacatgtacacgtatgtttattgcagcactgttcacaatagcaaatacttggaaccaacccaaatgcccatcaatgatagactggataaagaaaatgtggcatatatacaccagggaatactgtgcagccataaaaaaggatgagttcatgacctttgcagggacatggatgaagctagaaacatcattctcagcaaactaacacagcaacagaaaaccaaacaccgcatgttctcactcataagtgggagtttaacaatgagaacacatggacacgaggaagggaacatcacacaccagagcctgtcaggggtggggggactaagggagggatagcattaggagaaatacctaatgtagatggctggttgatgggtgtagcaaaccaccacggcatgtgtatgcttatgtaacaaacctgcacattctgcacatgtatcctagaactagagtataataaaaaaactcaatcctatttataatagccacaaaataaaataaaatgcataggaatacatttaaccaaggaaatgaaagagctcttcaatgtgtaccacaaaacactgctgaaattgtagatgacacaaatgaaaaaaacatcccacgctcactttttaaaaggatatattattaaaatgaccatactgcttaaagcaatttacagattcaaggcaattcctatcaaattaccaatgctattgttcatagaattagaaaaaaaaatcctaaaattcatatggaaccaaaaaagaacgtaaagagccagagaaatcataagcaaaaagaacaaagctggatgcatcacgttagctaactttaaattatattacaaggctattgtaaccaaaacagcattgtactgatatgagcatagacacatagatcaatgtaacagaatagagaatccagaaataaagccacatacctacaaccaactgactttcgtcaaaaaaaaaaaaaatgtacagtgggaaaggataccatatgtagtaaacggtgctgggaaaactgaatagccatgtgtggcagaattaaactggatctctaattcttaccatatgcagaattaactcacagtggattaaaggcttaaatgtaagacctgaaactataaaaatccccaaaggaa

SEQ ID NO: 7605 - DNA, 1105 bp, Homo sapiens
ctttctttcagttttggccagtaacttacaagccaagtaatgccctgtccttaccaatactcaaacatcagtattggaaagatggattcgtttcttaaagcatcaaaattaaattaattaattaaatgataattcctcacagtgtatatagttcatagtttttaaaatgctttcacatattctattcctttaaattttatgataaccctctatggtagaacgcatgagcacaattgtttgcagcatgtgaatatgagtgtaacctgtttttacatcagaatgtcagtatgtctggatgtgtctggtacactgatgaaacagacactagaagtctatttatattaagggacaaagaagctcctggggaaaaaatatttagaaggaaaataagcaaaagctgccaaggttattttaaggacaatggatcaggattaaaggagtagaatatttaaatgcatagtattgcacttatatctgaaattgattacagtacgaatttataaaaatatgtccaggtcagagggaaaaaaagttacaattaaacttagtctttattgtaagtctctgtgagatgcagagatcacagaatattagaagcattgtcagtttcactgacaaagtcagctatctgaattgaaattattatgagaaaattaatcctctccacttacagcattacctaaatatatttctgaaattattccaaatcttacagtgtattaataacttaacagaagctccattttaattgtttcttcacattttattctaccattcctttatctcagtgtactcttaggttgattcctgtcatttaaaagctatcatagcaccattgtcagtaagaggagtatatttaacaacagcgtctactttgctgaacagccattttattcacaggcctaactgaaagataatcatcattagtgtgttaattttaattcagaagccccaaaactcctgtcgacgacttatactgtattagcaatcacaaattgtttacaagttgtggcaaaaagactaggcttattatgaactagctcttaaagaaatctttaaaaatcactagagaggccgggcgcggtggctcacgcctgtaatccca

SEQ ID NO: 7606 - DNA, 1073 bp, Homo sapiens
atttaaagaagtgttttaattgtgtgaaaaaattaaaactgataacaatatactagaaaaattacttattcagataaacatcaacagttcacttttgagagacaatatgggactatatacaaagaatgactattggctttttgatgtttagatattcaaaatgacaatattatattttttgtaaagtatagatatattatttaaatatttatatttataaaaataatttttgaatattatttaattattctaacaatataataaatctgtattaaaattatataagtattttaaagcaatagttattttaattatttttagggcactactactttatatttgagttgactttgcttgggtaaaaagttactttatctccctaatgaaaggcatccatgttaagacataaatcaaaaatttagacttaaaaaaaattaagcaatagcaactactacaaatgtgatttatcttaaccagtggtatccagaaattcaaacaaattacaggaaaaatttacgaaatttttcattgtactattactttttgtgaattataaaaagtagactgtggattagaattggttggttaaacccatagcagtgtagagcaaagatgaaatctgaattatagataaacattttgcctttataatttaggtagtcaaaaggaggccaaatttaaccaaaatgtagtaattaaaagatcactgaatatgccttaaaatgtcttttaaattaaattttcctaaaggtttaaaatatatgtatatataaaagagactattttaatgaatcttaatacccacatcatcaagattgaatgatgtttaacatgcaccatgtttaatttgtttatttttgatttaccaaagtatttgaatcaagaactgtcatcatggatcgtcagtatgcagctttttaaagaaagaattttttttcaataatggaaatttgaaagtttcttaattttatctaatgctcaactcactttcacattgacaggtaaaacaaaatagtatttttatcatttgtttaattgaaacaataagacaagttccggggtacatgtgcaga

SEQ ID NO: 7607 - DNA, 1032 bp, Homo sapiens
tagtttttagaaacaaatttttattctatagtacatccttttgaaataataagtttaaaatgaaactttaggtactgcaatttaaatactaaaaaatgtggtgattaaagtataatttgaataaaattttcattgacatttaaatcctcattggggcttttgtgattatagtgcacagaaaccaagaaaatccagaggataaatccactgaagaagcaccaatatccacatcaaaggtcaaatatttagaacactgtgcttgtaagcagtggaaacacattgagctacaaaacattagtttacctattactgtaagaagtctaactttccattgacataaaaataaaaattgaccattcttgtgctgaaatgtaagtgaaatgatatctttaatgttttagcaccattagcagaagaacaatgccaatgttgaaattatatttatcatcagtagcaatagatgtttctagtaaaaaatcaggttatctatcattcctcgcgctggacaaacagactcagataaatccaactgtagagtcaacaggaaacaagatttctccatggaatattctgcagctgtaaagtgtcccaacaactcttttctttgagtgattaccattttattactcaagaatgatttcatattctaaaataggccataaaattttttttgaaattatattagtaaataaaacatcttactctcttctagaagatttaagtcaccttgacatagcaaagcagtctaatttccaacacagatacagaacatcaaacaagtggcttcctgatgtaatattccacatttagcttaactttgtaattcccgaggaagaaagaccctgtgtcagcttggttatttggaactgatattgactcctttatatacagccctgctttgctttgtgtctgttaaaaattttcttggcataaattttacctaaactcaatccttgtccatgactctattaaaatgtcatataccttttttggttctaatgtttgttgactaatttttgtcttctgccaggt

SEQ ID NO: 7608 - DNA, 1048 bp, Homo sapiens
catagtccagatatcttttaaaaaaaagtgcagtggtcagaacacagaatgaaaataaagtagtgatgtgaggttatgttggaaaggtagtaatggctagtatatgtagactgtagtcttctaaggaatgctgactttatcctatgtgcaataaaaacctattgaaggaaaatgaaattgtttaagggtaaagagtgtgtgtgtgtgtgtgtgtgtgtgtgcatgcacgtgcatgtaggcaggtgagctggtgacaatatgattcaatttgcattttaaaaagttgggtacatctatgttatgaggaatagattggagggagcacagcctgatggaggtagactaattaggaagctacacctgtagattatgaaagagatgagtgtaacttagataagagtggtggtagtcaagatagtgaggagtaattgaattccttaggaggtaaaattgataggagtttttatattcaaagtgctgtgaagtatattatgtataggaataaataggacagaattaaactataggcaggaggatttctgcttagcaggttcaagtgatagtgaaggcatgatgaatatatatttctctaaagcaggaagaatggaatataagaggctgaaatgaaacatttctaacttgcaaatatttgaaaatagaaaatttctccaactcagctttataatatttatgtaaatggttaccagatccactgaatcagactcttgaggaggagacctatgaattttgtatttaataagccctagagaagaatctcagagagccagattgccactgacctacaaagactttgaaacacagccctacataatcattattattccttgaagataagaaatacttaataattactacattgaaatacatattatagaagaaaatatttaaaagataaaatataaaaatacagtgcaaaacaccatttatacacctgtacttaatatttgggcctttaaattttaatatttatatatattaagccatttcctctgtattctgacagtgcttatatttaaagtaatgaaaa

SEQ ID NO: 7609 - DNA, 1035 bp, Homo sapiens
tgatgtttgcaaatagatataattatatattttgcctttccagtctgtatgtcttttatttctttactggctttattgcatttgttaggacctcctgtatgatactatgcaggaattgtgatagttgatatccttggttttttccaaacttagagagagaaaacccagtttttcagcaatatgtagaaacattatgtagaactgtgtgtgagctacagtttttgatttgtttgtctaagatatactttctcagactgaaaacatgttcctctgtttttggttttctgaaagttctatatcataattggatgttagattttgtcaagtgcttttactacatctattaagattatctttttttttcctttagtgtgctgatatggtgagttacattggatgattttccaattttgaatcaatgtttaataaccagataaaacaaaattggtcaagatatattatcaatttcatatgtccctggatttgatttaccaataatttgttaaagttggttgcatctatgttcatgagaaataattatctatagttttcttttaatgtaatatccatattgagtttcagaggtgtattaattatgctgtcataaaagtgagtgattttgaaggtggtcccttcattctttattggagaactgattgtgtaggattgatataacttcttcactaagtatttagtataattatgcaagaagctccatgaatattgagatttctttggctatattttttaacaacaaatgcaatttttttaacagatataaagttactcactctatttcttcttggaaaatttttggtagtttatttacttaaaaaatgtttccaattaatctaattggtcaaatttaacgacagagagttttgttaaagtatttatttaatagccttttaatattcctttaatagccttttcttttctctttttttctttttgtattttttgtcagtctaactagaagtctataaattttattgatattttcaaataactatcttcattacagattgatttttc

SEQ ID NO: 7610 - DNA, 1040 bp, Homo sapiens
tatgtaaaatgtgtttatgtacaagtgtgtactgtgtatgcatgaaaagctaaacaacaaatagtttaacatggatggcaccactccttttccttgccattgcatgatccaaggattgcatattgtagatctcacagtgcttatcttgttcagactgattacctctcacaattgagggggaaaaaattaaattgttacttacttatctttataaactttcttgtgcttagcgaaatccctggacaaaaataagtgcctagaattagtttaaccagattatgacagtgactcaaaataaataatgagacccctgccccttttctttcctttctgtacttaccttcttactaattgaattgtttctcttcttgggatactatgtggttcctacatgtacaaacaataaaaatataatacataataaataacatgtatctcaaaagaatctgaggggagtagataaatagttcacataagggattcttgggtattgaaactggtaagtatcttgactgtcatgttagaacctacgcggatgataacactgcacatagaatttgcatgcacccacaaatgcatacaactgaataaaagtaaaactggatatatctgagtggatatattgcataaatgttaatattccaattgtgatattatactgtagttttacaaaatgctagtgtcaggaaaaatgggtaaattttaccaaggatctgtcgatattatttatttatttatattttattgacgtataatattaacagatgtatgcagtttcagggtatatgtgataaatttaaaacagtccaataatttgtaaagatcacatcagtgtacttcagatatccatcatcttaaatatttgttttttctttatgctagaaccatttgaattcttctcttttagctattttaatatatacaacagattattgcaaactatagttaccctactgatctgtgtaacactaggtcttaacttcatttatttaagagtatatgtgtgcccattaatcatcttgtctttaaccctccccttc

SEQ ID NO: 7611 - DNA, 1062 bp, Homo sapiens
gatttgtaaaacacacatggcgtgactttgatttctccactatgaatggtgtttcagcaactaggcatcatgtagtttcctttacaagtctctacattttgttatagtcacacattgtcattacttcaaaatgttcacttgtataattcttgcctctgaactgaaacattttactcttattgtcaataagctctgcttttgtggtgaaaagattataatgctggcacatgagttttacaataattttgtataactaactggttgagattggacagcattgctggagaccaacggaagcagagctatttatggaggtagacagaaaaatagaagcatccactgttggatttccaggacagatcccagcaataggcagaaggtaagcactgaataaatatttgtttaataactgaatggttggataaatgtcaagtgcctggtagagacaagaacaattaggactatgaataggagagttttaaatgaagcaatgtgttatgacttaaaataatattaaatgaggaattgaaaactgggagtcaaaattactttcaagaagcttggttgtaaagagagcaaatcaaagttactacaagtaaaatcatgagttttaagactcacttgtacataagtataacatagtgttacacttaaggctaccctcttagcaaatttcaagtaaatgatacagtattattaactatagttctgacttctttaaaacttaaaatctttctcttatggcagatttttgatatgactagattttcttgtaaaaaattaaaaaaaaatctcccaaccttcaaacacagagaactaaagttctaaagtagtattgtctagaatcatgcttatgacaaagatgtgttaatgtgttgtatagaagtgtcagaatctattttacttatagtcatatttcttgtaaaatttatcttgggctgtacttcataccataagcttcgattaatacatgcaagactgattccttcactctgagaccaacaattgatcaaatggaatttaggtttataataggataaacagtattatgaaaagatagaa

SEQ ID NO: 7612 - DNA, 1035 bp, Homo sapiens
catcatccacataaaagaatcaattattgaggaagttgtcaaacttgtgtatttatattcacgcacacacagttaacacacatgcatgatttatagaactaaaaggagcaataggtacatcttcaatcatgaagactttaatataccttttttgatacctgatagcaaaaaggatacaaaatatcaataataatacagaaatttaaagcagtaagattaaatactttgacataaaaactgtacccaaaaatagcaaaacacacatttattgtagtgtatttggaacatgtttcaaaatttaccgtagatgtcaatagatatctctgtctatctaggtagagagatgatagatagataggaaaacagatagatagatagatagatagatagatagatagatagatagatagatagatataggctgaggttaggccccaaacaacaatctataaataccaaaaatttgaaatctttgacagtgtttttgtacaacaattttattgacctggaaatctatggcaagactttgaaagtgtacaaatgtttggaaattaagcatcatatttctaagttattcatggatcaaaaaagtaattacaatgaatattaaaatatattttgaatttaataataacaaaagtaaaaatactgcttgttaaaagttgggagacttaggcaaaccacagtttggagataaatatatatggttacataaatatgttaaaaaaagtaaagcttgaaaattaataatctaatcatcaatctaaaaaatttaaaatgtaatgtcaaattaaatccaaagaattagaaaagagaagatacataagaagcaggagaaaaggaaacaatcacaaaataaatgaaatcaacaaaagccaaagttactacgaaaagacagataaaaatataccatgattacacaagaaattaaaaaaagagtatacacaaattccaaatatgaataataacaaggaaatcattatggattctatagtcatgagagagaaaaagagaattcagtaagtaatgttaagt

SEQ ID NO: 7613 - DNA, 1068 bp, Homo sapiens
attataagtgaaaggccatatattagttttatattagggttcactcttggcattatacatttcataggtttggacaaatgcatatgtcatgtatccactactacggtattataagaatagttttactttcttaaatatttctgtgcttgatttattcatccctcccttggagactactggaaattctgatctttttacagattttcgcctttttaagaatgttgtatcattggaattatacagtatacagcctcttcagattagcttctttcactaagttatatgcattctaggttcttgcatattttgtatggcttgatagcttattcttttatcactgaatatcccattttatagatatgccagtttattgaaccatcactcacgtgttgggggcatcttggtagctaccaagttttgttatgagaaaagctgttttaaggagtcatgtgacatttttgtgtagaaatatttttgactcatttggataggagtgaagttactggtccatgtggtaagactacatttaactttgtaggaaactgcaaagctatcctctgacgtggctgtgccattttgcattcccacaagcaataaatgagtttcccttgctctttatccttaacatgatttagtgttgtctgtgttttagattttagccattttagtaggcatgcagtggtatcttgttctagtgagcaattgtctaataatatataatgttgagcatatttcatttgcttatttgccatcaatatgttttccttggtgaaatgtctgttcagatctcctgcccactttttaactggattatttatcttttttttctttttgagttttaagagttctgtgtaatgctcataccagttcttaattggatacatgttttgtaaatattgtctcccagtcttggcttgttttttaaatataaactatgtctctcttagagcagaagtactaatttttataaaattcaatttataacattcttctatagtctcgcatttttatatttaaatctattatccattcttgtatattgtgtaaacacagtgtctagattctttt

SEQ ID NO: 7614 - DNA, 1489 bp, Homo sapiens
acgctagcttcctgaccttggacaaaattcttaacctctttgtgtctcattttcaataactgtgaattaaagataataattatatatttctcaagggattattgtgtgaattaaataaaataatcctctaaaatacttagtacagattctggaacataataagtagaaaaaattaataactattattatttttatttactatattatatgacatactttttctttatgatcttcaggagaatttctactcatcttaaaaccatatatagatatttatctgcggagaaacttatctctgttatttcaaggtctgtggattacataatggtcaactctgatttactgattgactaaacaaaattttaaaacaaaaataaaaatattgcagctatgttggttttaaccattctaaactgatgaaatttgctttctgtttggtttgtgactaggaagctaaacattatttattaggaccaaaaatttctggtgtctaaaaaaattcaagaggaaaactgttagattctattacaaatgggtatatttgaactgttaagatttaactgcgagtatgtagataatgcaaatatatcttagggtaaaacttttgttcttattaagttacccattttacattttgagaacactaatagaaattcttgtcaaagagaagatctaagatggtttaaagaaaatattaaatgaaatcaaagttacttgtcaagctccatagcacaacttacaagtcataaatcacactctgtatgacagctacaggagggatctgggtagtaaaacaaaatgatgcattttatctttcccgtttttgagttattaagaaccagttgaactatagaatgatgtgaaagactcacatcagagatgggaggttatttgcagaaactcttgttttctttaccacattaatgtcaatatttgacatttccatatgactaattgttgaactaacttttgatttcttatgccaactattaataatcctcttttcatctagaaaacaatcactttttgtctatctgtaaattaatatttgttatgttaattcatttttgcttattacaaagattaccttttatttacagaaaaagcagtcatagatttgtcttcaatcaaatctcttaaatgttaattgaattattgaaaggaatttgtaaattattgttttttctaaaatagtaacatcagcgtgtatattacattaattttttactgttttttcttcacattaactatatttaactgattttaacaatcttagataattccaaaacatcaattattttacttggatttattaattcattcaaaaaatatatgacgagaatctattatttgccaggcactaggctaggcaaaggtaagagtgaagggcaaaatcatgttctctctgttttcctgtaatatattgtctggctaaaggctgtgaagaaagagtaatgtgaaggaagggtattcgaaggatataagaaaa

SEQ ID NO: 7615 - DNA, 1028 bp, Homo sapiens
tataattatccatgaggtaattttagtaataacaatgcataaaattaactctcatccacaaatgcgggtgataaagcactgctagaaatttgactatgaatatttcagtatcactttcccttgctaattttctcttccttgtatttgatataaatgatacattaactgtggagtctctagtagattagagtttcttataaaagacacttcatttatctcgatgatcatactttcttttctaatctatttgcccttgcctagatcctctcctgaccctcactttcaatgacaaactctattccccaatgcacttgatgtcattgtcttcactatttacagccctgactgagtaatctcgctctttgtactgctgatgcaaagtattacatgtaatggatatcataaattacatcttagcatagacagatagaaccaatgctttttgaattttctagaataattacagaaattgacattcgtctgccactgctgcagataaatagtgcttcagctgttgtctccatagtcaaattatttctgcctgcacaagatctgacaagaggtcctcaataaatatacagtgggaggaaaatgtactgttatttgccggtgtgtttgttttatattttaccaaataatcaacacttctttatctttttattctacatctcaatcatataaacaatcattaactccttaatcaacacaatgattattgcctttcttcagaatgtagcccagccctgaatgaatcctacaatattttgcatgacactgcgcaaaatgatatgaaattttatagcaaacagaaaaattcaagaaataatgtggtacacataagcatattcttatgtgcatgtgcatatacaccagaacatgtgaatttcaaaagccacttgtttttctttaaatttgtttcatacatctaaataattactgaacctaacactatgtttaaggaaatatctcagatataatttaggatatttgcatatatattaataattttcaattgtgagttaatttta

SEQ ID NO: 7616 - DNA, 1047 bp, Homo sapiens
tataaagcaaagaggtttaatttactcacagttctgcctagctggggaggcttcagaaaacttacaatcatggcagaaagtgaaggggaagcaaggcaacttcttcacaaagtggcaggaaggagaagtgacgagcaaagcgggaagagccccttgtaaaactatcagatcttgtgagaacttactcaccaacaggagaacaacatggggaaccacccctatgattcaattacctccacctggtctcccccttgacaagtgggaattatggagattatgttgatataattcaagaagagatctgtgtggagacacaaagcctaaccatatcaatgttcgaatgattttggccaagactccaagaatattaagtgtagtagaggacagtgtttctcacaaatgatgctaaaatcttttatatttttatgggggagggaaatggacttgagcataacctgccatatgaaaacttaactggggaaatggatcatggcatattcaaacataaaagtgaaactaagacatttgttaaaggactatgagaatatctacataacattgaaggaagagaaagatcagaagaagcatgaacaataagaatattcattttgccaaatcgaaaactttttgttcttaaagagaaacaaggggaaaaagactcttcagactttggataacatattgaaaacagatgtttctgacttgtataaaaataaattaaaactcttataacttaatagtaataggacaacaaccaaataaaatggtcaaaagttttgaacaatttacataattaaataaatttccaatgaacatgtaaaataagctcaaaaattattcttctgaaaaatacaaattaaaattagcataacacatagctatatatacactatgatatctaacagtaaaaacattgagataaccaagcagtggtgtggatttggataaccagaacactcatgtagctttggtaggagagggagtttaagatagtgaaattatttcggaaaacgtttgaactcatttacattacttataaagttatgc

SEQ ID NO: 7617 - DNA, 1051 bp, Homo sapiens
cttcccaacagtctgccaaagtcttaaattattccagcattgaccaaaaagtccaagtcccaagtttcatctgagacaagtcaagtccattctgcctatgagcctgtaaaatcaaaagcaagttagttacttcctagatacagtgggggtgcaggcattgggtaaatacacccattccaaatgggagaaattggccaaaacaaaggggctacaggccttatgcaaatccaaaatcctgtgggaccgtcaaatcttaaagctctgaagtaatcacctttgattcaatgtctcacattcaggtcacgcttcctgatgcaagaaatggcttcccatggccttgggaagctctgtccctgtggctttgcagggtacattccccttcttggctgatttcatgggctggcattgagtgtctgccacatttccagcagcatggtgcaaactgccagtggatctaccattctgggatctgtaggatggtggtcctcttctcacacttcactaggcagtgccccagtggggactatgtgtggggcctctgaccccacatttcctttctgcacttccctagcagaggttctccataaggacataaggactccacccctgctgcaaacttctgcctggacatgcaagcatttccatacatcctctgaaatctagacagaggttcccaaacctcactcttgacttctgtgcacctgtaggcccaataccatgtgtaagctgtcaaggcttagggcttgaatcttctgaaacaatggcttgagctgtatgttgaccccttttagccacaactagaatgcagggcaccgagtcccaagactacacaaagtagcaaggccctgggcctggaccaggaaactattttttcctcctaggcctctgggcctgtgatgggaggggctgccatgaagacctctgacatgtcttggagatattttccccattatctttgcaattaacatttgacaactaattacatatgcaaatttctgcatccagcttgaatttctcctcagaaaatgggtttttcttttctatcacattg

SEQ ID NO: 7618 - DNA, 1039 bp, Homo sapiens
gtgctcatgacatctcttttggaacaattcggaaaatttagccaatcttattaaaatgtcagtggaataaaataataacatgaactcagaactattattcatgtcactgtgtgattgtttccagaaacacatacacacacaggcatacacaaaaatgaaattatatggatatttatgaaggttaaggaaatttagtttttttagatgatatattacatgatcggaaagaatgagctattctttatatatctctcttactgatgtttatagcccatatctgcttctcagactcatcagcttctgtgattcttttattgcctctaagctcctagcatatgggccttctatttatttttacttcagatatgtccacttcattcctgctgtggtacctttgcactatttattcttcctggctgcatatcttcaaattaatgttttcttttttgtcatttaaatctcagcttatatatcacttattttgtaattgctcatcattctgccataatcctccatcaaaattctctgtgcaatacctatcaatgccatctaattccccaaattctggactattgttttataaactttcaagtaaataacatataataagttgtacttatttgttatgtagttatttacagaatatgaggtccacaatgatggaaattttctcagctttattcaatgatatatcctaagcagaataagtgctaaataaatatttcttgaatatgactaaaatagttgataattttcttataacactttttattaggttattacatgcccaacactcgtaagttgaggattagttctatgaaaaatgttgtttttctcttcattcttcacaaaattcactgtaatgttcaaacagtacttggcaaacataaaagtactcagatatatttaattatgtgattcgtttgccatggaagacaaatgaatcatataattatttttaaagtctactttcagaatttatacttttctggcctcacataaacattaaaaaccttaaattaatcactacatatctgat

SEQ ID NO: 7619 - DNA, 1030 bp, Homo sapiens
aagaaacaaaacagaaaatagcaagagttagcaaagatgtggaaaaataggaactctcatagatttctgctaaaaatgttaatttgtgcagctactgtgaaatattaatataatttagaagttcctcaaaattgaaatatagaattaccatatgacccagtaattctattcccaggcatatactttacataaaatgattgaaaagtgactccaacaaatagttagataacaatgttcattgggtattcacagtagccaaaaagtagaaagaatccaagtgtccatcaatagataaatggataaataaatgtgacatatacctgcaatggcatatcagtcactcataagaaggaatgaagcctatatacatgctgaaaacatacatgaaatttgacaccattgtgctaagtgaaatgaagcacaaaataaaggagaaatattttgattcaacttatatgaaatatctagaacagtgaaattcagaaatattaaagttcaccagtgacttgggcaagagaaaaatggagttattacacaatggctgtagagtttgtttagtatgatgaaaaattttggaaactaatagttgcgatgaccacataacatagtaaataaaactaatgtcactaactttatacataaaaatggttaaataggaaattgtatgtgatatgtcttactatgataaaaaagactttaaaaagaaaattgttagtggagataaagaaaaactttttgtaatgataaaaaggccaaccaatcagaagaaaacaaatcaaattggcttaaataaaacattatattatagggacccagattccccaaaaatgtatccagacatttatgtgcaacattaaactatttattcgtcctctcagtacatttttcaaagcaaactatttactttcaaatcactttttcctcggcttaaagtctttaagacaaagtaataagatatggtgaatgaaacacactgtgtcaaatgatgagatctttaacaatgaagcacttaatgaatacagtgcactgc

SEQ ID NO: 7620 - DNA, 1037 bp, Homo sapiens
ttgctactaagtgataaggaaacattgtaagatgatgggcctgaaggagaagagaatatatgtggtttacaaagactatttgaatttttttatgtttgctcattttttttctaattttgaggtaagattatgttttgttttttctttgtctattaattttaaacaagaagaaattaaaataattatcaaatgaactctttggaataaacgaattttataaattaatttgcaagaaaaggcaatctatgaagaattgaagaaaatatgctaccttgagtcaacaaatagcaggaaaaaaattagtgcatgccatttagattattcacataataattgtagcagtattttgattattggattttttattttcccttgtttattaggcaatacaaaagctaaaaaatgtatttacatgatttttttttcttttacactatctcataatctgaatcttattattatcctgattttcttacacctatgtagttttggttaacaaacccaagaataatattgcctatactctgttaactgttcttcagtagaaatcattaaaatcaaattgacattatacttacacatagccaaaaagaggaatggttcaggatagccatctattccgcatctaaggcagagtaagtcaataagagatccctccttagcatactagcttcattggatggatataaatacattatgcaatcagaaaccataggaattctgaagtggctcttctaatatcagaaaaaaaaaaacttcaaagagtaacagcagaataatggtagagtaggcagacccaaactcttgccctcccacagaaatattgagaaagcaagagacagcatcagaaccaactttgtcataactcttagacacaaaggttcccagcaaccaagtgaatgctggaacaagaaaatagcagctttaaatggtaggaaagcttagtggcatttacttacccttactcaactttcttcccatcacatcagcaaacttgaagggagacgctcacattcccagtctgagaccctggtgcc

SEQ ID NO: 7621 - DNA, 1074 bp, Homo sapiens
cagtttcattttttgcctggtagtaaaaattcaccaccccagactggcttgcatatagaacaggtcatgagacacagttctggtcaaggagatgtaaggagttacaaggtggggctccaagctgaaaaagtaaggaattggtcctgttgacttgctcctgttatcctttcttttccccatcagcctcagccttctcctatcttaattaaaagcttgatgtctaatggagccagagcactcttgtaagcttgagggaaagtcctatacattaaggatggcagagtataaagttgaaggaacctgactgtcggtaaggattgtgggatctctgttctgaattggaccactgaactctaaagtgaggaaaataaactgattatttagtggagccaaagcttgttggggttgaagtttttcacagccaaacatttacatcttaaatatactaagcaatcagcaaaagcgagaaaatgatctattgaacagaagtttcatgcattcattcaagtctcgatatggagcgtccaccttttgccaaataattgccctaggaactgaacttgggtccttgagggagactgacactttgccttcaaagatgttcattcagagaatcaggattcatgcataagtgcagttcaaagcaggctgatgaaagtttccataaaaaatgatattatactaaagatataggaatgttttcatctccttaacatacatctagtgaaaaagaaaacatttgttcaacatttggccagggaattggacaaagctcagtttatggtgagtttatgtgccatattaaagtgttttagtgactgatttccctgatactactgaaaaaaatttgtttaatttcaccaaattatctattaactgctaaatactatatttgtgtaaataataaagccaaaataagtatttctgacatgacatttgccatctcttaatttataaattgtttttaaaaaattattgaatatctgttttcactaagattcatgtatgtcttatttagctgtttgcttttcttgtttgtttgcttgtttattcatttatttatttaaataccag

SEQ ID NO: 7622 - DNA, 1021 bp, Homo sapiens
cccactgacctgcgcccagtgtctggcactccctagtgagatgaacccggtacctcagatggaaatgcagaaatcacccgtcttctgcatcgctcacgctgggagctgtagaccggagttgttcctattcagccatcttggctcctcccgaaagaaggtatttctaagacagaaatatttatcacatatggcttttttttcttgctatttcatttttactatttccttgctgcagtgtagacataatgccagaagttttatcaaatatctagaaccagctacaaaatttgcattacccagtacaaataaaaatgtgggactcttgtttaaaaatcaggggaaaatgtttagataaatataaaatatttcgtgaaaatactttgttactttaaaatttgatatgggggtaaagtaatatataagtaacaatataatgacagaaaatcatattacaaaggacaaaaaaattatgtcattcataacttttataacaataaataataatggtctgttaatgtgacatttgattgattatatgattctttggactaaattttctgcaaatcaatttactttgtcttctaaatatatactttagcaatttcatttttaagcagtatagttgaaagtgatgccagtttctttggacaaatgcaagatccagataatatttataatttctaattttggaaaggatttttatgctaatgcaattggtactgtaactcttaagtgtattttatagaatgtaaaaatttgtggataaggttctggtaaattagcttaaaatatatattttagcatatctggagatgatgacactaatagaactttttttttctaaaaatatttaagtcttcaaataaattattttggggtaattgtaaatttaattttaaatattagtttataaaatggcattttattgttttctttgctattttctgtaactttctagctagtgtaactgttttgtttacaagttgctcattgccctctgtgcctagggtctgagcctctg

SEQ ID NO: 7623 - DNA, 1046 bp, Homo sapiens
gaaaccccgtctctacgaaaaatacaaaaatttgactagttgtggtggcacatgcctgtaatcccagctactcgggagactgaggtaggagaatcacttgaaccctggaggcggaggttgcagtgagccgagatcacgccattgcactccagcctgggcaacaagagcaaaaactccgtctcaaaaaaaagaaaaaaaaaaaagaaagaaagaaatccaattctgctaaatctatgcatgcatgggttctacttcctaggaatattggcagtgtcaactattttaagatatatttccccagctagagactgaaataagtttttatgttccaatctatagttatttgtaaggtaagaggtaagtggaaaagtgataaaagtttgatgaaagccaatgtagtgtgctttgtttagcaatttacaactctaatcaattgagatttttgaatttggattttgtagtcactttcagccaaatgtaattttaactaatagaatctgttgtttgctctcaagagctctgactgctcaggtacatttattgagttttttttttttttttgtgacaggcactgtgctaagatatttatatacactgttatttgatcccttaatagttcaatggaagtgctgttatctgccttttacagaatatgaatttgaagctcagaggattgcctcaggttccttaggttacacatttgttaagtgacactaccacatcttgaattcatatctgtctgagtaaaaaaagtcataccttgaatactatagcagctggtatgtgatttttacaataaaaaaaattcatgcttttattgagatgaaatctgtattgctctagcttagattctttgtgtacatacaataccatttactattgtacctctctctcacctgaaaagcttatcaaatactagattgtagattgtaaaaattatatcccctaactcatcactgtcattctacaggcaaacgaattatttagtttctctgtttattgttgttgttatctaaatataagcatgctttaaattgtgtcttcta

SEQ ID NO: 7624 - DNA, 1737 bp, Homo sapiens
gtccagctgagattcctttccttcacacttacctcctctttgtaggtatcagaccttcctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggtaaatgagagatggaacaggtgggcatgggctggcaggtggagacagaagctgggagattggccttacccactgtctatactgtatttctccaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttcttctgacttcctttattttcacaatcattcaattcatagcatttcctatattctgttataattatttcattgattcataaatttctttgaaaaataatttggtcttctattgattgtgagaagataatctaagtttaatttggtcagagaatatcatctgtttaataaactttgaaatttggtgagtgaattatcttttttactgataaagagtgatgtcatcttttttaatgtttcacataggtttggaaagaatgcattttagattgtgtgtagtattttctattagattatgtttgcaatttttgtttcaatttatatcttatatacttaattttttgttgtctgtcacctgagaggtgtgttcaaatctccaactatgatagtggatttgtgcatttgtc

SEQ ID NO: 7625 - DNA, 1119 bp, Homo sapiens
ttttggcacgtattaccaccgtgtgccctccatgcacgccattcctggttgcaggctgtggacccttcaggcccttgtgtaaactctggtcaaggcaagactctcaatactatatatactgatatacacatccacatttgtttgtgtacacacacgaactgtagaactagcaccacaagaaactgcaatttcctgtgtttccttgcccctccagggtcctggctgaggtggcaggcatcttggaacctgtaggcctgcaggaggaggcagaactgccagccaagatcctggttgagtttgtggtggtatgtacaagatgagagcgagcctttcagaagccagggtctggtcctggctcctcttactgagatacagggcagcactggcagagagcagacttaaggaaacctgtaaggaggtaaggatgttccctgtctctgccctccctctgagcaggactctcagaagaaagacaagctgctctgcagccagcttcaggtagcggatttcctgcagaacatcctggctcaggaggacactgctaagggtctcgaccccttggcttctgaagacacgagccgtgagtaggcaggggattgtagtagcagctgacctgagtggggaaggaaggaggatttcagttaggtctcccatttggctgatgggaaggaggcccagtgttgcagggaggcaggctagcaggccaccctcactcatgtactcattcctggtggctcatctcaggacagaaggcaattgcagctaaggaacaatggaaagagctgaaggccacctacagggagcacgtagaggccatcaaaattggcctcaccaaggccctgactcagatggaggaagcccagaggaaacggacacaactccgggaagcctttgagcagctccaggccaaggtacacccaggggtcttgagtacagggagggaagggcagttagaaaggaagagggaaagagtgagcaagctgagttgtgccagcttgcaatctcccaaaattctagccagaaaaaatagacttctcttggtctttctcccttgcttatctgtagaaacaaatggccatggagaaacgcagagcagtccagaaccagtggcagctacaa

SEQ ID NO: 7626 - DNA, 1026 bp, Homo sapiens
tggagatgggaggagaaaatctgaaggtaaatgtcctgtgcttctttcttctctcataccatccatggttatcttttagacacagaagcttgggtgtattccaactccttgatcaggatatttccacttgtcccattagttttcacagacagcagtttcatatctctgtcaagatcttttgttttctcttatcctgaaattgtctgtctgggaaaacccttctttcaagtgtggaaggctccttgggtgtgtcagtgcttctcccttggactgcagtaacttttttgtcatatttgggcttaacttcacttagttctacagagttataaccctgctctcttcttctttgactaaagcataaaaagtatctcttgtcctttgaaggagaagatttattccttttaaatctgaggggcttaaaaatttttcaagccctaactgggttctcacttttgtttgagcataaacttctttattgtaattcagcagctatgctagtcttggtggaatggggataatgaaaggacatcagagagtaaggcttctcttaccccggtactcttttatttaattcagagaaaataaacaccttctctaaccttatttgtcatgttcactgatagtaatcttttctgtgtttgaggagaaatacttcttgttacattcctaactaaaaaatgagtcatgatctcattcagaactttgagatgattctttttttttttttttttttttgagatggagttttgctcttgttgcccaggctggagtgcaatggcgcgatctcggctcaccacaacctctgcctcccaggttcaagccattctcctgcctcagcctcccgagtagttgggattacaggcacctgccaccatgcctggctaattttgtattattagtagagacggggtttctccatgttggtcaggctggtctcaaactctcgccctcaggtgatccacctgcctcggcctcccaaagtgctgggattacaggcgtgaggtacctcacctggccgagacggtt

SEQ ID NO: 7627 - DNA, 1026 bp, Homo sapiens
gtattttcatgatctttacctcagaaaaattaaggcactatagaaattctttatatactttctataaattaataagtgataggttattagccatagcctcttaaatgtagctttatttctaaacatagttacctcttgaaatgaactccacatatttatgaagagtagatatccttttatttattatacaagtaccagcactaagctttacagactctctgtcttagatctggggtttacaagtgccagtccttagacttctgcaggactcacttcataagagtcctaaatagagtttccagagttataaaagtaaatctagttaattgtgctatctttatgatacacacacgtctatgagaggtatatagatatgtaaaattaagctctattctaatattcaaaattctgcctttacttgtaaactacatcatgtgaaatactcataattattttacaagatattttccaatcatcatattaatatagcctaatttatattcttgaccttgaacagagtgaacttaaactattccagatagaacacatctatcttaccaggcacattggctctcacctgtaatcccagcactttgggaggcgaaggtaggaggattgcttaaggcaggagttcaagaccagcctgggcaacataacaagactctatatctacaataaattttaaaaattaggccaggtgcagtggctaatgcctgtaatcccagcactttaggaggctgaggcgggtggatcacctgaggtcaggagttcaagactagcctggccaacatggtgaaaccctgtctctactaaaaatacaaaaattagctgggcatggtggtaggcacctgtagtcccagctactcaggaggctgaggcagcagaattgcttgaacccaggaggtggaggttgcagtgagccaagatcacaccactgcactccagcctgggcgacagagagagaccctgtttcaaaaataaaataaagagaaaagaaaagaaaaaaaataaaaattagctgggtgt

SEQ ID NO: 7628 - DNA, 1027 bp, Homo sapiens
aagacacacaatatgaaaagatatgttcatggattggaagaattaatattaaaatgttcgtactacccaaagcagtctacagagtcaatgtaatccctatcaaatcaccaaagacattcatcagagaaatagaaaaaagtcctaaatttgtatggaaccacaaaagacctcaaatacccaaagaaatgctgagcaaaaagaataaagctggaggcatcatactacctggcttcaaaatttaccacatagctgtaatatccaaaacaccatggcactgacataaaaacagacacatagtctaatggaacgtaatagtgaactggaaataaattcactggtttccagccaactgatttttggcaaaggtgctaagccacatacattggggaagggatggtgtcttcaataagtggggtgggaaaactggatatccataagcagaaaaatgaaactagatctgtatcccttaccatatataaaaaaccaatatgtatttgattggattggatgtaaaacataaaactactagaataaaatactgaagaaatgctttgggacaatggtctgggcaaagattttctgggcaagacctcagaaggacaggcaacaaaagcagacatacaaatggggttacatcaagccaaaaagcttatgcactacaaaggaaacaatcaacagagtgacagcctatagaatgggagaaaatatctgtagactatccttgtgagaacagattaataagcagaatgtataaagaaccaactcaacagcaaaaataatccaattaaaactgggcaaagaatctgaatagatatctctcaaaagtggacatacaaatgaccagttggggtatgaaaaagtgctcaacatcactaatcataagagaaaagcaagtataaaaaacaatgagatattatctcatgctagttaaaatggctattattaaaacgtcaaactgagcatggtggcttatgcttataatcccagccctgggaggctggggtgggaggattgcttgagccctgag

SEQ ID NO: 7629 - DNA, 1032 bp, Homo sapiens
aaccacccccatgatttaattatctccacctggctttgcccttgacatgtgaggattactacaattcaaggtaagatttgggtggggacacagccaaaccatgtcagactgctagagagagttcttcagtctgaaggaaatggatgctaagatgtaacaagaaaacatctgaagttaaaaacctcatggatgtggccgggcacagtggctcatgcctgtaatcctagcactatgggaggtcgaggtgggtggatcacctgaagtcaggagtttgcgaccagcctggccaacatggtgaaaccccatctctactaaaaatacaaaaattacccaggcgggtggtgggtgcctgtaatcccacctattcaggcagtcgaggcaggagaatcacttgaacccggaaggtggaggttgcagtgagtagagattgcaccattacagtgcagcctgggtgacagaaggtgactccatctcaaaaaaaaaaaaaaaaaaagaaaagaaaactcttggataaaagtagaacaacttaactatttggtattatgtttattatctgtgtgatgaaataatctgtacaccagacttccatgacatataatttacctacagaacaaacatgcacatggaccgctgaacctaaaagtaaaccttaaaaaaaaaaaaaaaaacagtcaaattcagaatactctaatactgtaattatggtaagtaaaaccacttatatcttaaagatgaagactaaaagacaaaactcttaataactccaacaattggttaagaggcaatataaaaaggtataaattgaaacagtcaaagtaccgggggtgatatggtgttaaagtatagagtttgtttttgatacttgacagtccacattgagttgttatcagtttaaaataacctgttgtaactacaagatgttttttataagcctcgtggtaaccacaaaccaaaaactgtaagagagacactaaaaataaatggcatagaatcaaaacatactgctagaaaaaaatccttaactacaaagga

SEQ ID NO: 7630 - DNA, 1052 bp, Homo sapiens
actcatagtcaatacaagtatttttaaaaatgtctaatattttatcaaatctaaataacatagctaggacacttgttagggaaagtttatttagtatccaaagactgtttatgttgatgtatggaaaagagcatgattttaaaaaatcaatcataggaggaaaagaaattcgcttttcaagtaggaaggaatacagctagcaagaaagcaatttatttgaaacttctaatggatttttgagtgataaaacatttactaccttgtcctttaagtctgctaggctctcagtaccctaaaataaactagattgtgttgctatttttttctttctctataaaaataacacattattttatccgttatttgaaattttacatttctggttaccaaagttcattctgatagcatgtactttgtgaattattatctttgtctataactgacagatgtttatattaaaataaaatattgtattaaaaatttaaaataggtattttggatagatatgtgtctgtagtatataatctaatgtgtccatagtattattgctaatcttttggtttactataagatgatataactattttttcattgggaatatacatttttcttaatgttccaacatctatactttgtaaagtcaaaacatttcccatgagctgtagttattcatccttctgtacaaaatgaaaagtttggaaattgtttgccctgataccttgaaaaagaagccagaatatttatttgcttcatcaacttcagtgtatatcattttgtgttattttatacgaaaacatgtttattattttcatttttgtaaaaggaagtaaaaggtcaacattttctctcatgtaccaaccttgtttgtatttctattttctgtaatgtttaagtatgatgttgaagaaattcacattctcttatagtttggatgggaagactattgactatttcagaaacagacttatttcagaggcttattgttttctctgtatttacctaatattttataacttttatgaatcagaataatgtccttcataaatttgttt

SEQ ID NO: 7631 - DNA, 1095 bp, Homo sapiens
cactttaaaaatacctttctttgggttcttttagtattagcttttcatgcatagaaagagtgcctggaagtgaccagatggcatgcccagaagcttggtgtctgacactgctcttgatgcctcccaggcccagggcttggtagacaacctgtcctgtctcttcgagttccttgagaatcatacgttcctctggctctatctggagctgctggtccaacttccctgagtgaattggctaattcagcctaactcatgccacttgagatgaatcattcttgactatactttctaattgacttgggatgagactagtaaaggtaccgcccacatcgaaggttggaatttccttcagtggtctttctgtttgctttgtatattcaatgttccccaaatattctccccatagtgcttctgctcataaatgaaaactcccatttgaaaatagcttttgtcatcttaatagcagatttttatcagctgtaccactaaggtgatcaactattcaagaatcgactagaagacctggagagtcaagtaggctgaaaaatgataagcatccagcacccagctttctctgtatccctagagggcacttctgaatattccacactatgatggataatttctctttccctagctccacagctcagggagaaccctggacctgggcaggacattgttcagccttgttgttatctgagcagttggctccattttggtgacatagggagagtaaaagatgttctcagagatcagaagctgtccattggacatttcccttggttattgctcaaattcaatgagattgagagacattaaataatgcatcccaggtcacaccagtgacaaaactgggacgagaatctgggtcttcctgagcctgtggctcgtgtttttatccattatggcaaactgcctcttgggtttgcagggtgactgtcatgaagcccagccctgttttcagggtgacaaatttcccacccctccagctccctaacacgtctagtggccatctatagaaactggcacataagactgcttggagtgctgacctcctcactgctcagtcagtctccccaatgcagagtccctttt

SEQ ID NO: 7632 - DNA, 1069 bp, Homo sapiens
tattttatagaatagaccagaggactgccatttcgccaaaggatgcttttgaaactcggcaggacttaaatgaggtacgtgcaatcattactggttataagaacatgaattagccaatcatgagatttactattctttttcacagtactaggaattcattctcatgaaaacttagtatttttgcttttaagtgaacttgtaatacttatagttctttgttcaattggtaatgtttttcctttttccggagcaaacatttaaaatactgtttgtgaggtggcttgcgatgtcttggccctaacccaagtccagcagtcattttgttacactcttttcagctttgcttcaggattgtataaccgtggcgatgacagttaacatttgcaaaattttctcttaattttattttgtctacatctctgtttttcctaacagcttctgcaatttcaaacataatcatacttactgtttatccactaagaatgatatagtttagtgtttgcaatgtgattttcttagtagacttcaagacgtgaagccgtattttccaatccaaatcatttcccaccaaactggacatcatgatgttaattagcttgttctggattttctttggaatatgtaattgaattctcctgtatgaaattaatgtaatataattatgatatctattataatgaatgccattgtttaagacattggtttggaatactctctctggctcttcttgtcctcattgtaaattaagtagtagtaggtggtatttagtacgtctgattaaggtcatagcaaagagaatgaaaagacctgatgatcagatgccaaaaagagaaatgatggggctttaccgcaaattgtttatttgacgttttgaagatgcatcccttcctcctcttcctctcccaccccacaaaaagggtatttcacttaatttaggtgattttatttttcttttctttctttttggtagaacttggtagaaataaatagctaaaggtaaaccagctgcttggttaagccaagttaaatagctaaagtggtaaaaagtgtcctaaagataagaacacag

SEQ ID NO: 7633 - DNA, 1029 bp, Homo sapiens
ccctcccccgccccctccccttcccctttccttcccttcccttcccttcccttcccttcccttcccttcccttcccttccctctttttatttattttaagttcagggtacaagtgcaggcttgtttcacaggtaaacttgtgtcatgcgggtttgttgtacagattatttaatcacccaggtattaagcctagtacccattagttattttttcctgatcctctccctcctcccacctgccaccctctgaaaggccccagtgtgtgttgtccccctctatgtgtctcatagattgatgtgttctcatcatttagctcccacttataagtgaaaatatgcggtatttggttttcactcaaaattataaaaaccctggaagacaaactaggcaatatgatttaggacacaggcctagacaaagatttcatgacagtgatgccaaaagcagttgcaacaatagcaaaaattgacagatgggatctaattaaatgaaagagcatatgcatagcaaaagaacttattgacagagtaaacaggcaatctacagaatgggaaaaaatttttgcaaactacccatccctcaaaggtctgatatccagcatctataaggaacttaaacaaatctacaagaaaaaaaccaagcaacctcataaaagaagtaggcaaaggacatgaacagacacttttctgtttttttgagactgagtctcactccgtcgctcaggctggagtgcagtgacgcaatctcagcttattgcaacctccgcctcccaggttcaagcaattctcgtgcctcagcctcccaagtagctgggactacaggtgcctgccaccacgccccactaatttttgtacttttagtagagacagggtttcaccatattgcccaggctggtctcaaactcctgacctagtgacctgcatgcctcagcctcccaaagtgctgggattacaggcatgagccaccgcgcctggccgaacagacactttaaaagaagacatacatggagccaacaaacaaatgaaaaaa

SEQ ID NO: 7634 - DNA, 1045 bp, Homo sapiens
ctactcacacccacttattttcttcgatgcctgaaatttcacctagagatgatttctttggatgaaggcctctggtagtgacccttattaaattggaaattaaaaagtttgtgcccttgggaagtggattcaaattgtcatgaatactttaatatgaattattttacctaacctattttctaacctgttatggttatggttatgcttggccagctgggagtcctagaagagtcaaggggaaagggaaattgggagggactcaaggacagattttattttcttcttggtttttcccagccctggcactatctatgcagctctagacaaattcaatttctttttccaccccaatgttttcatcacaatggccttggccttttcttccctatctgtggcaccttttcatctaatatttttccatggtcaatcgtgacattgccccagctaacttgctattttaaatgaagcctgcaataattctgattagttatcattcaaaccagtggttctcaaagctaactgatcatcaatatcaactggggaaggggactggagcttgtgaaaattgcagtctcccaggttttatctcaaagtgggaacccagaatgggtgattgtattggtgtcaggacagtgctgttttggggtttggaaacctttaggtcagtgttaaatgtttagaaacatagtagttctataggtaggcagtctgttttaaaaatccacattcctgggctctgccctcagagagttgatgtagtggggctggagacttctgttttgaccaggtacttcaggtagtgctaatgcaaggggccacattttgagaaagcccacaggaggctgtacctctgcaactttgccttcagggaacatggtactacagggcaagtgtaaatatctttatagcacaactacattttatctaacagtcagtctgaggcctctcttctgttttaggcagcaaaaagaacttcttgtgggtatttctttcaccaccattattctaagaaatggcatgccctgtctcttgtgatcctctggca

SEQ ID NO: 7635 - DNA, 1035 bp, Homo sapiens
gggtatcacacatagaacttttaattctgctggtgtaggctgttgcccaaacatctataattttactgagctcttcaagtgattctgataacacagcctggattgagaatttttataagattggcaatggaaaaacatttattcttttaaataataatttttttaaaacccaagaggtcaggggattttataaaccaatagccaagtgttctttaaataggaggcacccttcccattgtgccaaaatcatcttttcatttattttgaaatttgtatgattattttatacttgtatgttgcctttcttcgaaggcgcctgaagcactttataaacacaaatcctcacaatacctctgtgaggtaggtaaatagtacttttctatgtagtaaacctggaatatggagaatttcataacagttcattctacttaataatgcaataatggagctccaagttgtcttggacttctacaccacactcagacttctggaaagttttctgtacctcattctttagtccctgtcaaggttagtaaataaaataagtgacataaaaaaaaaaaaaactaaactacttgttgtgttgaaagttcctttttgccagttatgttcaggaaacccaataacctgaaaaagtttgactttgatgtgacatcttcatattcatcaatgctgataattgtccaaaggcatcttcactatgtctgctaaataacatccaatgtgggcgttatctgttgtctaggggatgaattttaagttacaataaaatatttttctttgttttgcatcagtttggttgctttttctcctcttagttctccacccaattatagtgacatgtcacttgaatgtaaaactataaattacctggcataattcagactctggaacatggttattggacaaaagcatattcaaaatgcttagctacttttaccattgccttccaaaaagctagtttatcagctttacctcttgtggtaaagagtactctgcaggtcttagttcttaataataatttatagaattctt

SEQ ID NO: 7636 - DNA, 1044 bp, Homo sapiens
tctgtgtaacttgatcttctgtctagtacttgtcttataggtaaccaacactgaaaactttgtagtgatgactaccaaagaaatacatagtaaaacaaccttttatttccaaattgttaaagagccagccattgatgctgctacatgagttccatgctcaagagccattgtaagagattaaggggtttctaggtttttggtgattttttgtttgtttttttctttgttttttagggtttttttttcttctttaattttttgattaaaacatacacacagctgttagcataaagtcgtggggggcattttctggaatgctcagcagttctgattaactgccaagcccaggttgcctctcatgaggcaactgaaaaaatcctgtgtcttgatagcatgggtgctgtgtgtgtgcatgtgtgtgtctgcattcatgccttaactcgggttactgcacaactttagttcttgacttagtctgcaccgtcatctagattgtattgtacatctcggtctgaacttcatcctggcaaaaacaaagttgcaggcacaacagtttaagaatgcattcctccagaagagtatctggtcaggttgacccctgagccttctttggacttgatttggaacttagcctggaaagcgaaagtggactgtccaacagaaagatgtcaacaaggaaaagaggagagccaagcgctagcatgccttttgcctctgcatatctgtgcacactgtatgttgttcatgatagcttgtctacaacttgactaggttggagttctggtaatagtggcaatcttgacattcttggtcagagtttagagagatgtaagactttcaattaatgtcttatttactcctttatgttgattagtctttgatacatgtgctgaatcagaaacctaaataaagataattttttaaaatgtacctcttgagccttaaaccctatcttttttcatttcggtttttgggaataaaacattgtttctctgttgcttctgacagacatctaacttaaattgtaaactctaaaggctgcct

SEQ ID NO: 7637 - DNA, 1498 bp, Homo sapiens
gtgggagaatgagaaagaccagatatcttttttgtttctttgttttttgagacagagtcttgctgtgttgcccaggctgaagtgcagtagctcagtctcgctcactacaacctccacctcctgagttcaagcagttctcctgcctcagcctcccgaatagctgggattacaggtgcctgccaccacgcccagctaatgtttgtatttttagtagagactgagtttcaccatgttagccaggctggtctcgaactcctgacatcaggtgatccgccttcctcagcctccccaagtgccaggattacaagtgtgagccaccatacccgaccagaaagaccatcttgtaacaattccctctgtctatggcataggggctgaactgaagtctccttttttttagatttggatatgattgcatgaaacatggtttaattgaaaactctgacttttcagattcagagaaaatggcacagtatctggaggaggaacgtcacatgagagaagagaacttgaggctccagaggaagctgcagagggagatggagagaagagaagccctctgtcgacagctctccgagagtgagtccagcttagaaatggacgacgaaaggtgtgtgcatgtcttatgagccttgtttttgtttaaaaaataaaacccaggttctacagaggttttctttggtatcctgttaggtgtataaggggatggcttaaatatgtatttattgtgctaatgaatgccactgcgttatagtagatgccaagaatgggataaagattgaacattttccttaaacacaaaaagatgaaaaaaatcacctctctaaaatcatttggtggggagagaaatggagacagggttatattagagaagcagcagagtttgcatttgttgttgaattagtttaatccagtgtcatatctgtttaaagcatgggaacatattaattcctgtactgtataaggataagcaagctatagtgcagctcgaggaaaacagtgcatgcgtaggttgaaaagaatcagtagggacacaggtgggggttgttgaaatcccaaggacttgccttaacacacttgataacttttgagcctttttgtagccacttaaaaaaaaataaaactaatggattgcattcatctgttcaaacctaagcaatgaatcccctcattgccccactgtgagtgatctggaataacagacccatcctttggttaactagcagaaatggtctcaagtatttgtgcctcatccagttctcttccctcttcctcctctctaaattcgggataaggtagtggtaagataacaaacaagtataaatggaaaaagatgttcaatctgcagagaaacccagaagttagagaattaacctttctctgaaccagatcatttctgcaaggaaattctccattctggatcagcgatgccctggcgttacatgggcggtatcttagtgtgagaggtgagactgagtattcttgggggtccctccag

SEQ ID NO: 7638 - DNA, 1034 bp, Homo sapiens
acagtcacccttctagttctagaaacagcaaatactccaaggggtcaatcttttgtttcctgtagagccaagtgaaaaattctgcatgcttgcatatttgggatcaaataatttaaatcgtttatattaaaagtgtactttgtaaatattttcccagcatgccttcaattaaagagatttttgtgtctggattagacagcggggtttctggctatgttgaaacagccaagggatttagtgtttagtgcacgtaatagtgtttaataattttggtatttttatttgaatttctaaaataaggatattcaagagcttttgtatatctgtaatgatgctgtcttggaaatcattgaatacttatcagaagtctttattggctaaaatgccagacctttgtagagttgcttaaaactgaaactaatttgatgggcattgagagttgaaatagggtcagtctgtgggagaaaaatgctcattgtggcattcagctccctccttcttccctaaatttggaccgaactgacaatatggaacagcagcctacaggaaactctcttagacgtgctcatggccactgaatttgtagctgcttttcagaaaagagaagtatatggagattttacttttcccaagttcattgacaaagacaaggaaaagaaatgaagcaagaagatgggtagacaccacattttgtattagataattctggttacttggtagcagattctgtgtgagataaaccagaaaggaatgggggcggtggggaggttgtcaaaagaggaaggaagacgtgtttttctttttttggaaggttgtggagtatgccacagaatcctgtgaagaataaccttggaaggacaagagttttgatggctccggggaacttagctgaagcagaccctggatccccataaagatgtcagttccccatttcagattcctgggagaggtagtctaagtggctcagcctgggtccaacagctagtgccagggctagtcagctctgtcctgggagatgggtgctgtagcagaga

SEQ ID NO: 7639 - DNA, 1026 bp, Homo sapiens
atctggaggttctgcatccacaaccaaagatggatggaaaatacagtattcatgggatgtcaaacctgtacatgtggaaggctgacttttcctatctgtgggttcctcagggctgactacaggacctgagtatgcacacatattggtatacttgggattcacaggttctgagggacagctgtagtaacacaatgagcacactcatttacacctttctcttttcgcttactatgcattgtagttttctcccctgctgatacatacaaagctgccttcatcccttatttaaaggctgcatagtatttgattgtatgaatatgccataattcaactagtcccataccagtggaccctttttggttgctatgctacaaccgcaatgaacatctctatacacgtgtttgatacctgtgcaggaacaccttcaggatagattccaggaagtggatttgttgggccacatggaatgtgcattttaaaaagttcagtggttcctacctttgttttcgtctctgaagttccttacaaattcttgtgccgtggagcatctgggatggtgtatcagtatcatccttggagcctttgagaaatatggtgtagtactttcctatttctgctattacaaattaccacaaacctagaggctcaaaacaatacaaacttaaccatcttacagttctaagatgggactcactaggctaaaatcagggtgtcatcagggcagccatccttctggaggttgttggggagcctctgtttcctcgccttttccagctctagaggctgcctggattccctggcttgtggccccttccttgcagtcgtaccaccccacctctgcctctgttgttacatcttcttttcactctgattcccctgcctccctttattaggatccttgtgattatgttgggcccactgtgataatctaggataatctacccatctcaagccccttaacttaatcacttctgcaaaggcccttctgtcaagtgaggttagtagcatttataggttttggggatt

SEQ ID NO: 7640 - DNA, 1050 bp, Homo sapiens
cagttatcacatatgctcccacatgtcccactgctttgttagatcagtagtaagtgtaggtttgggcatgtgaatggtgagtggtcctctgtatttcagaaggcagcgcaggctagtgttcagggcctgggctctgacttcaaagcaaccagttgtgaacccgttccctctacttaataatcctttcaccagttcactttctttttaacagccctagtgagatgtaatttacatatcctacaattcacccacttaaaaggtacaacccagtggttttcagtgtattcggagttgtgcaaccatcaccaaatcaattttaggacattgttgtgaactcaaaatgaaaccccgtaccattcatctgtcacctctaatcccctataacctctaagcaactgctgttctactttctgtctgtgtatttgcctattctggacatttcatgtaaatagaatcataatatgtggtcttttgtgattggcttctttcatttaccataatgttttcatccctgttgtatctgtactcttctttttttctggctaaataatcatctatggtatggatataccacactcatcaattatccatttatcgtttgatggacatttaggttgtttccatcttttagttattatgaagaatgctgctatgaacattcacgtataatttttttgtgtggacatatgttttcatttttcttagtcatatgccaaggagtgaaattgctgggtcacatggtaactctccttaaaattgtggaaacaaaatgtaattttaaaataatccatactttgcatgtagtgggtgaacctgcagaagggatattggaaggcattctgccagagatttgagttggtcacgatgtgtttgttttgaaagtagagcttgggttatcatggtttctgagttggctcctttctgttctctgtaaagcagaacttaactgggctgagtttcttcctaggaaggccccagttaactcacatgtcagcagggcctcactgtaagtttatctcactgaaagttagtcctttggtatggacactt

SEQ ID NO: 7641 - DNA, 1019 bp, Homo sapiens
atgcctggaggaatttaagtgaaaagtagttttcagctttctctccccactgtggagacttcatttctaaagtgagcattgacaggtttacatagttcctatcattctctcacacattttctcttttttaaccacaattaataaagtttcaggagataagttgtgatgtactgatttatagcaggaaatgtcagcttcctttttgcaaagcaaagggagaagaatgtttttgaccacaggatagtttctgtgaaagttcctaagacaatgttgctatggaactaaaactggtctttcaaagcttcttcagaataaacaattaacattttcctctttgattgattggcaaccttacatgagccttctcttctcccagtccagacttgttggtacaaatatggagtcatagacttggtaactcaccttgagtcaaccactgactgattgtatgaccttatattaacttcattaatttctctgggctcaggttctccatttgtaaacagagcaggacagactaaaaccagaaatggcaaacttaacaagggacaaaggtgggaagtagtaatagcacgcaatccctttgtcctctgccctcagcaggcattggtgttggaacattggccttgggagtccagacttggtctgtatgccccattatcacagagaactctgggcagctgttgtcactccattcagggtgtgtcaaactatattattgctagcctcggtgttccccgatgccttcacccatgctagcgtcctgaaattttagttcccttaagttataagaggctgatgctagtgtactgctacctgggtttccatgtaaaatgcagtagatgaagatcttccagctgtttgtattttagatcctgattgccctgattaggctaagcctcattaaagttgtctgatttatctcacattcaggcttctccctgtgcaccttactccatgttaactcattccatcagtcactctcaggaccgctctcgtttgaatattttacctgagaa

SEQ ID NO: 7642 - DNA, 1053 bp, Homo sapiens
acagctagtcttgagtcaccctgcaccaggcttcccagggtttttacgtctgtggtgccatgagctatagctttaaaataggcaggtcaattcagggtgttggttcaaaccctattggagccacgttgcttgaatttacatggtatctgtttaaaagagaatatctgaatttttcttagacaaactatatgaggcaagttctgtagttattagtccttcaaggtccctatgcacacatttgcctcctacctcttgctcatcttaacccttgtctcatgattttaggggactgaggtgcttctgtgcttctctcaagcaagcttttttttttttttttttttttagacagggtcgcagtctgtcacccaggctggattgcaggggtgcactcatgctcactgcagccttgaccttctgggctccagcagtcctctcacctcagtctcctgagtagctgggactacaggtgcgcgcaccaccgtgtccagctaatctttttttgtagagacagagcctcactctgttgcctaggctggtcgcaaactctggggctcaagcgatcctcttgcttcggcctctaaaagtgctgggattataggcatgagccactgtgcctggccgtgtttctctttttattggcagtttctttgttccaggaagaactatattttctgtttctagtctttgttcaggaactccatgctctgcttctgttgcatgtcacctgaggtggcagaacaaagcaggcagcagaactgtttgttttagcactgtctttgggggatgataaaaactgtgaatctttagcaaacagagttagatctcagaatggcttgatattttccaaatgggttagtgtaacccagtgaccttacttgagttctggtaatgacagctttaccatcaaattttccttagggtacagctcttgagaggaaaatgcctcctaaaattgagagctctgttaggctttgttactagttcaatctatagtcttaaaggaagtacctaaagctactgacagtgttagaccatctgtctaaatatggatat

SEQ ID NO: 7643 - DNA, 1024 bp, Homo sapiens
tcaagtctgacagtgtctataaacctcctctaaagggtggtctgcaggctagtacttcaactatgtgtcccttgcccataagaaaataagttaataaatccagcgtaaacatttagctacttttctagcaatttttcattgctctgtatccaagtaagtgaccagtgaacccatcttcttgaaccaggtatggaccaggttgagtgtttttgaactgacatgatgaggtgtgtatgcaaagctgtgttctagtcatgtgcattaggacatgcccagaaggacatgtgtctgtccactgcagatgggggtgggcagtgacgactacctggtctttcatgaaagctggtttgagagaaaccacagttggtaaaatttagtaacttaagaattcttatccagaaagtcactctttggtgctattttctctcttgctctgcagtcctgtaacaatgacctaggcttagtatctgaggcagaattagtgcatttgccagggctaataatgattctgctccaatccctgtatatattagtgacttgctggcaatactggaatggagtaaataatatgaatgcttcagttatcaactattagttgcttttattgtgagctagtgtgcagtatgcggaggaagcgtgtactagtctagggcttccaaagactaaatggagaattgtaattctcaggcatgtgactgaaatcctcttcttgcttcttctaatagaaaaaataaaggcacatgcaggcttgtcctctgtgtcatctgttacctacccctgctgcaccggcacttaaatattaaacagatgtctgcaggacagtggttggtgttgataaacccattgctgtgaccaacagtcaagctaatcctataagaattgccagccattggtcatgagggattctgctaaattctgaccatctcccacaacaatcattatgtacagtagtatacctaggaaaggacagtttaaacagaacaagtttttattcagttgcctgtgtgttgggtggtccctgcta

SEQ ID NO: 7644 - DNA, 1045 bp, Homo sapiens
aattgttggatctctcagtgagatgataactgctaatttatacggtacctgcttctcaaatggatttgaggtggccaagaagatatcccttccctccaagcacacaaactgcatcttttcctttcctttcccttatggcttggcctaaatgaatagtcataattgttaaataattccttgcctatgaaaaaaaattttctgaaagggggctcttcatccaaaaaaacttcattgggatgccccatggaggcactgaaatctctcattatgactctttttaaggcagggtgtgagtagaagacttgatactttggcaagctgaatgttatgattggttgtgaaggggtaggggtttgtgtgtcacattctgggtcaccttagactcctgaatcttttcacatggattgggatgtgacttgaccagaacatacttttctaattttcttgtctaacagggcattgaaccttctgatttctggcacccctgttttgctacatagccttatccgtaaactgcagctgtgaattccttctcatttggtttcatgggatagattgtgaaactggctgatataaatggcgagttttcccttgcagtatccagcctgacagtattcaagaaaggaaagggaaggaaggtgaagaggagtgcttggataaatggaatcaaaactcagaccaattcaagtagatgaaataaacaaggggggagctggaaatgcagacattttgctgtcaagtgtagggcttcttgtgcatatttgtaataatgaggtctggctatgagcatccaattaactcctggatacttatttgtttctcaagaaaaatttctaaactcttgtttttcataaatctatagtttataatatgggtgttcttaaaataggattgaactttagtaacttcttattccttaagatactaaggaactgaggtactgtctaattttgtctaaacacagtatatggccatttattccattgaaatgctttgaaatggcatctaaattccatagatacccgaacttagttgtgtaccctct

SEQ ID NO: 7645 - DNA, 2004 bp, Homo sapiens
ggatatttttgaggttacgtctaccctatcacacattgtccccttcatggggactctcacaagaaaattgttttctttggtcttaataccaagtagagctcctcagttttggggcaacaaaaactgcttaggcagccaggatgttcagcgaagttttcaaaatgcatactacctgttgatcagcatgtgtgtaatttcaacttttggcttcatttgaatattggactttttttctcctctggccatccatgcctcctctccctttaaaatcttacacatttatgcaagaaccccccagtgaattttagaatgaattcatgtattaaaaattagcccaaaatgaatctgaaattttagtaggccctcagctgatccctaagagaggaaaggggcataattgtctcacctcgttatgccccttctgggacaccaagataaagaaggtggaatttcccccatgtgaagccccaacagtttctttttttcttatgaatgtgctgccgggatgttcatcttaaaaccattctgaagtcttacaggacacatcacactctggctcacacccacttctcggggattgccctggacctctcattctctgggctggggtgactgtcagtatcaggggcccaggaacagtggtgagtggtaggaagtggtgacatctgtgataatacagtgaaaacagtagacaagatattggttgaagatggctattatggtggaagatgtggatttagtcagaaggcacatggctgaggagactgttgggacctgctgggcggggctgaagggctttggttggggaaggaggagataaagggagtgcagcagggggtcgggcagacaacgctctgctctgccagattatagaaaggtagtcatctctgatcatgtcagaactgatcgttccttcctgagttgcacagaggtggcactgggcagagactggatagcaggacatcagtggtttgaaccaccatcctctgtgcaccaggctaaatacaagcagtaactcacataactctcaaaaggagcctgtgagtataagagttatcctcatttacagatggaagatgtgtctcagagaggttaaggaactggcctaaatagtggacatatgccactttcagagcctcagttaagtggaggctgctctgtgacatgctaccactttatcttttccttttaaaaactttttttggagtataacttatacacatatggtaagtgtacattttgattcattttcacagattgaaggcacatgtgtaacttgcacccagatcacgaaacagaatattactaatacctggactccactgtgcccccttccggccattatccctccaagggtagccactatgtggagtttgaactctgcttaactggaattagacagtgtgtactttttaagtgtttaatgtctttctcccagcattatgtctgtgggatttatctatattgttggtctcttcccgtctgagattgggtcttagaacctagagtgtccagaaaaaccatttgttactatagggcaaaaccatttgttactatagggctgtaaagtcccctgagtgtacagttggtattttcagaacttgtaaaattggaaaatgtggtcctctcggtgtcatcgtggtctgccatgctttgagcattagaagaaaaagctacctggttttcagagttcttggtatagaggattctctgtatattaagaaggaaatgtcttcggtattttttaaagaatggattaaaaatattgatgcactcagagcctctgccagagacattttctcttatagatgtagcatgcttctatgcaatagctaggatcctgaaaagtttatttgcagatgaagttaaattcggttttatcaaaatgtaaatgtatgagggagcctgatggtgaaagaaaagggaaattggtaaaatgatgaatcatttgtgccctcaaagacctctaggcacatattgaacaagcttgggtttatcgttcat

SEQ ID NO: 7646 - DNA, 1029 bp, Homo sapiens
gctgtaaagtattctgggaactgggcgcactctctttaactcttcctctgttgattgttttcagtctccttctttctataaagcaagttaaaggaaacattcttttaacaatgtttttaacaagtcttagcaatggtttttattatctgtaggataatctaggagtagagttgccagtttttagagtatgtgcttttgaaattttgtttgtattcacttgggcagcagtaagtcatcttttgcttattgtcgtcgctgtctcgacctgaaatcctttctttttatattcttgccttctttttttggtcctgtagcagggaacatcttatttttttgtttgttttgaaggggttgcttttacttagaacaaattgccatgttacttacctttatttttttcctgaaacttagtcaactttcttaacattaaactcctcttttgcttaattggcttagaagtaagtgagagaacagagataatatggcttttagtaccaaatgcttctcttagtaagaatctacagattggttgatgttaggagtttaaaactgtttttggagcccattaaagacatgtctcctgtttgtatgggtcactctctcaagtcacataagaaggtggtggtctttgtaaaaatgctagaaaatgttgggaaatttgttcaaagtttgaggctttctgtcaaacttgagggttttgaactctgacaacaatacattaaactttatccagtttatactgcatacagagtttcttaaagcaggctctaccctgatcaccatcagtatatgtgatagggatcttagccctctgttctcaaatatagtttagggagttttagaggaaagtgtgtttcctcattaaataatcagttgagttgactccaatttgtgtacgtgaaaccaacaaaaagaatataaacttttaatattatggtccagttggataggatttataattttgagtaaccttccagtaaaactttgtgattcattaagtttttccctgtcatcagcctgtgctgacat

SEQ ID NO: 7647 - DNA, 1151 bp, Homo sapiens
gtcagagggttttctcaaactggattttggtagtctggtaaatggacagtgacatattagtacagtctttgcatttctctcaagggggtggataagcatcatttcttgtgtttataagagccatttgtattctttttctgtacctgcctagttgatatcctttcttgtttgtctttggggaccttggtctttctcttacccatttttcttagaactctatatgttacaatgacttgctcttgtttttcaattttgagttgcaaaaaaatttcccacctgtcaattgtcttttgacttggcttttggtgttttttggccacagtgaaaatttttatttttatggtttcttgatgtcatttataatctacaggaaatattgctaacattttatggtaaaacctttctgtatatttacttctttggaaaaaagtaggacagactgcttttgtgtttttgtttaaatgatagtgcatttaagacagattcagaagagtgtgtagaagtagcgatgccagatattcttttaaattgcataaacaattgaactcacaactgcacattagatacatctcctggtgtcttttttcctcattcttgtctgtataacactttatatttcatatgagatcttgaattaggataatttcctctgactagttgatcaattactgaattgtttattttggatactattattgtagcctccttcttcctccagaagctgctgcttaaatggattcaagtgtaattggcattatttttctatcctggtccgtttcgggctctgtttatctggtggttttattttactctgcagtattttccatttcccctgcttaaagatagatttaaagctgcagaccttaaatgtaatcttctttcatattggccggtcttctttgttcatctcacagatattacaaataacgtatatattacaaaactttgttcattctgctaatatttctgaggttattctgtatataaggctgttctatgcattgtgctaagaggttttgagacagttcctgcctctggcagctgatattctagttgggggggcggggggcggggttggaaatagacatcagacaactgatttcacagttatagaattgaagctgtgataaatccttcaaaagatgtgtttc

SEQ ID NO: 7648 - DNA, 1036 bp, Homo sapiens
aattcgaatttaactgggcctcctgtgttttatttgatagtcctaaaacctagaggacctgtgtttaaaaatctgtctgccctatcgcaaggacagaaaaccaaacaccacatgttctcactcataggtgggaattgaacaatgagagaacacttggacacagggtagggaacaccacacaccggggcctgtcgtggggttgggggaggagggagggatagcattaggagatatacctaatgtaaatgacgagttaacgggtgcagcacaccaacatggcacatgtatacatatgcaacaaacctgcacgttgtgcacatgtaccctagaacttaaagtataataataaaaagaaaataaaaataaataaataaaaaagaaaaaaaacaaaaatctgtttgccccttccttgctgtgtgaacctggggcaatttagctaacctctaagccatcttgccctcttctctaaaaagcgatcatagtatcttagctctccagttttggggataaatgatgtgacttaggaaagctctcagggtgcattcagcacagttcttccttttccttctcaattcaatgattatagatttgcttcttgcccatttcttcccttttctgttttcttcccccacaaacctgagatcaggttgctgtctgagaagaagccgacgcagcatcccctccttggcagcatcccctccttttgcggggctctttggagtcttctcaggatggtgcctccacttcttcctcagcggctctcagtttgctttcacagttcctgttcttccacaccagcttcctggtctcctcctctctgaaagccatcgttgactggatgtctcaggtatctgccgttacttggccacatgttacgaaaccccttgttttatgtctcctttcctcgccagcctgcagtggtactgggagaactgggcctatctatgccttgccttctctgtgggacgagacatcagtcatgtctttcttgacgagcctcagcttcctgagagaagtgtgtttagaatttagggtt

SEQ ID NO: 7649 - DNA, 1038 bp, Homo sapiens
cttggaaaaacgctccctttgaggccttgtcttatatgcaaggccatatattagtaaccacatgctttttgcactagataaatatagatcatcttatcaaattttaaattattgataagttatagtttatacattcttctaatattctttattggaaaaaatagttgttaagtaactctaataaaaaagatcaccagaacacaacagaagtagttgtgttgaaagcttcatttaatttgaacattttaaaattggaatatccttaaaatacagtcaaaaatgaaatggctttttgttgctgtatcttaatatttttaaattcctttttcaaaatttcttagggaaatttagaaacatgtatatgaagtaatttcacttaggcagattataaacctcagctaatcttagccagcttttcaacaagagtctggtttatagatgaccataactgaaaaatgttcacttacctatagcaatttgagtttacaacagcagctaagttggtatttacctgggactgatggaaaaattagacttttattttgtagaccaacaattcagaaactgtggtttgttgcttttttcctgtctctcctcttcgttgaacttttatgaaacttcctttcctcaccatgaccagaccattgttgacttttctctctgctgaggcagaaaaatgcttccatagtccatgcagcaatgtttaaaacaagggattcgttcccccctccccttttgtgtaggctggttaataaactctatgtttcatagcattgtcgtgaatattcagagtgctccctgcgaatggttttcctactatctctgttgtgtatcatttctgtttatttgattcgtggttctgagtggaccctaccactgacttcaccaagaccttcatgtactccacaaccctttcatcttggtcatatctgtttttgtacaacaccctaaaactacatggagtcttttaaacttggtctgttttttcaatccttttcttaacatcgtttaaaatttttttcccagtgccactgctct

SEQ ID NO: 7650 - DNA, 1041 bp, Homo sapiens
taacagtaatttattatgtatacatatttactaatatcaactttatattttaacattggacattgtaatctgaaaatatactggagcaaatgtttgttttgcattattatatgcctagaactgttagattattttccttaagcaaatacagtcagagtaaatttttggagatgtggcttaatagccagacgaaaagccataaacctaaaattcctagtgtcagtgtctttgctctttattaagtctctagacaatggatacagttttgtcatgaaggcttattgggcagtaggagtattgtctcttaagacacagagatgaagaacttaaaataattaacttctctaactagaattactgtatgctcaatgataattattaagaatattaagcatttaagagaacaaaatttatatctgtccctcgaaaccactattaacatcttatgtgctttttttaaaacaagaacgttttataatgttatacatacaatgtaatctgcttatttgtaactgtgtcattctacaaaattaaatattttctgatcttggttttaatgcataaaaaaatatccaatagatgtaccttatgatggtggttttctaactgtggttcacaatgcttcaatgagatgtgaaatcagttcatactttgtttttgtttttaaatggaatattatataaaagaaaatgactgtgtttaagtgtattaaggctaaattctgttccggggagatctgattttatttatgtaaacaccatgatatataatgtatttctaactgtaggccatgatcacaacagttgtttgcaagccactgccttaaattaactcttatccttttgttcaacatgcagattgttttcaatgaacattcatgtatataaatcattgtatataactcatatattgtcagggtaaatttctaaatgtgaatcacttggtcaaaagataatggacttttttgagcctctgaatgcattttgcaaaattgctggaagtattttgtaagggggatagagtcttgaccaattccttttc

SEQ ID NO: 7651 - DNA, 1048 bp, Homo sapiens
tttagagtaatacaatgtgttatttctggttaatgttcagtaatcaaataatggatgaaatgcaaatacagtattcaagtttcattttcatttctggtggagcccagggacgttctagagggatcaccttctctctccaagaacagaaggagagaggaaaattgttttgtcattattatttgctgttactgttgcaaaagctggagctttcagaaaaaaaaactgttagaaggaaaatgcacataactcagactgtactatgaattgtcaggattagatcatcagacacaacaatcctgcgtttaggaatcgggcatctaactcttgctgagttcagatgtgaccaccccggttgctgcataatcgtaatcatcatcttttccctttacctttcctgcctctcatagggcttgataaaacaaccatgcttaactcttatacagttaaaaatcctcagataagtctcattctataaccatcaactaccaaaattcttctagattagagacaccagccaagagccctgtggtcgtctgtcttttctgaaagaaccaaagacaacaaaaggactgcctcaaacagcggtttgcaacttaaatatcactctgccagcacataaaaaggtatcttttaatactgctttaaattgtctttccctggtcttgaagaagtgggcctttggtatgcaattaaggaatgctttgtaacatgaataaagctcttgaaactgaagttgtattagtctcctcgtgtagattgcctaagtcttgttaatgtggtgtcaaattcttatagtttgtatgatggagtcttctctgtttatcgcttttgcttctgctggtagcgcatagatttttatgcttttaaataacgtcatatgttaatttgccatggatgtacagttcttgatattttttgttggctttttttaaaatttgctttgctttctaaatcagcttgcatttgtgctccctactcagtccttttcatatcctgatattcttttccctgctgtccattataatattccttgtctctgcaatgcatc

SEQ ID NO: 7652 - DNA, 1066 bp, Homo sapiens
acatatacccatttccgtggcagtgcctggatctgatggtcgaatccctaaccccacccatttctcagctaatgttgtttagaaggggcataagtccctcctgttctgcaacagtgagacccaattctggccgttcagagcattcctatctcctggattacagcaattactttaggataaaaagtgaaatctgagcccatctagtgagactcaaatttgagactttgtctaaccttttgggaaagagaaactctactggggttcctaagctataaagatgacatacgtccaaagctgctgggagtagaatgtgaagaccaatgattcctaccatcatttgagctggattcaaccgaccttgaagttagcaccatacagattttcttgccatataaaccagcaatttaatttcagtcttcccccatccctggaaagggagtatcttaaaccagttcagtttggttttctgtcattactaatgtggttgctattggtggtaatgaaacctggtaggaacaaccacatatcaatgggaacataaaacgtctagcatcttaaagtgccattcaaccttgagattctattattttatgctttctctctagaaataagtaaatccaatattaacaaaagagaaaatgaggaactatgatttaagagaatgctataaagttggggatttcttttttcttttctttttttttttttgagacggagtctcactctgtcacccaggctggagtgcagtggcatgacctcagctcactgcaacctctacctcccggattcaagcagttttcatgcctcagcctccccagtagctaggattacaaccatgcaccaccacacctcgctaatttttttgtatttttagtagagatggagtttcaccatactggccaggttggtctcaaactcctggcctcatgtgatccacccgcctctgcctcccaaagtgctgagattacaggcgtgagccaccacacctggataaacttgggtatttctaaacaaaaactttagaaaggagccccttgccaattgatcactctaaaatgaacacctt

SEQ ID NO: 7653 - DNA, 1041 bp, Homo sapiens
tgcaaaatgaagacatctttaggcctttcggttgatagctcccaattcagggctctgttctgcagttggcactcatagagaaattaaaagaaggaggagatgtttaagaagtatcaacaaagtttagatacatttaaaaatgaaattaaaatgaataggtaattattttttaaaacttttaagtgtttgtctacatagaaaactgtttcatacaccccaatgttaacatatcatgccatggggaccataatttgaagaaatgaatgtctaatgcagagagtggccggcgactctcaaatcacaccactggagcaaaatttaacattgttattaatacttagaagctgcactaataatgtagccactagccacctatagttacttaaattaaaattagttaaattcatttgttcgttcacaccagccacatttcaagtgctcagtagccgctgttgttggatagctcagatttagcacatccccttcataggataaagttctgttggacagtgttgagttagagaattcctgctcttaggaagcttctactgtatttgagagaaggtaagagaatagaaacaggaatggcggaaagaagggcttgcaattgaaactggggaaaaaagagagtaatgggtcccatgattgggcacagagggcctgactgtgcaagtggctagagtcatgtggcttactagataagttcctctgtgcaggaattatgcttataatggtcttttagtaagttttgctgaatacattaaataatgactgcagaatgatggttgtttggggataagagaggtccatctgagattctgataaaagtgaaggctccaatcctagaagaatgtacgtacctatctgtgtagacacttagaatgaggcctctaatgtcaggaggctctgtaccttgataaaaggatacccactttctgattttctttagtatagcaggcagtggggaaaagaaattgtttcatgcaaagaatcatttatttacctcttatgtgtatcttctttgttcatttccccatcaag

SEQ ID NO: 7654 - DNA, 1048 bp, Homo sapiens
atattattcggcccttagaaggaaatcttgttgcatgctacagcattgatgaaccttgaggacattatgctgaggtgaaatataccagtcacaaaaggacaaatactgtatgattccacttatctgagacatctagaatagtgaaaatcatggaaacagaaagtagtatggtagttggcagggactgggggtagaggaaatagttatttgatgggtatagagttttagttctgcaagatgaaaaagttctagagatctgttacacaacagtgtgaatgtggttaacattattgaagtgtctgcttatggattgtgagggtaaattttatgttgtatgtattttaccacaattaaaaatttttaaaggctgggcccactggcttacaactataatcccagcatttttagaggccaaggcaggaggatcacgtgagtccaggagtttgggaccagcctgggcagcacagcaaaacctccatctctaccaataaaagagaacaaaattaactggtagtggtggcatgcacttatagtcttggctgtacaacaggctgaggcaggaggatcgcttgagcccaggagttcaaggctacagtaggctttgatcacacctcagcaacagagtgagaccctgtctctaaaacaaaacaaaacaacattttttaattaaaaaattataaaaacccacaaatatgtctaatctaggtgtttatgtcatgttgcttctttggagtgatgcattgtgggtaggggaaaaaaccaagacttagaatttgatttgaatccaaattctaaacttagctagctgacttaggtaggctatttaactttactgattgtcctttctctatctgaaaataaagaaaattaatggccaccttgtagggttgttgcaaagatcaagataatgtttgtaaactgtgctggcataaagtagggcagaaataaattctagccactgctagtatatctcagagctccagttagtattaaagttctagccacgggttttcttattcaatatttcttgtgcaagaagcaatctaat

SEQ ID NO: 7655 - DNA, 1033 bp, Homo sapiens
tttctgcgtgtacttcctaaaattctgaggtggtcaattagctatctcagagaattgtttgatatcagggtcattgaatgaaatagatataatgaaggcgtccaccagagaattttgtatcagtagagcaggagttcttaaatgcaagttcatgagcaagcttagcactcctgaaccacatgaaattatgtgcaaattgtgtatgcagatgtagatttggtgtgtgtgtgtgtgtgcaattgttgaaggaagataatttattcatcacctttattagtctcaaaagaatccagatcccaaataggtagagaaccactgaattcgaagatttgttttataccgattttgttttgttttagaggtttggatgggaaaattctgaggaaacttgagagcaaaatggacagtgtatggaattattaaatctttccagatatgcgatcaattcaaaggcttttttcttgaattataatacctctattttaacttctttagccgctgttgttatgtactccatgttggagtttgggatgcttaactcacagttgttatctctggcagttgaaatatccaggcagactgatgtcatttgttcccagaacggcatcagagcccttctgggcaaattcactgataagtcattgaacaggcacaaagaagatgatattttacggtgcaatgagccatccttgcgtggctaatttagttctaactgaacttataaacaaaaaactaacctctaaatagtgaacctctttaaaaactgcattctgtttttctttaaatccctggaaacttttatttgtcctttgtttaagttgaacttttatcttttgtcatctgcttaaccctctgctctgattaaatgattttcatgcttatctcaaattccaattttatgttattttaagtaatagctgtgtgtgctctcagacacctgactcggtgacttagtttataatctctggtattcacctttgtatctatcagattctcaacttaaactgctgctgctgctaataaagcctcctat

SEQ ID NO: 7656 - DNA, 1071 bp, Homo sapiens
ttttagctaagaaaaattttactgcatcataaaagacttcagaaatccatcatcttacattagaaaacttgctgcgaagttatgcaaggccactgctttcccttaaacctcctggagtcaaggggagagaccctggcccagcaacttgggatcaatcagaaaattagcccaggaaactcatctgggtcttccagctctgctcctctgcacctagatagacttgaacctctctaactggcagatatgtaataaagtacagtgatgctggcttgctaagagtgcaaattttaaccacggtagtaaatattttatgaggtgcggggggaagggaggattgtggtgtggtggcttttgggtgctattaatatagatcacttttatcaggggaaacatttgtcattgaagtacagtttcaaattaaataaattacaaagattattttatgtggtcaaaataaacatgtgaagcccatattcattgtattaagtgttggtaaaaatctttattaggggaaaaagtataagataattagtaaccaacatattcaagactgcagacattgtggaagagtctatgtaacagactaatagagattacccaattgccatcacctgggatttttaaccttttttagtgtagtgttaatttctgctctctgccgaaattcctgtgagcacataggtaggaaatgaaacacaactaaccaatacatgtatacatcattagtggacaactgatggaagtaaataaaaaaatataattagaactaaatagtatcccaggttcagaataacaggataatatgtgttttcattgggttcatctgtagaaaagaaaattttctttaaaaacactatgagaatggcgatcattaaaaagtcaggaaacaacagatgctggagaggatgtggagaaataggaacacttttacactgttggtgggagtgtaaattagttcaaccattgtggaagacagtgtggcaattcctcaaggatctagaactagaaataccatttgacccagcaatcccattactgggtgtatacccaaaggactataaatcattctgt

SEQ ID NO: 7657 - DNA, 1031 bp, Homo sapiens
cagatgatccaggctgcctctgaatgattgtagtttttaggagtttccttccaaaaacacaggctggtctgctcattttcctccctcggcctctgggaataacggaggcatgatgctccttccacaagtccttgtaggcaggattttcagtagctccaggccagactgtctctttctaccccatgccccacagctgatcacaagaaacacctgtgccctctggccttgctgcaggtggggcacggaattgtaggcagctgacaatacaatctggtttttctttctcctgctgcctcccttcaatagccaaagcctctggcatggagattcccccaggcgtgtgtcagggactggtccactcagcccctggaattccagaggacctcgaaggaaattcctcgactctgttctcacagtcattgtgggtggagattagtcacagcatactgataatatctccaaatgattcctctctaatcttcagtgcctcctctcagcctttctaatacagtctgaaggtgagaacgctaaggctactgctttggcaaatgctgctcaggtgtctattagctcactctgaaaggtgaaggtagctgccaccaactttttatgacttcagccaaaaaaagcgatggaaccatattgtttggacatccagtaatatataaagtaagatttttgccagcattgaaccatctacccttctctggtagtccatggcacgtaggagagaaggcatatttatttaaaccttcccctccttccaatacctgttcctccaccatggcttccttccctatctccaaaggagatctccctcaaaaaaattgtacagcttcttgtatataccaccttttttgttttgtaattaattagacaagcttgtcctttactgtggttatttgtggatacgccttgtgttccttgaactgcactgaagatcgatcttcattgttataaagttgcatgttcctgagaaattttgtatattcctgttatgtttcataatccagtccccatggatatgggag

SEQ ID NO: 7658 - DNA, 1034 bp, Homo sapiens
tgttatttggagatcatccgtgtcagatgtttggtttttgttatttagtgagaggtcattggctaatttgctacagtggagattgaatcctaacaggaaaacaaaggtaatgactgctagcagaaatactctaagatatgtagagaaaagaaaagcaaggcccagagaggttggatgtaaaaaaatgactaccacagatgaatactggagttatcgagttcggttttgatgttttactgaggtctgcatccctgtgaaagtgtggcctcacctgaagttaggattcattccaggtgtctgttttctcttttaaaaaggtaggtccctggactaaaaattagaaatcagaaggcaggcttaggtaggcaggagaagggactctgtttcttcctgaatgtaacaggccaagagggcatccaacatatcaatgcagacactttgcttctgacattcttgtctttgatgatgtcctgttttagcaaaatgagatgaacattggaaggaatgtaaagttcagaggcttaagaactgtggtgcatggagtttttctgccagcccaggaggccaggtgctctttatatgtgcaaattttctagcagatgcaggatagggccaggtatgctaacttagagcctgtggtaccagggcccatgtctttggcttaatacagttatagactgtcagagtaggagcaggggcctctgagatcatttaaatttttgctcttcatataatagatgggaagaatgagtgatgtgccatgcccaagctcccatttcaagccaatgactaagatgaagctgaaatgaggtttccaaactcctgacccagtactttttctttaaattcatctctttccaatggatttttaaaatgagcttgtgggacatttgtaaatgtttccaaaactttaaacttcatttaaaaacaaacaggtttatattcagtaggaggttggattcacacattagccatttaagacaatcaaattgagaatttcaacctaaaacttgtactttgtttttgaaatcaaa

SEQ ID NO: 7659 - DNA, 1050 bp, Homo sapiens
actgaagggacaccactgggatcagtgggtggaggtcaggggtagtaacagcactttgcccttcagtacacagaactatcctgtacagtaaagaattgtccttcaccaaatgtcaatagtgcctcattgtgaaatgccgtggaaagcatgtattccgatttggtaacatgtactctgttttctccgtatgtataaaagtcaaagcaaaattttcacgttttaaaactactgaaaatcactcccacatgagctttctatttcattagtatgattattttgactgagaacgttttttaatatttggcaaagctctctttattagcttgtgcagtctacctaattcttatttgcatttttaaaacttcccttgtaacagctgtgcaaatgccattacagcttaggagggaaaaaagaaataggctatgtttatgaaccaaattaatgaaaggcattattaaagtaaatgattgctgaagctttattacctagaaatgaataaaataatgtgttgctgaatccaggtagaactgaaatccaaaagataagaactttataaaaagacgtgtcaccccgtgtccctagaagcatagattttaatattttaggcagatctttatgattacttcaatgaacttggatagcaagaggatctatatctcttgacaaatcaaaagtctagagtagtctttgtcagttaaaatttacattgctaataacatgtgaagcagaataattttgtacatagaagatgctcagcaggtatttgttggcagctgtatagatgaataagttaatggaagaatgaatgaatttttgttccttgtggctttttagtaactagtaatctgtggctctaagtcttagccaaggataattaatggtagaaactttggggaaagactttggtggaagttgttcaaaattaaaagacaagacagggtcaacatttaaaaactactgcaagcaaagaatcggagtctgcaaatagacttcttgatcactaaaactcaagccatgttcaaattcctgctctatagtatctgatttgaa

SEQ ID NO: 7660 - DNA, 1074 bp, Homo sapiens
aattctaaatggctagccatcatcaaaagtaccccggcatcaacgcatcaaggcaccagatttgctgtgatttcaagctgggtatttaaagcaggtcacaaattgctttctgctttcccttccttttgctcctctgaacaaacaggttgtaattttaagaacagcactaatggagaaaaatgttgatgacaaatgccagtggttacattgggcagacataaaacacagctttctatatttttatgttctttttcatattctgtgatcatctgagaaagcctttgtctactttcattgtctgtatttttgtcattgattgacatgctggtaacaggcctgggaaacaagatacaattctgcagcagccccttaaaatttccctgatgacctggcctggccaaaaagcttaagaactgtggtgcactgtttatgttaccattctgattgggagttacccagaaattcttgtttaaaactgttattgcagttatttagggaattttgttggctggtaatgtgtgaaacctgcctttgatagagagacttgtacaaatataaatggtgtttacatctgaatttcagcgctcctttttttttttttagtagaagatataccagacaaactaaagattgactaatcctggagccctgatttttttttttaaatcactattgtcagcttaataactatttactatgatccaagtatatgctaagagcttttgtttgtttgtttgcttgcttgcttgtttgttttttggcacagggtcttgctcttttgcccaagctggagtgcagtggtgtgatctcggctcgctgcaacctctgcctcctgggttcaaacaatccccccatcttagcctcccaagtagctgggactacaggcgtgcaccaccatgcctggctattttttgtatatctttgtagagatgtgattttgtcatgttgcccaggctggtatcaaactcctgagctcaagcataggcgtgagccactgtaccaggccaagaactgttttatcgttttttaaaacatagtttcaataattagttttcttgtaatctagaatattgc

SEQ ID NO: 7661 - DNA, 1031 bp, Homo sapiens
attggcaaatgtctaggagagtgtgtgtaagttcctaaaaacagtaaattactaggagcccattgaaggaactcagggctagtgatctgagatgcctttggttcattaaggtcatattccagaaagaagctgcattttacttgctgggtgagaaagactgggaaatctttatggaaacagttttaaaatccagcaggcatcattaattaaagctgacaaaagaagcaatcagtcagaaagagaaaagacctagaatgatgcatcagcattgaaagcagatgatcttaataaagtagaagagggttccaggcagttgcaaaaaaatagctgagtaaagactctgaggtcgttatttaacaaaggtagcagcaacaggtatctgacaatgtccagagtgcctcaccacatccattatgtgattgtcaggttgaagttcctagttagtacaggaaccagtggcagtgtccccgacctgccagatcatacagggttttgaaatgagaaatatggtgaatgagacaggtaggtgtgctgtttatgacagatgtgggtgactttcagataaaggaaacattgaaaatacgctcaaagcttttcaccctcagaccaagagacttaaccttttacctgtcacaggaacacaatctcaaattgttctgtatataacatgtctatcctttggaaacggaatatatttgttcctcgtaagccgattctgtcaagacacagttgagtacttttcagtttaggctcttggatatgcactatcactcatttcgatgtattatattttatggtactttttagtgtcctaactttgtattaaaaaactctcccatattttacatagaataaatgtcatcaacattttttgttaggagcattaaggccaatccaattctctttttttaaaggtgatgcatattcataaattccttgatgttttaggtctgaatagcgtaagtaaggcttctcactttcactacatcatttgcagaccctcaagcatgaccccatcgtcttcacacagg

SEQ ID NO: 7662 - DNA, 1045 bp, Homo sapiens
aatccttattttatgtgaggaaattaagtttcagagatactgtaatccaggtcttttgaccctaaagcttatgctgttaaccactaagatgctccatttggttttccatgatttgtgttaatgaaatatatttatcaaatttttctctttaaaaacacagtagtagttctgtcaatgaaagtgattagctcaaaaacatcattttctcctttcaccttccttttcaggctaacaaaattatcagaaatttatatctttcttgtacagtatttctttgttctcagcaataattggcttatattaatgatctgtacccactcttgaaagaataaccatttatttcatctcaattgtctttaaatatttgctgtcagatttgaaacacagctataatggtaatttcacaaagttccattagtcattcttcattccattcagtttttgtttttactattgtattaaaatcatctatcatataacctactgaaatagctacagatttttttagcattgcagaaaaatatgtgactgttacgaacaaaatcaggaagtatgagaaatggcaattttctgaagttttgattttgaacttgaaattggaccatgaaaaacccattgagtcagactaataacctcttcaggtttgtttcttaaaaatgttaattgttgactgcttcatggttggactctggagaacctcttattataaatgttatatcaggaaagaaattcatctctttgaagattaatgatgaattcattctccccgtttccgtttgcccaaatgaagactggcatttaatttctcattaaaaggaagtctcacttagtgggtaatgatagttgattttttacatacttgtcaattatatattttaagttttacaaagtcacctgacttcatattatcctaggaatgtccttcctgcaggataattaatagattacataaaaatgtttcaatctgttcatttgcaacctctttcttagttttattgtttctttactgtggaaagaacagggatatacaattaggtttttggta

SEQ ID NO: 7663 - DNA, 1756 bp, Homo sapiens
gaacagtcatggataaagacaggatgtgtagctgtaaatgataatggctggttggtcatgatgttctgagtctacccaagtcttctttcctgatttttcacagggaagtaggaaggcaggacaacagtttttagtgagggttaaggatggaggaggtgcaggaggtttgaggaagtgcggagcagtggtcgtcaaactttttcatgcatcagaagcatggtgtgtgttaaaacaaatgttctgggcctcatcccagagtttctggttcagtaggactgggaaagaccctgagaatgtgccaagaagtttttagatgatgttgatctagataagactctgagaaccactggtgtagagctttcacttttatagctgagacattcatgctttgaataataaaatggttcatctaaggtgatggaactgtgactagtaagtagtccaggctgctgcctccagcttgggctcatcctacatatgcgctctgatttcagggagggagagcagcagaaggcagtgggttccaggggttaagtggggagtgtgcactaggcagggaattttggagaaaggagaaactgatatcaccaaagcaaatcttgttaaggtcaccttagtttgttatggcctgttccctgatgaataaatgtgggcaagaaaatgtttttatcctgttcagtacatatgagcatagcttcagattctaggagggctttgctttttttcctgtgaagaaggtttgttcttaggatgttcattaatggagatatgtttacattatttttaaaaggctggttctttatttgcatgcacatgcttttgtggaaccaggatacatacatattttaaagaaaattatgcaaatatgactgtaaaaatatatattaatatttaaagagccttttgttgtatatacatgaattatattgaaaagcaacacagtcatggtgaaagatgaatttgaactatgtatagtaataccaattaatatacctgtttatgtttacagaaaaactagaaggaaatgtgctaaatgttaactgtggcttttctttgagttatatgatcacagatggttttaatttaatttttctatatttttctgctttttgtgtttctaaaatgagtgagttattttcataaaacttatttgtaaaacaaactactcataataaataaaatataatgtaatacataacatgtaataataactaacagcataaaagctaatctatgtctagtgtattagtcttggctcctgggcacttgggatgtatcaatgaacaagtaaaatgtccctctactttcagggttggtattttggaatatcaatgattaaattcactgtgcattggagaagctatcttggcacagggtaactgcacatgtatattttgctttgaagtactattattcatgtttatgttgtttgcctcttttggattatacatttcttgagactatggactatggtcattgtgaaaattgtcatttgcttccaaagtaaccacttgtaataaaagtgctataattttgcctagaaaaaaaattaaatgtattttatctgaataaaagtaggataccatatccatttctggttgaaatctattcatgaaaatgagcaaaatttccaaggctatgtttggtaatgtcaaatcatagcaaataagattaattatttgatttaaacaatttaacatcctccagtaacatatggtacagttgtctaatgcatgaataaactacagcttttatc

SEQ ID NO: 7664 - DNA, 1376 bp, Homo sapiens
tgaactgcatatcacaaactgtgctctgtaaattggagggtttttgttttgttttgttttcttatgaaattagctttgagctataaaagatcaagagaatgtgaagaacagttgttctaatcacagaaggttgaatatacccagtgattcaaagacagaaaggagaaaaaggtctgggggcagcgaggtagaaatgggaaggaaggcttttagaaaaaaccttgtatgagaacagaagatgaggcaatttggagatagagattgtgggtggattgtcaggagtccgacggtgataatggatgttccaacaaaaggtaaacataactgcagataaaacctctaaaaatactttcctttcctaagagatgctgaaagttctgttctctgagatacaggggtaaaatgaaattttgtgggtgatttatagcaaccatattttgtttgtgagtgtgcggtgctttgtatggtgcatctatatctctgtgttatcatctaggacagtacttttcaaactttgtgcatcaaagttgtctgagtagctttttaaaactgcgaaggggatctgagcattatttttaaaatagatggctacagtgccaatcaaatgaacatttttagtctgtaaatactattataaagaataccaagcaaagaatgcttctctttgttccttataagaatcttgagaggcatgtacaggaagtgtgccaaaatgtaataaaaacaaaagcttaataaatcaatcatgtatatgttgaatttcctccagcattttgctttgtgcatttttatggcttatctcacaaactctgaagtacaaagtgtgaatacatgactgcctgggacttcactttgtgtgttttctattgttggcttttggggttaagcatatttaaatgtaattaagcaggtaccagaacaactacaattattctgactatgctattaagaagattgatactaggcacatatttattacaacttacttgggccatttttttctttttttaaagacagggtctcactctgtcacctaggctgaagtgttcactgcagcctcaacctcctgggctccagcaattctccttcctcagcctcctgagtaactggggaccacaggcatatgccaccacacctggttgattttttaaatttctttatagtgacagcatctcaccatgttgcccaggctggtctcaaactcctgggctcaagtgaccctcctatctcagcctccaaaagtgctgggattacaggcatgagccattacacccagcctgtttttgttttgtttttttctaaaactgatactgtattcaaaaagaaaaataaatgctttctgcaacaagtccttttcagagagaattgaacaccaa

SEQ ID NO: 7665 - DNA, 1049 bp, Homo sapiens
acgcctcccagtgcttcccagcaacgccatggctgggttctttttatcagtttgggtaagtcatgaattatcaaaatgccttcaggcatcgcaagccagaattgcatattggtttggataattaaaagctgtttccatcaaaaaaatttgtattcaagcccttggtagtcttcaggtgaaaatagttttcctgtcattaaagttaattagtaagtgtgtatgtgtgtttatgaatctgcagataatggtttcacaagccgtgagattgggagttggaagggaggggaaagtgataaagaatcaccatcggtgtctagtagtcagctacgcttctgagtacactgtatcctaaacaggcctgatcctaaggttcatttggggtatagattctcagggctcttagagattctgattcaggagttctgaggtagagcctggagtctagatgtttaacaagtaccccaggtgattcttatgatgggctaagagtgagaaaacctggtgtgtgcctttcataggtatctgaagaatccagcttcctgtagtaacgttagggggcttgtggctcaaggaggccagagcagcaacagtataggcctgctacgtgtcactgggagcatctcatctgccgggaagtaggagcttgctattttttctcttttgacatttgctgatatgcaccatgtcatctgaagatagaagaagtaggtgcattttacataaattatgggatgacaacaccagaaacttctggcagcatggaacaagttcttccatgatgtccttgccccaggctttagagtaagttttagccatgccaacctctagggtagcgtggtgctaacgtattttggctacatttattcagtatttctgctgttcagggctttgctaagccagtgagtcatgccacttaaactgcacaacttctctgagatgtagtattattctcatgtttatgatgagatgcataataggagcagagcgaggttaagcaacttggctgagtttgcacagctagccagtggggtggttatctggttcctgtg

SEQ ID NO: 7666 - DNA, 1031 bp, Homo sapiens
cattttttgatttaagtagtcttcttgtaatttacttgtttcaaaaatgtacttttgtatattggatttgcttaaagtgaaacatgtctaatatactattgactttatattaagaccattaaagtatccagtggacaaatctatcggtacttctcaacatgtattctaaaatcctatcaggtttagtggataggcaatctggaaaattatttcttacacaatattaaaaataagagttgattctaccatagcgtatagtaaggtaatggctgcaactgtgtatgcgactgttgccatgtttgattagggcatgcatatttgacatataaaatattgttcttattaatgttcatagcagtggatttatttgggtaaattttaatttcagtgttggtgatttcattattgttgagtgttcagccatttcacagcttgttaaagatctatttcaagcatttgtttttccttcagcacagtttcccagtatctaattattaaagagaacatataatatgtagaacaaattcacatgtgcaaaactgacaatcccagaagtgttatattcttatttgtatcatagtcttattcatgtcgggtaaaatccacatttctcaaatttctcttcttttcctcactgagcctcttagcagggatgctgtacatgatactgcaggcgtgctgttaggaatattaaaaaggttaagagcctcaagctgaagaattacggggaaaggattcagtgtgaactgtcaatcaggcctcttgtgcctttttttgtttgtttttgttttactttcttgttggcaatatctggggaaaatgaaactaccttggcaaaaattatgatagtgagaaaaatctgacataggaaaattatgacagtgaaagaaatctcacctaaccaactccatcttgcttttaattatcaagctacccttgttcattcctggttgcaggcaaactaactttgggaagaatttagttcatagtttaactttgaaacaaagataacagttcctccctaaaataaa

SEQ ID NO: 7667 - DNA, 1081 bp, Homo sapiens
aaagactggcctttcctaccaggataccttattaaagtaaactcaacagttttttccaatgatgtcaaatgtggccaaacaaaggcttacagttgatgagtacaagcatagcaaggttttaccttaatcagctcttagacatactccccagtgtctaaaacttgttaactcttctttcacttttaattcaacagctatataagtgctttttatatacaagccatacttttaaaatgaaaacataatattttaatcaccaaatgagggaagacttttctctctacagaaatgtatgttttagaaaggatcctgtgtactttaaaaaaaaaatctcatgagaccaattaatttgattaataaaaaacttttaaattatttttagtattgtactgttaactgtgttccaaaagaaaatgttcctcaacccaaatttataactgtgtttattatttttctaattcagcatcgaaaaactaagaaatgcatcatttttaaaaatcaggaagtatagggaactgagaagagactgactacctttcatttgtatgttccttttctaattgtcaatattgctactcatcaactgctaacactaaattttctgatggcttaaagtctaataataaagctacatttttatttttttccaagaacttctttatagacagaaataaattaaaatttgccactttcgactgataatttgaagctctagaaattgtcagtaccaatatggcactcctacaacatgactttagaaggcaggaacttttgcatgaagtcataaagagtattcagaagtttgtaaatgctttctgtcactttacttgaaattatttgatttttaaaaatcatccttatgaaatgagcagagaagctcttattaatacaagtttatagataaacaaactgaatctcagcttacatgacttgcacaaagccacatattgacctgcctatgaatacagcacaggcctttgtccattgatttttccatcatcccattatttgactcaactcctttaagagaccacatgctcccattcacatagtttccttgtaagaagcaagcaagctttgt

SEQ ID NO: 7668 - DNA, 1037 bp, Homo sapiens
accaagcatttttgtttttctgtggaacctgaatatatggcctggcctatgaaaagggcaaagcaaaagagatattttctatttaaattgtattccactaaatttaattataattagtttaattctgtttattcagattctacttaagcacatcactttacctcatagcatatgattttgacctgcttggcagaatgagatctgggaagaggaacttagattggaggcagggttagggaggaacagggtcttggtgtgcagctggttatcagaaaaggtgggtgtgggtgtgtttttcaagacttggttatcagatgaggtcttagcaagatagactcaagactctttgggagtgggcctgggcatggggaaggaaaagagggtaggatctatatgttttggcggtacagagaggtttgggaggggcaggatctgaggttcctgttagagagatgggagaaagcctgggggtgaaggagctcttccagaagagggcagaactaacctaaagaaagaggatggcctgggtaattttattctaggaaccactatagggtcaactttgattatgaagctttctaatactggacattttttttcttatttctggttttaatttcctgtcaatttttcaacagttgctaaagttaaattgtcctagagtagcacagaaagacatgtatttatttagggtcaggtgaataggagccaaacttgcccttccataatgtggtgagctgtagaggagaaacatttggatcagagtttggctggtggtcatgaaaaggaaagcggatgggccaaatcttatttatacttggcatttgctctgacagacaccttcaaccctaatgggtgtatgagaaagaaggagaaggccagggggtgccacagagacatttcactctggttttctccttctaccttgctgtttaccaccatctccttcttacctgctaactcaacccttttcctccaagagtttctcttttgcttcaaagtcctactcttttctgcttcagtgtttgtacctccag

SEQ ID NO: 7669 - DNA, 1050 bp, Homo sapiens
taacgtattgtaaccctaaatataaaagctaaagttgtaaatcttctagaagaaaactagaagaaaaatatttgtgaccttggctttgtgatcttgtctgagatttctcaggacacaaaaagcatgactacaagagagaataattcgtcaagtgggtactctcaggataaaaacttttgcttcttgaaaaatattaagaaaacagaaaatgtacagaataggagaaaatatttatgatatatatatctaaaaacttgtacctagaaattatagaggtctcttataattataacaagacaaccgaagaaaagatacttcacaaatgaaaatatatatttggtcaaataaacacatcaggagaggctcaccatcgtgagtggtgtttggggaactgcaaatgtgtaaaggcctgcactttgtagaacgtacccagactccacctcctatctggtctctagagagcccttgcccagtctttctgtagtatagtttttgatattggtttcgttctttatcctgcctctgcttcgacttctaactacttcctggttcaaagttatcagactggaaccttcgtggtcccatttctttgcccagtttagtttttttttttttttttacattttgcctggaagggtgtcacctcctcaaacaataatatggtaaacaagctggtgtcttccctcctcaataaaaacctcccaaggaatttcagtacttgactaatactgttcttaattgttactctttacacgatcatgcccccatttatgcctctgcctctatttccttttctccttggcttttgattaagggtttaaggttctttttcttaataagacctttttcaagttctttatctctccttcttttaatttcattagtgtagtatagttttcgttgttgtttttgagacagggtctccttctgttgccctggatggagtgcagtggtgcaatcatggctcactgcagccttgatctcctgggcttaagtgatcgtcctagctcagccacctgagtagctagggctacaggtgtgcgccactat

SEQ ID NO: 7670 - DNA, 1023 bp, Homo sapiens
tgagaggggatggactgcgatatatacagttgtgtgttgcttaatgacagggatatgttctgaagaatgtgtcattagaagatttcatccttgtgcaaacattatagagtgaatttacacaaacctagatgatatagtttactacacgcccaggctgtagcctatagctcctaggctataagctgtacagcatgttactgtactgaatgctataggcaaatataacacaatggatgtatttgtgtatctaaacatagaaatgatacagtaaaaatagcatatttataatcttgtgggaccatgatcatatttgtggtcaatcattcactgaaacattgttacactttactctattttgcagggtgcatgattgtatatgggtagaggtaggttattgtgaagatcctagcattcctatcgaatactaagtttatgcatgcttgttacatctgtaacataattaacaaaataatgagttcacgtggttcaaaaatggacctatgaagagactgtgtcatgaacaaaggataatgattgatttcatattgtgtacatgaggtctaagattacaccaaaataaaaagtaaaaatgtaataatacctacagttgttaggaagattaaatgagttaatatttataaaaaacttttaatagtgcctggcacatagaaagtactatacaagtatttgttatgtaaaatatatgaacatcattaactatacaagatattgccagattgttctgcaaaatattagtactaatgaattttatagcttcatcccactccaaatgccacaagcatgggtaagggatgacatttcttcatattcttttaccacttgaaataatgaggtttctaaatttttgtcaatttttggttgtgaaatgaatctcactgtggctttaatttgctacattttcctaatttaaaatgagattgaacaacttttaatatatttagtgttatttcaatttcttcttttataaaatgcctaattatattcttcactcattttctttcc

SEQ ID NO: 7671 - DNA, 1050 bp, Homo sapiens
gatgaacccggtacctcagatggaaatgcagaaatcacccctattataatcttaagaagcctacatcacatgcctaataagtggtaataaaataatttttttgttttttgtaagtgtcattcaattctttgacctgcttccatatcatatgacaaaaacaatctgttatcaaaaatcacttttaacaatcagctatcagctaacacctgaattttgctctccttctgctttgttcaaagcaaagaattggaaatatctgactttcaaaaggattgactaatcagatgttagagtctgatttctttctgattttaccttattaagttgactgcagtaaaatttgaattgtccctttatttggagtcccagtggttgttataccctgaggccacgcaccctagaaaaattcagagtagaaaagaggtttgcacttttattggtaaattgggcagacaggaattatgacaagaggagaagaatgtgtgacacttccatacattcttaatagatcagttttagggaaaactagaaatggaaattgagaacctagaaatagatatacagaaatacctatgctcagatttgtcatcctgaaccttgtaggttacacctagtagccccagtttgaagaccctcatttgaggcagcccatgacagaaaggccaacaccttgggctacgttggtcttgtctaacaacaagatgtacagcagctgggtgtcagcagaggcagagctcctgtgctctgtaaaacgtatgccagtattgcttatgtaggaacactgcccagtgatttgatattgtcttcacaagaatgttttatgcaagatgatacatggttggtcactcaaacaacaaaatcccttgacacacattggcttttaattctgtcccataacacctatttgtatcttaaataatgtggttcacatagctttgttcagtctacttgatgatggcttgaatttagctagtgatgagaaatagagggctacttggcatattcattaccagctaaggctatctattcttgacaacccctcctactggg

SEQ ID NO: 7672 - DNA, 1028 bp, Homo sapiens
ttttttttttttttttgagacagggtcttgtcctatttcccaggctggagtgcagtggcgaaatcacagctttttgcagcctcaccctcctgggctcaagtgattctcctacctcagtcttccaaggagctgagactacagatgtgtgccaccccacctgactaatttctttatttacttttttttgtagagatggagactcactatgttggccaggctggccttgaactcctggcctcaagcagtcctcctgcctcagactcccaaagtgctggaattataggcatgagccactgcacccagcctaatttttgtttttaggaatttctgctgtaaagttttatttataattatgtaaattgtatctcttccttctatcttatttccttcccctttaattaaccatttttagagcttatggtttaattttttcatagttttaaacgtaataggctacttttgatacacatttatatatatacttgcatccccttttttattttttgttgttttgtagataaaggagggcagattaattagagaaagtacaaagatatgttggaagggtgcaatgggcagcacagcggagaaggggctgtctgccactttctcctttgtttagataaatgtagcatgctatacatacttaccccatcttgctgtttttacttaatatagcctggagattaagtcacagcagcaataaatgctattgtgttgaatgtaccataattttatttagcttgtcatttcttcatgagtatttcgattattcccagttttgtgctattataaatagtcctgctgtgaattgcctcgtcttttcattttttttcttttttccccactgtgtatcttttcatgtttttttttctagtgtatctttgagatcaatgtctaaagcaagattgttgagccaaagggcaaatgagtatttcactccttcaaatattgccaaattccctttcattgagactgtactgttttatattctcgaccacatatgaaaatgtttttttttctcacag

SEQ ID NO: 7673 - DNA, 1073 bp, Homo sapiens
tgaactcccatctacctgtcactaaccataacaattatagacacatgactagtctggtttcattataccttactttcctctctcctgtattattttgaagcaaatgaaagacttcttaacatttcagccccacatatttcacttgtatctctgagagataaaaatttaaaaaaccccaaaaacctaaccttacaatacctaaatcttcagtcatacctaaactttcaataataatttcttcaatatttttccaatccatttggaaattatcaaatatccactaagttcaagcttccaaatgtcttataaatatcataatattttttaattgtttgcttgaattaggatcctaagaaggtccatacattttgattagttgatatatctcctgagtctttaatctgtgggtttctgcttttctggattttgtatttcaggcaatttatttgtcaaggaaactaagtcctttgttgattgcatccctgtggtatcattgaataagttcttttattccctgtgtttcctgtaaactgtagttggatttagaagctctatcagattcaagcttggatacttttttgtaagacttctttttagattgtggtatattcttccatgtgaaggcaaaataatgacttgcctggttgtctctttttgtgatcttagccactgttgaaaaattcacagatccacaaaagttttggaactacaaaatgatgatattctgattatagaattcattcttcttttctaaacccatagttcgttttctttattagccgaaatgcttctataagagaagatctcttatatccactatttgcttatcttttggtacagttcatatagaaagttttcaaaataatgagttagatcactagtcttctatcttacatctgtatttttttttacacaccaataatcacatttctcaaggacccaaagaatagtaacaccagaatatcaaataattactcattggatttatcccacagtatatacccaacagtctcaaaataacaataccagcactaccaccaacaatatgattactgtacaatgttttgtatcca

SEQ ID NO: 7674 - DNA, 1127 bp, Homo sapiens
tttcttctgcttctgtttcctggaaaagattgtagaaaactagtattttcttctcaaatttttggtcgaagtcaccagtgaacccatctgggaatgatgctttccatttgtgaaggttattaattattgattcaatgtctttaatagataaggattattcagattacctgtttctccttatttgagctttagtagatttcaaaatgtctttctaggaagtgattcacttcatctaggttataaaatttataggcatacagctgttaataacattctgttattattcttttgatgtttatgagatcaataatggtggcccctcttttatttatgatatgagtaatttgtgttttgtcttttctttttctgggttagcctggctagagctttattaattctattgctctttgcaaagacccagcttttttttttatattctctatcgatttcccattttcaattttattggtttctgttgtaatttttctttttctttttcttttttttgagacggagtctcactctgttgcccaggctgcactgtagcctctgcctcccaggttcaagtgattctcttgcctcagcctcccgagtagctgggattataagcatacaccaccacacccagctaatttttgtatttttagtagagatggggttttacaatgttggccaggctggtcgtgaactcctgacctcaggtgatctgcccgccttggcatcccaaagtactgggattacaggcatgagcactgcacccagcctgttgtaatttttattatttcttcttttctgcttgctttacacttacattgctcttacttctgtagtttcttagattagattattgattttagatctttgtcttttttctgatatatttcttcaatactataaatttccctctaagcactggttttgctgcatttcataggttttgataagttgcatctttattttcatttagttcaaaatatttttaatttctcttgagatttcttctttgactcacatgttatttagaagtgtattgtttaatgtccaattatgctgagatttttttcagttatctttctattacttgtttatagcttaatttcattgtggtgtgagagcatactttgtat

SEQ ID NO: 7675 - DNA, 1720 bp, Homo sapiens
tttaaattttattaaacatcaggtatgccagaaactatgctttcttagtctactgaatccaacagaacaggtgcataagcaataattaaaatttctttgcggccctatccttcattttgcagagtcttggtggattgaaaagctgctgtggggtgcgaggggtatgaaatggcatagtttaggttggtgcggatgtccacttaagtctccatggagacttaagtctgtctcaatgtgtataactgatcagccagaaattattcagatgtttgaaaaatcagtgtaatgagttgctctctgagttgggaaatttgggttcagcctatcattcaaaatgtatgtacacttggcaaagtcacttctgcagagtttcctcccaactggtaagatttcagccaatttaaagattctccatgctttgagatatgaactatgatgaaggtgtcaattaaaactagtacatgctattttgcagaacctccactaaactaattttaagctctaggtttgcctagaaattgatgaggactctgcagggatgagtaaataccttaatgtgcatttatgtggattcttgaagcagcttttatctgttagtaatcattgtctgcccaagttagatatcggtgtcattaataagacctttctccctgtctcatggaatgaagtacaaatcattttaatactactccacaaatgtccattgaatccaatctttgttttatatgtacaaaacaaagatatgatgtcattcctctgtttaaaaaccttttatgattacccattataaataggataaagtccaaacgtcttagggggttgtacagaatatcttttgccatcttgacccaaaacagttttactctttatttttgtgaaacatctgatcctgtgaccatgctatacttattttttcaacctttctttaaatgcagtctgcctttgcatttttccacctctacatacaagtcttctctctgctaatttgtgccattctcatttttctcttcctggaaaatcttccttcaagacaagctcaagtactcctcttctgggcaactttcatggtcttctgcagatggtgacagtcagtctgtcttctatagtgttatagtacttcatgtatattttgcagtcatggcatttcacacagcttattggaactatttaattactgtttcttccctaactaactggacaatggacttctagagggtatttttactaattggatatttttatatctgcttactcacatctaggatctagcacatctggtgctcagttgacagctgttaatcataaaaatgcttggttggatggtatttactaacatgatctcctgtgggacagtattaaggtcactttgaccttcaaaaggtctgggcttggtgtcccatgcctgtaatcccggcactttgggaggctgagactggcagattgcttgagctcagcagtttgagaccagcctaggcaatatggcaaaaccctatctctacaaaaaatacaaaaattagcagggcatagtggtgtgcacctgtggtccctgctactcaggaggctgaggtgggaggaccgcttgagcccaagatgtggaggctgcactgagctgtgatctgtgatcacatcactgcattccagcctgggcaacagagcaagaccctgtctgaaaacaaacagaaaaccttcaaagatacttatatttaagtcagatatagat

SEQ ID NO: 7676 - DNA, 1055 bp, Homo sapiens
cagctgctcctaaaccaaccccccagcaaaaggctatctgcttttcagggaaaaaatattagagttatcctgatggcctcttatggtgtctaacagcctttctaaaccaggagactctcacctgtgactaatgaaaatctctcctgagcttgggtcaaaggtgttttggagcatcattactgagacaactgcagcacatggaatctgcacagttacaggactgtgggactcaaatctcaactcctccacttacaagtgacttgggcaagtgacttaacctttcttggctctagtatcctgatctggaaaacacagttataacccatactgtggttgtggggtgtaagagtcattacttgcaaagcagttcagaagcattcaataaatagtagctgccgctggacttattctgatgttgttggtagtgatggtattctttacctcttgtatccagaaaaaagctagggtagccaccaatttgtaaaacctcatccagttggtatttgactgacttcagcaatctctggagataaagagctgggaggattgctccccttctttgtccagctcactgaagtgcatgctgattgtgcagcagaggacctgctattcacagagtagggagaagttgatcgaggtcaggaacgcaggcacaaagggacactgtcagagctgacctcacgaatgctaatctcctttatcccttccaagaatggactgtaatcgtctccagattaaaatgtgcagtagaggtgaccaaaacaaaaacttggcagcgaatgtgaatgcacatgtatatggttgtttgatggcctctcctggaggaggccacctgtttagcacaccctgctggagagatgaggtccctcaccacttagaactggagttgaggctaataggtttgtatacattcagaccagctcaaaagacaaagaccacggaaccaagccactgaagacctgtgccacaattcctttagccagtatattgaaaatgcaatgagctgtcgacattctcgccccttcccgtcccttcactttatttcctgtgtaaac

SEQ ID NO: 7677 - DNA, 1034 bp, Homo sapiens
tccaactgcgggctgctttgattgctggttctctgagtaacacttcacttgccttctgttagaatgttttaagttattttggcacttggtcaccctacttcagaaagactgtttggtcttttcatgaccatattggcagagtctaatgttatttgctttggattttgtgttatctgaaaagtctattatttttattagaaggtcatttttaaaaagaaagaaaaatatctccaaagtccttcgcaagacatatttccaaaatgaacagaaacactaacgtttatttttttaaaaaggagaaaaaaatctagtaatgggaaaactcctctagaaggacattaatatgggtaggaacatggtcaaagtgccttaaaatatttagcaacctctccttgccaccataacttaacgtctctctcaatgaatgggttatagctgttaaattctgtattaatggagactttttttttaccacttaattataaatgaacacatttcattttcagtgtagaacgtagatatcatggccttgttgtctcttcttaacatcaaacatcatatcaccttacaggattttattagttaggtactccaagcacgtgaattactccttggtattgagataagcatttctgaagattcttctatttctacaagccagtagctctttgaacggacttttattgtcatttatctaagtggcctaaaataatgaataaactgctgaaagagtttgccctattcccaggaattatttcacacactgaaagaatctgtgacttagaccactttctttcaaggggactcagagagttatggaagcaaaacacgattttaatgtccccttggtaacaaggacttttgaacttagtatcctacatcatagatagttttcttttccttgaatttcctggattttttttctttctataatgttgttgattgttatcttaggtgccattttgcttttttcttttgtccaattgttctacatgtaaaaataacaattataaatgaacctgcttgtaactgct

SEQ ID NO: 7678 - DNA, 1072 bp, Homo sapiens
gattagtgcccttttaggaagaggaagagacaccagagctttgtgtctctgcctgtcatgtgaggacaccacaagaagacagctgcctacaagccaggaagagagccctcaccagaacctagccacaccagcaccctgctgtcagacttccagcctccagaactgtgagaaatgaatttctgttggctaagccacctagtctatggtattttgttatggcagctgaagctgactaagggggtagttagaaaagctttttagaggatagttaggaaagcttttgtgacagagctgccacagtaggatatctgaataaggttttaaagaatgaatagaatttgccaggcagacaaggaatggaggagagttggcaagaaggaaaggtgtatataaaggtaacaaacaacatttagaatttgagaaagccattttgtgtggctaaagtgtgctacgttagtttcttattgctgctgtaacaaacgtcaaaacttagtagcataaaacaaagtttattttcttatagttctgaaaatcaaaggtctgacatgggtctcactgagcttgaagtgttggcaggctgtgttactttgggggccttaggggagaatctgttgccttacctcttctagcttctgtgggtcacatacattacctggcttgcagccccttccttcatcttcaaagccagcagtatagcaacttcatatttctctctgactctgacttcctgcctacctcttccgcatttaaaggaccatcgtgattgcgttgcacccacatagatagtccaggataatctgcttatattaaggtcggctgactaacaaccttaattccatctgcaaccctattccctcatgccacacaatggaacatattcacaagttccgcggattccgtggacgtattcagggaggctattattctgcataccacatatgcaatgcaagaaattgagggcgactgtaaagagaaaagttggcatgacccatcatccctaggtggaaaagatcatccattcaaaagggacctatcatctgacatttaaaaataaatagaggagtgaaggtac

SEQ ID NO: 7679 - DNA, 1040 bp, Homo sapiens
ttggtttattttttcaagaaataaatgaagtctttattttttcaatgagggcaatgtttattaagaacagcacataaggtagaaaagaaggttggtttctaatcttggttcatctcccccactgatcttgagttttaaaagcatagagagcacgatcttctgtgggtctccactgtcagagagccctggtgagaatcatgagcggatgtagtaaaaagtgcttctttcatatcagcaggtggttctgtagtatttgcatccatagacttctatgcagcatcctttctgttacttactcttttcttttttaatcaaaacagtccattgaaaaaataatgttgattacaacaatgaattctgttgatttaaatggtggaaggcaatgttatcctggagatataattctgtgaagttttgattcagggaagtccagcccagcccttgcatctctttcccggctctgggtctattctttattccagctgagatgtttattttatgtatgaaacagctcccacctacctacaactgctgattaaaagctcagaataatgaaatctgcacaatcgaaacttggctgttggctatagttattatgcaacttttaacattttccttttttcctgtcaataatataaaattgtcagttttttatttcagggctaactctttgaatacactaaaatttgttgcactagtattttttaatggctgagctaaattacttcttaaagttcagattatatgcttttgggaggaataagaaaatgtagtgtccgtgcaatagcatcattcagactgtctgtgaacagctaaatggagataagactacaaaggtccctccatgggccttcaatttttgtctttaagcagactgctcaccatgccttgatagaaatagcaaatatagggccaggcatgttggctcatgcctgtaatcgcagcactttgggaggccgaggtgggtgaatcacctgaggtcaggagtttgagaccagcctgatcaacatggagaaaccccatctctactaaaaataaaa

SEQ ID NO: 7680 - DNA, 1087 bp, Homo sapiens
ttatcaattccaattttacagaggcaagaaatggaactcagagattttaaagaactactaggaaacagagcttggatttgcacccaacgctgtctaagaacttgaatatatatttgctctaaacaaaccccccctccaaaaaaacaacactttaaaccatttcattccaggttactcttgcagatgtcggagtatagaagttattcttctgggtttgtttctactttgtaaattttgtatttaaatttgaactacacaacatttttgcctggataaattggctaactgcttaggtcattttaaatgtattttgatggaagttgtcacaatcttaaacagttgagtcatagagagttgaatcatggagccaggaatgtccttattaaggacccttagcccaacctcatgtggatggaaaacactggcacccagagaaacaacgtaacttgactactctcatagttaataagtgacacagtctgaactgaacccaggcttccaagtcccagccagagcccagttccattacataacactgcctgaaaagtgccaagtcttctaaatcttccaatgtagcctgaaatacaactagcaagtatgatatacatctgaaacccaaggtacatccagaaatgctgataagagaattccagtcgtgcaaagatatggtgggtactaggagaaacctcacttatcttcagtggtgctgagataaaatagtctttttctcttattcaaaacataacacccttctaagctgtctttgttacataaacccttccaagctgtctttcttaagtgatctgttcgatgctttttcattttgaccaaactctggcatttcattaactatgcaacttcggtgaaatatgaccttactttcctcaactgtaaaatgggaacagcatcccctcccccctcagagggttatgaggatgttataaaatcctcatgcatgtaaagcacatagtaggtgctcagtaagggttagctctcttcttagccttcctagagtatctcgaaagaaagtcttttaacatattaggcagttgtatcatttttgtctctaaatttactggagtcattt

SEQ ID NO: 7681 - DNA, 1048 bp, Homo sapiens
gacccacagctagcatcatactgaaaactgagaaaaaccgagagcattttctctaagatctggaacaagaaaaagatgcccatgttcactattgttattcagcatagaatgtgaatcctaactacagcaacaagagaaagaaatacagggcatacaagttggaaaggaagaagtcaaattatccttgtttgcacgatatgatcttatatttagaaaaacctaactttccatcaaaagagtattagagctgatgaaaaaattcagtaaagttgcaggatacaaaatcaacatagaaaaatcagtggtatttctatatgccaacagggaacaaactgaaaaagaaatcacgaaagtaatcccatttgcgataggtacaaataaaacaagatgcctaggcataaaagtaaccaaagaaatgaaagttttgtataatgaaaactataaaacattgatgcaagaattgaaaaggacacaaaggaaaagatattccatgttcctagattcaaagaatcaatattgttagaatgtccatactacccaaagcaatctacagattcaatgcaatccctgtcaaaacaccaatcacattcttcacagaaatagaaataataattctaaaatttatatgaaatcgcaaaagacccaggatagctacagccatcctgaacaaaaggaacaaaactgggggaatcacattacctgacttcaaatacagagctgtagtaaccaaaacagcatgctactgacataaaaatagacacatggacaaatggaacagaatagagaacccagaaataaatccatacatctacagtgaactcatttcaacaaaggtgccaagaacacacggggaaaggacagtctcttcaagaaatggtactggagaaaactaagtatccatttgcagaagaatgaaactagacccccatctctcaccgtatacaaaaatcaaatcaaaatggattaaatatttaagcctaagacctcaaactatgaaactactaaaataaaacattagggaagctctccaggacattggtctaggcaa

SEQ ID NO: 7682 - DNA, 1037 bp, Homo sapiens
tcctgacatactgcagtttaaccagagcctaaccaacctggaagaaggggaatacccaattcaggatttctaaaacactgagacctcactgtaggattatagaaaacgtctcctctgtccacacctcaccaccatatcagtccagctcctgaataatagcacgattacagctaacagaactgcaagtctcagtccctatttaataggtctctaagaaaactcaaaaaacgggcgagacaaaagaatgctagaggcaacttttgcccctgatgtcacagatgcagcaaaaagtaaacacaacctaagtagccaaacatgaaacttcatgctaaaatcctatttaactcagttcctttgacctaatcatttcaggctttcaactaaaaattacaaggcatgcacaaaggcaaaatgaacaacgacaacaaaaaacacagtctgatgggacaaagcaagcctcagaaccagactcagatacagcagagattttgaaattaaaataactcttaattaatatactaagagctctaatagaaaaaaatggacaacctacaagaacagatgggcaatgtaagcagaatgatttttcttttttggtaagaactaaaattgggtgtgtttatttcttttttaaaaaactttttaggtttagggtacatgtgcaggtttgttatataggtaaacttgtgtcacaggggtttggtgtacagattattttgtcagccagctactaagcatagtgcccaatagttattttttctgatcctctccttccccccaccctccaccttctgatgggccccagtgtctgttctttccctctttgtgttcatatgttctcatcatttagctcccacttttaattgagaacatgcgttacttggttttcagttcctgcattagtttgctaaggataatagcctccagctccatccatattcttgcaaagaacatgatcttgttctattttttttgtcactgcatattattccatggtatttgtgtaccacattttctttacccagtctaccactgat

SEQ ID NO: 7683 - DNA, 1029 bp, Homo sapiens
ttaaaattagattttttcttctcattatgtttcagaagttacttgtgtactttggattcatgtcctttatcagatatgtggtttgcaagtatttcctcccagactttcgcttatttgttcactctctgaccagtgcttttaattctgatgagatcagatttatcagaatcttggtttttattttattattttacgaaccatgtttttgttgtcatgtctaagaagtgtttgcctaacccagtgtcactgatatttctcatacattttttacttccaaaaattgtacagttttggtctgcgatctgttttatagtttattttgtatatggtgtgatatatcgattaatttttttgcatatgaatatccaattactctagcaccctttatttaaaagactactttctcttcactgaattgcctttacagttgtagagtttgtagagttaattgttcatgtatttgtgagcaatttttttattcagacactccctattttgttccattgatttgttgttctatctttacaccaatactacattgtcttaattacttcagctttctgataagtgttaaaaccaggttattgtttctaaaactttatcatttttcaaaattgttttggctatttgagattctttgcatttccatatgaattttagaattgtcttgttgatttctacaaaactcctgctgtcattttgactgggattatatttaatctatagattcatttgggaaaagttacattttttttttctttttttgtgacagggtcttactctgtaacccaggctggggtgcagtacacaatcacagctcactgcagccttgacctcctggtctcaagttttcctccctccttaacctcccaagtctctgggactacaggcatgcaccaccacgcctagctaagtttttggttttttgtagtgatggggtctcactgtgttgcccaggctggtctcgaacttctgggctcaagtgatcctcctgcctcagcctcacaaattactgggattacaggcatg

SEQ ID NO: 7684 - DNA, 1034 bp, Homo sapiens
ctctgacagattctctctgagtagttggggcagggatagctacagatagtattggggagcatcctcataaattgtatctagaagaagaaaagcagcctgtaaatgccaccactacacgttaagttcaccgagggcacaggccagttttttaggcatgctttgtcaatataagtatgctgagagaatcacacctcacctgacttgatttaaaaatttctaaaaaggaaaaaaaagtggttcacatatatccaggtcactaatgtgacactattgacttgatttttcttgcctagcagctcttttgcaaggggagggtgacacattaaattgcatccacctgtgacatcttaaggtgactgaatgtgtgtaattctcttcagtacacaaaaggaaaggagaggcctgagggctctgaagggtgacacagaggggtgaacagattgaagggaggaaactttaggggcttcaggcaaacctcatttacatgtgtccaaggactttgaatggagtccctgatttctgcttccctctgaggactattcaactgaactttttccctatgttttttcttttttttttttttgtgatttgtgatgccaaaagtgttccttaaatagtcacttacaagaacaaagctgccgtcatctctgaatcagtcactcaaaggttatctgggaaatcagaatagtgtgcctggtatacttcaacatctttgttgtattaggcagcaaagcagcccaagaaattaagtttagtaaaactttggaataatttggagataataattccactttagaccgatttcaacccagatcaattactaaaataaaatgcttagggtggagaacccagaaagctttggactaaatgaaccacaagtcttatcaacaccagtgaaaatagtatgtttaatttttttgccataaacttcctgggacgcaatcaataacttgtactattaataaaatattttgggaaaaatgtactcaaccaacttattgctagtcctcatcatatacaggactctgctagtt

SEQ ID NO: 7685 - DNA, 1162 bp, Homo sapiens
ttatttcttattttttgaggaaccaccaaaatgttttccacagaggtggtatcattttacattccgaccagcaatgtacaaaggttttagtttctccacataccagctaacatgtgttactgtttttttgtttgttttactaatcttaatgagtgtgaactgatatctcattgtggttttgatttacatttccccaatgactgatgatactgagcatctttttatgttttgttgaccatttgtcaacaaaagagaaatagacatttctctctttggagaaatgtaatgtgtcagaatgtaatgctggatcttgtcctctctttggagaaatgtctattcacgtcctttgcttatctttaaatcaggttgtttattatttgttgttgaacatacaaatattttgtgtagtagtagaaatacaaaaatacttaaaacatgtcttctttcttactattagtggtgtaaagtataatttgctagctcacactaccctaaccttggaaagtgctgaggatagtttcaagacccataatctgtctattaatggaaatggtaagtacagtatatattttacttattacatatattctgtctatatttctaattatagtatgttcccctcaagtggatatcggcttaaataatggagacatgagtgattctgttggttctttaaaatatatctgtccctcttccccaaaggagaaaagtttattttcctttctctacactgagatttgcttgcaaggcttagtgggaaaagaagggtctcaggtatgctcaatccttgtttttgacttggaatttatgactttaccactcttctagctggaaattaaagacctgacttatttttaaatttgaaatcaaggaagccagcttttctgttagtaggaagcagagaatgtaagaaagagaaagggttaaattatcttaacttttttctctttggatggcggtggtatttagagtttacctttttctctttggatggcagtggtagttatagtttatccaaaataaagatacaggaaactgaagaaggggtttaggtcattaggaagatttgtaaaacttagcatgagcacttgctactctcccaggttattttacttgtgatgaaaaaatatggagcagtgctggtaaggcagtttggaagtat

SEQ ID NO: 7686 - DNA, 1049 bp, Homo sapiens
cttttacatacttagtactcaacaaatgtcagttttcattcttatatgcctccagcattatacaatgaaattgttccattagcataatgtaggaaaatgtttttcagataggcatacattggtttaagtgagtgcttctcaaagttggtaacttgtagcactgagagtacatgatgcaaagtcatagaataaatatggcatgtcttcttagagcatgaatttttaagattaagcatgagaagtttagaatagtggagtatttggaggttctgctttcttattcctggggataggggatatatgttccctctcagcctttttattaggatattttgtcaagaggggcagtttcaatggaaaagtttgagaagccctgattttagaaagtatgggactaaacattatattatgtcatctatcacaatatctggaatattatttttgggaccatatctgcctccatatttaatgctctttaaatatttataatgagttatgaattgactgtttcttaaattcggcagtgtggcttttctgaagttgctgatgtataaaaactattaaataagcctaatgcctgttcaatttatatagcagtgatggggaaaaattaggatccctaactggaaatgtgtatgattttcagtttctttactaattatctgtgatagatgagaatatctttgtcattatacacacacacacacacacacatatatttgttcatcattcatgtaaaaacagtgtttcccttaattattgctggaatttaaaaaaatcttgtatagtctatatgtattctttgtttatagcttcattttgtatgtgaagatataacctgaggtgactgatcagatataactagaaattataattgctttgttattacacaaaaatgacttgaagattaatgatttagttccttgaagaaagttatgtaaattatgcagatatactgaatatctaccgcttgcagaacacttattaagccctgtgctagggtgtctatgttaaaagaacagaatttgtcaaaatatgacaatattgta

SEQ ID NO: 7687 - DNA, 1030 bp, Homo sapiens
acaggattgtccttctgtgtcttgtctgtgaaaaagacctcagccctggggccagcggagggtataccaaggacctgtgttgtatgggtgggtcaaatggactccactttgagaggaagggcattatgggtacagaagccaacaccacctcaccaccccttagtctttgacccaaattttgcagatgataaaagatgtggagagctggatgagtaaacaaatacactttgggaggccaaggtgggcagatcacgaggccagaagtttgagaccagcctggccaacatggtgaaaccccttctctactaaaaatataaaaatcagctgggcctggtggcacaggcctgtagtcccagctactctgtagactgaggcaccagaattgcttgaatctgggaggcagaggttgcagtgagccaagaccgtgccactgcactccagcctgggcgacagagcaagactttctcaaaaaaatagaaaaaaaaaatgagaaggaagtataagatgagatgcgaactgactgctttcccaaggagagcgagtgtggtcctctggcagcatagtaaggatggtaactgacaggtggggctactgtggaatatggaaacaacggttcaaggtaggtgatacaggtttgctttagtaagtggaagaagttcaagataaagactcagggatcactgtttccagccacacatgccatgccctacgtaagtgtaaggtagaactatcttgggccacgtgcggtggcccacgcctgtaatcccagcactttgggaggctgaggcggatggatcacctgaggtcagaagttcgagaccagccttaccaacatggtgaaaccccatctctactaaaaatacaaaaaattagctgggtgtggtggtgcaggcgtgtaatcccagctactcagggggcttaggcaggagaattgcttgaacccgggaggcggaggttgcagtgagtcgagattgtgccactgcactccagcctgggagacagagcaagactctgtctcaaaacaaaaaat

SEQ ID NO: 7688 - DNA, 1097 bp, Homo sapiens
ataagtacataagtaataagtcaataagcaagcaatcattaagcatgtaatgtgcaacaatcaaatcattcattcatttacgtttctttccaaatgttaataaagataaaaaggcagaaattacccttttagtaattaactgcattccttatagaacggcagaaaaacaagagtggagaaacagttgttttaaaattgaaagactggccttcaggagaagacttcaagactatgatgccagcaaggtttgaaacttttcattttgactcttgactttttgagatcgagctaagactgtccccagagataggataagtaaccgtaaatgtgacctgtaggctttttctttctcaattaaaaataaataacttgaggctgagcgtcatagtggctcacgcctataatcccagcactttgggaggccaaggcgaggggatcgctggagtccaagacttggagatcagtctggccaacatgacaaaaccttatctctacaaaaaaatacaaaaattagccaagcatggtggcaggcatctgtagtcccagctacttgcgtggctgaggtgagaggatcactggagtggaggaagtggaggctgcagtgagctgagatcgtgccactgaactccagcctgggtgacagagtgagaccttgtctgatggattgattgatagcaaaactgagttggtagcctcagcagtgggaaaatctttatgttaggacagtgaaggaaagaatgttcatgttaaagaggctgggcacggtggctcacgcctgtgataccagcactttgggaggctgaggcgggcaacaagagtgaaactttgtctcaaaaaaagagaacacaggaccctgtttaggacctcccttctattggagctttttaatggtttaatggttagagaagcagaattgctattttagtcagtatcacttgagtcaaggaaaattgttacctgtcttatggaaaggtagtctgctgttttgaacaacttgaaaattatatatgtgaaaatacttagcaatgcaaatctttatttataagaaggcaatgttgtttttcttcagatacgaagatcttttaaaaagtctgcca

SEQ ID NO: 7689 - DNA, 1046 bp, Homo sapiens
gatgccacctacttgtattctctgtcccaggcctataacaatgtaaaagacaggaaggctgtacttctaagtttttcagacctggcagttctcacacaaccagacttctggtttgcattttgtcaggaatataggaactcaaatctaagagaagtgcatattgtggagtgtagggatattgtttaaaaaaaaataagtctgtgggaggaaaatgtatttgatttctctcaaaaacaggttttttttgttttgttttttccttaatagagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacaggtgtgtattttaggctgataaagaacactcttggtggaactgaagcttattaaatagaatggttccctccttaggaatagaaatggaggggggaaaaatagtggttaacacatttgggggacaataagatataaaagtaccgaaaagattgtcagaatgcttgtttctcaattcctgttttttggccagatttaatatgaattaatagggaaacgttgattattttatgttactttttgatctatcagaacagacatgtaataacgccttgaatttacaaaatgcagttcctttctcctctttttagattggtattttagtccagttagtagatccatgtctactattaaaatattaatattggcagcatttttcatgaacctatgtagatgttcttatctgtaatatttatacacagaacatttacttacaaattagttcatcaaatcttgaatgacaaactatattgtttcattctcctctaatataaatgattttgt

SEQ ID NO: 7690 - DNA, 1050 bp, Homo sapiens
ctgaaaaaacagctttgtcctgggtgaaaaaggatggtaaggaagttaaatataacatgaactgcacaaatttcattttaagaatttctctttgaattatgtttgtgaaagaagtccctaatcttatctaaccttgatttttaattatgataatgatacctttttacagtatgtatttaaggttacagatactttcctatagagggtgaattgagtcaattaaccatttgtgaaatcacaatagcattttgctgtttctgccattacaacattaagttaatgtgttaaacccactttagaaattgtgaaatttcagcatttggcttataaagacataatctaccccaattatttgtattggaatctcagctttactccctaactgttacctttggcaaataacctctctggatatcaggcaggtctggaaaataggaaagataactatctcattaatttgtttagaaagtagttatgttaattatgtttacttaagtacttaatagttcctaacatagtagatgctctaaatattagcttcttttccttcccttccttgaaatcactggtttgcccctcaggggacacttagcaatgactggagacatctttggttgcataactgagggagttaaggatatgttgccaacatctgataggtagaggctacagatgcctctgaacagtctgcaatgcacagagtaatccctcccaacaaagaattattcaacctaaaatgtcaaaagtaccagagttgagaaaccctgcttagatgtacggcatttttatttttcacttaatgatcatttatgggtcttctaaagagaattacaaattacttcaagaaagctattggtcttcagttaatatagccttgaaagttcttggtttgcctttacatttttatttcttctgtatttcagccaaaattgccttggaaaagagcatgtttgcctttaaaatttttgttttttctgtatttcagccaaaattgcctggaaaagagcagtgagaggagtccgggagatgtgtgatgcatgtgaagcaaca

SEQ ID NO: 7691 - DNA, 1047 bp, Homo sapiens
actcttatatcatctggtgacaaaattggaagcttatggaaattactatctatttaatgctgctcattcaaacagtccttaacaataggtaaaaattaacataaggggaggcttgtggttttgtgtattcatttcgatgttaaagaattgccatattaatagcttcacaactgattatatatcctttgtggcaacagctggacaaaataagagatacttaacagtaatattcactataaagtgtttctatatcattttactctagtagtagtttttctcagtttgcttatttctttttaggtatgttgcacaatgcagaaagcacttagtttcactatgtccgtgtgttcatccacatacaatatatgaaatatctgtgacaatgtggacactcaaagtactttcacaagcacttggatgcttgaaggctcccatttgtgccttttaactgaatgaggttttcccacatgcctgtgtggaaaccagaggcaaagtgaaggagaggaaaacaggaggatggaatcatagaaaaggacagtcagaaagtgaaagaacaaaggacaaactcaactagagccagagactgacagactgaaatgcaagcatagtcagaagacagagagggggattaacatcgaaggatacctgccatttacttgaatattggattatatacagtgttgctttttcttatgtgttccccttactctccctcactacccccatgaattcataataggcttagtgtgagcaatttaattgtttctcttctgtcttatatgacatttcctttggtgttgggtgttcagatacttgagtaaaacttaaaaaacaaaaacaaaagataggtaccttccaggttttaatgcctagaaaactcttgtgaagttaaatttatgaaattaagtgttagtgaaatacgtattctcttttcatcttgagacgaatatacatattcacatgtaagagttctaagaaaagggccagaatgagtgcctttttttcccccaggttgtaatgtttagtcaaatctcccctgcttggtaa

SEQ ID NO: 7692 - DNA, 1028 bp, Homo sapiens
agatgaaggaggaaaaatatgattatatatcacgaggaggtaggacccacttttttttttaagggaatgaaaacaaataaaacaaaaatacattttaaaatatgcttatttagtatgaaaaataagactcttctttctttaatcctacagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccctaaaaaatagccagcctccctgggatcaaatacaggaagataaaaaacatgaagaagcagagaagcggaagtctgttgacactcagcttcaagaagatatgattattcattcgtcagaacagtccacagtttctgatcataattctaatgatttacttcctcaggaatgcaatatggataaaacacataccatggaattgctaccaaaggagaagtttgtatccagaccacccacaccaaaatgtgttattgatattacaaatgacactaatttagaaaaggtggctcaggaaaactcaagtacctttggccttcagacacttcagaaaatggatcctaatgttagtgattcaaaacactctattgcaaatgcaaaattcttggaaacagcaaaaaaagattctgaccagagctgggtcagtgatgtagttaaagtggatctaacccaatcaagtgttacaaatgcttcttcaggaaatgatcacttgaacatggaaaaagagaagtatgtctcttacatttctcctttaagtgcagtttctgtcatggaagataagctgcataagcgaagtccacctccagagactataaaatctaaacttaatacttcagta

SEQ ID NO: 7693 - DNA, 1049 bp, Homo sapiens
tgatgttcaggatacaaaataattgcttttatggtaactcttatactatcaaagatggtttttatggagaaatttatgtcatggaatggaatttaagaaagcacactggatgttaccacaaaggtcaagggttttatagcagaggggaaaatcattccattaataagccacacatatcagtatcaatttgaaagtgagcattcagtcattatctatcagaaattgtccaaaggaggagaaactgctgcagttttgtgatatttcttttatcctaaaatgaaagtgctactctagacatcagttgagacttttgagcaaatctgttacgttattaagccagtcttctctgtcacttagaaactaaccaccctttgttggttttttgtcagcagtcaaatgagactatgtgtgacataaataatatatttcttgaactggcaaggagcactctaccttattatcttaggaaatgagttgtgtatatttttaacattttcataatactggtgtcattaaacctaactaggcatatctgaatattttagtgttctgagcttatgttttatattacctagatggttatttttttctttcgaattaagtagaaagtacataatcacctaaaattatgttagtacagtagtcttactgtcaaaatacacattccagcctgattttaaccttttctttgagagtctcactctgccacccagactggagtgcagtggcacaatctaggctcactgcaacttctgcctcccaggttcaagggattctcctgcctcagcctcccgagtagctgggattatagatgcgcaccactacacctaaatacattttttttgtattttttagtagagatgaggtttggtttcaccatgttggtcaggctggtcttgaactcatgacctcaggtgatccacccacctcggcttcccaaagtgctgggattacaggcatgagccaccacacccggcctgatttcagccttttactccatcatgtccttctctctctctttttttttttttttttttttgaaacagggt

SEQ ID NO: 7694 - DNA, 1351 bp, Homo sapiens
ttcacagatacttttctaagtttaccaaatcttaagcctatttttctttcattgcttttcttttcattatataaactcaaccctctaatataaaaaactaaaagttatcacacccagtctggttatggccttatcttactcctttccttcatagctggacttcttataatgtgaaccgttatatctatattttcttgcttcccaataatatcttcagttattgcagcctggtttcttcctccacttcacaaaactgatgttgctaagatggctaatcatctcttagttactgcatttaatattcaagtgtgcatcactgtcctactgaacctttgcatttaacactggatcactgtccttttggaaattctttgttcctgttgctactctgatacttctcttcaggttttcctatttttttaatcagtctttgctgtatgtttgttctctctgtagaagatttagtgtttatgtgatttttttttgtagtgctccttattttctgtagtgttcctttttggttttttccatttcactactcaccctaagccgtgtcacatttccactgtcttttaaaaccctgtcttctgaatccaaaactccagacctctctgctctaccattatttaataactgtttactaagcatcttctctgtgccaggcagtattcatacaaaatttcctgcccccatggagttaaaattctggagaggccaggtagataataagtgtaataagtaacttatatagtgtgatatacaatgtaataaatgcgatgacaaaatgaaaatgtaaagcagtgtaagatcaataaggattggggaggggagaagcagatatttaatagaatgttcagagtagatatcattgaaaaggtgaaacccatgtcttctgctgtctatttactgtattcacattcaaccatcagaccttgatttcgtttttcttcctgatcattctgtatcccagctaatgagatcaatcacatctatgccagtttgtcacttaaatcaacatgtagggccaggagcggtggctcacgcctataatcccagcacttaggaggccaaggtgggtggatcacctgaggtcaagagtttgagaccatcctggccaacatggcaaaacccccgtttctactaaaaatacaaaaattagccgtgtgtggtggcacatgcctgtagtcccagctactcaggaggctgaggcaggagaattgcttgaacccaggaaacggaggttgcagtgagccaagattgtgccacagcactccagcctgggtgacagagcgagacgcaagtctcaaaaaaaaaatcaacatgtaggaatgttttaggtctctctcttgcc

SEQ ID NO: 7695 - DNA, 1656 bp, Homo sapiens
tcactgcagcctcagtctcttgaggacgataggtgcgcaccaccaccccggctgattttgataaatttatgaattgcttttctgtgttatcttggagatcactctgttttcttaaaacagctgttttgaatttttcatttaagagttcacacagtgccaccttgttagggtcaatcactgttttcttgctttatttgggtatgtcatgattccctgtttgctgttgtttcttttggatgtatgtctatgtctttgcattgaaggattggttattctagacttctctgactggcgtgttttggctttaattagatatttttgcttagactttttaaataatttacctttcttgttttccccagtagtttgctgcctccttttcggcactaaatgacatcttaagcccagatttgccttggttctagtaaacagtcaggagtgccaggagtcccaaattgcagtggtcccaaagtggagaatatcctggtagtgcgaagactagctaggggtttgtgcctcgggtacctgtggaactaatctccacagcatggtgctgctgaactgccactctgatatggcatctcctttgtctaatttatggagcagagtttccaggactggggatggtagtccttctctgcttcctttgtttctggctgtcctcagggatatttctccctttgggtgttcctgatgcttcctgtcagttgaggcagggatagatctcctgccagaaaaccccaggtggtagggaagctggttgtccaccttgatcttactttttccagtgttgtagaaaccataagttggtgggaaagtgtggtcctgggcagattgctgggaggggcactgcagatagaaagtgagattctctctcaaaataaataaatagaaagtccaattctcttattatctgcttctggttttttcacttctctgtggccccaggactgtctccctctcatatttgaggtctgggatgttattggtgataatctcagcattgtgtatttcttttttgttttctactgaggggagtgaacccaaacattgtcattttggaactggaagtctgtacttgtattttttatcaatttaatttggctggtggtacaaggtgggtatttctgcctttgtaccaagaacttcgagaactgatttattgctaatattatttaaaatcagaagttgcttacaaattagtgaaaaaaaattttttttgagacagaattttgctcttcttgcccatgctggagtgcaatggcgtgatctcggctcagcgcaacttccgcttcccaggttcaagcgattcttctgcctcagcctcccaagtagctgggattacaggcatgcaccaccatgcctggctaattttgtatttttggtagagatggggcttctccatgttggtcaggctggtcccgagctcccgacctcaggtgatactcccacctcagcctcccaaagtgctaggattacaggcgtgagccaccacgcctggccaaattaatcaaattttaagatatagagagaaccagaatcagctcacaacaattgtagaataagttactaaattctattgagattttgttgaaagatacctatctagccatatatatatttatatatatatatatatatataatttatgttagt

SEQ ID NO: 7696 - DNA, 1291 bp, Homo sapiens
agactctaagccatcactagttaccattgagaaagattttctggtttcttttttccaatcaaaataagatcataggattgatttattctttttcttaattgcataatcttactgaagcatgtcatattatttaaaatctcagaattagagttttattcctcagtataatagtaatattttactagaattagaatttaattttgggaatttgatcattcccaaaatattttcatgtgcattattttatttccaatgttagctttatgaggaaaatagattgtattctcttattttgtgtaatgctttcaggatatatattaatttattaatccacacaactgtttgagaagtctaacttacagatgagaaggaagcaaaaatagaaacgatgtaaagtagattaagttttaaaagggtgtgagtattgtgatgatatagcaggcaatgtcatggtacatccatttcaagaaagtacagctgaactttactcagactggaattgggaactagaaagttaggaactcaagtcacatattccctttaaaccctctccagaatctcctttttttgacgggtttattctgctaactcatagatactgcttctcataacactagttttcatttgacttacgtgtgtcagtatcaattcacctacctgtccccgctcctttacaagaccttttaaatctaatatttatgttttctactaaaattacagatagatggcataggggaatgaaacgttgaaaagaagaaataaatataaggaagagaatatatggtagtaattttctgtggtaggcagagaaagtgaggtttagctcagctgtgacttggcatctaggttcacacagcttgtgatagtcaaaaaagaacctgtgttgggtatggtggatcacaactgtaatcctagcactttgggaggccgaggtgggaggattgcttgagctcaggcatttgagactgggtaacatgggagaacccctgtctacaaaaaaataaaattagcagggcatggtggtgcacgtgtatagtcccagctactggggaggctaaggcaggaggatcgcttgagcccaggaggttgaggctacagtgagccatggtctcgccactgcacttgagcctgggtgacagagggagaccctatctcataaaaaaaaaagggggggagctatgctgcatagtggcacacacctgtaatctcagcactttgggaggctcaggcaggcagatcacttgagctcaggagctcgagaccagcctgagcagcatggcaaaactccatc

SEQ ID NO: 7697 - DNA, 1043 bp, Homo sapiens
gacctttttgttaaccttcatgagttgacctgatatggtactgtttgaaaagaaatagatcatttgataatgttcaaggattaaaagtcctcttgagaagatgccagtgttttctagtttacttaaaaactaaactgacagagatataatatgaaaaaacattttttacagtagggatcagccgaatatccctgtttatgttacatatttcatgtcaattggtcacgtagtggtggacacttttaaagcctaaatacaataaatgctcttgaatttcttacaaactttttgtcacttaagtaaaataataaataggattttatgaaatcctataggattttatgtaattgaaaagtgttaaatgataacagtagaaggaaatagctaaataatgtgaggattttctattttgaaaatgtgatttctcacccaaataatagtaattttgataaataatagagtgcttaaaaggttagcctaggatatgggagagaggatattactgtgactagattttctgatcttaaatatcgaaaataagtgagaatataagagagtttttcctgttttttaattaagaaaatattatttgtaacttcatgatgtagatagcatagaaataagacttgcttaaatttaatattaaatttttaactttgaaacattgttacagattgcagtgagtcaacctgaaattcctcttaggaatttcttaaatatagaaattaactccttaaaagccactccaaaccaaacatcttgaagtttttccctggagtatgtttattgttattaacaaaatgttatatattttttaagacagaataagagaaaggggaaacacaatgattttgaaatgcctggtaatttgtactgtctatgccaaaatctttgttttgtgtggaaatattaacacaaattaccctgtagctagaaagatttctccatgtgatataggtaacttagaaattgagttgattattaattctgttttccgaacttttttccagttaaaaaatttttttatagtaaagcagctgtgt

SEQ ID NO: 7698 - DNA, 1043 bp, Homo sapiens
cctggccaatgtggtgagaccctgtctctactaaaaatacaaaaattagctgggcttggtggtgcgtccctgtaatgccagctacttgggaggctgagggaggagaatcgcttgaacccaggaggcagaggttgcagtgagttgagatcatgccactgcgctccagcctgggtaacagagcaagactacgtcctccaaaaaatagagagagaacttactattagagcattcttgtccagtagaaataaaatgtgagctacatgtgtgattttaaattgtctttacatcaaaattttaacataggtgtattaattttacagtattttatttaacccaatatgtcaaaatattagcatatcaaaataaaattattcatgagatacctcttaattttttttatattcaatgtgtattttgtacatcacacatctcaattcagattaactacatttcaggtgctcagttgctacatatgattagtaactaccatattggacaacatcagacagcagaactctagaatttagatagatgttaagagactatattatataacacatctgagaaatgcattttatgctttcaaattgtatcttagaactatctaggttaagttgttttttgtaatgagtgaaaatggttgaggaatattttcaaatctaccaaaataaatattaccagtttttttttagtaaaatgcctatgagattgttgagatcattgtctaaaaatattttaaattgatttattttgaagtttttaatatttttaaggcaaaatggttatactaataaataaatcgtgcccaaaaacatacaaagtatatttgatgctttatttttaccaacttgagagatagtcacatgttatttcttttctgcactttctcaccttggtaaatctggaaagcaaaaacttagtatttgcatttgctttatgaaggagacagtaaacttgagctttcagtctcgccactagtctgtctttgtctgttgttaaaattatgagccagtctctatggccgcagccaaatgagtaatcac

SEQ ID NO: 7699 - DNA, 1065 bp, Homo sapiens
accagtgcaaaaaaggtgtcttattcaagtttctaagaggacaaacaatgaaacgattaggaaaaactggaagaggcatattactagcttttgaccaaaaaaggtcaggaaatcagtcatatgcaaacgtatatgtcctactccttgaggatggtgtgcttgacaggactcaagattgaggacattttattttaggttaacctcagtttctcctgtgatttttatgagtattaacattttaacacaagcattgcttttatggttgagttgatttaatggtataatatttcttattcccacagaattatatttaatttttatcctcaagaggtaaaggattggctgggcatggtggctcatgcctgtaatcccagcactttggaaggccgaggtggtagatcacgaggtcaggagatcgagaccatcctggctaacatggtgaaactccatgtctactaaaaatacaaaaagttagccaagtgtggtggcatgcacctattgtccatgctactctggaggctgaggcaggataaccgcttgaacccgggaggcagaggtcgcagtgagccgagatcataccactacactccagcctgggccacagagtgagactccgtctcaaaaaaaaaaaaaaaaaaaaaaaaaaaaaaggccaggcgcagtggctcacgcctgtaatcatagcactttgggaggccgagacgggcagatcacaaggtcaggagttcaaaaccagtctggccgacatggtgaaaccccatctctactaaaaaaacaaaaaacaaacaaaaaaaaaaaacagaaaaattagccgggcatggtggcgtgtgcctgtaatctcagctactagggaggctgaggcgggagaattgcttgaacctgggaagcagaggttgcagtgagccgagatcgtgccactgcacttcagcgtgggcgacagagcgagcgagactccatctcaaaaaaaaaaaaaaaaaggccgggtgtggtggctcacgcctgtaatcccagcactttggaaggcggaggcggtgaatcacgaggtcaggagatcaagaccatgct

SEQ ID NO: 7700 - DNA, 1036 bp, Homo sapiens
ttagctgcttgatatttttaggaagccagaatacctttaaataaatatcttctgcaaaataccaaagagcttattctcttactagccctagatttttcgtatttgaaaacctggtgtgtataattgggtaaagtttaaagggcctctatgtggttcaaagagctacatactgaggatgggcagctttccaatgtaagctcttggtaaattatttaaaggtcctgtggttcctgagaaagtaggatgttgagtgagcaaagtgaccaggaaactgatctgttaagaaaaggtctaagttctggactgaggtgctctgctctgagatatattcactctaggccaggtgttcttaaccgtgttcacggtcgcaatggctgaagcaacggttcctaaaggtgattgaacctcagaactaacccagagagctttttaaacctaaggattcctgggacccaccctcagtgtaagttacagagtaaggcttagatatgtgtattcttagaatgttctccaggtgatcttgaaaattctgaaattgtggagcaaaatagtgtgtgtctcatgtttcttttggagctacagctttcgtcagattcttaaaagggtctttgattcgaaaatcaaaatgttaagaacagttgctagaagccactaattctcaaacttgatagtgtatcagaatgacctaagaatttgttaaagcacagattgctggaccccacttctagaatttctgatttcagtaaatctggtttggagcacaggaatatgcattgttaattacaacaggtccttgaatgatgtcattttgttatttcattgatgataaaaagtatagattcctagctggggctgctctcaagcaaatgggcttgctgtccagtgtgcacagaaaaccaataactatggcattggctttttagaaaagaaaggtttttttgttttgtttgttcgtttgtttgtttctgagacagggtcccacagtgttgcccagtctcgagtgcagtggtgtgatcatagctcactgcagcctcaa

SEQ ID NO: 7701 - DNA, 1044 bp, Homo sapiens
taatagttgaaagatcttagatgcaaagagttttaaatcattagttcaagaactagtcagtgagtgattgaataaactttattaaaacatgcttagtgaattagtgaatattacaacacaatttttttcctattactttctttgagtttcgagaaagtttctagctgggtgtggtggtgtgtgcctgtagtcccagatactggagaggctgtggtgggaggatcccttgagcccaagagttcgaggttacagtgagctatgataggcaacagagtaagactctgtctcagaaaaagtagtctctatatgtgtatgtaaactttaggaagaagtggatgtttatcactgttggtttgtttctgaagtgtaattattatttgattgtgacttgaatctactttttaagaggccataattttggctaattccaaataagacctgaccttacaaatggcctcattactaagtccagcttgtgctagagctttcactaattactgtctgggtctaggactggtagtcagactgcaacagtcacaacttggtaaacattttaaatactgacataagatttttatattcatacattattcataattgaagtaaaaacatagttccaagatgttgtaaaggtgtctttcactttttcttcagtcttagctgtctgtgaagataaacatacaacttgcctcttataaatggttctcatgcaagataaagctataatgggatactttttttctgtttttcaaatatcagattagcaaagatcaaatgttttgaacacgtttttgaaaagagtgtagaaagactgccactgtcattcattgctggttatgagtatatacagatataaagcttgtggaatgcatttctaattatatatattcatttactcaggcatttttcttctcgtaacttattgtccagtctacatgcatttattcatttgtgggagatgacttgagtacagggcttcttcttgtatgtattagaagactggaaacagcctaactatctgttaaataaactgagtgcagttgc

SEQ ID NO: 7702 - DNA, 1047 bp, Homo sapiens
gtcaagactttgttggctgggcacggtggctcacgcctgtaattccagtactttgggaggccaagacgggcagatcattcgaggccagtagtttgagaccagcctggctaacatggtaaaactccatctctactaaaaatacaaaaattagcccggtgtggtagcaggcgcctgtagtcccagctacactggaggctgaggcaggagaactgcttgagcctgggaggcggaggttgcagtgagtcgagatcacaccagtgcactccagcctgggcaacagagcaagactcactctgaaaattaaaaaaaaataaaattaaaaaaacgtgataaactaatgactaagtctttttcttttctttttttaagagatggggtctctaccgggcacagtagctcacacctttaatcccagtatttaggaggccaaggtgggcagattgcttgtgcccagaagtttgattccagcgtgggcaacaatgtgaaaccccaactctacaaaaaataaaaaaattagtttgcacatgcctatagtcccagctactcagaaggctgaggagggagaatcacttgagcccaggagttcaaggctgcagtgagccgagattgtgccactgcacacagaagaaatatcagaaaaatgatttttaatcaaattacttacgttacaatacagtttgaatacaagtatagcaatatccctttgagaaagatctttcaacacacacacacacacacacacacacacacacacacacacacacacacacacacgccagcatggtggtgcttgcccgtagtcccagctacttgggggctgatgtaggaggatctcttgagcctgggaagtcgaggctgacaaaccttgcctccagagagagagagagagagggtcagaccttgcctccagagagagagagagagagagagagagagagagagagggtcagagcgtcttgccatgtcatccaggctggagtgtagtagtggtacaattagagctcactgcaaccttttttgttttttgttttttttttgaggtggagt

SEQ ID NO: 7703 - DNA, 1063 bp, Homo sapiens
caaagtagatcaaagacttaaatctaagatctgaaactaacaattctagaggataacattggaaaaacccttctagatattggcttaggcaaagacttcatgaccaagaacccaaaagcaaatgcaacaaaaacaaagataaataggtgggacttaaagagcttctgcatgccaaaagtaacaacagagtaaacaggcaacccactgagtgggagaaaatcctcacagtgtatacatcctataaaggactaatatccagaatctacaacgaactcaaacaaaaagttcaacagtcccatcaaaaagtgggctaaggacatgaatagacaattctcaaaagaatatgcacaagtggcagatggccaacaaacttattaaaaaatgctcaacatcactaatgatcagggaaatgcaaatcaaaatcatgagatcatctcacaccagtcagattagctattattaaaaagtcaaaaaataatggatattggtgcagatgtgatggaaagggaacattcttacaccgctggtgggaatgtaaactagtatgactaatatggacagtgtgaagattcctttaagtagaagtaccatacccagtagtgggatccagcagtctcactactgggtgtctacccagaggaaaagtagtcattatatgaaaaagatacttgcacagtcatgttcaaagcagcacaatttagaattacaaaaatatggaactggcacaaatgctcatcaatcaaggagtggataaagaaattcttacacacacaatggaatactactcagccataaaaaggaatgagttagtggcattcacaacaacctggatgggattggagactgttactctaagtgaagtaactcaggaatgaaaaaccaaacatcgtatgttctctttcataagtgggagctaagctgtgaggatgcaaaggcataagaatcatacagtggactttggggccttgcgggggaaatggtgggtggggattgagtgataaaagactacaaattgggttcagtgtatgctgctcatgtagtgagtgcaccaaaatcccacaaa

SEQ ID NO: 7704 - DNA, 1035 bp, Homo sapiens
gtggtggatactctaaataccttaacttgatcaatacaattctatgcatgtagcagaataccacattactacataaaaatgtatgaatattggccagctgtggtggctcacgcctgtgatcccagcactttgggaggccgaggtgggcggatcacctgaggtcaggagttcaagaccaacttggccaacatggtgaaaccccatctctactaaaaataaaaaaattaactgggcatcatggtgggcacctgggatctcagctacttgggaggctgaggcaggagaatcgcttgaacacaggaggcggaagttgcagtgagcagggatcatgccattgcactccagcctggagaggagcgaaactctgtctcagaaagtatgaatattatatacagaataaaagaaaattacaagcaagagaagtacacacaaaacaaaccaaaaaacacgtaagaagccacatcataaccaaatgcctcaaaagcagtgacaagtataaaatgccaaaagcagccaatgaatcaaggcacattactttcggaaaaacagatatgaaaattactgcgtacttctaactaatcaaaaaattttcaagccaaatgcagtggaatgacatgtttgaagtgctaaatgaaaacaacaaatttttgtttgcgtgtttgcttttgagacaggatcttgctctatagcccaggctggagtgcagtggtgcaaccatagctcactgcagcttcatagtctcagcctcaagtgatcctcccacattaccctcccaagtagatggaactctacaggtgtgcaccatcatgcctggctaatttttttattttttaaggagacaggggtctcactattttgccagggcttattttgaactcctgggctcatgtactctgtccatctcagcctcccaaagtgcttgtattacaggcatgaaccaccatacccagccattagaatttcttctttttttttttcgtggtgttttttttttttttttgagacggtgtctcactctgtccccaggctggagtg

SEQ ID NO: 7705 - DNA, 1032 bp, Homo sapiens
aaaaatgtatgtttggtttgtatgaagcaagctaaggatttcatgactccagcaatttacaatttaactcaaaatctagctgaaagcctagttcaagttctgtcttttctattaaatgttttctgattagacttacatgcagtgactacccagtataaaccaccaccctggaacctcttttcttcccgaaaatgcttatttttctctaaatcacttatcaccatctgacatacacgtttacttgtttattgccatttctacactcacacaggattatgagctctataggtaggagttttgttaacacactgctttgactttgtggttaccagtgcttgtcacatatcaagttcttaagaagcattcattgaatgaaggaatctgtttaattctgaatctttctttcctctaggcttctttgtttataagttgtagtcaatatagaataatacagggtttgtattgtttgatgtgtataaatctgatctccgtctgcaggaactttcttggagcaagggcctaactttgtactattatctcctccacagaatcttagttggcatttgtgtttgatctcttgatttagatagacacgagtttgatttttggtttagctgtttacttacttttgtgacagtaggtaacttttctgaaccttggtttctctgttttaaggatatacgagatagtgttggttgaggactgtgatggttcattttatgttgtaagcatgactgggccacaggatacccagatcctggtaagatattatttctgactgtgtctgtgagggtgtttccgaagagattagcatttgagctagtagactgagtagggaaggaccacccttatccatttgggcagatattgtccatcctttgggggcccacatagaaaaaaaaaaaaaaaaaggcagacgaaggatgaattggctctttctgagctggaacatccttgtctcctgctttcagatgtgggtgctcctggttcttcatttttcagacttgaaccaagacacaccactggctttcc

SEQ ID NO: 7706 - DNA, 1151 bp, Homo sapiens
ttagctattgttacagaagcatattgctaagtgagaatttgcttacctaataagttaggttgcagttcatacataagaacccaagtatgctttagggctgtttcaggccagattttgatttaacaaaactagtgtcactcataggctttagagcctcctcttcatttatcttatgtttccccttttcatggctttattttagttgcttctcagctactcagagaaatctctgtatcttgtagtatctaatcacactttaaaaaaatgattcatttcccagtgggcagagtagcacacagctgtagtcccagctacttgggtgactaagttaggagaatctcttgaggccaggagttcaaggctgtagtgttctataattgcaccactgcattccagcctgggcaagatagtgagaccccatttactgattataagatttaaaaatatctgctgcatgatttgtgaaaaacacagaaagtcgtaaggagtaaaataaatcatctttaattttttttaaagttaaccacggttaagagttgggtctgtttccttttattccgtatgtacctttttccctgtctcctttaattagtactgagttaaagaccgtgctttacttagtacttgagtatgatttctggaaaaaaaaattactggttttataaaaatgtgtgtacactaaaattcatttattttaccatgtacaattttttgagtttgggcaaattcatagactcaggtaaccactgccacaatcaagatacaaaatagttctcttaccttaaaaattttcctgtgctgcccccttgtagttgtctccctactcctaacctctggctagtttctgcatttttcagatcattgtataaatgtaatgataaagtatataacctttcaaagctggcttctttctttcattcattaattttgagattcatttatgctgttccatagattggtagtttgttccttttttttgtttttttttttttttttgagacaaagtctcactcttgttccccaggctgcagtgcaatggcacaatcttggctcactgcaacctcccgcctcctgggttcaagcgattctccttccttagcttcccgagtagctgggattacaggtgcctgccaccacgcccggctaatttt

SEQ ID NO: 7707 - DNA, 1600 bp, Homo sapiens
catatactgttctctctgcctagaaagttttcctagttaacttgactcatagttcagatattactttatgtcttcatgaaagggctgtctacacccatggtcttgattgaggaaagtacttaataaattttcctaacttcatttatcacacatgaaatgtaatatattttatgttgtttgatgaccatcagtctctcctcgtagactgtatgtcccatgaatacagtcgtcaggattggttttgttcagtgttgtgaacaataccattcctccattagtggaactccgaatagcattctaggaccaccagcctacttttaccaaattccacacatactcaagtcctgaagttggccccgtagaacacactcataaaaagtcagccctctgtatacacaggtttcacatcccatgaacactgtatttttgatccatgttctattaaaaactacgcatacctatgcatttcaaacctctcttgttcagcggtcaactgtatattatttttactgttttattgctttgcctctgtgctgtatttcctctgacttgacttccagtttaaattttttttttttttttttttttgagacagagtctcactccatcacccaagctggagtgcagtggctctatcttggcccactgcaaactccacctcctgggttcaagtggttctcatgcctcagcctcctgagtagctggaattatagatgcatgtcatcacgcccagctaatttttgtatttttagtagagatggggtttcaccattttggccatgctggtttttaactcctggcctcaagtgatccacctgcctcggcctcccaaaggggtgagattacaggcgtgagctaccatggctggccagacttccagtttacttatcctttttattggtatctaataaacttttatcaattcattgctttttgaaaatatgtctattagtcttttatttttagaagctctgtgtagttctttttcaattttacttgctcatttaatttgtttctaaacgtatttctaaacttacctttatttcgttaaacacaaagtacctcaagttagtctgtgttaatctgtatctgctaattcctatgtctaaaatttttttgttttctgtcttcattggttctcagtcatgtgaccttgtttccttgtgtatatttttttattctcgcccctccttactaggatgagatggttaggggagatttttgagaatgatttaggtctagaatggaggtaggtttctctagagaggatttgctgttgtgtctgctgtatatctggggagatggcactgatggccttggactacattaaattgaaagcttgaagttttttgtatcactaaaatgatgtgaatgaattcatactgggactggtttgtggttacggcattcaaggatttttttttaagccgtatttgctcggtgctaacctagctttccttgcagacctgtgaaggtaaaaagaattagggtaggtttacttctggtactctgttatcccaatgagtagttagccctttgtaggtctcttgttagtcttctttgcatgaacagagggtgattttatgttctatttttgttt

SEQ ID NO: 7708 - DNA, 1062 bp, Homo sapiens
tgaatctaaaagtaccgggttaccatatggaaacaataccaagccatccttaaaaaagagtttaaattctaaattgtaagagcagttataacaactttcagtactttcttcaataactatattttgattagcatttctgtgacattagtaactctgataaaatgatttcatgaaacaggaggaaacgaccaactcaatagctagaaaagaaacatttcaactagattaaaacaaagttaaaacttgtactgagaccacaaaattcctatcatgggtaatgaaaagtattcattaaaattcaattttttatgtaataagaagttagaaattggatagtcatattcaggtaaattggtcacattatgtggaatgcagaaagaaacaagggaaataaaaccagttctacaaaaatgttttgtcattataaaaatattagatcacattttcaaaaattaacttttgaagaaactgctgtgttttaagaaaatgaaagttagtaggataaattctctgtaaaacgtccagaacaaatgtatgaacataatatgtggttattaccatgataaatgtgcacaacagcttagaaaaatgttaaatagttgtgaatgtagaaatggtggtagccatgaatatggcccaggccagttataccaatggctaggtaatagtgagaaattataatagcaatctctaagatgatactaaaacaaaatgttactttctaagaattaacattactaggattatgaaacaactccaatttaaatgggaatttaggttctcaaatattctagtataacaggtgttcctttcattagtatggctgctcaaagaatatgaaatggatttctatctggtagtaatattcttaaattcacacaattaccatgcttcggtggaaattgaaggaggtcattattttgaaggtccaacatggttagattttctgtcatcttcattttcggagggtccacaagatacaatctgatcgttactaatcaaaactgttttaaatgtgaatgtatgttgtagaacttaaggtagtattttgaactagatagt

SEQ ID NO: 7709 - DNA, 1124 bp, Homo sapiens
tggagatcatctctcagttgccaaggtggaagcccaggcatctttttcttctttggtgtataggctatgccctagcctttggcctacactcttaaagcaaaatgaatatatttgaacgtctacatttaggttttatatgacagacattgcagtagtaactttttgaatatgcctaatattgggaggagccagtgttgaataggtgtacatttaaataaacagtcaatctaatttataaagccattatgtacatcattttcttgtactaatttaattactcattttcccccggatttaccactatttttgtatcttatgaaaaattcatgcaggactattggcatagaaattagttgatgggctgggcacggtagcaaacgcctgtaatcccagcactttgggaggctgaggtggggggtatcacttgaggttaggagttcgagaccagcctggccaacatggtgaaaccccatctccgctaaaaatacaaaaattagccaggtgtggtggtgcacttccataataccagctgcttgggaggctgaggcgagaattgcttgaacctggaaggcagaggttgcagtgagccgagattgcatcattgcactcctgggcaacagagtgagacgagaagaggagaagaaaagagagagagaaagagaaagaaaacaggaagaaaaggaaggaaggaaagaagaaaagaaagaaagaggaagaaaaattagttgatggttaactaattcttccttaggctattcattttccatcattattacaccctgaggaggctttaactaaatttcctgatacattagatgatcaatatcagtattataagattgatttctataaggggctgggcgtgatgattcatgcctataatcccagcactttgggaggcgagggtgggcagatcacctgaggtcaggagttcgagaccagcctggccaacatggctaaaccctgtctctactgtagtcccagctacttgggaggctgaggcaggaaaatcgcttgaacctgggaggtggaggttgcagtgagctgagatcatgagactacactccggccagggcagctgagcgagactctgtctcaaaacaaaacaaaaaaagatttattta

SEQ ID NO: 7710 - DNA, 2168 bp, Homo sapiens
ccagccttccagatcaccccaaccagtgctcctatataaccatcctgtgctcctatagaactttgttttgtacctctgttttaacaatcagcacattctgctttgtattatacctatttgtttgcatgtctgtcttcccttaatagattgtaagttctttgaggacaggagtcatgtcttagtcatctatgtatggttccttggagtctagcacagtgctttacccatctcagaaagtaaattcttattttaaagtgatgaatgtgctgcaacccagctagtgaaaaagaaccctactgggagttatcacaagttttctgactattaacatatgataatatcaaaggacaggaaagcagaatcacccaattgtggtaaaactgtgagttaccaattttaaacatgtcaatatataataaaaaatactaaaaagcttataatgccaattctcatcaggtacaaatttgattcctgaaatcaccaaggggaaaaatgtaaaattacctgaaatgcgttattttaaagatgttaaaggaagaaacagaagtcctcacaattgacttaaatattcaaatctttgataatttacttgaatttctgaattgagttttaggaaactcagactactttttctcaatgtagcttttccttcatagataggcaattctggttcaaccaggaattgtgatgacatcataaacacgtaaactcttagcaatttatttattttaaaatattctcttagagtgctttttacttactatctgttccaaaagaaaccccctcaaaggagaatagagttcactgctctttgggacaagattacctttatatccagcagttatcaaagttggtttagattatggcctcaagcaaattttactaaaatgtgaaaatatgccaccttccaagtcagaaataaactttggagtatgttcatttaaagagtttttacatatttataattgaatttccacaattagaataaacagttgcatgtctttttgtactttgttaaataatgaaatggaagtaatgacaatataacttcaggattgttatttctctacaaggtaaagcactttaagagatcaaattatacataataaaatattaagctttttaaatgataaactctaatactggcatgtattgcaatgaacgagttcacacactcatatcttgtggattataaaatgacattattcttttggaaagtattatgttataagaaccataagaagttcatactctttgattcattaattctagtcttaggaaacgatgcttgaaaaacagtttttaaaaagtgtattcagtttagctaatgtttgtcacgtacctcatacgaattagacactgtggtgggagctgcagattaaaaaaatgaaaggtttaatgttattagaagaaagatgtttattgcagtcttattaaagaggaaaagaaaaatggaacaaccttgatgttcaacaatttgtgaatgctgttaaattaatattttggcatattatgcagctttaaaagtgataattgtacatactttaggaaaatgtagagaaaatttaagtaaaaaaaattaattacatcagcactagaattatgtatttaaaaagtcttatagaccagggacagtggctcatgcctataatcccagcactttgggaggttgaggcgggagaattgcttgagtccaggagttcaagaccagccagggcagcatagctataccctcatccctaccaaaaaaaaaaaaaaattagcctattgtagtggcgcaagccttgtagtcccagctactcaggaggttgaggtgggaggattgcttgactccaggagtacaaggctatggtgagctatgattatgccattgcactccagcctgggcaatggagcaagaccctgtctcaacggaaaatatatatattataaagtaatggagatcattattttatattatggcagaattttgcctgaccaaaattgtcttttccctaaaaaacaactattatttcctagcaaattggaaatttcatataatgatgttattcagtattttatattttggaggtagtcttcttcaaatgagttattttagtaaacttgttttatgtttctgttaatatactttgataggtattatttgtgttttgctattgcagcattta

SEQ ID NO: 7711 - DNA, 3417 bp, Homo sapiens
tttgcctgtttttgaattggatcatttgttttttttggtgttaagttttaggatttctctatgtattcttgatattaatccccttttagatacatgatttggtaacattttctttcattttacaggttgcctttttactgtgttagcagtggcccgtgctgcacaaaagttttaaattttgatgaagcccaacttgtctgtttccgcttgttgcttatgcctttgttgttgtattaaaaaaaaattgccaaatccatgtcatgaagcttttccccttatgttttcttctaaaagttgtatagttttagatcacaaattttggtgaattaattgattttaagtttggaatatcatgtaagggtccagcttttttttacgtgtagatgtccactttttccagcaccatttgttggaaagactgcctttgccccagtgaatggtcttgacactgttacagaaaatattttgactgtatatgcaagggtttgtttctgggctttctattccattccattggtctgtatgttcttatgctgataccagctcactgttttgattactgttgctttgtagtacattgtgaaatcaggaaatgtttttccgtcaactttcttctttctcaggatagttttggttattcagggtcccttgagattctgtatgaatttcaggagagatttttctttttctccagaaaaaggtcacttggattttgatagggattgaattgaatctgtagatggatctgggtggtagacatcttaatattaagggctgggtgctgtatcccagctctttgggaggctaaggcgagaggattgcttgaggccaggagctcaacaccaggctgaacaatgcagcgagcccccttctctgcaaaaaaaataaaataaaataagccgagtgtggtggctcacgcctatagtctcagctacttgagaggctaagtctgaaggattgcataagcccaggagttcatggctgcagtgagccatgattgtgtcattgcactcaagcctgggtgacagagtgagaccctgtctctaaaactacacacacacacacacacacacacacgtgtaaatattaagtcttctagtctttgaacaggggtgtctttttacttatgttttctttaattttgctcagttatgttttgtagttttgtttatttcatcttctaggtaatttattcttttttgatgctcttgcaaatggaattatttgttaatttcattttcaaattattcattattgttatatagaaactagtcagcgtgagcctgtagtcctagctacttgggaagctgaggtgggaggatcccttgagcccagaaattcaaggctgcagtgagctatgattgcaccagggcactccagcctgggtgacaaaccaagaccttgcctcaaaaaaaaaaaaaaaaaaaaagccaatttttatgtgttgatttcatatcctgttgcttaggtaatatcctagtcaatggtgaaagactgaaagcttttcctctaagatcaagaataagacaagggatccctgcttttgccatgtccactcaacatagtatttgaagttatagtccagaaattagaccagaaaaagacaaatagcatttaaattggaaagaaagaagtaaaattgtgtctgttcacagatgatataatcttatacttagaaaaccataaagacttcacaacaaagcctactggaactaataaatgaatttggcaaattagcaagtacaaaatctctgccttcttttaaacatagttttagctaacactgcattaaaattgtagatcctgcttttttgcctaacatctatcctctacatttctcttcatgagtagtaatttaggatcatttttaatggctgcataatatttaatcttataatgacccatttccttaatgtttgacattgtagtttccagttctagggagcattataagcaactgggataaataccattgcaagcctttgtctgcatctctgattttttaaaatgtatattcatagtagtagaattaataatcacagggtatgaacttgaaagccacaaaaatctatctcctgacactcttcacaaattgtgtaaaggttgtactgactgccattgtcctcagtcagtgttggggtgtttttatctcactcatcacacccttgtaagcattaattatttatttgcagtttatcttgttttaaaacacaaatatttggccaaaacaggaggagttttacatcctaaggggatgcagcattgaatgttactctttctctgctaattggatatttgaaaataatatttcgttgtttcaatttgcattcctttaatagggtgaatttttttcatgtttatgagcaacttgtatttttagtgaattgttatttagtacttattagggttttgagttttttatatttgttatgagctttctttatattattacagatattataacctttttgtcatatttcatagtttgcttagccagttgtttgatagtaagtctttttgaattgtatgtttattttaaagtctatgcaatgggatattgtcattaattccagtagtcaggttatgtgtgcttgccttccttccttttttcttttgttttaggagattgtaaaaattaataaacaagtgaagtgagaatgcttgtttgtaataattaagaaaatagtcaatttaagtttcataagcattttgcaaacatttatatacagttgatatgactgagattttattgtttccttttttgttcattaaaatttggcttctttaaggatgtctataaacagcaattataaagttaagcgttttaaaattcctacagcgtaatgaaatactatatctacagatttgagaaatttgagggatctgtatatgagatggcaatagaatgaaacagtagaaactaatactttgtctttaattttctacaaatttaatgtttctatttctgtgcacatgatacttgctttatgttcttttgtatttaaacatgtttgtatttattatcttctttctagttgtttcactcctcgtgtggtacttgtttaatattacatatcagttacgttatcttgtctacctcttatacctagaaattagtggaaactggcagtgtacctgctgtttcttgagatcatgacaagacaaaaacaaatcctgttgtctcattaacatattttaaagtatattttttaaaacttaacataattgcatcttcagcaaaatatgaatagtataatacccaggctccttctctggaattgtctggttcctctttctttctaggatatcagtagcaaaacatttatgggagcaccacatgtaagatgctgaagtggtgtctttttttgcttggtcctgtacaatcagagtaccacttgaggccattctaatgctgta

SEQ ID NO: 7712 - DNA, 1219 bp, Homo sapiens
ggccaaaaggaatgaccctagccagactcagggatcaaagagcaaacagattcagtggcctgcattggtaagatctattcctgtttcattaagcattttcatttgttcgtttaaaacaaagaacaacaacaacaaaacaaaggccaggtttggtgactgacacctgtaaaactagcactttgagaggctgaagcaggacaattgcttgaagccaggagttggagatcagcctgggcaaaaaagcgagaccccatctctaccaaaaaaaaaaaaaaaaaatagctggatgtggtggcacatacctgtggtcccagctacttgggaggctgaggtgggaggatcacgtgagcccaagaatccaagtcaatgtgagttactgtcacactgctgcactccagcttgagtaacagagtgagaccccatctcttaacaaaaaaaaaaagaataaatgaaaatttaagactaagaattaaatagaagtttagattcatcttactgatttataaattaatatttttgaagagtctctgatgaatctggcagagattttaaaacactgccttcattttgttaaaacaactttaggtgtctctttgttagtattctgtcagcgtatgtagttaatgaataagtttattctatcaaattaaaatataaattggattaaagggacctgagagatagttgactgtatgccacgtggaacaactttgctgaatgaaactttgttaagtgggagatggaacatactttgtattaaaacatttaataacgagtaattcttcttggtttgttaatcagtaaatcattgtgggtgatagatgtttaatgtgtaattattcaggtaatggattaaattacttatcaggacatgtttcatttaagaaaatataataattttcagtaaattctctggtactttgaagagttttatttaagaaaagaaacaggaagtaaacaaggtcattaaattgtattaggaaaagagccacattcatttaactattgttattgctgttttctggcaaaacatctagcatataacaaatttgcaatatttgtaaagttttcttcttatgttactatcaaagaaatatattaaaagctgctgaaacattattgcaggtatttgatataactaatgagttagggtagttcctttcaattttttaagcctgcaaattaactaattacaaggatagcttctgcttgctaataa

SEQ ID NO: 7713 - DNA, 1035 bp, Homo sapiens
tttttcatctgtgcttagaatgttgagagtttttattatgaagggatgttgaattttatcaaatacttcttctgtgcctattaagatgattcatgactgtcgatttacatatgttgaaccatccttgcatccctgggaaaattttcacttgatcttgatgtttttgatgtgctgttgaatttggttttctattttgataagaatttttgtatgtatgttcatcagagatattggcctgtagttttattttgttgttgttgttgttgtagcattcttgtctggttttggtattagggtaatataatgctggcctcttagaataaattaggaagaattccctcctcttcagttttttggactagtttgaggagaagtggtgttagttgtttcaaagtttgatagagttctgcagtggggccatctgatcctgaactcttcttttttgggagattttttactactaattttacctcattacttgttattagtttgtttagattttctatttcttcctgattcaatcttggtagttgtatgtgtccaggaatttatccatttcttcaaggttttccagtttgtttttgtatagttgttcataatggtctctgatgatcttttgtatttctgtggtatcagttgtaatttctcttttttcgtttctgattttgtttatttgggtatccttttttgttgtttattctcaacaagcagttaattgattttgtttatctcttcaaaaaacagtttttcatttcattgatcctttgtattttgttagtatctgttgcatttgtttcttcttgatcttaattgtttctttccttctgttaattttgggcttgccgtgttctattctgttttcatgggatgtatggtttgacactgtatttgaaattctgttactttttggttataggtattaattatgaacttccatcttagcactactttattaaatattctctagattttggtatgttttgaattgatttttatttattgtaaagctacatttgatttcatccttagtttctt

SEQ ID NO: 7714 - DNA, 1051 bp, Homo sapiens
caacagtatatgagagtacccttttctctacatcctcaccagcatctgttattttttgtctttttaatagtagcctttctcactcgagtaagatctcgttgtggttaagatatatacatttccctgatgattcatgttgttgagcattttattttctttttcacttttgagacaggatctcactctgttgcccaggctggagtacagtggtgcgatcacaggtcacttcagcctcatcaactcaggctcaagtgattctcccacctcagtctcctgattagctgggactacagttgtccaccaccacatccggctaattttttgtattttttgtagagacggggtttcaccatgttgcccaggctggcctcaaactcctgggcgcaggtgatctccctaacttggcctctggaagtgcttggattacaggcatgggccgctgctcctggactcatttttttcatatacggtgttggctgtttgtatgttgtcttttgagaaatgtctgtttatgtcctttgctcacgtgtgtgtgtgtgtgtgtgtgtgtgtgtgtgtgtgtgtgtgtttatgtacttttttgcccaccttttttttttttttttttttttggagacgaagtctcgctctgtcaccaggctagagggcagtggcgtgatctcggctcactgcaacctctgcctcccgtgttcaagcagttctcttgcttcagcctcccgagtagctgggattacaggtgcatgccaccacgcccagctaatttttgtatttttagtagagatggggtttcaccgtgttggccagaatggtcttgatttcttgacctcatgatccacccacctcggcctcctaaagttctgggattacaggcatgagccaccatgcccggccttttgcccactttttaatgggatttttttttaaactgttgagtttctcatatattctgaattattagtcacttgtgcgatgagtagcttgcaaatactttcttccattcaacaggttgtctcttcattctgttgattgtttcctttgccgtgcagaactg

SEQ ID NO: 7715 - DNA, 1033 bp, Homo sapiens
tttaaacattcatgtacaggtttttgtgtaaatataggttatttcacatgggtgaatatctaagtatggaattacttttcttaagtagtttatcattttgcattcccactagcatccagagttagttgctttgcatccttcccattcttttgggcagttttaaaaattttagtcattcttttttttgagacagagtctccctctgttgcacaggctggagttcagtggcgcgatcttggctcactgtaaactccgcctcctgggttcacgccattctcctgcctcagcctcctgagtagctaggactacaggcatccgccaccacacccggctaattttttgtatttttagtagagacggggtttcaccatgttagtcaggatggtctcaatctcctgacctcctgatctgcttgccttggcctcccaaagtgctgggattacaggcatgagccgctgcacctggccaaaaattttagtctttctaatagatgtgtagtagtagctcattgtggtctttatttgtatttctctaattattaatgatttttaatatcttttgatgtgcttacttgctgcctgtatgtcttctttagtgaagtacatgttcaaatcttttgcccatatttttgaattaattttcttttattgagtttcaaaagtgttttatatattcttgatacaagtcttttgtgaaatacgtgatttgtaagtatttccttacagtctgtggcttgttttcattttttttaacattgattttcacagagtaaaacgtttccaattttgatggcatctaacatcacttttttttttttttgtgatggagtttcactcttgttgcccaggctagagtgcaatggcgtgatctccgctcactgcaacctccacctcccaggttcaagcgattctcctgcctcagcctcccaagtagctgggattgcaggcatgcgccaccaagcctgactgattttgtattattagtagacacagggtttctccatgttggttaggctggtctcgaactcccaacc

SEQ ID NO: 7716 - DNA, 1047 bp, Homo sapiens
aacaacaaaaagggctggatgtggtggcttacacctttaatcccagcactttgggaggcgaaggtgggtggattgcaaggtcaggagttggagaccagcctggccaacatggtgaaaaacatagtgaaaccccgtctctactaaaagtacaaaaatcagccgggtgtggtggttgcatctgtaatctcagctactcgggaggctgaggcaggagaattgcttgaacctggaaggcagaggttgcagtgagccaaggttgtgccatggcactccagtttgagcgacagagcaggactccatctcggggccgggggaaaggcagaaaagaacaaagtaaactcaagaacaaggcaggaaataaagagcagaaatcaatgaactagaaaataagcgggaaaaaatgaaccaaactacactgagttaacaatgttcacctataaggtagtccctcacttggcttctcttccctcaatggacaacacacccaattggtgagactctagaggagaggaatggacacactcacatgttgtttattggaatgcagagtggtataacctcctataatggggttttgtcaacatcatctttgatctaggaaatcctaccttaggagtatgccttaaagatagaatggcaaaaatacaaaatgacatatgcacaaggatatattcattgcagcattatttagagtagcaaaagattgaaacaacccaaatatccatctgttagggttctgattgaataaaatggttcatgccccaagtgggatattatgtaggtataaaaatcaaaaacaataccttttaagctgtgattgctactgtacattttgttaagtaaaataataagatacagaacagtgagtaaagtaggctttttatttaagtaaatatatttgagtatgtgttcatgtgtatatctatgtttctacttttatttttttttaaaaaatggaattaacccaaaactaatttattatagggaacaggtatagaaggactagctagaattctccgaatataccttgttttctagatgtgactt

SEQ ID NO: 7717 - DNA, 1041 bp, Homo sapiens
tcctgaatttatgcaggcaatgggcttgtttggttttcctttgtattacttataaaatgtagtttgttctgataacgttcttataagattgatgatattaatctgtatatatgcatatttgtttctctcctgttatatatatgtcctttaaaaattggacaccagaaactatgtagcctcattgttttactcatccccttcatttattcagtccactgacagtaagttcctaatgtatgtcaggccctgagaaatcaaatattgatattactttttactactagagttactactttcacaggaaatgtctgctgcattttcttattagaattattgacatctatagaattaaaaaatacatcttttgcttttttgtctcccatccatattgtcaagtactgtttccttttaaatgtacatgtggggctgggcgctgtggctcatgcctgtaatccccgcactttgggagactgaggtgggtggatcactcaagcccagaagtttgagaccagcctggccaacgtggtgaaacgtcgtctgtattaaaaatacaaaaaaattagctgagcttggtggcgcacacctgtaatcccagctacttgggaggctgaggcatgagaatcgcttgagctttggaggcagaggttgcagtgagctgagatcatgccactgtactccagcatggacaacagagcaagactccatctcaaaaaaaaaaaaaaaaaaaaaatctacatgtggtattaaagtagactcaggtttgaattctgactctcccatgtattagctgtgtaacagataaatcacttaatctttttgggtcttgagttctcatctgaaaaacatatttaatacctactttataggatttaattgagagaattgaggtgctaaaaatgaagtgagagaatgtacatacatgtgttgtataaacttcttaaatttaaaaagttatatgatggtagtatttttataaggattgctattcacatatttatccttgcactctgtttgaaatataattgtagttatccttgggag

SEQ ID NO: 7718 - DNA, 1033 bp, Homo sapiens
agatattatcactttctttcacctcactcactcttcatttccttcacagtattaacagtaaccttttctgttacattttgttaactttagaaatagtagatcatgttagactaagtagagatcacaaaaagatgagatttaggagaaatccatagatgttttgaactgtggatgaatagttcaccaactatttcctgtacacaaaagccatgcaatatatgtgattaaatttgtgccttggtgaaataatatgttatatgtcactgtatgtattgtggggtcatttataaatggttacaatattttaaagtaggaatacctagggtctgcttgtcgttagttttctgtgatagatattcgacagtgcttcctggcatttaggaaggggcagtgagatcttttaatacatctagagaagacacttccttatatgatcttttcatttattcaaatatatatttattacttcctctgtgccaggtactgtgtggctgagcagcctagacttgattctgtaaaggaaattaaaaatcccaggacccccagactccttatgcaaaaggaaagttaatcctggagtctgagtcatgcaacacactctttcaagtgagtagctgttactaacattatgccttaaccagatcctcatgtaaaagtaaaagacctcaggcatctatgaaagacttcccctacagatcactgaaaagcaaatgcttcgctggtctcccacaaacagatacatgccagttgtaactttaggtgtacaatctaagtgaagctcctaaaactaaggtctgttctgtgccacactgataatgtcatttacaatcttaccttctcagatgcagaacagagacaagaatagtcattcttccactgacccagagatgtctgcagaattgatttttcctttactctgtttttccttcattcacctaatattatgtaaaatatagtttttactagataccaattaaaatctcacaggaatttaaccattcacgttactgcctacctgtccctcttcctacat

SEQ ID NO: 7719 - DNA, 1434 bp, Homo sapiens
gattttttaactgacatcgttaatctttgatgaattcatcattcatttccctacagtcactcatctccagctatgttcagctgattgattagatacagaaacaaagtaggtggagagttggatttaatgatgattggggtttggctggaaaactaagatgcattcagagatgggcaaatgaattactctaatgatagacctaggattttacatttggtgagcaaaaaagtgagaaaatgagagatgaatagcaatgaaatggtgttgagatcagtgaatcttaggtccaggggaacttgaatgtgaaaaagaaaaataggaggtagtggcatgagagagagaaagatgcttgaaatcgagatttttgagggattgctgtttggggccatgataagggtctaagataggatttcttatgtctgaaaggataatccataggtttatattgcctgagtaaagttaaagatcctctggtctagagtatgccatggtaagtcagtggttgagataaggttgaggacaaaatcattaaagaagaggaaatcaaagaaatgagaaatggaacaattaaaacagtcatcactgtggatactgaaatcaccagaaatgattattggacagaaactaggacagaaataatattgaatggcatgatgaataacattttagggtacgcatgagtgtggtggatgactggttgatggtagtaggttagtataatgtgctgttcagatttcaaggtactgatttttagagatgagaggatagaagtctgaaaatcatggtagaggaaacagctacaccaccatacaagagagctagtaagtagcttcaaaggagattttaagagtgattttaacttggggaatttaagagctggagtcattgtttacttcactgtggcacctttgaaactgttacattaacataaggtaattgaagaattgttattcctcttgtattcaactgaatatttatggttagcttacagaaatttgcagttgtgaaacagaacagaaacttgtgttgaattcggctactacttaaatatgcatttttaatactctttaacacctcctccctcctcatataatctctcaaggcctgtgattacatattgcatattgaagtcacttcttttttctctttcatagatattaatgccttccaatgcactgttgttgatagaatataaaactatgaggtaaaaatatctcagggttttgcctttctttgaatatagaatctaacctttccaccatattgggtatttatttagagagggtactcaagtattttgccacactcttttttagtttgtttgtttgagacagcgtcttgctctgtttcccaggttggagtgcagtggtgcgatcttggctcactgcaacttctgcctcctgggttctagcagttctcatatctcagcctcct

SEQ ID NO: 7720 - DNA, 1049 bp, Homo sapiens
tgttttgaatgtataaatatcaagtattgattatgtatgtggtcagtgttgtaggctaacatagcatttaagaagtaaacccgttctcaagaaatttctacttctagtggagagagttgatgaatattcagcggttgattcatactactgtatacagttgtatatttagaaacatgtttgttatttgttcccagttcctggcacagagcttctgatacccttggactctcccgagtgataggggtgatagaagtgtcatttcttctatgaggcaacccttggtggacttctagataacttcagggtatggtctggtcaccaaaaagaccagaccttgaatagaagcttggaacactctcatctccatgacctaacctctggggagtggggagtgactggagatagagtaaattaccagtggcatatgtaaccaaacctctataaaaggtttgcatatgtaaccagacctctataaaaacctgtcaaaaggctgggagcagtggctcacgcctgtaatcccagtactttgggaggccaagttgggtgggtgcctttgagctcaggagtttgagaccagcctgggcaacatagcaaaaccctgtttctacaaccattacaaaaattagcggggtgcggtggctcacacctgtagtcccagctactcgggaggctgaggctggagaatcacttgactcaggaagaagaggttgcagtgagccaagatgctgccactgcatcccagcgtgggtgacagagtcagaccctgtgtcaaaagaagaaaaagcaaaacaaaacaaaaaaaacaaaaccctgtaaatgatgggatttggagagctgagagggtgacaccctgagagagggtgtggaagctggaagctcccttacttcctacctcaccccatgcatttcttctgtttggtggttcttgggttgtatcctttataataataatctagtaagaaaatgctttcctgagttctgtgagttattgcaccaaattacctaactggaggagggggcctgggagcccccaattattgctggtcagt

SEQ ID NO: 7721 - DNA, 1022 bp, Homo sapiens
tttgcctcctgggttcaagtgattctcctgcctgagcctcccaagtagctgggagtacaggtgtgtgccaccatacccagctgatttttttatttttagtagagatggggttcaccacctaccttcccctatggttgacatactgcaactagatggacaatgcacttatactgctgattccttttagttgtgatattgatgccacaaaaccatagaaaataagatttgatcacttcaggttataaactgttacctttattatttctgtccatctaagtaatttggaatattatgattcatgttagagtacccagcagatgtgaaggaaaatatataagcttagtgaaattttgactggtcacttaattgttcattgggaaatgaaagaggtctagaatatgttgaagtttattacagacaaaaataaaaatgaaggggaatctaaatgcattaacattttgtaccttttaatattatagtttttttcttcctctgttccaaagttttccagatactgtagcctgctttttactatgttgataaagaggaggtgtctgagaagctttgtagaaataatgtgggaacatggagaagaactgaattgaggtcagggaagctataaacctttgagtgcttttgtgatgtgatgtgctctatgggaggctgtgtatgagttcaagcttgagaaacttgcttgataaaaatgtgactattaacacttactgttccttcctcttgttaagagtctcttgagaagatgaatttttatttaaatactgttttgtcttttttttttttcctggttataaaatgcttacagatattttgtccttagagttatacctatccctcacaaataacctgaaacataaatataataacagagtatgtcacaaagataggaaattcctggtgattccagagaaactggaatctctagtttgtaaggaaaatagtctctatctttggcttctttggcttgtaaagtgcttggtattatacagattgtccccagtttgttg

SEQ ID NO: 7722 - DNA, 1061 bp, Homo sapiens
tttttgttttttgttttttgagacagggtctcactctgtcacccatactggagtgcagtggcacaatcacagctcattgtagcccggacctcctgggcccaagtgagcctcctatctcagcctcccaagttactgggtccacaggtatgtgccaccatgcctgcctaatttttaaattttttttgaagatggagtgtccctttgttgcccaggctggtctcaaactggcctcaagtgatcttcccacctcggcctcccaaaatgctgggattacaggcaagaaccgtcacacctggcctaactttgcttggaattgtgtacagttttatagactaatttaggaagtatgaatatcttttcattactgagtctgcacttcaaataacatgtagtatccctccagctattcatgtttgatttttttaaatattctccagtggatatgattttcttcatatacgtcctgtgtttgttaggcttattcttagacactatatattttgacacttagatgtatattgatatatgcctgaatcattaatacatatcttttactcatttgtttcttcagacacaacttttggaataaaaataatgtgatctttcttttcccagtatatatttttagctcatataatagcttggtagcttttttcattcataggcttaataaagttacagtagactttatatatatgaaaagtgttataaagaaaaagtgaaataatgttactagcttcttaaatcttgcctaaagttttaataaactgttcaagatgttatttccttatcatgtcttttgttttatcattatgatcaatggaaatataatatttattttacagaatttcacttttagattgtgtaccagttcatcttcaagtgaaactgtaacaaaaaatttctcattcaaaatacagatttaaaaacattttagtgatgattatttactatacaaagcaagtatatattagaatcctttacattttattttattttattttattttatttttgagacggagtcttgctctgtcatcaaggctggagtgcagtggtgag

SEQ ID NO: 7723 - DNA, 1029 bp, Homo sapiens
atggctgagtaatattccattgcatatatataccacattttatttatctaccaaagggtagaaggattgcttctaccttttggctattgtgaataatgctgccatgaatatcagcatatctatttaagtccctgctttttacttccttggggtatgtacccagaattggaattgctggatcatatggtaattttatgttttgtgaggaaccactgcacagttttccacagtggctgcaccattatatgttctcaacagcaatgaagatggattccagtttctctacatcctagtcaacacttactatttcctgggtgttgtttgaaaatagccatcctagtgagtgtgaaatggcatttcattatgataattttcccaatgattagtgatttttgagcatcttttcatgtgcatgttcacaatttgtgtatctcctttggagaaatgttttaagttgttcacccagttttgattcagcatgttttgttttgttttgctttgttataggagttctttacatattctggttattagtaccttatcagctaaatgattagagatatattctctattctgtgggttgccttttcacattcttgataatgtcttttgatgcataggaaaattataaattttaatgtagttcaatgtatccatcttttattttgttgttggtgcttttggtgtcatttcccagaagttgctgccaaatctaatgttattgaagctttcctgtcttcatttgcttctaagtcttctatagtttcagctcttgatttagttcttctatccatttttagttgacttttgtgtatggtgtaaaataagggtccagctttattttcttacatctgttaatctcattttctcagctccatttattgaaaagactgtcctttttccattgaatagttttggcacctttttcaaaaattatttggccatatatgcaggggtttatctctggtctctgtcttcatctgtacagttgtctctcagtatcgtgggggattgattagagcccccaaa

SEQ ID NO: 7724 - DNA, 1035 bp, Homo sapiens
aaaggagaagaaactaataataaatatgactaaagttcatgattgtcaaccttttatttcttgtattccagtgtcccagtggatagggttaagctttaacgtgcagaattgtggaggaaacatgtttgaatggtttttttctagacctcatacccagatactgtgatcttagatatggagtataggacaaaaatctgtactaaaatttattaacttttttgactgggtaccacagaaacataaagaagtatattttgaataatctcactcccacacctgccccgatcagcctagtttaatctgcatctcttttaaataaccatttttgttaatttcttatgttttcttccagagttttttgttaaaaataaagatgtgaacggatgcacgtagtcttattcctcccaggcatatgtaatcaagctgagcataacctaaaggaaaataaccacgttataggtgttgcgatacaatacaacaggaactacacaattcaacttatgaagtatttttgccaagaagaactgaacctgaatataatgaagcttctagattctgacagcagtttacaggacatatggaggtagaggaacatgtgaaactacaccatgaggatacagtcagccatattcattatgtggggaattacagagctgtgcttttcagtatggtagccactaatgtgtggcacttcaataaaatgaaaaatcaggctaggtgcagtagctcatgcctgtaatctcagcactttgggaggccaaggtgggtggatcacttgaggtcaggagttcaagaccagcctgggcaacatggtgaaaccctgtctctactaaaaatgcaaaaattaactgggtgtggtggtgcaggcctgtaatcccagctactaggggggctgaggcatgagacatgagaattgcttgaaaccaggaggtggaggttgccgtgagctgagatcgtaccactacactccagcttgggcaacagagtgagattccatttcaaaaaacaacaaaaaaattagctgggtgtggtggt

SEQ ID NO: 7725 - DNA, 1037 bp, Homo sapiens
tcatccatacacccatctatctacctttctttgatgcttaggttgattgtatttctgttttcaagccagttctgtctaaagtgtaagtatttaataaaatatgtctggttttttcaatagagaaaaggacaataaaaaatcatactgtgtattaaaggccaaacccataaatttgcttgtatttaggggatatcctgggaatgaagagtttaaactgttgaaatgtgtatcagctgatgttattttgcaaaacttctgtcttaaatatgaataatattcatgtttaggaaatttaaagtgatttatgatttcgcatataaataaaacccctttttgtttttgggtctacacatttctgcttagttttctcatttaagtttcttatttagttggtagcattacatttccttgtatgtttctttatgtcagtctgacatttatattgtcttgcatcattattaaaaatgctgatttctggtctgtttacaaaatgttgaatgtatgaatgaatgaatgatttttacttcattggtcaatacgatcttgataggtttactatagcaaaattggtttttttggtaggtagaaagacttctatgtctgatgtaagtatgccaactatttttcacactcgaatttgttattgctattgctggtaaagacttgaatataggaaaatgacgaaattgccccaatggtgggacataaactcgtgcagttactaccactagctagttttaaaagaaggtgatgatcgcccagtaaatgttgttaattgtgtttctgtgtaaaattaaaggggctgttgttttatatgatcttttgacccatcatctatatgttctggcacatattttaaatagggtattccaataatttccaataattttaaatagggaattcagtaagttccagtaattttaaatagggaatgttttcattcattagaataattgaactatagaaattttaccatgtgaaaccttatcgtctttgtatagggatattattgcatgtgaaagtaaaaatgttaacta

SEQ ID NO: 7726 - DNA, 1053 bp, Homo sapiens
cactgtagtcaatgatatggttaatgcggcatgtattaatattgactcgatatcgcaaaataggtgtgttttgctgataggtatttctaacagaaaatagaggtagttttgaaggttttggctggttattttcgtatagaaatgtataatcttccttaaaaagtattggtgatgttagtggttctaaaaattatggcagttcaattcagtaactatttttgtttgtgtaaaaggctgaggtaagaggattgctagagcccaggacttattaagagtccagcctgggcaacataggtgagaccccctcatctgtaaaaaaggaaaaaaaaaatttgtatatataaataacttaattgctctcttagttgggaatttaagtgattaaagagttaagtttgcatatgttagtaaggtattaagctggatattaaaaaataaattatctatggatggtagagattgactggaaagaataggagtttcttcaggtgatagaaatgtttcctatcctgattgttggttacacagatatatatatttgtcaaaactcgttgaattgatactatctttgcgtttcaccatatctaaattttaccaaaaaaagaaaaatgtatgttgaaccatacctatgtgaacccttgatgagtttttttaatctgtctttatttgaaaatttgaatattaatttagtttttttagcctagaatctaccattttagatttattcccagattttcttacattcacatttcttaaacgaaacttggaacagtttagcattaacataatgtaatattcctgttcgactttgattactgcagagtagattttaagttacatgaaattaggctaggcacagtggctcacgcctgtaaacccaacactttgggagactgagatgggaagatacttgagcgcaggagttttgagactagcctgggcaacatggcgaaaccctgtccctacaaaaaatacagaaattagccgggcatagtagtacaatgcctgtggttccatctactggggcggctgaggtgggaggatcacctgagc

SEQ ID NO: 7727 - DNA, 1035 bp, Homo sapiens
ttacaatgatgtttaaaaactgttatttagtactttggtttgtattatattagtatgtattaatattagtaattagtatgtagtaatattagtattaatcatatgtatatcttctttgagacctttgagaaatagcatatgctgaagtctttctaacaatatttgttttgctaagcaagattacttttgtcagtcctttaacattttgggggtttgaacctaccacgtgacaggaaagcatactttgctccttgctgaattacgtgtgttcttgattataaatttccttcattatataatacctagcttcattggtgaggaagaacatagatggagtatatggttagcatgcagagattttgagttggtattactttttagtttagattttacattggctttccttcatttatagttttaatacaagtttagaacctcctttacttaatgaactttcatggatataaacagaagacttttaccctgctgctattaacttgtaacaatagtgaaagcttgtaagattaataagaacacgacccttttggaacctaacctgtttgcaaagtgcagacttgcatattttaatggtagttaatagttggagcgtttatgatagggatgatgaacagagaaaaagtgcagtgggacacgctggcaagactcttactgtgtgctcaatggcaactttccatttctttatttcttgtagttcctcactcagcagattaggaattttctgatgctttgtgtattctttctaaatttttaattttttatcattaaaaatcaaccttgtttttaatagagaagagaatgttgaaaagaagtggtacattcctgtgcagccagaatttaaactggaaactggataacagatggatagaaagtacaattagaaggcccaatagagattgcttcacttcctccttcatttcttttctatcttcctttttttcttctctttccctccttccatggcatcaagaagatagtcagaaagttatgtttgtatattggctccatcaaggatgt

SEQ ID NO: 7728 - DNA, 1033 bp, Homo sapiens
tgtagtcccacctactcgggaggctgaggcaggagaattgcttgaacctgagagaaggcggttgcggtgatcctatgatcgcgccactgcactccagcctggcaacagagcaagactccatctcaaaaataaataaataaataaaaattgaattataaaattcctaaaagaaaataccaaagaatacctacatagagtatttttaaagcatgccttaaggctgcaacataaatatattagcatatttggctatatatgaaattttaaaacttgtgaatataaaaagaaattgcagggcggggcgcagtggctcatgcctgcaatcccagcactttgggaggcagaggcaggtggatcacttgaggtcaggagttagagaccagcctggccaacacagtgaaaccccgtctctactaaaaatacaaaaattagccaggcgtggtggcacatgcctttaattccagctacttgggagactgaggcacgagaattgcttgaactcaggaggtggaggttgcagtagctgagattacgccgttgcactccaacctgggcaacagggagactctgactcaaaaaaataaataattaaataaaaaagaaattgcaagtgggggaaagaagcatccatgcaaatttagatataaaagcaaatgaagcaattgcttttaagataatttttgtagctagaatagttgaaattattaagaaattattatatataatatataatagttgagataggatttttatctattatagatgaagaaggtatataaggttaaaaagtgtcaattcaaaagtttatttgtaatgtagaacattgcaaaaattcttccatttcaagttagttttgatagactgtttgtttgtttgtttgtttgttttgagactgagtctcactctgtcgcccaggcttcagtgcagtggtgcaatctcagcccactgaagtctcttgcttcccgcgttcaagtgattcccctcccttagcctcccgagtagttggcactacagccatgtgccaccatgccca

SEQ ID NO: 7729 - DNA, 1031 bp, Homo sapiens
atatggtatctgcaataaatgtgtttgtacatattgtcatattctgttaatatcaccgtaatttccaagtgaactttaaaaaactataagggatcaattatttttcaaatctgaaaattttatctaaagtttaaaaactatttcattctacagctatttatcagctaaagaagagaacttcatttattagcagtacctataatacaaggaaatcctatttagttcctgaagaaaaatacttatagtttctcagcaggtagaagttgaatttagtaaaaacatttgaggattcagtctatgatatgattagcctaattttataatgtcaacacatgagtggcatttgtaaaatttacaaataatgatacttagttctgatgagtctataatgtggttatgttaaacataatttctcttacatataaatatgaattatatggtaggcgatgaaaatgcttaccatttcttctccagaaagttaatatcctgtgatatagaatgaaagtaaggaaaggactgttgttggtagtcacaaaaaggaactttttcttcctttgtagttatagccagagtcctgggctttctcatttgccatttccattttttttttaactgagtgatataacagcaatgtagcaaaaataagtttgcatccacagtgctttctgtcagaaatggtgcctctatctataggcattcaaactggctgtgatgaataatagttttttttttttttttacaatagtacttttaaattgtcaataacatccactgaaggaagctttaaatgcgttggtcctgtaaccattgtgctcacagctttcattgctgccattctagggtgccagtccctggagttgtgttggctttataaaactatagtttaggccaggtgtggtgtgtcattcttatgatcccagtgctttgcgaggccagtgtgggaggatcacctgagccaaggagttcgaagtacagtgagctatgattgtaccactgcactcaagcctgggtagcaaaatgagactgcctca

SEQ ID NO: 7730 - DNA, 1945 bp, Homo sapiens
aggctaaaatttttcttcccatgattaatttcatcaaactttgttcatatcagaaggaatctttttatttggagtttccgcttgactttgaaagaaaaagtgccagcctgggcaacatggtgaaacactgtctctacaaaaaatacaaaaaattatccaggcatggtggcatgggcctgtagtcccagctgcttccggggctgaggcgggaggatcccttgagcccaggaggtcgagggtgcagagagccgagatcacgctttactccagcctgggtgacaaagtctcgaaagagagagagagaaagaagaaagaaaaagttataatttactctatatgttgtttaaaggaaaagtttctctgtaaggaaaaggaatttctgctaggttgcattccccccgctctgcccctcttagtttagaatgaattctgttttgtgctgacaaatagctgtttctgaagttggcaagaaaatttcctcttgggactccactagaagtgttgtagtagctatctgattcaactgcttagaaagctctctgaaagttgccttgtttgtctggaaagagtgaggagcccaaacctgctttttccctggaggggggttgtagctataagctgttatgggaagaactaggagggattgtgtcataacagtatgaaattgagcaataccaaggcataattaaaatttcatactccaaagcaaattttcagacacaataaagaagggctcttaaagataggcttgggtagtattttatactcttatccaccttcttaggagatagaaaggaaagaggaggaagattttccttttcttcattttctttttatttaaaacagtccacaagtaagctgactgccttatgcgagtcattatgcaagaaaggaagggggatcaagagttactggtgcagattccatcttactataaaataaaattgtgggtctttatgtaatatcttattgaatactaattgttttatattaaaatattacatgtaaatattaagataccccatgaaattattttgaatcagatcaagtggcaaggagaaaagagtcagtagttaagaataactgggggagggggtgatgaaaaagaaaagttataatagtaaaatgagatgaggaaggtaatagaaaagttggaagcagagaagttaagtaaaataactatttctgttttctccatctgccatcttcattctttgccaacttttaggccaccttgaagagattaccttgattatcttgcccacacactaaattgtgtgaccacagggcaagatacaacaattcgtcatctcagttttcttatttctaaggttagtaaactagtacttagcacatagagttgttgcatggattaaatgagctatctatagattgctcattagcgtgcttcgtgcatggtaggtgctcagtaaatgttaactgttatttttgtcatcactattgttattaatgcctcctttatttattcatgcattcaacagatgtttattgaatgcttatattggaagttggtgattaaacaaaacaaagttcctgcccttcttgagttcctgccctcaagaagctttcattcactcttgtgaacaagacagttaataagcaagcaaataaataattaggctgggtgcggtggctcacgcctgtaatcccagcactttgggaagccgaggtgggtggatcacgaggtcaacagattgagaccagcctgaacaacatggtgaaaccccgtctctattaaaaatacaaaaataagctgggcatggtggcgcgtatctgtagtcccagctacttgtcaggctgaggcagaagaatcatttgaacctaggaggcggaggttgcggggagccaagattgcaccactgcactccagcctggcaatagagtgagactttgtctcaaaaaaaaaaaataaaataaataaata
